United States Patent 9,029,636 (ISOLATED NOVEL NUCLEIC ACID AND PROTEIN MOLECULES FROM SOY AND METHODS OF USING THOSE MOLECULES TO GENERATE TRANSGENIC PLANTS WITH ENHANCED AGRONOMIC TRAITS) - sequence listing, part 46

SEQ ID NO: 210926 - protein, 626 aa, Glycine max
  Coding DNA Sequence Number=SeqID_94148
  Gene Ontology: Mol. function=protein kinase activity; Cellular component=mitochondrion; Biological process=protein amino acid phosphorylation
  Homolog annotation: Hit_ID=Q1T0C2; Match level="QueryCoverage=97%, HitCoverage=86%, E-value=0.0, Identity=70%"; Hit description=Protein kinase
  Pfam annotation: Domain name=LRR_1; Domain location=100-122; Score =2.9; E_value=81; Accession=PF00560.23; Description=Leucine Rich Repeat
  Pfam annotation: Domain name=LRR_1; Domain location=124-146; Score =13.1; E_value=1; Accession=PF00560.23; Description=Leucine Rich Repeat
  Pfam annotation: Domain name=LRR_1; Domain location=148-170; Score =11.3; E_value=2.2; Accession=PF00560.23; Description=Leucine Rich Repeat
  Pfam annotation: Domain name=LRR_1; Domain location=172-194; Score =8.9; E_value=6.1; Accession=PF00560.23; Description=Leucine Rich Repeat
  Pfam annotation: Domain name=LRR_1; Domain location=196-217; Score =13.2; E_value=0.98; Accession=PF00560.23; Description=Leucine Rich Repeat
  Pfam annotation: Domain name=LRR_1; Domain location=219-238; Score =6.3; E_value=19; Accession=PF00560.23; Description=Leucine Rich Repeat
  Pfam annotation: Domain name=LRR_1; Domain location=240-262; Score =11.7; E_value=1.8; Accession=PF00560.23; Description=Leucine Rich Repeat
  Pfam annotation: Domain name=LRR_1; Domain location=264-286; Score =14.1; E_value=0.52; Accession=PF00560.23; Description=Leucine Rich Repeat
  Pfam annotation: Domain name=LRR_1; Domain location=288-310; Score =9.7; E_value=4.3; Accession=PF00560.23; Description=Leucine Rich Repeat
  Pfam annotation: Domain name=LRR_1; Domain location=312-331; Score =11.7; E_value=1.9; Accession=PF00560.23; Description=Leucine Rich Repeat
  Pfam annotation: Domain name=Pkinase; Domain location=416-626; Score=- 47.8; E_value=1e-05; Accession=PF00069.15; Description=Protein kinase domain
  Pfam annotation: Domain name=Pkinase_Tyr; Domain location=416-609; Score=-111.4; E_value=1.2e-05; Accession=PF07714.7; Description =Protein tyrosine kinase
  Pfam module annotation: Pfam domain module=LRR_1::LRR_1::LRR_1::LRR _1::LRR_1::LRR_1::LRR_1::LRR_1::LRR_1::LRR_1::Pkinase::Pkinase_Tyr; Domain location=100-122::124-146::148-170::172-194::196-217::219 -238::240-262::...
  Pfam module annotation: Domain location=264-286::288-310::312 -331::416-626::416-609
MSCSAQLQSSQTQVLLQLKKHLEYPKQLEIWRDRWTDLCSISSSGQVNVTCKDNFVTELTILGDKPTKGRDFDGFANPNQTLSESFSMESFVATLARLTSLRVLSLVSLGMWGPLPDRIHRLYALEHLDLSSNYLYGSIPPKICTMVNLQTLRLGDNFFNGTISSLFSSSNNLTVLSLKSNRLKGPFPLSIPSVITLTEIDMSCNQISGRLQDLTDLSSLEQLDLRENRLDSKLPAMPKGLISLFLSRNSFSGEIPEHYGQLDRLQKLDVSFNSLTGTAPAELFSLPNISYLNLASNMLNGPLHNHLRCSSQLRFVDISYNRLVGDLPSSLSTKSENRVVKSDGNCLSGRVYFPWGVSEQHLLHKTVQDSSYAAGISSELLTNARYVSEAAKLGREDLPTCRSYSLEELKEATNNFDNSTFMGENIYGKLYRGKLESGIQVVIRSLPLSKKYSIRNFKLRLDLLAKLRHPHLVSLLGHCMDGAVGENNEANVFLIYEYVSNGTFQTYLSGDSPGKVFNWSERLSVLINIAKAVHFLHTGMIPGFFKNRLKTNNILLNENWMAKLSDYGLSVISEETDASGVKGESPDSWQMKMLEDDVYSFGFILLEALVGPSLSAKSEVNVLNVM

SEQ ID NO: 210927 - protein, 168 aa, Glycine max
  Coding DNA Sequence Number=SeqID_94149
MVFMMIKLDGEATNESFELEGPWAYALHDGESRELTYTPFLQRMIVKEWRPMFRMLIHPLNGQWNRDPWFKDDDCDSDVRFCLSPMAEEPHISPFYFDLHLVLTQDLVLDYMRILSNLFSSPSCSSSLAWSMDDITMMVEEIFAQSIVKEYISPSPNNKIPLSAYFHP

SEQ ID NO: 210928 - protein, 381 aa, Glycine max
  Coding DNA Sequence Number=SeqID_94150
  Gene Ontology: Mol. function=catalytic activity; Cellular component =peroxisome; Biological process=metabolic process
  Homolog annotation: Hit_ID=Q84P23; Match level="QueryCoverage=65%, HitCoverage=44%, E-value=1e-70, Identity=57%"; Hit description=4 -coumarate-CoA ligase-like protein
  Pfam annotation: Domain name=AMP-binding; Domain location=97-381; Score=-28.1; E_value=2.1e-06; Accession=PF00501.18; Description=AMP -binding enzyme
  Subcellular localization annotation: CTP_CleavageSite=79; ConfidenceScore=5.01e-01
MVENRENNNSHSRRSLTLHFISVMATQTQTQSHPNTTIDPNSGFCSHSRTFHTLRPNVPLPPPSHPLSLTDYAFSLLPAAATTTSALIDAATDRHLSYSLLLRQVQSLASSLQSLTPLSKGHVALILTPSSLHVPVLYFSLLSLGVTIAPANPLSSLSELTHIVKLAKPAIAFSTSNAAKNIPSLKFGTILLDSPFFLSMLDDDETVNRDSRAHRVEEVSQSDSAAILFSSGTTGRVKGVLLTHRNFITLIGGFYHLRNVADGDPHPVSLFTLPLFHVFGFFMLVRAIAVGETLVFMQRFDFEGMLKAVERYGITYMPVSPPLVVALAKSELVKKYDLSSLRYLGCGGAPLGKEVADDFRGKFPNVEIGQNLRSRYQISHL

SEQ ID NO: 210929 - protein, 390 aa, Glycine max
  Coding DNA Sequence Number=SeqID_94151
  Gene Ontology: Mol. function=protein kinase activity; Cellular component=integral to membrane; Biological process=protein amino acid phosphorylation
  Homolog annotation: Hit_ID=Q1SI44; Match level="QueryCoverage=99%, HitCoverage=54%, E-value=1e-128, Identity=61%"; Hit description =Leucine Rich Repeat, putative
  Pfam annotation: Domain name=LRR_1; Domain location=110-132; Score =4.6; E_value=39; Accession=PF00560.23; Description=Leucine Rich Repeat
  Pfam annotation: Domain name=LRR_1; Domain location=134-155; Score =3.2; E_value=73; Accession=PF00560.23; Description=Leucine Rich Repeat
  Pfam annotation: Domain name=LRR_1; Domain location=36-58; Score =16.8; E_value=0.079; Accession=PF00560.23; Description=Leucine Rich Repeat
  Pfam annotation: Domain name=LRR_1; Domain location=60-83; Score =15.5; E_value=0.19; Accession=PF00560.23; Description=Leucine Rich Repeat
  Pfam annotation: Domain name=LRR_1; Domain location=85-107; Score =17.4; E_value=0.053; Accession=PF00560.23; Description=Leucine Rich Repeat
  Pfam annotation: Domain name=S1FA; Domain location=192-262; Score =6.1; E_value=0.1; Accession=PF04689.4; Description=DNA binding protein S1FA
  Pfam module annotation: Pfam domain module=LRR_1::LRR_1::LRR_1::LRR _1::LRR_1::S1FA; Domain location=110-132::134-155::36-58::60-83::85 -107::192-262
GVLPAQLSNATALHSLFRHGYYLSGAIPSSLCTLPRLQNLDLSENAFSGHIPEHLRNCKNLQRLVLAGNKFSGEIPAGVWPDLQNLLQLDLSDNELTGSIPSEIGTLISLSGTLNLSFNHLSGKIPSSLGKLPATVIFDLKNNNLSGEIPQTGSFSNQGPTAFLGNPDLCGFPLRKSCSGSDRNFSSGSDQNKPDNGNRSKGLSPGLIILISAADAAVVALIGLVIVYIYWKRKDDENACSCIRKRRFGEEKGNMCVCGGLSCFGGVKSDDDDDEEFEGGEGEGEGELVRIDKGLSFELDELLRASAYVLGKSGLGIVYKVVLGNGVPVAVRRLGEGGEQRYKEFAAEVMAIGKVKHPNVVRLRAYYWAHDEKLLISDFISNGNLAHALR

SEQ ID NO: 210930 - protein, 64 aa, Glycine max
  Coding DNA Sequence Number=SeqID_94152
MWTTTGLFAPGGLVTKDHSRVTLRVRVKVDGDADATAREGGGEGGGGGGEAASSPMESFVWTKD

SEQ ID NO: 210931 - protein, 325 aa, Glycine max
  Coding DNA Sequence Number=SeqID_94153
  Gene Ontology: Mol. function=Photinus-luciferin 4-monooxygenase (ATP -hydrolyzing) activity; Cellular component=peroxisome; Biological process=metabolic process
  Homolog annotation: Hit_ID=Q84P23; Match level="QueryCoverage=49%, HitCoverage=28%, E-value=2e-69, Identity=75%"; Hit description=4 -coumarate-CoA ligase-like protein
  Pfam annotation: Domain name=AMP-binding; Domain location=2-166; Score=-128.3; E_value=0.036; Accession=PF00501.18; Description=AMP -binding enzyme
MNLVVVCVLFGRRRKSLWKIMKSLKGLGEIVGGGYGLTESGGGAARVLGPDESKRHGSVGRLAENMEAKIVDPVTGEALPPGQKGELWLRGPTIMKGYVGDEKATAETLDSEGWLKTGDLCYFDSDGFLYIVDRLKELIKYKAYQVPPAELEHILHTNPEIADAAVVPYPDEEAGQIPMAFVVRKPGSNVTADQVMEFVAKQIQINVPRLETIVTCSDATNARYRVKHLAYHEACSQNIFFLTANANVSMVSIPDKVLSQAKKTPNTLKPNISFGHVSTRSSRHLTHSRLQQGTTGKRSSDTVEDHKAKRQVSDPFVTRTFWRPP

SEQ ID NO: 210932 - protein, 812 aa, Glycine max
  Coding DNA Sequence Number=SeqID_94154
  Gene Ontology: Mol. function=protein serine/threonine kinase activity; Cellular component=integral to membrane; Biological process=protein amino acid phosphorylation
  Homolog annotation: Hit_ID=Q9LY50; Match level="QueryCoverage=98%, HitCoverage=97%, E-value=0.0, Identity=48%"; Hit description =Receptor kinase-like protein
  Pfam annotation: Domain name=Pkinase; Domain location=504-788; Score =145.4; E_value=1.5e-40; Accession=PF00069.15; Description=Protein kinase domain
  Pfam annotation: Domain name=Pkinase_Tyr; Domain location=504-788; Score=108.4; E_value=2.1e-29; Accession=PF07714.7; Description =Protein tyrosine kinase
  Pfam module annotation: Pfam domain module=Pkinase::Pkinase_Tyr; Domain location=504-788::504-788
  Subcellular localization annotation: CTP_CleavageSite=68; ConfidenceScore=5.28e-01
MTPPFTLSLSLFVILTITAVHGLGSAATTAVTYGTATVCGIVAGEPQHRIQCSRSGRRVVPLTLPNVSFDAISGGRSFFCGLRSGGRSLHCWDTAAPNAYFRSKRLFHSDVVQLADVAVGDSQVCAREVQSGVVRCWRGSGGVQFSSPSEGLRFRSNSITCGCGFSCGVIKESGRVVCWGDGDEGANTKSISDEIQRKFENFTMSSLVAGVSHVCGLTLHGALVCRGNNASGQLGNNDGVLSSSLEFSGLALGEDFTCGIRTRNGVVVCWGGGFESDVVKGVSFESLVAGLDYVCGLTTRNLSVVCWGKGRFFHVPSELPLGVILPGPCVEGACSGSCGTYPDSGALCHGSGSICYSCQTEVPLAVPLLPPSTTQVVPKQEHSSRGGRSLREFLIFFIVGSVGVFVGLCTILYFIWICARRFLLSRKEVGGNNSVKPTSSESDAYVDIIPMPNVGSNGTTFRTFSSKSQASRRFGRHRSGSSSKHVDRTESFSLSELAMATDNYSLFNKIGAGSFGCVYKGMLRDGREVAIKRGDTSAMKKKFQEKEIAFDSELAMLSRLHHKHLVRLIGFCEENDERLLVYEYMSNGSLYDHLHDKNNVDRSSNILNSWKMRIKIALDAARGIEYIHNYAVPPIIHRDIKSSNILLDSNWNARVSDFGLSKIWPETEQELMSSKAVGTVGYIDPEYYVLNVLTTKSDVYGLGVVMLELLTGKRAVFKPEDGSGPMGVVEYTGPKIASGELWSVLDYRVGQPEVNEVESLEIMAYTAMHCVNLEGKERPEMTGIVANLERALAFIEGTPTSLSIASFSAPLE

SEQ ID NO: 210933 - protein, 167 aa, Glycine max
  Coding DNA Sequence Number=SeqID_94155
  Homolog annotation: Hit_ID=Q1SLQ8; Match level="QueryCoverage=20%, HitCoverage=6%, E-value=9e-09, Identity=80%"; Hit description =Dihydrolipoamide succinyltransferase
MPSLSPTVTEGDIARWLKKEDDKISPNDVLWEVETLLVLKKFWHPPRPRLQQMQHWIISTFQSLRCGRSMYLADTYSGDSYEKYFHDSQTKKLIKPSFIISRSSIHLDVDFSYQLKVNSGVSMVANNPFDSSFMSTRNHDAYQSNSGSNSKSATSSTPKKYHKYLKP

SEQ ID NO: 210934 - protein, 105 aa, Glycine max
  Coding DNA Sequence Number=SeqID_94156
MPSSCYLPSLTAKEVAEVLSEKFSNFMDFHHKKLLRDTGFSQSVMYGLNNQGNQEPNSSSVLPTILNPRTLTGFPSENWRAQTETKEGMTEALIKWQDLQNFERM

SEQ ID NO: 210935 - protein, 103 aa, Glycine max
  Coding DNA Sequence Number=SeqID_94157
  Gene Ontology: Mol. function=aminopeptidase I activity; Cellular component=vacuole; Biological process=proteolysis
  Homolog annotation: Hit_ID=Q2QVB4; Match level="QueryCoverage=84%, HitCoverage=18%, E-value=8e-29, Identity=73%"; Hit description =Aspartyl aminopeptidase, putative, expressed
MLECYDPSESQIVVIVCYIRALIDATSSDSSLEEESGVRMVALFDHEEVGSNSAQGAGSPVMLNAVTRVTNSFSSNPNLLEKAVQLSYLVSADMAHALDPNYM

SEQ ID NO: 210936 - protein, 85 aa, Glycine max
  Coding DNA Sequence Number=SeqID_94158
MANDVNKCKGYLFHHLNCTYGLGRNQKINNQLLGGIQFQQNGWCRQRYLQLPKNFFTIFILDKNFGLLEEVHNGSSLLGNSWLKP

SEQ ID NO: 210937 - protein, 39 aa, Glycine max
  Coding DNA Sequence Number=SeqID_94159
MGCDGEGRFLVSECDCASSSSGLQVFVLDLTPSAVKTHK

SEQ ID NO: 210938 - protein, 178 aa, Glycine max
  Coding DNA Sequence Number=SeqID_94160
  Homolog annotation: Hit_ID=Q2HRE1; Match level="QueryCoverage=88%, HitCoverage=35%, E-value=6e-42, Identity=46%"; Hit description =Lipopolysaccharide-modifying protein
  Pfam annotation: Domain name=DUF821; Domain location=5-175; Score =5.6; E_value=1.3e-19; Accession=PF05686.3; Description=Arabidopsis thaliana protein of unknown function (DUF821)
MAVRELTIGLMSEINIRPWQEEFPDIKQGSRNVSWKNKFPWAYWKGNPDVASPIRTELINCNDSRKWGAEIMRQDWGEAARSGFKQSKLSNQCNHRYKIYAEGYAWSVSLKYILSCGSVALIISPQYEDFFSRGLIPNHNFWLVDSLNLCPSIKYAVEWGNQHPVEEIGMNVQFNCSK

SEQ ID NO: 210939 - protein, 165 aa, Glycine max
  Coding DNA Sequence Number=SeqID_94161
  Gene Ontology: Mol. function=aminopeptidase I activity; Cellular component=vacuole; Biological process=proteolysis
  Homolog annotation: Hit_ID=Q8LF32; Match level="QueryCoverage=71%, HitCoverage=24%, E-value=6e-55, Identity=83%"; Hit description =Aspartyl aminopeptidase-like protein
MEKHEANHQPKLHGGLVIKTNANQRYATNVVTSFIFREIASKHKLPVQDFVVRNDMGCGSTIGPILASGIGIRTVDVGAPQLSMHSIREICAVDDVKHSYEHFKAFYEEFSHVDGRPTDSLKLSPCRLTQHTRQMYRNATVDQINAKEKDVIERVNRKKPRRMAK

SEQ ID NO: 210940 - protein, 243 aa, Glycine max
  Coding DNA Sequence Number=SeqID_94162
  Subcellular localization annotation: CTP_CleavageSite=10; ConfidenceScore=5.05e-01
MTAAGQTSVRAESVGKEKRTFEICGASCNFRSANYVLLHQTATSSPTTTTTTSSPAATVAASFPPPCWRQLPPPPPPPSRQQPPCVAATLLLPSFFLSLLRVGLDRLVVWDDVADAGFAERDKFHQDMLPNFISKSDLYREDDVLEHHDREGVVSEDKVEDDTLEHCNREGVVGEDELEDDALKQYIKEGSVNGEEEVEDNVLRSNTHKLMKPLLAVCCLVKNRENKGDRRRRKKNDIFCDSF

SEQ ID NO: 210941 - protein, 1189 aa, Glycine max
  Coding DNA Sequence Number=SeqID_94163
  Gene Ontology: Mol. function=RNA-directed DNA polymerase activity; Cellular component=chromatin; Biological process=chromatin assembly or disassembly
  Pfam annotation: Domain name=rve; Domain location=835-991; Score =85.4; E_value=1.8e-22; Accession=PF00665.16; Description=Integrase core domain
  Pfam annotation: Domain name=zf-H2C2; Domain location=776-817; Score =22.2; E_value=0.0004; Accession=PF09337.1; Description=His(2)-Cys(2) zinc finger
  Pfam module annotation: Pfam domain module=RVT_1::rve::zf-H2C2; Domain location=316-490::835-991::776-817
MALAKLQEDKLRDHRQTSSRPHPSPSPLYNPPNTSQKQKPTYVQRTPDEIALRREKGLCYNCDEKWSSSHRCKGRVLLFIADNSDEPTLDTPSLDMEPPTPLTLDPDTNPPHISLHALSGLHSSETFRLNGIINHTNLTILIDSGSTHNFLQPRIAQFLRLKPQSTSPLHVLVGNGSVLDCNQVCPETSLSLQVLGIEWLRQFGLITTNYTSFSMKFTYMGRPIELHADISNGPRSISAPQVKRLIHTGSASALFHLSIIPTQPDPQTLLPHPIPAIEALLTQFQKLFQNPSTLPPPRQIVHHINLLPNTAPINVRPYRYPQFQKSEIEKQVTELLSLGLIQPSTSPCSSPVLLVKKKDGTWRMCVDYRALNTATLDLRQGFHQILMHTPDIEKTTFRTHQGHYEYRAMSFGLCNAPSTFQAAMNNLLTPFLRRFTAVFFDDILVYSKSLSSYIQHLESIFQTLLQGQFYLKRSKCLFAQNQVEYLGHVVFGRGVEPEPSKIRAMVQWPTPASSKDLRAFLGLTGFYRKFIKNYATIPAPLTSLLGKDAFEWSSTAQSAFEQLKKAMTSAPVLTLPDFNEPFVIETDASGTGMGVVLMQKGHPLAFFSKKFGPHMLHSSTYVRELHTIVSAVRKWHQYLLGHSFTILTNHKSLRELMSQVVQTPEQHYYLSKLLGFDYMIQYKTGSSNAVADALSRTNSGSSGALLLLSVPHPDFMDDLRRTLNSSTEFQTLISKVRSQLEDHSEYRIHNKLLFFRNRIWINHDNPYIPTLMLEFHATPLGGHFGVTKTTHKIESSFYWSSLRKDVKRFIRECTTCQQTKMITQRPAGLLQPLPIPSGVWEDISMDFITHLPQSHGYTVILVVVNRYSKVVHLGALATNHSAFKVATLFMDIVCKHHGFPKSIVFDRDPLFLISFWRELFRLSGTRLRMRTAYHPQSDDQTEVMNRILEQYLRAFVHEQSANWYRYFTLAEWSYNTSLHSSAGLTPFEIVYGKPPPTLAHYLQGTSPNEAVDSMITSRQEIHHKLQRRLTKAQDNMKKLANTKRWDISYTVGQWVYVKLRPFRQRSVTGSLHPKLSKRYFGPFQVMERIGQVSYPLQLPEGACIHPVFHSSILREHHGPPPPSPDTSPLQFIAQKPWEGQPPKDTTWEEWARVCDLYLLEDKVVFAGGGIDSSSSRMGEGTINIAPRTA

SEQ ID NO: 210942 - protein, 162 aa, Glycine max
  Coding DNA Sequence Number=SeqID_94164
  Gene Ontology: Mol. function=metal ion binding
MLCSCSWLLWVCKFTIGTLLLTFDKNQLNVSAVYEGVVPVLVLLALKIFKMFQTNGEEREEFQQVQLILEQAPLLPSKDDVLPSWGSSDESLSNEEEDLTMWLALQGILLWKESHQGKGRLAMTSSICMPFALMLKGIASFSHVVIGWHAFHLELVTHYFYI

SEQ ID NO: 210943 - protein, 230 aa, Glycine max
  Coding DNA Sequence Number=SeqID_94165
  Gene Ontology: Mol. function=peptidase activity; Cellular component =intracellular; Biological process=proteolysis
  Homolog annotation: Hit_ID=Q8W065; Match level="QueryCoverage=73%, HitCoverage=100%, E-value=5e-69, Identity=81%"; Hit description =Nuclear movement protein-like
  Pfam annotation: Domain name=CS; Domain location=91-165; Score=97.2; E_value=4.9e-26; Accession=PF04969.6; Description=CS domain
MWHDKEEEEKKRMNERSEDKLRKIITKETARTKGKEEELRRNQKRRRRRESVQKTLETKHGGKISPRKASQLRSQRESESNKPVCVILGQKVFEWDQTLDEVNIYITLPPNVHSKQFYCKIQSKHLELGIKGNPPYLNHDLTSPVKTDSSFWTLEDDIMHITLQKRDKGQTWASPILGQGQLDPYATDLEQKRLMLQRFQEENPGFDFSQAQFSGNCPDPRTFMGGIRSD

SEQ ID NO: 210944 - protein, 555 aa, Glycine max
  Coding DNA Sequence Number=SeqID_94166
  Homolog annotation: Hit_ID=Q9FUA7; Match level="QueryCoverage=28%, HitCoverage=85%, E-value=2e-54, Identity=65%"; Hit description=PRLI -interacting factor N
  Pfam annotation: Domain name=DUF1771; Domain location=390-455; Score =48.3; E_value=2.5e-11; Accession=PF08590.1; Description=Domain of unknown function (DUF1771)
  Pfam annotation: Domain name=Smr; Domain location=463-537; Score =68.3; E_value=2.4e-17; Accession=PF01713.11; Description=Smr domain
  Pfam module annotation: Pfam domain module=DUF1771::Smr; Domain location=390-455::463-537
MKNPRKKKRPKPAQKKVLEENNKGVVVAGNENEEEEKRKRSVLEALVEAFSLSSIREASMAYEIAGGDPDRASEILRKGSSDRFEDSFSCFSYGSSSSGGSSGGGGSSSCSGLELGSKGGRQQKKKVVASTGTVSTVLGKEYVRRNNIRNKGFSSNGVFEMEEAEQFLCSMLGDDSDINLAVVRDVLCQCGYDIETASDVLLDLAASTNDKPNTDRHPNYRVDNIDDERFFADPNDSLIDRRSECTSLSSEGYLSDNPWPFGRKYVEVLNSSKADSAISPGCTKSEIPQKVLESLFNIPKSTEHDKDTMNWRNVVKKIQSLGPGFNVSPHVAESQQHTLALNSLKQYLLVAWGLAVLGNLSQSEEDTSCNFGKITSATLVEFAKKAKGDEYHVFREDSKQQWDSVKSYYTKAATAYTKRERAYAAYLSDQGKEQTRLAQKADTKASHDIFIARNKGIENMITIDLHGQHVKQAMRMLKLHLLFGSYVPSVQTLRVITGCGSHGVGKSKLKQSVINLLDREAIEWREENQGTVLIKLSGWREYSFLDTSSDSDSND

SEQ ID NO: 210945 - protein, 580 aa, Glycine max
  Coding DNA Sequence Number=SeqID_94167
  Gene Ontology: Mol. function=RNA-directed DNA polymerase activity; Biological process=RNA-dependent DNA replication
  Homolog annotation: Hit_ID=Q1SKJ3; Match level="QueryCoverage=40%, HitCoverage=32%, E-value=7e-23, Identity=28%"; Hit description=Zinc finger, CCHC-type; Endonuclease/exonuclease/phosphatase
  Pfam annotation: Domain name=zf-CCHC; Domain location=204-221; Score =22.7; E_value=0.00018; Accession=PF00098.13; Description=Zinc knuckle
VSEESSKEEDDLLLMSARKVKRKTDEGDEMECDNGNIREENKTPYKEKCYGSQDKEIPPPPISKDDMERFLEVPISDEEFFDRCKPWKGSLMVIVLEKRIGFHHLEAKLNRDWQGRDEDYNHAFMKGPWMIVDHYIVVQIWRPLFLANTLMGRKLMLKIDKVTTIQSRGKFARICVELDLDKPLQPKAIVREYLLNMQYEGLHVVCFKCGRYGHRERDCVHGAETGSSDMMFGSPKGDEKESWARREAKVIETCGKQHADLSDKQSSKYAGVSIALMNDLIDNYKVSLCFLLENHANVQKPKSIIKRMKFNAHHVIASNGQSRRLWYMWNSDVWQIKILEENAQFMYLEVKKDQQARALDFNTILHESDRNGGVEYPSHRVVRAFRKVMEYCHLLDARFEGPNFTWSRGDLSMRLDRLIMNQAWRLQFPRAIVTHLYQYKSDHKHLLLNLDVGGIDKKLNESPNIFLSLLQKRFVEKARGCYVPRKTFMVPKIQVQMVEVRGWELGGRFNFNGGDDNEIDILSKEISDEEMRRFVFLMGSYKAPGEDGFQALFYQSQWEETFCGTAKNCASRLSTTTSPG

SEQ ID NO: 210946 - protein, 394 aa, Glycine max
  Coding DNA Sequence Number=SeqID_94168
  Gene Ontology: Mol. function=catalytic activity; Biological process =cellular metabolic process
  Homolog annotation: Hit_ID=Q9LUY6; Match level="QueryCoverage=94%, HitCoverage=96%, E-value=1e-115, Identity=57%"; Hit description =Induced upon wounding stress-like protein
  Pfam annotation: Domain name=Epimerase; Domain location=29-274; Score= -58.5; E_value=0.025; Accession=PF01370.11; Description=NAD dependent epimerasedehydratase family
  Pfam annotation: Domain name=NAD_binding_4; Domain location=31-261; Score=-105.7; E_value=0.088; Accession=PF07993.2; Description=Male sterility protein
  Pfam module annotation: Pfam domain module=Epimerase::NAD_binding_4; Domain location=29-274::31-261
MVSIWKGGSASRAPHVAMAATIETSSYVAIIFGVTGLVGRELARRLLLEPSWKKVYGIARNPETPPTLIISPCYHFISCNLLNPLKTQKKLSGLQDVTHVFWVTWASQFPSETQESCDQNKAMMCNALNSMVSVAKNLKHVSLQTGTKHYVSLHPPFDEEKFHYYYYHEEFPRMSRSLNFYYALEDLLMEKLSGKVSWSVHRPGLLFGSSVRSFYNFMGSLCVYGAICKHLRLPFVFGGTRKCWEESYIDGSDARLVADQHIWAATNGDIISINGQAFNSINGPSFTWKEIWPIVGKKMGVQVPQDMVVESFWFSKAMTGKEEVWEEIVEENGLVHTTVENLANWEFLDALFRFPLKLLGCRNKVDGLGFGARYKTLNSILYWIDCMRDEKLIP

SEQ ID NO: 210947 - protein, 212 aa, Glycine max
  Coding DNA Sequence Number=SeqID_94169
MDIQNLTNHYLHRITQLKSLKSCVNGSGAEAVALRGLEELDGEIVEADLREAGAADGVDEPASRSAAIAAVFVVAGGEGRAGGTAEAPGAAVVEGGGVGGVVGGGSSDEGSLGGGFECRGGHRRKGEIEMPNSRRNGRAFEELTTSLNELESLSARKLHWKIIAIGKHAKRANSQLSARKLHWKTTSIGKHTNSGLSANPLDPLAIQLDMRA

SEQ ID NO: 210948 - protein, 560 aa, Glycine max
  Coding DNA Sequence Number=SeqID_94170
  Homolog annotation: Hit_ID=Q9FK37; Match level="QueryCoverage=57%, HitCoverage=53%, E-value=2e-44, Identity=37%"; Hit description =Arabidopsis thaliana genomic DNA, chromosome 5, P1 clone:MXI22
  Subcellular localization annotation: CTP_CleavageSite=68; ConfidenceScore=5.56e-01
MATAAFKSTTKRTLVGASSADDSAYSSSLHHRRSRSLSRPARPSFPSRNDEDGGDRRTPRGRFVNTVRGSGFPEISLDDLAIEFFESAKRDRFSSRTSKSEASPAGAGSAASQRRGRSVSRKSSGVGDDRRSSVGGGRPFSDANSRRRRSVSVVRYQISDSESDLDRSQNSRSRSNLKNTDVGNKLMHKPVASDQRPVLRKSLSLKGLRAYDGYSSHSSVLTDDEGTSAHSNKNGIEKLRSVYAQKKVALTDTDKGSHKAKQKELTHMETEQAVVKPRTSTLSTVDCLLLNNSDVIQTVSSIRRSYETELEKSEKRKQDLLAEMVFEEQRGRELSKIVNELIPAKEDNLIQNPSRARKRSKDRSRMSMRLTEEAEKYIEDFISNVEDTDISSLDGERSDASSSIGGLIKPETFNSLPVPRSLPVLTDGVTLPWLQWETNNDASPMTNLNKTHMTITPKTENIKVQDQGDNSISSRGSWSPDYLQEYVGKDVYSKLGEGCGYPDHSLSAKSKGLRGPEVHSLHFSSRINHSVPGRKRDSRATDNDGGGGRQTATVRNERGH

SEQ ID NO: 210949 - protein, 65 aa, Glycine max
  Coding DNA Sequence Number=SeqID_94171
MATSPQTNTGSRGAPRVCLGFLGRGRDARSERAFRFLVAWSTHNDVVKKAWDPNVHDLVAKYRRT

SEQ ID NO: 210950 - protein, 783 aa, Glycine max
  Coding DNA Sequence Number=SeqID_94172
  Gene Ontology: Mol. function=kinase activity
  Homolog annotation: Hit_ID=Q9LYA2; Match level="QueryCoverage=88%, HitCoverage=93%, E-value=1e-106, Identity=38%"; Hit description =Kinase-like protein
  Pfam annotation: Domain name=Bromodomain; Domain location=207-296; Score=117.5; E_value=3.8e-32; Accession=PF00439.15; Description =Bromodomain
MAPTVPIEFAGQKESRKYSHSQNMGKSRKYSKGYATGFVPDFRHAVETMGESEGLGSLGRVDTELTALADSCAPKGKRPGLNAGDGGYGSFDVPFQHFSLSAMSGFERKDLKVRLTWELEQVREFRKKIDGMNSNVVGLSLSSDIMSCSAGQKRPKLESQHRTMEVSVPHGKKRPLPGHTGPKLKKSMSGHLEYAKPAAPVTSYATLMKLCENVLNRLMSHQFGWVFNTPVDVVKLNIPDYFTVIKHPMDLGTVKKRITSGEYSNPMDFAADVRLTFENAMFYNPAGNDVHIMAETLSKFFETRWKAIEKKIPAIDSVASEPSRPTHVETEISDRVPPTKKKKITPNDTNVKPEPVKRIMTVEEKQKLSLELETMIGELPDSISDFLREQSYNEGQINDDEIEIDIDALSDDTLFKLRKLLDDYMLEKQKSLAKAGQCEMELLNESGFSNSSMQPHKDAGEEQVEEDVDIIGGNDPPISNYPPLEIEKDVTNRNSKCSSLSSSSSESGSSSSDSDSGSSSGSELDMAKTSEPLSATKENVGFDLTSDQNKGDPGNSETGKDSTNVGGQVEQSSQSGHVATEPESHQDGESAASKRQVSPEKLYRAALLRSRFADTILKAQEKALEKDEKRDPEKLRIEREDLERRQKEEKARLQAEAKAAEEAQRKAEAEAAAEAKRKRELEREAARQALQKMEKTVDINENSHFLEDLEMLSAVHDEHLPSFKEETSADQPQDGLGGIKLQGNPLEQLGLYMKEEEEEEEEEEPPPSGAAGPSNDVEEGEID

SEQ ID NO: 210951 - protein, 168 aa, Glycine max
  Coding DNA Sequence Number=SeqID_94173
  Gene Ontology: Mol. function=hydrolase activity; Biological process =metabolic process
  Homolog annotation: Hit_ID=Q0ZPV7; Match level="QueryCoverage=77%, HitCoverage=38%, E-value=6e-32, Identity=53%"; Hit description=CXE carboxylesterase
  Subcellular localization annotation: CTP_CleavageSite=68; ConfidenceScore=5.33e-01
MMPFFSFTHYKSFWRSSIAFAFAFAFFLTFLLIANSLTLQTQSTTIPCNKDPYKELNLIPNPNGTVTRPNKPPQSPPAPDPNLNTLVLSKDLSINQSKSTWARVYLPRVALDHSSKLPLLVFFHGGGFIFLSAASTIFHDFCFNMANDVVAVVASIEYRLAPEHRLPA

SEQ ID NO: 210952 - protein, 349 aa, Glycine max
  Coding DNA Sequence Number=SeqID_94174
  Gene Ontology: Mol. function=glyceraldehyde-3-phosphate dehydrogenase (phosphorylating) activity; Cellular component=cytoplasm; Biological process=glucose metabolic process
  Homolog annotation: Hit_ID=P34922; Match level="QueryCoverage=98%, HitCoverage=98%, E-value=1e-154, Identity=81%"; Hit description =Glyceraldehyde-3-phosphate dehydrogenase, cytosolic
  Pfam annotation: Domain name=DapB_N; Domain location=4-133; Score= -33.9; E_value=0.03; Accession=PF01113.11; Description=Dihydrodipicoli nate reductase, N-terminus
  Pfam annotation: Domain name=Gp_dh_C; Domain location=159-327; Score =331.1; E_value=2e-96; Accession=PF02800.10; Description =Glyceraldehyde 3-phosphate dehydrogen
  Pfam annotation: Domain name=Gp_dh_N; Domain location=4-154; Score =321.5; E_value=1.5e-93; Accession=PF00044.14; Description =Glyceraldehyde 3-phosphate dehydrogen
  Pfam module annotation: Pfam domain module=DapB_N::Gp_dh_C::Gp_dh_N; Domain location=4-133::159-327::4-154
MGKVKIGINGFGRIGRLVARVALQRDDVELVAVNDPFITTDYMTYMFKYDSVHGHWKHHDVTVKDEKTLLFGDKPVTVFGHRNPEEIPWKSTGADIIVESTGVFTDKDKAAAHLKGGAKKVIISAPSKDAPMFVVGVNEHEYKPELDIISNASCTTNCLAPLAKVINDRFGIVEGLMTTVHSITGEPIACYLYFLLPIMIQVANSAKDWRGGRAASFNIIPSSTGAAKAVGKVLPALNGKLTGMAFRVPTVDVSVVDLTVRLEKEASYDEIKNAIKEESEGKLKGILGYTEDDVVSTDFVGDSRSSIFDAKAGIALNKNFVKLVSWYDNEWGYSSRVIDLLVFVAKKSF

SEQ ID NO: 210953 - protein, 332 aa, Glycine max
  Coding DNA Sequence Number=SeqID_94175
  Gene Ontology: Mol. function=ribonuclease H activity; Biological process=RNA-dependent DNA replication
  Subcellular localization annotation: CTP_CleavageSite=30; ConfidenceScore=5.29e-01
MPWRKVDKIASTLGFQSTQNINNYLDFPLVASRVKKSRFSFIVDKVNVCLARMLLNFFNPGSNFEWIKDIWRNRAWCWCDAVSNIPQWLKLEVENLFLNDDIHDVVAWGHESNGIYTTSFTYRWLARARSSVVFNKGRGSWVWPLQIPENIKHFLGLCGSSEESILHLLRDYPKAIHVWDLFQLDVHGNPPEDGVSIWIKKHATNISGSLFVATTWWVGKTRNKEFAADNGICKLKTYGSTLGNPGKAGFGGVVHDSNGAWVVGYLGSCVCESDSLCALKFIKNGVEHTLQEGNQVADYLAKDGGAQGDDPLVILDICPLSLKPKLLADALG

SEQ ID NO: 210954 - protein, 417 aa, Glycine max
  Coding DNA Sequence Number=SeqID_94176
  Gene Ontology: Mol. function=RNA binding; Cellular component=plastid chromosome
  Homolog annotation: Hit_ID=Q2VY14; Match level="QueryCoverage=65%, HitCoverage=45%, E-value=4e-88, Identity=59%"; Hit description =CONSTANS interacting protein 5
  Pfam annotation: Domain name=AT_hook; Domain location=60-72; Score =14.9; E_value=0.061; Accession=PF02178.9; Description=AT hook motif
MCGKTRQDKIRNEAIRERVGVAPIVEKMVENRLRWFGHVERRPVDSVVRRVDQMERRQTIRGRGRPKKTIREVIKKDLELNDLDRSMKLKSQSKKVEWGFDKKNSLSIVFSTLVSNSSNMLPSAPSKDFFNSRIKSSPRKLGVTWLWQINVAEQMILDDMAINPDKYEGKKLSDLVDEEDFDEQNAVEYTKVQYKNTMLPQTTLKTSVKELDLEAALAERELHLKLRTEAEDRGEKYKITKLRRNVEMDEYDYMHWRRSFEERETLIRDISCRKVLGLPLEEPGRYMDASFFGKDQYDPTSPLYRYDYWGEPKNSEKSMQERMTDIHNKKIVGKGNVWYEMSYEDCIKQQMESEAQSKEQENHEDTRQGHADEDEDDNDDDDFDFSILSSFGSNFSEQPHVNGTESSTISSGGMFED

SEQ ID NO: 210955 - protein, 443 aa, Glycine max
  Coding DNA Sequence Number=SeqID_94177
  Gene Ontology: Mol. function=RNA binding; Cellular component=plastid chromosome
  Homolog annotation: Hit_ID=Q2VY14; Match level="QueryCoverage=73%, HitCoverage=54%, E-value=1e-168, Identity=82%"; Hit description =CONSTANS interacting protein 5
  Subcellular localization annotation: CTP_CleavageSite=46; ConfidenceScore=5.21e-01
MQVLQTSYLFTFPKPLNPSPQRLHHRLQPFLHHRHRRPLTISKSFSSDEFPVDETFLENFGPKDKETEDEARRRNWIERGWAPWEEILTPEADFARKSLNEGEEVPLRSPEAIEAFKMLNPNYRKKKREEMGLTEEEFYAKQFEIKGEIPDPLVTTWAGPLVVRLVAPRDWPPRGWCVDREELAFIREAHRMQARRVRLEEVESGVRTDTDDAGLDRYKVFLKQYKEWVEANKDRLEVESYKQDQDYYPGRRKRGKDYKEGMYELPFYYPGQICVGKVTMLHLYQGAFVDIGGVHDGWVPIKNNDWYWLRHHIKVGMHVIVEITAKRDPYRFRFPIELRLVDPNIDHLIFNKFDFAPIFHRDEDTNEDEIRRDCGRPPVPRKDPGDRPEEEPLLSNHPYVEKFITWLHLTLIFNLFKEPIQDPIQTCINVKPSKTFYLFHIHS

SEQ ID NO: 210956 - protein, 1012 aa, Glycine max
  Coding DNA Sequence Number=SeqID_94178
  Gene Ontology: Mol. function=protein serine/threonine kinase activity
  Homolog annotation: Hit_ID=Q2M405; Match level="QueryCoverage=30%, HitCoverage=51%, E-value=1e-32, Identity=30%"; Hit description=CRN -like CRN8
  Pfam annotation: Domain name=Pkinase; Domain location=789-992; Score=- 107.4; E_value=0.037; Accession=PF00069.15; Description=Protein kinase domain
MGDKGDTTKKQQSQQQQPQSHHHHQQQQQTQQQISSSPKAPHEEPITEVRPIHHHHHQQLSPVVVATGAPPFIPSPLYVSSGASSSPFEPQFETLNPKRPRYSGQWKQLLPSPPAQQKQSQMAMLPTSESSPSPTTHTSSNPLQQQQPQTQTASSSDTSSSPTHSLPLLSGEGTKQEGEQIHQQLRKGKYVSPVWKPNEMLWLARAWKEQYKGGGGVGGSDFSSRAEQQAELGITRAKTRADKDKEVAEFLKRHGVNRDAKTAGTKWDNMLGEFRKVYEWERGGEREQIGKSYFRLSPYERKLHRLPASFDEDVFEELAQFMGSRMRSSHGRAVSSLGSGDEARTALAATRALPPPPRPFKDDEIPLSARTKQLALTSGGEPFFHGSRGGLLGLDTLLDVTGSSSSSSKELRRIGKIRMSWEESVSLWAEEGEVHRGRVKLQSSSFLNADELTCFDDAMVPCPMEYFEDGPLKGFSVDRFVSGQQVKVFGRRKSSPASDSSSAGFAERVQFPSKALPIRSIATLDFRDPSDYYMECFLRASPQTLPSLLELKRHLQEPPPEDLRFPLRRDVYEDLPQGKELFFTTTSEPLDCRAIMFEIVGPIIRPSLNPTSSSRDSFIPLWDDCINRVIQKFCPENLTLIRKPTSSPPPTATTAAATATESTNLLLQDQWPNITGFVNNYCLWRGEETHQLTETQPNPSTTLVAKLLWTYMDLPYILGYYAVANTVTFCAMSRSQEGIINRTDLLELNLTTPTERLKALVPCFRIGLLLPLLSKRCSSIISNSKGFAYSDFERVCYGNGVVTEVTPNTCTRMFSEKRKWMAVKEVYEILDHRIPHAEVLVGVSERELGLSFKPRGCRVRPGNCEELVEALKYVTKALVALHDLSFMHRDLKWEKVMRRMDSREEEWFVCGFDEAAGAPELKGWRVTGEREGNAPEMERGLHGVKVDVWGVGNLIRTCGLGGVPKMLRELQSRCMEQNPEQRPTAADCYHHLLQLQSSLSAATAAAGGGIMM

SEQ ID NO: 210957 - protein, 259 aa, Glycine max
  Coding DNA Sequence Number=SeqID_94179
  Gene Ontology: Mol. function=RNA-directed DNA polymerase activity; Cellular component=intracellular; Biological process=RNA-dependent DNA replication
MEGTWERPKLDGVNFQKISSHDNFVLIANFKEDEVKDIVCDCASSKSLGPDGFTFLFIKEFWELLKENIKRFLSKFHCFGVLLKGKYYWYDGRLEASNLGIYAGSSNGEVKNLEMDSWWWKASSSGCYSKILVYRLCMEEDSMDEAPNVIFQDLWQISFPKKVFMFLWKTFKNRLPSKENLKKSNIIVRDEDMLCPCLQKSETIPLFFYCELASKVWNECYSWIAPDFATTSPGDMEAHYWYIKWLGRSKLEREIWQYI

SEQ ID NO: 210958 - protein, 124 aa, Glycine max
  Coding DNA Sequence Number=SeqID_94180
MTKGYNGSPLPQADQLCFSCFQLYRILSIAWCFSYFCLAFGNFNSMCSALKGLDDAPQPKSKAAARWIVVKCNRQKGSTECGYYVMHWMSTIILGNFRNNWEAYFNDPRPLELERLKTLRIQWA

SEQ ID NO: 210959 - protein, 44 aa, Glycine max
  Coding DNA Sequence Number=SeqID_94181
MTNVLATYGGIVNGGRGGHDGFVFNVKDSGNQSFNAELCFCPYR

SEQ ID NO: 210960 - protein, 81 aa, Glycine max
  Coding DNA Sequence Number=SeqID_94182
MELQFETDSERISKENLKKLLENIKVKGGFNPKRIGSEIPVLYDDLRVQSEKSVRKRFTLKATSALYQKEDNERVQMSKDR

SEQ ID NO: 210961 - protein, 74 aa, Glycine max
  Coding DNA Sequence Number=SeqID_94183
MSKYPNISGHFEEFLNVKVVSVQVFSMTKYPNIGESFEEFLNDKVVSVRIFDMAKYLNTDGSFEEFLNVKISVY

SEQ ID NO: 210962 - protein, 1454 aa, Glycine max
  Coding DNA Sequence Number=SeqID_94184
  Gene Ontology: Mol. function=nucleoside-triphosphatase activity; Cellular component=integral to membrane; Biological process=transport
  Homolog annotation: Hit_ID=Q7PC88; Match level="QueryCoverage=99%, HitCoverage=97%, E-value=0.0, Identity=62%"; Hit description =Probable pleiotropic drug resistance protein 3
  Pfam annotation: Domain name=ABC2_membrane; Domain location=1203 -1417; Score=240.6; E_value=3.5e-69; Accession=PF01061.14; Description=ABC-2 type transporter
  Pfam annotation: Domain name=ABC2_membrane; Domain location=560-773; Score=190.0; E_value=5.5e-54; Accession=PF01061.14; Description=ABC -2 type transporter
  Pfam annotation: Domain name=ABC_tran; Domain location=236-458; Score= 38.3; E_value=6.9e-11; Accession=PF00005.17; Description=ABC transporter
  Pfam annotation: Domain name=ABC_tran; Domain location=916-1106; Score=106.6; E_value=7.5e-29; Accession=PF00005.17; Description=ABC transporter
  Pfam annotation: Domain name=PDR_assoc; Domain location=778-842; Score=93.4; E_value=7.1e-25; Accession=PF08370.2; Description=Plant PDR ABC transporter associated
  Pfam annotation: Domain name=cobW; Domain location=237-403; Score= -75.1; E_value=0.067; Accession=PF02492.9; Description=Cobalamin synthesis proteinP47K
  Pfam module annotation: Pfam domain module=ABC2_membrane::ABC2 _membrane::ABC_tran::ABC_tran::PDR_assoc::cobW; Domain location=1203 -1417::560-773::236-458::916-1106::778-842::237-403
MAIAGFSFDMTSERESFARASNAEWVEEDEEELQMAALLRLPTQKRVNTALVRKPSSDTSNRGDSGKKKAKVLEQIDVRKLNRSHRERLVKDALATNEQDNYKLLSAIKERFDREMRPSVRLETHLHHCNKNFHFSKHKNEKQEYIVFLLSRRHLQGFQLETKHTARVGLDVPSIEVRYKNLTIGADVQIGSRALPTLINYTRDVFEGMITGMGIGRPQRHSLTILNNISGVVKPRRMTLLLGPPGSGKTTLLLALAGKLESNLKKSGSITYNGHEQNEFCIQRASAYTSQTDNHIAELTVRQTFDFANRCQGSSDVEIVKNLERLEKEKNILPSPEIDAFMKATLVGGKKHNVMTDYVLKVLGLDVCSDTVVGNDMLRGVSGGQKRRVTTGEMIVGPRKALFMDEISTGLDSSTTFQIVKCIRNFVHQMDATVLMALLQPAPETFELFDDLLLLSEGYVVYQGPIKDALEFFESLGFKLPSRKGVADFLQEVTSKKDQAQYWADSSKPYKFISVPEIAEAFKNSRFGKSVESMCTAPFDKSKSHPSALPTTRFAVPKWELFKACFSRELTLLNGHRFLYIFRTCQVTFVGIVTCTMFIQTKFHNKDEEYGNLYQSALFFGLVHMMFNGYSELTLMIARLPVFFKQRGNLFYPGWAWSLATWILGVPYSLVEAVIWSCVVYYTVGFAPAPGRFFRYMLLLFMLHQMALGLFRFMAALARDMVIANTFGTAALMIIFLLGGFIIPKGMIKPWWIWGYWLSPLTYGQRAISVNEFTATRWMQHSAFGSNTVGLNILKGFDIPAEDYWYWVGLGVLTLYALIFNCLVTLGLSYLNPLQKARAILLGDEDDSKESSNKNGSKSSGDDGKAKGMSLPFEPMTMTFHGVNYYVDMPKEIANQGIAETRLKLLSNVSGVFAPGVLTALMGSSGAGKTTLMDVLAGRKTGGYIEGEIKISGYPKVQQTFARISGYVEQNDIHSPQLTVEESLWFSASLRLPKEVSMEKKHEFVEQVMKLVELDSLRKGLVGMPGTSGLSTEQRKRLTIAVELVANPSIIFMDEPTSGLDARAAAIVMRAVRNTVDTGRTVVCTIHQPSIDIFEAFDELLLMKRGGRVIYGGKIGRQSDIMIKYFQSIKGTSSIPSGYNPATWMLEVTTPAVEEKLGVDFSEIYESSEQFRGVLASIKKHGQPPPGSKPLKFDTIYSQNTWAQFLKCLWKQNLVYWRSPPYNAMRIFFTIICAFIFGTIFWDIGTKRQTTHQVYVIMGALFSACLFLGVNNASSVQPVVSIERTVFYREKAAGMYSPISYAIAQGLVEIPYVALQTIVFGVITYFMVNFERDVGKFFLYLVFMFLTFMYFTFYGMMAVGITPTQHFAAVISSAFYSLWNLVSGFLIPKSHIPVWWMWFHYLCPVSWTLRGIITSQLGDVEEMLVGPGFKGNVKEFIAATLEYDTKINGMSSVL

SEQ ID NO: 210963 - protein, 764 aa, Glycine max
  Coding DNA Sequence Number=SeqID_94185
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=98%, HitCoverage=64%, E-value=1e-118, Identity=43%"; Hit description =Chromo
  Pfam annotation: Domain name=rve; Domain location=469-625; Score =91.4; E_value=2.8e-24; Accession=PF00665.16; Description=Integrase core domain
  Pfam module annotation: Pfam domain module=RVT_1::rve; Domain location=167-336::469-625
MVGNGQYLECTSICDAITIHIQHHTFVVYLHVLPISGSNIVLGGQLVTLQGDPEANLSSLTSSQFRRLCRTQNSGLYFHITILSEDSTSSPKTLAPSIHVLLTKYTALFQPPQSLPPARTTDHHIHLLPQSTPLNVRPYRYPHFQKQEIELQVDSMLQKGLIQPSTSPFSSPVLLVKKHDGTWRFCVDYKALNSLTIKDHFPIPTIDELLDELGGAQCFPKLDLLQGYHQIRMHSEDIPKTAFRTHHGHYEFRVMPFGLCNAPSSFHATMNLIFRAFLRRFVIVFFDDILIYSGTFEDHLRHLDMTFQVLLDNQFVLKMSKCSFAQTQVEYLGHLVSGRWMEPVAKKIVAIVNWPQPQSTRAVRSFLGLAGFYRHFIRGYAMIADPLVRVTTIEPFHWTSQAQQAFENLKTTLSTAPVLALPNFQLPFTIETDASGSADVANFVANCTECQFTKYETKRVTGLLCPLPIPFRPWEDLSLDFITGLPSFQGKMVLLVVVDRFSKGIHLGILPQAHTAHMVALLFIDIVVKLYGIPRSLVLDRDPLFISGFWQELFKLSGTHLRMSSAYHPQSDGQTEVMNRVIEQYLRAFVHRRPATWGKFLPWVELSHNTSWNSGTGSTSYEITFGRKPFSFPDYLAGSSKLDTVDDLLMARDEVFTSIRRKLLKAQAYMKKTTDTKCREVTYDPGSWVLVKLRPYFAYRLKLPETARIHPVFHCSLLKPFHGDPDSGAAAPLPEHFLNDQPLITSLAILDYRRHTEKGSWEML

SEQ ID NO: 210964 - protein, 243 aa, Glycine max
  Coding DNA Sequence Number=SeqID_94186
  Gene Ontology: Mol. function=metal ion binding; Cellular component =integral to membrane
  Homolog annotation: Hit_ID=Q9LLM2; Match level="QueryCoverage=99%, HitCoverage=100%, E-value=1e-114, Identity=80%"; Hit description=MTD2
  Pfam annotation: Domain name=zf-C3HC4; Domain location=147-184; Score= 14.5; E_value=0.005; Accession=PF00097.15; Description=Zinc finger, C3HC4 type (RING finger)
MGKGSFQDSVKALEADIQYANTLALGYPRDKDGGCFQMRISYSPAAPLFLFLVQWTDYRLAGALGLLRILIYVTYGNGKNTMSIYERKASIRQFYSIIFPALLQLEKGITDLEERKQKEVYALRYQRKSEFNERRQSEIDIEREEECGVCLEVKAKVVLPNCCHYMCLKCYRDWCQRSQSCPFCRDSLKRTNSGDLWIYTDTSDIVDVGTIFKENCKMLFLYIEKLPLIVPDPRYVFYDPLLR

SEQ ID NO: 210965 - protein, 127 aa, Glycine max
  Coding DNA Sequence Number=SeqID_94187
  Gene Ontology: Mol. function=DNA binding; Biological process=DNA integration
  Homolog annotation: Hit_ID=Q1RSZ9; Match level="QueryCoverage=99%, HitCoverage=10%, E-value=6e-19, Identity=40%"; Hit description =Polynucleotidyl transferase, Ribonuclease H fold
  Subcellular localization annotation: CTP_CleavageSite=34; ConfidenceScore=5.20e-01
MKAFSSVSAYCQHLKSLLNQLKNAGFSVDNSRLVLQLVFGLTESYKRVATLIRQKFGLKKAAQTSSSAIVARDSNESQEMSDHSSACCTNNGGKRYSNHGNSRKNRNNTGGHDNSGVDKGGSGSKTY

SEQ ID NO: 210966 - protein, 155 aa, Glycine max
  Coding DNA Sequence Number=SeqID_94188
  Subcellular localization annotation: CTP_CleavageSite=52; ConfidenceScore=5.27e-01
MGVGASWGGGKGGGNGDTVGETRWRSSSIFRVMALTDSPRYNCCLVRRLRTSSSLSKEKGGASGSGMVKSNESTKIDKGLGPPVKKKELKQNWLWMHPSRGQLESSKSCIASSAPHHLYCNSSVIPEEIRNEWSNFEAHGKSKLTFLFNVTNLAA

SEQ ID NO: 210967 - protein, 90 aa, Glycine max
  Coding DNA Sequence Number=SeqID_94189
MDKEDHEERVHRRAQFFIYKVLEKADSRRKPSCVRIRMVKLKIKIGNGLRSIKKGIFSRAGFHGQFMMGQVKTLKSLMIGLRQTMKFCVC

SEQ ID NO: 210968 - protein, 45 aa, Glycine max
  Coding DNA Sequence Number=SeqID_94190
METVLVEFSPTREICGRCLIRIRLNYHEESGFSISINTIGTHEHC

SEQ ID NO: 210969 - protein, 143 aa, Glycine max
  Coding DNA Sequence Number=SeqID_94191
MKTNEERRRTVETFAKFFTENVMETFWKRLGLDFLHGNNFSKQIRKRENKIGEVVAAQLAQASQVASSRSNSLLEEYSGGPKWAWVLFAPPFLLTPLELVGLGSSSSMDSFALWKMNGSRMEKEEREETPLQGEDESRRSSPP

SEQ ID NO: 210970 - protein, 148 aa, Glycine max
  Coding DNA Sequence Number=SeqID_94192
QRSGPCLAKWPMASRKCKSIGSRPTTQYDTRRFSSLDAWTRYTDNVLGRNILPKRKVELYHTELDDFKAELERRHLVKIDANSLNTFLETPVVLVEGETLPVYSRYCRLPTDFREIEAALCILGRGFILNSKGNPRKILRKDLTTLAQ

SEQ ID NO: 210971 - protein, 320 aa, Glycine max
  Coding DNA Sequence Number=SeqID_94193
  Gene Ontology: Mol. function=chitin binding; Cellular component =extracellular region; Biological process=chitin metabolic process
  Homolog annotation: Hit_ID=UPI00006A17C9; Match level="QueryCoverage =93%, HitCoverage=100%, E-value=2e-35, Identity=32%"; Hit description= UPI00006A17C9 related cluster
  Subcellular localization annotation: CTP_CleavageSite=48; ConfidenceScore=5.11e-01
MSSHSEHYTSSPSVEYNPHLPRTTHPRLQRTTRAHHQGTTHPRLQRARCPHLQRSTRPHLKRATRPHLQRTTRPLLQRATRPCLQRATRTHLQWTTRARLQRTTWPYLQRVHALTLKGLQVLAFRGLHTLAFRGVHAHAFRGLHVLTFRALHVLTFRGQHALTLKGLHALAFRGLHTLTFRGLLVPAFKGLHVLTFRGLHVLTLRVLHTLTIRGLHVPDFKGLHVLSFTGLHVLTFRRLHVLAFTGVDALTFRVLHVLTFKGLHALAFVGLHALPFRGQHALTFRGITVLTFRGQHAFTLKGLHALAFRGQHTLTFRGLL

SEQ ID NO: 210972 - protein, 227 aa, Glycine max
  Coding DNA Sequence Number=SeqID_94194
  Gene Ontology: Mol. function=beta-N-acetylhexosaminidase activity; Cellular component=outer membrane; Biological process=carbohydrate metabolic process
  Homolog annotation: Hit_ID=Q9AAZ5; Match level="QueryCoverage=74%, HitCoverage=22%, E-value=3e-31, Identity=48%"; Hit description=Beta -N-acetylhexosaminidase, putative
VPVEGVELVRGHRVEHALDLVQALEVTGGVEHEAAPAEARRVLDLHCGQHAVAAAGGELGEGGRAVEQAGFVASLHQHALCGAFQRVALTAVAEGGHDLEADAAGLGADFALGQCQARATAAGQQVGELVGDALRGFAFGLQHGIGAHGDAAALAALHGGRGGNQHQAAGAQLRAGCFSGRRGVGGKCRQRRQRGEQAAQQHCAAHPGAGRLDHRYDSLERCDERYT

SEQ ID NO: 210973 - protein, 120 aa, Glycine max
  Coding DNA Sequence Number=SeqID_94195
  Gene Ontology: Mol. function=protein phosphatase type 2C activity; Cellular component=protein serine/threonine phosphatase complex; Biological process=protein amino acid dephosphorylation
  Homolog annotation: Hit_ID=O81709; Match level="QueryCoverage=86%, HitCoverage=23%, E-value=2e-12, Identity=37%"; Hit description =Protein phosphatase 2C
MKEASRNNLHLGSTATIVLVADNNILVANIGDFKAILDIGVETGGGQVQNWGGVPRINGQLAITRAIGDILFKSYGVIYAPEVIDWQPLTANDGYLVVASDGVFEKMNVQDVCDLLWEVT

SEQ ID NO: 210974 - protein, 105 aa, Glycine max
  Coding DNA Sequence Number=SeqID_94196
  Gene Ontology: Mol. function=transition metal ion binding
MTDRQSGPQSDPFDVEMGDHLEDMIRDLGQESFQHAHAPVYEGLQSDSKKPLYLGCKNSLTLLSVVLSLVNVKARYGWSDKSFTSLLQVVHDLLPEENTLHKSYY

SEQ ID NO: 210975 - protein, 126 aa, Glycine max
  Coding DNA Sequence Number=SeqID_94197
MKPIELYYSLWVGLSILKCYSLGNNIIELYKMRSLMFCTPPKAKLTKTQQTREEEQRVLRCQWLQGKQRHSRHEARKRDDGSEEGGFATRARPRWLCETLHGGSRTMAMKRVALRDSAWGGQGQWQ

SEQ ID NO: 210976 - protein, 322 aa, Glycine max
  Coding DNA Sequence Number=SeqID_94198
  Gene Ontology: Mol. function=hydrolase activity, acting on ester bonds; Cellular component=membrane; Biological process=metabolic process
  Homolog annotation: Hit_ID=O81020; Match level="QueryCoverage=99%, HitCoverage=62%, E-value=1e-112, Identity=58%"; Hit description =Putative phospholipase C
  Pfam annotation: Domain name=Phosphoesterase; Domain location=1-321; Score=425.7; E_value=6.4e-125; Accession=PF04185.5; Description =Phosphoesterase family
MENRSFDHVLGWLKSSRPDIDGLTGSESNPLSVSSPSSATIPFTDDALFIDADPGHSFQAIREQIFGSNDTSAVPPPMNGFAQQAESILLGMSKTVMSGFKPHTLPVYTALANQFGLFDKWFASVPASTQPNRFYIHSATSHGAMSNVCKDLIHDFPQKTIFDSLNENDLSFDVYYQNIPATLFFKSLRKLKNAVKFHDYALKFKKHAEKGKLPNYVVVEQRYFDVEVFPANDDHPSHDVAAGQMFVKEVYEVLRKSPQWEEMAVLITYDEHDGFYDHVATPVEGVPNPDGIVGPHPYYFRFDRLGVRVPTFIISPWIDKGN

SEQ ID NO: 210977 - protein, 285 aa, Glycine max
  Coding DNA Sequence Number=SeqID_94199
  Gene Ontology: Mol. function=zinc ion binding; Cellular component =integral to membrane; Biological process=ubiquitin cycle
  Homolog annotation: Hit_ID=Q6ERQ9; Match level="QueryCoverage=73%, HitCoverage=55%, E-value=6e-41, Identity=37%"; Hit description =Putative ubiquitin conjugating enzyme 7 interacting protein 4
  Pfam annotation: Domain name=IBR; Domain location=121-183; Score =48.5; E_value=2.2e-11; Accession=PF01485.11; Description=IBR domain
  Pfam annotation: Domain name=IBR; Domain location=194-250; Score=3.0; E_value=0.0091; Accession=PF01485.11; Description=IBR domain
  Pfam module annotation: Pfam domain module=IBR::IBR; Domain location =121-183::194-250
MIVKQSLQAENEQEQPHLLTSIKLNKDLLKSEPPIDHDHSEAKKSDQPSQFLCGICFDDKPLSDMFKDGKCNHPFCTHCISKHVVTQIHQSILKVICPDPNCYVEFKPEYLRTILPCDVIDRWECLRRESLILGSEKTYCPFKDCSVLLVNQGGEVATSAECPSCHRRFCAHCKAPWHGRKKCKEFQRVKKNEKKLDKKFFNLAKEKNWKKCPHCTMFVQRCGGCDHIACRCGCNFCYICGKNWNPEHRCMIMRRIVYDLYQRTVGWFRRANLRFSGGRNSSMNW

SEQ ID NO: 210978 - protein, 92 aa, Glycine max
  Coding DNA Sequence Number=SeqID_94200
MCLFLIYVGYLGAVMFAYGVDMGYCTIAQAELWAIYLGMKIAWRRDACYALIQKIHEFRRLEGNFDWSHTFREGKKVADKVSKTMIIRLRIN

SEQ ID NO: 210979 - protein, 280 aa, Glycine max
  Coding DNA Sequence Number=SeqID_94201
  Gene Ontology: Mol. function=metal ion binding; Cellular component =integral to membrane; Biological process=ubiquitin cycle
  Homolog annotation: Hit_ID=Q6ERQ9; Match level="QueryCoverage=67%, HitCoverage=55%, E-value=1e-33, Identity=35%"; Hit description =Putative ubiquitin conjugating enzyme 7 interacting protein 4
  Pfam annotation: Domain name=IBR; Domain location=159-223; Score =47.6; E_value=4.3e-11; Accession=PF01485.11; Description=IBR domain
  Subcellular localization annotation: CTP_CleavageSite=32; ConfidenceScore=5.13e-01
MVLLLSLVTSKTHHALSLRERFAAIVSNFTTSLSAAPSDSPCHHGARRRMVINSSTATLTDGDEKKKSPLLCHHDHDNETNKSDQSSKFFCGICLDDKPVSDMFKVGKCEHSFCTHGISKHVATQMHQNILVVMCPNPKCSMELKPEYLHAILPREVLVRWKCAMFESLIVESEKTYYYCPFKDCSVLLVKNGGEVVTGAECPSCHRLFCAQCKVPWHEKMSCNEFQELQRKIKKLDEMSPVHELDVRMQLLLHLCEEREAWTCMQEVMALARKIFEFYS

SEQ ID NO: 210980 - protein, 52 aa, Glycine max
  Coding DNA Sequence Number=SeqID_94202
MFKDEIEDDEASSMVGRSLKVINLQDYGEPTANHGHDPWKGASWGGNGGRKG

SEQ ID NO: 210981 - protein, 506 aa, Glycine max
  Coding DNA Sequence Number=SeqID_94203
  Gene Ontology: Mol. function=oxidoreductase activity; Cellular component=mitochondrion; Biological process=electron transport
  Homolog annotation: Hit_ID=Q9ST63; Match level="QueryCoverage=99%, HitCoverage=100%, E-value=0.0, Identity=72%"; Hit description =Putative internal rotenone-insensitive NADH dehydrogenase
  Pfam annotation: Domain name=Pyr_redox; Domain location=239-339; Score=34.1; E_value=4.7e-07; Accession=PF00070.17; Description =Pyridine nucleotide-disulphide oxidor
  Pfam annotation: Domain name=Pyr_redox_2; Domain location=71-384; Score=88.8; E_value=1.7e-23; Accession=PF07992.4; Description =Pyridine nucleotide-disulphide oxidor
  Pfam module annotation: Pfam domain module=Pyr_redox::Pyr_redox_2; Domain location=239-339::71-384
  Subcellular localization annotation: CTP_CleavageSite=16; ConfidenceScore=5.40e-01
MAWLRNLSKFATKRASSSQRPKNTDPFCLLPSFTFLSHFSSTNTIEEKPCVEPVEYNYSGLEPTRPHEKPRVVVLGSGWAGCRLMKGLDPRVYDIVCVSPRNHMVFTPLLASTCVGTLEFRSVAEPIGRIQPAISREPGSYFFLANCTQIDAHNHMVHCETVTEGVETIAPWKFTISYDKLVIALGSQPSTFGIQGVKEHAIFLREVHHAQEIRRKLLLNLMLSDVPGISEEEKQRLLHCVVVGGGPTGVEFSGELSDFITRDVRQRYVHVKDYIRVTLIEANEILSSFDDRLRRYATKQLTKSGVRLVRGIVKDVKPQKIVLNDGSEVPYGLLVWSTGVGPLPIIQSLDLPKAPGGRIGVDEWLRVSSVQDVFSIGDCSGFVESTGRQTLPALAQVAERQGKYLAALLNKIGKAGAGHANSAKEIEFGDPFVYRHLGSMASIGRYKALVDLRQNKEAKGLALAGFLSFFIWRSAYITRVISWRNRFYVFVNWITTVVFGRDISRL

SEQ ID NO: 210982 - protein, 61 aa, Glycine max
  Coding DNA Sequence Number=SeqID_94204
  Gene Ontology: Mol. function=GPI anchor binding; Cellular component =membrane; Biological process=cell wall catabolic process
  Homolog annotation: Hit_ID=Q93ZH0; Match level="QueryCoverage=79%, HitCoverage=11%, E-value=4e-15, Identity=77%"; Hit description=LysM domain GPI-anchored protein 1 precursor
MEEGVGGTGLVVNSDGFANIIDARVGDGNFEEELRGENVVLHVGVRDVDGVHGLKYPMSVI

SEQ ID NO: 210983 - protein, 336 aa, Glycine max
  Coding DNA Sequence Number=SeqID_94205
  Gene Ontology: Mol. function=growth factor activity; Cellular component=cellular_component; Biological process=regulation of progression through cell cycle
  Homolog annotation: Hit_ID=P82859; Match level="QueryCoverage=93%, HitCoverage=88%, E-value=4e-24, Identity=43%"; Hit description =Agglutinin
  Pfam annotation: Domain name=Jacalin; Domain location=1-105; Score =15.5; E_value=1.6e-06; Accession=PF01419.7; Description=Jacalin-like lectin domain
  Pfam annotation: Domain name=Jacalin; Domain location=186-319; Score =120.3; E_value=5.5e-33; Accession=PF01419.7; Description=Jacalin -like lectin domain
  Pfam module annotation: Pfam domain module=Jacalin::Jacalin; Domain location=1-105::186-319
ALYDLDGEPVWGYKHGGAGGFKHEKIIFDFPYEVLTHISGYYGSLMYMGPAVIRSLTFHTTKRSYGPFGDEYGTYFTTKLREGKVVGIHGRSGLFLDSLGVHAIEGKVIVPVATSPSMEIISREPSISEIDNPQWLVVAKPAPVEQHYVEEDILFTFAPYFTSKASRCVIKEPAPCGPGPWGGDGGRPWDDGVFSGIKQIYLTKAPEGICSIQIEYDRYKQSVWSVKHGGNGGNTMHRIKLEYPNEVLTCISGYYGSVTADEQPIIIKSLTFHTSRGQYGPFGDEVGKYFTSTTTEGKVVGLHGRSSMYLDAIGVHMQHWLGGIQKTSKLSFFKLF

SEQ ID NO: 210984 - protein, 173 aa, Glycine max
  Coding DNA Sequence Number=SeqID_94206
MRKRSYFELCELHVPSEVGHLLAEVVVIAGGGEGGSKECEPAGDGDGAFLEGGREDFAGDKDEYLASVVVDGDGLGGLGELGGESLEGGVDGRGVREREKEEVGEAVGEGGEAAGRVEGAAVRRGSGDVGEGDANGVEGGRRGRGIVDGHCVMVVLEWKGEVYITEYEQEARL

SEQ ID NO: 210985 - protein, 626 aa, Glycine max
  Coding DNA Sequence Number=SeqID_94207
  Gene Ontology: Mol. function=ubiquitin-protein ligase activity; Cellular component=ubiquitin ligase complex; Biological process =protein ubiquitination
  Homolog annotation: Hit_ID=Q2QU07; Match level="QueryCoverage=97%, HitCoverage=75%, E-value=4e-59, Identity=27%"; Hit description =Armadillo/beta-catenin repeat family protein, putative, expressed
  Pfam annotation: Domain name=Arm; Domain location=119-156; Score=4.9; E_value=2.9; Accession=PF00514.13; Description=Armadillobeta-catenin -like repeat
  Pfam annotation: Domain name=Arm; Domain location=157-200; Score =16.6; E_value=0.09; Accession=PF00514.13; Description=Armadillobeta -catenin-like repeat
  Pfam annotation: Domain name=Arm; Domain location=395-436; Score=0.5; E_value=11; Accession=PF00514.13; Description=Armadillobeta-catenin -like repeat
  Pfam annotation: Domain name=Arm; Domain location=480-520; Score =28.9; E_value=1.8e-05; Accession=PF00514.13; Description =Armadillobeta-catenin-like repeat
  Pfam annotation: Domain name=Arm; Domain location=527-568; Score=6.9; E_value=1.7; Accession=PF00514.13; Description=Armadillobeta-catenin -like repeat
  Pfam annotation: Domain name=Arm; Domain location=571-610; Score=1.1; E_value=8.8; Accession=PF00514.13; Description=Armadillobeta-catenin -like repeat
  Pfam annotation: Domain name=Arm; Domain location=78-118; Score=4.6; E_value=3.2; Accession=PF00514.13; Description=Armadillobeta-catenin- like repeat
  Pfam annotation: Domain name=HEAT; Domain location=163-202; Score =6.4; E_value=7; Accession=PF02985.12; Description=HEAT repeat
  Pfam annotation: Domain name=HEAT; Domain location=19-55; Score=2.3; E_value=23; Accession=PF02985.12; Description=HEAT repeat
  Pfam annotation: Domain name=HEAT; Domain location=400-438; Score =1.7; E_value=27; Accession=PF02985.12; Description=HEAT repeat
  Pfam annotation: Domain name=HEAT; Domain location=485-522; Score =13.1; E_value=1; Accession=PF02985.12; Description=HEAT repeat
  Pfam annotation: Domain name=HEAT; Domain location=576-612; Score =4.9; E_value=11; Accession=PF02985.12; Description=HEAT repeat
  Pfam module annotation: Pfam domain module=Arm::Arm::Arm::Arm::Arm::Ar m::Arm::HEAT::HEAT::HEAT::HEAT::HEAT; Domain location=119-156::157 -200::395-436::480-520::527-568::571-610::78-118::163-202::19-55::400- 438::485-522::576-612
MLERGTTRLAIHSLIGNSEKEREHAIKLLLEFCNDEDCCVRIASEKGALVLLSSIAGNMEYPSLSNLAEEVLRQMERVEDNVQCLAAAGRFGPLISRLHDGSVGVKIEMASLVGRMTLTNSCKEQIARQGARVFVELLSNQEGSGPSLQALYNLSGLDGNATILIESSVLPSLIEVLFDEKDPSYELKSLAASTIANIVSKPGHWELASADKKGNPMQSEIVVLRLLGLLNSLPSQCQVIVLRILCGITSSPQASELVASHITSKGGFGSVIPFLEHPEVEHRVFAFKLTRLISEWFSQYIANELRLSNKLTVLKEKLLNNQSTSDERSDAAQILANFSLSEGEIQTLLGGDFVEWTAVTLKNQRRISNARSSYTASGMQEGLIGLLLHFTRNLDQQTLNIVRENRLMGIFCEQLDYTSKAKVKQLAAIGLKHLSEFGRSVTARDSKPPSSSGFCSFFVLMCGKASSQPSMCPIHNCLCDEDSQLCLLKSNCIKPLVDILHDNDTDVQLAAVDALSTLLLDYTSCSFKRVVDELEHLGAIDSLITLFTEVRSEELQEKTIWMIEKILRVDNVSDRYALNHSLVRALVESFKHGNTNTRKHAQDALTLLKQLSGVSGKTSSQTRARR

SEQ ID NO: 210986 - protein, 282 aa, Glycine max
  Coding DNA Sequence Number=SeqID_94208
  Gene Ontology: Mol. function=ubiquitin-protein ligase activity; Cellular component=ubiquitin ligase complex; Biological process =protein ubiquitination
  Homolog annotation: Hit_ID=Q10FT0; Match level="QueryCoverage=56%, HitCoverage=19%, E-value=3e-22, Identity=36%"; Hit description=U-box domain containing protein, expressed
  Pfam annotation: Domain name=U-box; Domain location=109-184; Score =46.5; E_value=9.1e-11; Accession=PF04564.6; Description=U-box domain
MDENEERVWCTLEKEGEGRESSKAVQSGIVMDLARALGFEPGDRAEFCNQVKLFKGDPFRSHSVPERRVLMSLERILSNWSVEPVPVSPNWDFEIVEDAAAPVFAFKSFLCPLTKEVMRDPVVVLESSQAYERTAIEYWFERCIQDGRDPTCPVTGRVLKSLELKPNIGLAGAIEEWVGRVVEYQIKSAVQYLSEDPLSVDHVERALDHVFKVSEEHPTRRYIIRNAGVVQLIVTVLSNNSKTIGSHLRSKALMTLLSLAEDEESRVSFVYLSMLIFEFLHL

SEQ ID NO: 210987 - protein, 136 aa, Glycine max
  Coding DNA Sequence Number=SeqID_94209
  Subcellular localization annotation: CTP_CleavageSite=45; ConfidenceScore=5.45e-01
MNSLPSAVHVSSTIVSGAPRILCLAMFANSSFSTFIQSPMNLLLSAVHASATIEYGAPRSYCVERCSCILHQRVWSPVKLLRSAVRQFSILHLFRSPINLLPSAVHASSTNEFGVLRSYCVVLFANSPFSTFFGAP

SEQ ID NO: 210988 - protein, 104 aa, Glycine max
  Coding DNA Sequence Number=SeqID_94210
MLEQRLKINSWGSGLDGGGCMNDNQFMGLRNRFDDGGCTNSARQSIRGDPDSMEINSWGSRLDGGGCMNDNQFMGLRIRFDGGGCTNTARQSIRGAPDSIVEDA

SEQ ID NO: 210989 - protein, 52 aa, Glycine max
  Coding DNA Sequence Number=SeqID_94211
MVRALLTTHGRPIGDQVQSQSHSRTHLVAHDPRNLNKTSTSSEGRKIPWICM

SEQ ID NO: 210990 - protein, 92 aa, Glycine max
  Coding DNA Sequence Number=SeqID_94212
MAIIARWPTMVMGARFEPCTTMGTNSKACIRRGKTKGEESLGEEGRSGTKEGCTNSNQPSRIFQQKAVPSGGSNPARLGELGGNQLPLFPYK

SEQ ID NO: 210991 - protein, 169 aa, Glycine max
  Coding DNA Sequence Number=SeqID_94213
MEVLNAKAVVPSNSYGSPADSVDEYVRISESTVAECLEAFVKGVNDIFGDEHLRRPDNNINCLLQIGDAHGFPGSMTLESEEKRWLFIFAVVRLDNVGVIGAHHVSEDECITCGRNGQHYRSRGTVELVNADAIKFELEESDGGAGQGEVEDGFLGKGVDAILPPKGIG

SEQ ID NO: 210992 - protein, 90 aa, Glycine max
  Coding DNA Sequence Number=SeqID_94214
  Subcellular localization annotation: CTP_CleavageSite=46; ConfidenceScore=5.07e-01
MSQPTLRREGDARLTGASSKGGKRTESPPTFIRGKRQKNRKRRDLRALSVKGSGVVFTHREDRRTNEERWKSIAKSPTETSQKRYGSASA

SEQ ID NO: 210993 - protein, 219 aa, Glycine max
  Coding DNA Sequence Number=SeqID_94215
  Gene Ontology: Mol. function=hydrolase activity, acting on ester bonds; Biological process=lipid metabolic process
  Homolog annotation: Hit_ID=Q8LDB1; Match level="QueryCoverage=99%, HitCoverage=75%, E-value=5e-60, Identity=49%"; Hit description=CPRD49
  Pfam annotation: Domain name=Lipase_GDSL; Domain location=1-166; Score=11.8; E_value=0.00019; Accession=PF00657.12; Description=GDSL -like LipaseAcylhydrolase
DAKEQPSLVIVYFGGNDSTLPNPNGLGPHVPVEEYKENMRKIAIHMKKFLSSVCLKLDLMLMVAKFDTNPNDWQCLSEKTRTIFLTTPPINEAQIHNNSDPHGLLLRTNEACLIYAEACLEVCHEMNVKAIDLWSAIQKKDNWRDVCFIDGIHLSTEGSKIVTKEILKVLKEAEWEPSLYWRSMPSDFGEDSPYDPVGPDGKSTINLSNFAFPNNDQWD

SEQ ID NO: 210994 - protein, 36 aa, Glycine max; identical to SEQ ID NO: 141474
  Coding DNA Sequence Number=SeqID_94216

SEQ ID NO: 210995 - protein, 157 aa, Glycine max
  Coding DNA Sequence Number=SeqID_94217
  Gene Ontology: Mol. function=hydrolase activity, acting on ester bonds; Biological process=lipid metabolic process
  Homolog annotation: Hit_ID=Q9AYM5; Match level="QueryCoverage=76%, HitCoverage=47%, E-value=6e-47, Identity=73%"; Hit description =CPRD49 protein
  Pfam annotation: Domain name=Lipase_GDSL; Domain location=9-155; Score=12.9; E_value=0.00016; Accession=PF00657.12; Description=GDSL -like LipaseAcylhydrolase
MVGPVRPQFVLFGSSIVQLSYSLQGWGAILAHLYARKADIILRGYSGWNSRRAVQVLDEIFPKNATEQPDLVIVYFGGNDSLLPHPSGLGQHVPLQEYIENMRKIGTHLKLLLPSLTQILMIARAFQRRLALYFSVLLLSMRHKFMEPGFDFNLIAI

SEQ ID NO: 210996 - protein, 74 aa, Glycine max
  Coding DNA Sequence Number=SeqID_94218
MSDKDAMAEVKEWLAKKFEDSLCSHLAFAPRSRLLFQSQGGLLKRSLEMNLLMTLLFQAAQSEENYQGSLHSER

SEQ ID NO: 210997 - protein, 67 aa, Glycine max
  Coding DNA Sequence Number=SeqID_94219
MDLGMNMSCATFSCPRASPLPSPWSGGRLSHLHEAIEPKVLFKLMLSVLTPDRNEKAARAAFNTSID

SEQ ID NO: 210998 - protein, 108 aa, Glycine max
  Coding DNA Sequence Number=SeqID_94220
PIKRSFLIGAAVVASFGYRKKRDGSWVKKGAQLNDDEGHLSVEKDSSLLQSILDRFDGLQTYVGERFNSLERQVDTRFEEMNLGIAKVEEDVTIIRDCFDLPPPLPSV

SEQ ID NO: 210999 - protein, 260 aa, Glycine max
  Coding DNA Sequence Number=SeqID_94221
MVRESLKSARQSFLGFKNISDQGIVDICFEDFSNMSRTHISVPSNFMIHLRNYIDKRKDNALGLCWRLPDKETIIYLNRRKRRRLDKSASCNDFPQISEVQESERCADISTHTTPSISDIKMLEPEGSIQKDHQASTYVCETSMNFTEEFHKVDSKRIQSCESLSNLVHHFHSDKCEVDGSEAKAKGMLGSDSSVYQERLHMCCNRDTTPLNSKRSAKYILKLTRPRISDIKMLEQEGSIQKHHQASTSICETSMNFIDE

SEQ ID NO: 211000 - protein, 147 aa, Glycine max
  Coding DNA Sequence Number=SeqID_94222
AYAPGLGASSLLLSVPRPPPDIGGRPTVDRAHKTPCGPEEVQQGPRVSSSGYGPLSVLPGIAPTRHPVDPEKSNRVLGFPALITDLCQFYGVPVAPIKGETPQQPEDGRQRAIDAPPPPPEPPSSSIKVGALPTTRGRPAGDQVQSQ

SEQ ID NO: 211001 - protein, 76 aa, Glycine max
  Coding DNA Sequence Number=SeqID_94223
MGKMRSRASFTYLKLNFFSGCGSRATFILSQSMTPVQKIIVIILNALIQDFFKIKPCLTKKGFKSFKAHVIDYQYM

SEQ ID NO: 211002 - protein, 99 aa, Glycine max
  Coding DNA Sequence Number=SeqID_94224
  Gene Ontology: Cellular component=chloroplast
  Homolog annotation: Hit_ID=Q9ZS97; Match level="QueryCoverage=65%, HitCoverage=11%, E-value=4e-15, Identity=61%"; Hit description =Protein NAP1, chloroplast precursor
MPRFSKALRILGSTNLGSRWGEGVVGPNGGFHGEEVVQGFEAKLEHPVRFIFEFRDDEVDCVSIKAFGDQERVDVDGEAKLLVVVTVIAMEAFADVIIA

SEQ ID NO: 211003 - protein, 92 aa, Glycine max
  Coding DNA Sequence Number=SeqID_94225
  Gene Ontology: Mol. function=DNA binding
  Homolog annotation: Hit_ID=Q2MGR0; Match level="QueryCoverage=88%, HitCoverage=63%, E-value=2e-18, Identity=63%"; Hit description=ParB -like nuclease
  Subcellular localization annotation: CTP_CleavageSite=59; ConfidenceScore=5.61e-01
MANFVLQFPNTLRSFAVSASSNSNGAPPGGSGSSSGGGGGPVILELPLDKIRRPLMRTRANDQNKVLELMDSIKEIGLQVPVTTCSLLLIYF

SEQ ID NO: 211004 - protein, 147 aa, Glycine max
  Coding DNA Sequence Number=SeqID_94226
SAKVDVSLSELNALSECHPLSEASTHLADKKNLEGNLSHRHALNASLAHSTSCLSPSKLSASLALNENSLTRAKRDIEVSELFFKPDLRRMKGGLRRALNSHKSLNSEIHRGKEWSKEAKFLSFRKICEFLSDCEIPRHGGDIPTPL

SEQ ID NO: 211005 - protein, 143 aa, Glycine max
  Coding DNA Sequence Number=SeqID_94227
MFGHKYYILGRLSSEVGWSYYDTIRYLSYPNFIRGQLFVGMRIFAGHVELLKANFRVIRGVLQPWAHLGPLGSFNMKQPACLGEHVAFEQSHRLAWVSWAASFSLILAIKGRGRLRGRGSAPLIFIFHLKLVRRRRKKEKIKA

SEQ ID NO: 211006 - protein, 78 aa, Glycine max
  Coding DNA Sequence Number=SeqID_94228
MSKRDIYQSRIKAHASVVVKMSWIMWDGRSRFACESHVCDGATMPMIGKEIPVKGYVISKHCLVLEKDYGTCDTLYPN

SEQ ID NO: 211007 - protein, 37 aa, Glycine max
  Coding DNA Sequence Number=SeqID_94229
MLTLGQLTGGHSKQAAPDMTHMQASPCHSLSLYNNDW

SEQ ID NO: 211008 - protein, 112 aa, Glycine max
  Coding DNA Sequence Number=SeqID_94230
MLKRDNDRICDWKVLHNNAKHVVGAPTTNNEDRRRLPTKVGNRQKRGNKQKGQSKCGKGLPDEGQLADSSTKMWKKIVGKAIIVKKVTREGENVEISPMNKKVHVVFLIHLT

SEQ ID NO: 211009 - protein, 182 aa, Glycine max
  Coding DNA Sequence Number=SeqID_94231
  Homolog annotation: Hit_ID=UPI000034F013; Match level="QueryCoverage =23%, HitCoverage=9%, E-value=1e-11, Identity=81%"; Hit description =bile acid:sodium symporter
  Subcellular localization annotation: CTP_CleavageSite=41; ConfidenceScore=5.39e-01
MAFFLYLCSTSGLAIFACMPTTLSSGVALTQLAGGNSALALAMTVISNMLGILISRCSTRMINWLCWLYHRCPGHIGRMKRFTVQLPATVNGVPSTITMVALISICPCENGYSLRQEHIRVSAKVIKNALLFSDSFLALAGMDAAGGKISTPLCRSVDVLVVGSLAPKGCRSGNRGGGQKMH

SEQ ID NO: 211010 - protein, 233 aa, Glycine max
  Coding DNA Sequence Number=SeqID_94232
  Gene Ontology: Mol. function=nucleic acid binding; Biological process= DNA integration
  Homolog annotation: Hit_ID=Q0KIN0; Match level="QueryCoverage=89%, HitCoverage=12%, E-value=9e-25, Identity=32%"; Hit description =Integrase core domain containing protein
MASTSSVTPSKARAPIFSNLLLSIEKLDGSNYSNRTSEVTLWISRLGYKSHLTSTIDSILAVDRAQWAKIDANLCSVIKSTLHPSLKSIFLPHIICKSVWTEARALYTNDTQQLYGVCQDLMTLLAPQKFETLHEYNELLPLAASIPIEAKKELEKCSAFFMTLALYGMPPEYSATQDQIHGSPVAPMMASTCSTLLRIPPKPTTNIPTSMMGDTSTLASQSNNFWMLSNKVI

SEQ ID NO: 211011 - protein, 153 aa, Glycine max
  Coding DNA Sequence Number=SeqID_94233
MVITHLGPQVDGIELPLNEVTSQPPQIIEDALATISTSNPPREIAPLTTFAPTSVSEENIQELLRLQQTNLEDTMEKRFLVERMETNLLIKNTLEYSLKSFNDYVLFNMNLLMQQRLPPSAQPTPPPPTTVLLTCLFNKTSVIVVTHVCFHAF

SEQ ID NO: 211012 - protein, 106 aa, Glycine max
  Coding DNA Sequence Number=SeqID_94234
TRHVRRYMEKNEETTMEEKVNLKINRGLRSTNLKLLCSDNHLMEACLRSFYEGERRHHPLGNKSGKEEIHHQESSLDENPRAFFSRSIPILLESSINYPWGIGLHQ

SEQ ID NO: 211013 - protein, 79 aa, Glycine max
  Coding DNA Sequence Number=SeqID_94235
  Gene Ontology: Mol. function=RNA-directed DNA polymerase activity; Biological process=DNA integration
  Homolog annotation: Hit_ID=Q1SA33; Match level="QueryCoverage=91%, HitCoverage=7%, E-value=3e-17, Identity=60%"; Hit description =Integrase, catalytic region
MKELQKKFKMDDAKPIKTPMHPTTVLGLNEDSKQVDEKTYRGMIGFLLYLFASKPDITFNVCLYARFQKGTKGSSFIRC

SEQ ID NO: 211014 - protein, 110 aa, Glycine max
  Coding DNA Sequence Number=SeqID_94236
MVSRGIIPFEKHIAAVGTTNNNMLSKRKTLDEGSLLSSKSETQHDHRFTSTPYVPMDPGIRPIFNSPCVQKAHNKSRIKTRKSTRSSIKNPIQDSRFKRRNQEATSQDFI

SEQ ID NO: 211015 - protein, 125 aa, Glycine max
  Coding DNA Sequence Number=SeqID_94237
  Gene Ontology: Mol. function=DNA binding; Cellular component =mitochondrion; Biological process=DNA integration
  Homolog annotation: Hit_ID=Q1S7S0; Match level="QueryCoverage=96%, HitCoverage=9%, E-value=5e-38, Identity=63%"; Hit description =Integrase, catalytic region; Peptidase aspartic, catalytic
MSISSTVEPKSYIEAFKHDCSIKAMQEEINALQMNHTWIFTDLPSHKNAIGCRWVYKIKHKADGSIECYKACLVAKGYTQMEGINYIDTFSLVAKITIVRLLLALAVMNYLYLKQLDIKNVFSTW

SEQ ID NO: 211016 - protein, 225 aa, Glycine max
  Coding DNA Sequence Number=SeqID_94238
  Gene Ontology: Mol. function=calcium ion binding
  Homolog annotation: Hit_ID=O64866; Match level="QueryCoverage=60%, HitCoverage=95%, E-value=3e-50, Identity=73%"; Hit description =Expressed protein
LGSFEICSFLKKTIGIILEDHADGEGAEAVGDGEHDLPHLIPELAAVDGAAPVAVELVEDGVVELRELIRRRGDVDAEVRLDEAHGLEGRAELRAREDAVVVEVQHPELLVHALREGRLVVHEVAHGAAVDHHHTHSVLLSVSHSLSEVKERFKIVGIGIDGLGKGGLAIPCRQHVIFFAKSVDRGTGALFAFPPFKTSGDLHSHREGLPLKSKPSFSCSSVTCK

SEQ ID NO: 211017 - protein, 313 aa, Glycine max
  Coding DNA Sequence Number=SeqID_94239
GEYYIWERFEIDVINVWTMHDLCKACVDYMKFGLVYYLIPNQGLEGGFQRLENDWDVLDMCNIGFVDVANDVHVHFKHVVDEMLEIIPADVLENVIGGKNDAANCENEGGFQRLENDWDVLDMCNIGFVDVAKDVHVHFKHVVNEMLEIILADVLENNVHEGVGADFEKEIKMIVYSIRGGVDHVVAKPIVEEPVDEVGSDLLPNIRVDDLSDLEEIDPEYVYESPDEDDGREFESLPSNDNEEDTNKKIAYPHYNAKSHFGKVHLEVVMEFKTIKFFIEDVREYTIYHSRDLMWPKNDTIGARTRCKQKGCP

SEQ ID NO: 211018 - protein, 99 aa, Glycine max
  Coding DNA Sequence Number=SeqID_94240
  Subcellular localization annotation: CTP_CleavageSite=49; ConfidenceScore=5.20e-01
MGVKHLRWSSESRMPTNNGPRTELGSCRSTAPGLYGFSPADQPNATCMRASGAPSSTCEPRWTLGTVANVEAVVVHQLLAIAADLAPTVVPALECSTSQ

SEQ ID NO: 211019 - protein, 102 aa, Glycine max
  Coding DNA Sequence Number=SeqID_94241
MFHAKEPLSGGMQPSLDRLEGGVNSNQAHLSLPGGSNKRRCLLVEATQLAWASWVTTTSLFSPINSGKRVEQKCSALLVFRILSKLVRKIVSMEKILAEVLL

SEQ ID NO: 211020 - protein, 103 aa, Glycine max
  Coding DNA Sequence Number=SeqID_94242
MVSSFGYRKERDGSWVKKDAPAQAAEDRSPSPPPQRDDSSSLMHNILDILNGLHTFVGERFDSLDSRIDAIDARFAGMDTHITQLEEDMSYIHQCFDLPPPSS

SEQ ID NO: 211021 - protein, 476 aa, Glycine max
  Coding DNA Sequence Number=SeqID_94243
  Gene Ontology: Mol. function=protein binding; Cellular component =integral to membrane; Biological process=defense response to fungus
  Homolog annotation: Hit_ID=Q1S5Q4; Match level="QueryCoverage=99%, HitCoverage=67%, E-value=1e-129, Identity=37%"; Hit description =Leucine-rich repeat
  Pfam annotation: Domain name=LRR_1; Domain location=102-124; Score =17.9; E_value=0.036; Accession=PF00560.23; Description=Leucine Rich Repeat
  Pfam annotation: Domain name=LRR_1; Domain location=126-148; Score =10.6; E_value=3; Accession=PF00560.23; Description=Leucine Rich Repeat
  Pfam annotation: Domain name=LRR_1; Domain location=150-173; Score =4.5; E_value=40; Accession=PF00560.23; Description=Leucine Rich Repeat
  Pfam annotation: Domain name=LRR_1; Domain location=221-243; Score =1.8; E_value=1.3e+02; Accession=PF00560.23; Description=Leucine Rich Repeat
  Pfam annotation: Domain name=LRR_1; Domain location=246-265; Score =5.9; E_value=22; Accession=PF00560.23; Description=Leucine Rich Repeat
  Pfam annotation: Domain name=LRR_1; Domain location=288-311; Score =7.3; E_value=12; Accession=PF00560.23; Description=Leucine Rich Repeat
  Pfam annotation: Domain name=LRR_1; Domain location=29-51; Score =13.2; E_value=0.92; Accession=PF00560.23; Description=Leucine Rich Repeat
  Pfam annotation: Domain name=LRR_1; Domain location=316-335; Score =8.4; E_value=7.8; Accession=PF00560.23; Description=Leucine Rich Repeat
  Pfam annotation: Domain name=LRR_1; Domain location=340-362; Score =15.3; E_value=0.22; Accession=PF00560.23; Description=Leucine Rich Repeat
  Pfam annotation: Domain name=LRR_1; Domain location=364-386; Score =13.4; E_value=0.86; Accession=PF00560.23; Description=Leucine Rich Repeat
  Pfam annotation: Domain name=LRR_1; Domain location=388-409; Score =10.5; E_value=3.1; Accession=PF00560.23; Description=Leucine Rich Repeat
  Pfam annotation: Domain name=LRR_1; Domain location=4-22; Score=6.1; E_value=21; Accession=PF00560.23; Description=Leucine Rich Repeat
  Pfam annotation: Domain name=LRR_1; Domain location=410-432; Score =9.0; E_value=6; Accession=PF00560.23; Description=Leucine Rich Repeat
  Pfam annotation: Domain name=LRR_1; Domain location=434-456; Score =6.2; E_value=20; Accession=PF00560.23; Description=Leucine Rich Repeat
  Pfam annotation: Domain name=LRR_1; Domain location=54-76; Score=8.9; E_value=6.1; Accession=PF00560.23; Description=Leucine Rich Repeat
  Pfam annotation: Domain name=LRR_1; Domain location=78-100; Score =10.8; E_value=2.7; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1::LRR_1::LRR_1; Domain location=102-124::126-148::150 -173::221-243::246-265::...
  Pfam module annotation: Domain location=288-311::29-51::316-335::340 -362::364-386::388-409::4-22::410-432::434-456::54-76::78-100
MLPSLIELHLQRCQLENIYPFLQYANFTSLQALKLSGNDFESELPSWLFNLSCDISYIDLSQNKIHSQLPKTLPNLRRVKFLTLSQNYLKGPIPNWLGQLEQLQGLDLSHNFFSGPIPASLGNLSSLTTLVLDSNELNENLPDNLWHLFNLERLSILKNSLTGIVSERNLLSFSKLRWFAMSSPGLIFDFDPEWVPPFQLQHLTLGYVRDKLPAWLFTQSSLKYLIIEDSTASFEPLDKFWNFATQLKFFNLVNNTINGDISNVLLSSEHVWLASNNLRGGMPRISPDVVALTLYNNSLSGSISPLLCDSMKNKSNLVHLDMGYNHLTGELTDCWNDWKSLVHIDLGYNNLTGKIPHSMGSLSNLRFLYLESNKFFGEVPFSLNNCKNLWILDLGHNNLSGVIPNWLGQSVRGLKLRSNQFSGNIPTQLCQLGSLMVMDFASNRLSGPIPNCLHNFTAMLFSNASTLKVGFLIHLP

SEQ ID NO: 211022 - protein, 211 aa, Glycine max
  Coding DNA Sequence Number=SeqID_94244
MSSSAHLVNRGQRASWHAEIYVVFRTVNLCQYKPSIAANEPDDMRKFTSSSAQPRARRHADTDVVFYTIFQSWPTSSLKPRDLHRPPHPEHDSMQKLTWSSAPLVNRGQQARWHAEIYVIFRGVNLYTEHVSIQKLASSSAPFVNRGQQAHPEHDSMQRLTSSSAPFVNRGQRAHLHVEIYAVFRTVNPEHDNIQRLTSSSAQFVNRGQRA

SEQ ID NO: 211023 - protein, 44 aa, Glycine max
  Coding DNA Sequence Number=SeqID_94245
MTLVSACCRALGLMDSKRVFMRKNHLGIFACPQPSRRLTARMMT

SEQ ID NO: 211024 - protein, 95 aa, Glycine max
  Coding DNA Sequence Number=SeqID_94246
MQRMDLCMQHLADQQAANHRGQVQLNDSFYQYTLHQQRQDPSPYPWPTLEQFRANVAWLRDRPNFQAGAGPIEAPGDEDEAEEDGDMENEMDFFL

SEQ ID NO: 211025 - protein, 124 aa, Glycine max
  Coding DNA Sequence Number=SeqID_94247
  Subcellular localization annotation: CTP_CleavageSite=78; ConfidenceScore=5.07e-01
MAVPSLTPVPLLPIAAPPAVPASVSGGTPMPLIPLAAPPQEETPFFVKGTPYSKFAGLKQSFSYLCQILELSRSLTTRVSGTPYLGGSPLPQTSRRHIFYVSRQKKAKTEARECQSTLIRGPHQ

SEQ ID NO: 211026 - protein, 212 aa, Glycine max
  Coding DNA Sequence Number=SeqID_94248
MTEREEKQKNVHSSWARVYVEGAVHGGTIIVTTIFGCAIRKKEKGKKRKKKRKWGRVVGNRFLKRRAMVEANEKGRGKEKNMNFDGAMKGSLSTKVEKTENKKAELRCSTPVTTQSRGSLSVLIKNTKGYQGRGQNGPFWVFLDPSSPKLASGSPGPSNNFMVKKLARLGELVTSGLRFNLPRRAPARLGKLQLPQSDHLPINRRPRGVLRG

SEQ ID NO: 211027 - protein, 126 aa, Glycine max
  Coding DNA Sequence Number=SeqID_94249
  Gene Ontology: Mol. function=nucleic acid binding
  Homolog annotation: Hit_ID=Q1SKJ3; Match level="QueryCoverage=88%, HitCoverage=12%, E-value=2e-26, Identity=46%"; Hit description=Zinc finger, CCHC-type; Endonuclease/exonuclease/phosphatase
MAKKASEDSLCEIGSLSERKIEVPLEIERGFDLMDVTHGFFMIKFDLDIDHDKAINGPPWTIYDHYLIVHPWTLEFSVADATVEHTLAWVCLPSLGKIFYDENVLLSIASAIGTPIKVDHQMLDMA

SEQ ID NO: 211028 - protein, 76 aa, Glycine max
  Coding DNA Sequence Number=SeqID_94250
MRMMADPHTSGMIVNSRPATNAKTHEMISNLDNQNDMGIDLQPPNTSSMSTGSSLTSTMLTKLVNGFQIVGMEVEQ

SEQ ID NO: 211029 - protein, 85 aa, Glycine max
  Coding DNA Sequence Number=SeqID_94251
MHNFKQFITIKSLIHESAIKMIQEDILVSYPMYPLVKKIKSFMQLEWVPHFSHTLQKGQPSGKRSMVCLSILSPKFLVDSLRSSH

SEQ ID NO: 211030 - protein, 101 aa, Glycine max
  Coding DNA Sequence Number=SeqID_94252
MLTDQVIRKTHNNFLIAVYAIAGNTGGKKKRFTTLTSTVDGHETPSTAKKKKKNEEEVETRRMKKQEGPRKKKQEGPRKKKQNRGTGETGEGYFFEKVLRG

SEQ ID NO: 211031 - protein, 157 aa, Glycine max
  Coding DNA Sequence Number=SeqID_94253
  Gene Ontology: Cellular component=chloroplast thylakoid membrane
  Homolog annotation: Hit_ID=Q9LU01; Match level="QueryCoverage=96%, HitCoverage=28%, E-value=8e-16, Identity=47%"; Hit description =Arabidopsis thaliana genomic DNA, chromosome 5, TAC clone:K15C23
FGASQEKAGLDLRRGHVQHKVRPESRPWLMMVIMMFYDMRPMNDLVKLTIMIEDAREVERRRLLGIEDLDGPTREDLVDALDEVHLCSMRLGSGTLCLCDNGIVQQGLVSIGHFRVGKQIADIFMKINEGKIPKDRAALQMLAEELASWPNLEFIEF

SEQ ID NO: 211032 - protein, 55 aa, Glycine max
  Coding DNA Sequence Number=SeqID_94254
MEMAGSMDIRIPCIKSLPSRLVHALRSGSVAVAQWRVRWCKVWRFKVLEHVGSLV

SEQ ID NO: 211033 - protein, 60 aa, Glycine max
  Coding DNA Sequence Number=SeqID_94255
  Gene Ontology: Cellular component=chloroplast thylakoid membrane
  Homolog annotation: Hit_ID=Q9LU01; Match level="QueryCoverage=81%, HitCoverage=17%, E-value=7e-11, Identity=62%"; Hit description =Arabidopsis thaliana genomic DNA, chromosome 5, TAC clone:K15C23
MEDALPKKKPSKSLYAKATDTGIDPELAAKKLNIDWDSAAEIEEQNADDETEVPPVVVSS

SEQ ID NO: 211034 - protein, 74 aa, Glycine max
  Coding DNA Sequence Number=SeqID_94256
MWEHVNDMNTMVDSLETPNVARKLFQRIIVPCLLLYHSREDIAHLKLVNGKGLTFNACKLSTQYNFIQLQDLNM

SEQ ID NO: 211035 - protein, 63 aa, Glycine max
  Coding DNA Sequence Number=SeqID_94257
  Subcellular localization annotation: CTP_CleavageSite=22; ConfidenceScore=5.01e-01
MARCILSHVLAFALVAALSLVNVAQSQSANATTDPSEGLNFWEFSQFQFCRGFREIANSSSLT

SEQ ID NO: 211036 - protein, 121 aa, Glycine max
  Coding DNA Sequence Number=SeqID_94258
  Gene Ontology: Mol. function=protein serine/threonine kinase activity; Cellular component=integral to membrane; Biological process=protein amino acid phosphorylation
  Homolog annotation: Hit_ID=Q7F106; Match level="QueryCoverage=46%, HitCoverage=5%, E-value=2e-13, Identity=61%"; Hit description =Putative Receptor-like serine/threonine kinase
  Pfam annotation: Domain name=LRR_1; Domain location=22-43; Score=9.7; E_value=4.3; Accession=PF00560.23; Description=Leucine Rich Repeat
  Pfam annotation: Domain name=LRR_1; Domain location=46-68; Score =16.8; E_value=0.081; Accession=PF00560.23; Description=Leucine Rich Repeat
  Pfam annotation: Domain name=LRR_1; Domain location=70-92; Score =15.1; E_value=0.26; Accession=PF00560.23; Description=Leucine Rich Repeat
  Pfam module annotation: Pfam domain module=LRR_1::LRR_1::LRR_1; Domain location=22-43::46-68::70-92
MVAFGSNKFRGSLPSELGKLTNLEEIWASDTELTGKIPDFIGNWSKLQSLRFQGNSFNGSIPSSFSNLSSLTELELKNNNISGLIPSTIGELHNLNQLCQLESKKLVNVVIPWYISDLSIG

SEQ ID NO: 211037 - protein, 110 aa, Glycine max
  Coding DNA Sequence Number=SeqID_94259
  Gene Ontology: Mol. function=protein binding; Biological process =protein amino acid phosphorylation
  Homolog annotation: Hit_ID=UPI00000483AA; Match level="QueryCoverage =54%, HitCoverage=5%, E-value=3e-13, Identity=58%"; Hit description =ATP binding / protein kinase/ protein serine/threonine kinase/ protein-tyrosine kinase
MCLKNTQNIIILTWVKLPYKYCKRVRFSMLGGREPVNGSEESIQIGEREIEKIQCCDATSSSIVIGTITFDQWVEGCIINEGSVDGSSSTKFTANIPMSWVCQYIPFLKD

SEQ ID NO: 211038 - protein, 141 aa, Glycine max
  Coding DNA Sequence Number=SeqID_94260
  Homolog annotation: Hit_ID=Q1SKZ9; Match level="QueryCoverage=85%, HitCoverage=31%, E-value=8e-08, Identity=26%"; Hit description=Zinc finger, CCHC-type
  Subcellular localization annotation: CTP_CleavageSite=10; ConfidenceScore=5.23e-01
MELGQGNLVSFSSSPSVSLQPKLPDPPTLMPHHDFPSRTRYLGNKQNQKMFRNLLMERVMKLEYDGLNRLLFKFFLEKALFEELCQPWKKFLVIKILGKNINTDHDKAINGRPWMIYDHYLIVCPWTPKFSIVDATVEHTL

SEQ ID NO: 211039 - protein, 107 aa, Glycine max
  Coding DNA Sequence Number=SeqID_94261
MTNVFEFSSLGEVSLCQGEQSNRKCHASIKIIHYDEVCLWQGESTNRATLRLKPKFAIPRFPSTMANIKHQRYYRVEVISLQQGVNCCNDFTPTLLSMIGAEIFKKT

SEQ ID NO: 211040 - protein, 282 aa, Glycine max
  Coding DNA Sequence Number=SeqID_94262
MEDLFKMWNGHLDNTRSRVSQPPLINCDFCGGKHYNDNCYFYSMNNSGWRQELNPYSKYEEERIPNLESVFEEFMAYHASSKANQNSMQNQELHFGKSYSIESYQVGSELQPYNQNEAERGSNLDNLLIQFKETTESTQRAIKSAKIQVGKLAEEVTQFVARREEDFVEVEAQEESPAKEHDSRGKHEEKGEEKVQQWEKYPTIENQQESILQVNTFPHQLIIKEERQGEHEKALSVILSLITNTSSAMSWKVLPKYMKFMEFLAKRQNYKEDVLYVTFMPP

SEQ ID NO: 211041 - protein, 120 aa, Glycine max
  Coding DNA Sequence Number=SeqID_94263
MGARDISIIHRVLSWVLIHKCGIIIREIHYWCGHWRCLRSSGVQYSCGSPVWPHHHPSAPPEVPGLRRPHLLQKKKAGLLVKPPAEETPPSSCLVDAEPDSVDAEAPGIEPGVCSIASAL

SEQ ID NO: 211042 - protein, 282 aa, Glycine max
  Coding DNA Sequence Number=SeqID_94264
MQNSLSANLRAKPNFLSGISNFCSGLNEFARLAHEYENSNINFARLAKVCVEGLQNPNLSRVFDELAKRDCALSEVISFACFFGFPDELAKHGPDLLSEFIFSDEGLNPGLSEFISLSPRNLCLFLNGCLSAKPALLAKRTIFSVFVIFGTGLSEPCSLSHLFFQRLCRAKRTLCAKRNLFSVFELGLTSLLAKPIMQWLLGNERPQLLDLRLIMIQLDLHLKLLGTAIPSGAGSPTMYPWQGICAECRGPTMEASKKRPHDSDGDLERIVLLQPCPHITYF

SEQ ID NO: 211043 - protein, 283 aa, Glycine max
  Coding DNA Sequence Number=SeqID_94265
  Gene Ontology: Mol. function=protein serine/threonine kinase activity; Cellular component=integral to membrane; Biological process=protein amino acid phosphorylation
  Homolog annotation: Hit_ID=UPI00000483AA; Match level="QueryCoverage =98%, HitCoverage=32%, E-value=6e-59, Identity=37%"; Hit description =ATP binding / protein kinase/ protein serine/threonine kinase/ protein-tyrosine kinase
  Pfam annotation: Domain name=LRR_1; Domain location=111-133; Score =11.4; E_value=2.1; Accession=PF00560.23; Description=Leucine Rich Repeat
  Pfam annotation: Domain name=LRR_1; Domain location=135-157; Score =6.6; E_value=17; Accession=PF00560.23; Description=Leucine Rich Repeat
  Pfam annotation: Domain name=LRR_1; Domain location=159-181; Score =10.6; E_value=3; Accession=PF00560.23; Description=Leucine Rich Repeat
  Pfam annotation: Domain name=LRR_1; Domain location=183-204; Score =4.5; E_value=41; Accession=PF00560.23; Description=Leucine Rich Repeat
  Pfam annotation: Domain name=LRR_1; Domain location=207-229; Score =16.8; E_value=0.077; Accession=PF00560.23; Description=Leucine Rich Repeat
  Pfam annotation: Domain name=LRR_1; Domain location=231-253; Score =16.1; E_value=0.13; Accession=PF00560.23; Description=Leucine Rich Repeat
  Pfam annotation: Domain name=LRR_1; Domain location=255-277; Score =10.7; E_value=2.9; Accession=PF00560.23; Description=Leucine Rich Repeat
  Pfam annotation: Domain name=LRR_1; Domain location=63-85; Score=2.3; E_value=1.1e+02; Accession=PF00560.23; Description=Leucine Rich Repeat
  Pfam annotation: Domain name=LRR_1; Domain location=87-109; Score =15.7; E_value=0.17; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1; Domain location=111-133::135 -157::159-181::183-204::207-229::231-253::255-277::63-85::87-109
MNAARALNSIFSKWDILANPTQWNISSELCSGRAIDATTTIDDTTFNPFIKCDCSYDSRTTCRITALKVYAMSIVGTIPEELWTLTYLTNLNLGQNYLTGSLPPNIGNLTRMQYLSIGINNFSGELPKELGNLTELRSLAFGSNKFRGSLPSELGKLTNLEQIYFDSSGISGPIPSTFANLKNLLHVGASDTELTGKIPDFIGNWSKLQTLRFQGNSFNGSIPSSFSNLSSLTELELRNNNISGSISSTIGELHNLNQLDLSFNNITGQNLGSIFNLSSLTYL

SEQ ID NO: 211044 - protein, 64 aa, Glycine max
  Coding DNA Sequence Number=SeqID_94266
YTQNLQLLEELRFATAVSKLKFEHHLDSDIVDFEVLGSLVIMVCLIEMVVLAGTFGTNGLTLRC

SEQ ID NO: 211045 - protein, 69 aa, Glycine max
  Coding DNA Sequence Number=SeqID_94267
MWPKASAKDPGRSVHFAPHKHTQHPTYERGPKQVPKTLEGFFKGSVRHAMVVPKSEKMQKQVETNKNQA

SEQ ID NO: 211046 - protein, 46 aa, Glycine max
  Coding DNA Sequence Number=SeqID_94268
MEDCAVCTIVGDNVSLEFNLRSTCAYFIVEVAMSIRKGSHITGFHS

SEQ ID NO: 211047 - protein, 43 aa, Glycine max
  Coding DNA Sequence Number=SeqID_94269
  Gene Ontology: Mol. function=DNA-directed RNA polymerase activity; Cellular component=nucleus; Biological process=transcription
  Homolog annotation: Hit_ID=Q6ZA50; Match level="QueryCoverage=81%, HitCoverage=30%, E-value=7e-11, Identity=86%"; Hit description =Putative DNA-directed RNA polymerase II 13.6K chain
MNAPDRYERFVVPEGTKKFSYEMDTKIINASSFTIDCTETPMS

SEQ ID NO: 211048 - protein, 180 aa, Glycine max
  Coding DNA Sequence Number=SeqID_94270
  Gene Ontology: Mol. function=protein-methionine-S-oxide reductase activity; Cellular component=extracellular space; Biological process= response to oxidative stress
  Homolog annotation: Hit_ID=Q9C8M2; Match level="QueryCoverage=59%, HitCoverage=64%, E-value=1e-43, Identity=66%"; Hit description =Transcriptional regulator, putative; 35498-34111
  Pfam annotation: Domain name=SelR; Domain location=79-179; Score =163.8; E_value=4.5e-46; Accession=PF01641.9; Description=SelR domain
MASQSLSLPPTHIPYNRIIGKLDSKFLLWPSCAHIKPRRISTSIRAMGSSASSHSQSQYADSVESEAGADTIDYKSLTDEEWKKRLTNEQFYITRQKGTERAFTGSSTKFNSGTGWPSYYQTIGKNVKSKLDLSMIFMPRQEVLCAVCDAHLGHVFDDGPPPTGKRFCINSAALKLKPKQ

SEQ ID NO: 211049 - protein, 91 aa, Glycine max
  Coding DNA Sequence Number=SeqID_94271
MYVCSYFIKSFRLSHHQPQMRMLISWLSFSTFGNVLYPPMLCGKKARRIKLKVWHSTWLSIWMMRKGVKDGDGDPSVVIPDSILIPEVVVV

SEQ ID NO: 211050 - protein, 170 aa, Glycine max
  Coding DNA Sequence Number=SeqID_94272
  Gene Ontology: Mol. function=nucleic acid binding; Cellular component= endoplasmic reticulum membrane; Biological process=DNA integration
  Homolog annotation: Hit_ID=Q1S1X7; Match level="QueryCoverage=72%, HitCoverage=9%, E-value=8e-30, Identity=51%"; Hit description =Integrase, catalytic region; Zinc finger, CCHC-type; Peptidase aspartic, catalytic
MSNANPMSTPLAKHFKLYVDQCPKTNVEVEYMSKVLDVSAAVYLMYVMVCTRPSLTYVVSQVCKFMSNPSKRHWEAMKWSLRYLKDTASHGIMLGHQQGDPSVVGYMDSDYAGDLDDKRFTTGFHKIKELMTSGQILLEKVHTSKNATNMLTKVITIDKFKHCLDLLNVA

SEQ ID NO: 211051 - protein, 348 aa, Glycine max
  Coding DNA Sequence Number=SeqID_94273
  Homolog annotation: Hit_ID=Q75GP1; Match level="QueryCoverage=86%, HitCoverage=90%, E-value=1e-78, Identity=52%"; Hit description =Expressed protein
MSSQGTGSVVDFDLPDEILSVIPTDPYQQLDLARKITSMAIASRVSSLESDASRLRQKLLEKDRIILDLEDRLSSLTRASHQTDSTLNTALNENIKLSKERDQLAATVKKLSRDFAKLETFKKQLMQSLTDDNASHAETIDIGTCDQSVPKAYPDKDDDGSGYMVHHSYNGPADVGKTNDEASRYSGQRFSLTPYITPRLTPTGTPKVISTAGSPREYSAAGSPKKTSGATSPTKLPYDGRTSLSSWYSSSQQSSAANSPPWGRSLPVRTPKIDGKEFFRQARSRLSYEQFSAFLANIKELNAQKQTREDCLTVMHASTESSIAEYCMSWYEVAPYVMRTRPVIDVLN

SEQ ID NO: 211052 - protein, 65 aa, Glycine max
  Coding DNA Sequence Number=SeqID_94274
MTEVVVEIIEAMPLNAYNGVGDRRILRRSSRVHHVEDNSFGSSLEQKMDILAKQMKIIVIDRYMW

SEQ ID NO: 211053 - protein, 570 aa, Glycine max
  Coding DNA Sequence Number=SeqID_94275
  Gene Ontology: Mol. function=DNA binding; Cellular component=beta -galactosidase complex; Biological process=DNA integration
  Homolog annotation: Hit_ID=Q1SLU3; Match level="QueryCoverage=84%, HitCoverage=40%, E-value=1e-137, Identity=45%"; Hit description =Integrase, catalytic region
  Subcellular localization annotation: CTP_CleavageSite=23; ConfidenceScore=5.62e-01
PNSDYPPFHTTPTPHNTADPHLPAASSSPPSQQTSFSPSPIPEFTNPISPPLSTSHPSPIHSPTPQSSPNNRIPFVPRRSSRPHQPPVRLADYICGSVQNQPSQSSSTCLYSIRSALSYSHVSESDRHYLMNLSSEIEPHNYQEAISQQCWHDAMRDEIAALKLNNTWEIVDTLANVKPIGCKWGIDFFETFSPVVKMTTVRVILALASIYRWDLQQLNVSNAFLHGDLSEEVYMSIPSGLQGHGSPQCCKLKKSLYGLKQASRKWYEKLYTLLVSSGYQQAHSDHSLFVKHYNGTITALLIYVDDIVLTGLEVNQYDEGICVSQRKYCLELLTNSGMMGHKPSSTPVDNSMRLRQNDSSDFLDDPLSYRRLLSQFMAHPTKSHLGAARRVLRYLKSCPSKDLFFKRDSPTHLIGFNDADWATCVDTRRSITEAEYRALATNTCELQWLSYLLDDLKITCTKSAVLYCNNQSALYIAANPVFHEHTKHLEIDCHLVREKSQAGLMRLLPVPSCHQLANMFTKALPPRSFTSNVSKLELVDLYTPTTCGGLTENGPKPLEEAHDNLAHINP

SEQ ID NO: 211054 - protein, 161 aa, Glycine max
  Coding DNA Sequence Number=SeqID_94276
MLQPYGINIGLKEHSNPVTPKAYTPKSPSGPLPPDSVDPITILVALKGSYNCVIAQFIVHNSIHTSHLNTHFYQDSSGFLRERKRLQCEGFFSRFRHDIEIPNGENSRNCVANMILKFHDDPTVNGFEIVVFLRLFWWAVGKRKGFERRRGKTKMRPKGDN

SEQ ID NO: 211055 - protein, 384 aa, Glycine max
  Coding DNA Sequence Number=SeqID_94277
  Gene Ontology: Mol. function=transcription regulator activity; Cellular component=nucleus; Biological process=regulation of transcription
  Homolog annotation: Hit_ID=Q2HRT7; Match level="QueryCoverage=87%, HitCoverage=57%, E-value=2e-26, Identity=30%"; Hit description=Basic helix-loop-helix dimerisation region bHLH
MPLYELYRLAREKLGKETTSTRAPDQCSSPKARDKDVGYGTYTRLGKFGDLDSGLNEIPMSMPSNEVDFCQDEDVLPWLDYPSIYRWDSQKTYEEQWNVFKGSSAGQVETPRPKASSTSQALDVTKNNNMSNANQDVSYGEITYILSSSSDFSNAKVQKCDPPMNSNGSSSTIMNFSHFARPAAMVRANLQSIGLKSSLSSSRSDSMEMKNKGVVATSRIPPESIHIDSSGECLKEPTMQCQQVVEQSKVDSEPAGKESSTKIDLFPNQVLGDSGTKGQTAAEKSKEPTKVQKSQNQILKQKRKDTDDYEYHSEDVEEEPAGSKKTTGGRGGVGSKRSRAAEVHNLSKRALDLLHQWSPLLLEDECQRNGEGRKMIGDTTSRRR

SEQ ID NO: 211056 - protein, 56 aa, Glycine max
  Coding DNA Sequence Number=SeqID_94278
MESLNLNCYTKTSVCRCGEGEGTGVERCGGHQRQTRYTKVVALSGTYGSLTDQLHP

SEQ ID NO: 211057 - protein, 74 aa, Glycine max
  Coding DNA Sequence Number=SeqID_94279
MRFTRNPIALGIVAAQAVFYFPGVGEAATLGAYNPRDNDQQSGALIVNGGSATLTGNQAFEPGIDGAVNTTLGQ

SEQ ID NO: 211058 - protein, 95 aa, Glycine max
  Coding DNA Sequence Number=SeqID_94280
  Pfam annotation: Domain name=zf-CCHC; Domain location=30-47; Score =15.8; E_value=0.0025; Accession=PF00098.13; Description=Zinc knuckle
MMKKKGKFQHSYKRNDTIFKKKYKEQSNEIICFECSKPGHMKDEHPQPKKKRYFRDKKKKSLMVTWDNPDNEKSSSSNNEQANVYLMANTDKKVE

SEQ ID NO: 211059 - protein, 256 aa, Glycine max
  Coding DNA Sequence Number=SeqID_94281
MPDTLPCLVALGQKQLDRNYTKVCMGCLVGNFQEMADQDYELPMVGLPESGSTGPNLARKWRNNAGKMKRHRVTGNKEELLILGSLATDNEERSQRKAPSRIVDKLVTIQRRFLWGGGSEQRKIAWVKWKTVNSALKKETEWRMGRGDKCRFLEDCWVDNDVPLMLKYPRLYQISCQQQQTIKQMGSNIGAAWEWQLNWRRPLFDSEIAMADDFLGEIAQKEIHPHRADSWVWKPEPGGQYSSKSTYDGGNSRCCF

SEQ ID NO: 211060 - protein, 334 aa, Glycine max
  Coding DNA Sequence Number=SeqID_94282
MGEKDMWLKFKKWGDVREDVKLLEQQLDSMVINGLKLHANLPKHGRERTTDRKTNSEVQSKVGMNRSRAYVDGQEHNRNDAVLNVGDERNSGVEISDINNIPLLIAAEHTHGTEDEFMWEARQEVKPKYLGDDMVLLVGLNNTRAEELCNTEEDNKMSLFHSLEKWNPGLQIGYRLDEQFRKVVCDWWTSHSIQGWGGYVLKEKMKGLKQRLKVWNKEQFGDIQKKISRIELELNMLEVDGVGRQLSDREIELRKKLQEELWVATTSYESLLRQKARTKWIKERDCISKFFHITVNGNRKHNSLRGLWVDGCWTEEPIRIKEEVSGLMDSGGFL

SEQ ID NO: 211061 - protein, 378 aa, Glycine max
  Coding DNA Sequence Number=SeqID_94283
  Gene Ontology: Mol. function=GTP binding; Cellular component =intracellular; Biological process=regulation of transcription, DNA -dependent
  Homolog annotation: Hit_ID=Q5N3G3; Match level="QueryCoverage=75%, HitCoverage=77%, E-value=5e-85, Identity=59%"; Hit description =Probable GTP binding protein
  Pfam annotation: Domain name=MMR_HSR1; Domain location=92-220; Score =34.6; E_value=3.4e-07; Accession=PF01926.13; Description=GTPase of unknown function
MGREDTKIIVISFCGSINIWELESIDSKQECLIKVDEEWSMSKISKLSSIFGDSYFTTAKTKVLSIPLGEVDYMDHMMPFGSIKDWRVEIHTFFVKVENGKAQAANFPFCTIEPNVGIVAVPDSRLHVLSDLSKSQRAVPASIEFVDIAGLVKGASQGEGLGNKFLSHIREVDSILQVVRCFEDNDIVHVNGKVDPKSDIDVINLELVFSDLDQIEKRIDKLKKGKAKDSQKLKEEAEKSALEKIREALMDGKPARSVTLTDFERDAVKHLCLLTMKPVIYVANVAESDLADPANNNYVKDVTNVVSELQSRIVTISAQVEAELTELPVEERQEYLQSLGVSESGLGNLIRATYDLLGLRTYFTSGEKETKAWTILAG

SEQ ID NO: 211062 - protein, 225 aa, Glycine max
  Coding DNA Sequence Number=SeqID_94284
MSEVEEVQEQMKTDIDAMKEQMTTMMEAMMSMRRMMEVNTTTVVVESTATKVDPTHPPGFNQVNRPASDMVGQGGEALGSTGGPYLVQVQNKHSFPPYVLPPNYTPPNVAHTPDENVKNSAPIPIESQQPQFGHAQVPLPMGGHMKYPETTLYPTLSLTSDMPLRDRHFVVYPCQTLWGASVSPTTTTFTFCSGKSTSCYGGKGKIRSYRRKAEGYLRRWRLCFC

SEQ ID NO: 211063 - protein, 149 aa, Glycine max
  Coding DNA Sequence Number=SeqID_94285
  Gene Ontology: Mol. function=RNA-directed DNA polymerase activity; Cellular component=chromatin; Biological process=RNA-dependent DNA replication
MEDEVEVVAMLWVLEKEIKENRELPVEKEELQNLLVEFMQVFAKPTRLLPHREVIHKIQIKAREDPINVRPYQYPYIHKNETKKQVDEMLSIGVIQPSNSEDYFAEFRHLLRRGKTYVLENFSAVRSIGEWRVNIIGVVVDIIVRCRCG

SEQ ID NO: 211064 - protein, 716 aa, Glycine max
  Coding DNA Sequence Number=SeqID_94286
  Gene Ontology: Mol. function=RNA-directed DNA polymerase activity; Biological process=RNA-dependent DNA replication
  Homolog annotation: Hit_ID=Q1S7B8; Match level="QueryCoverage=52%, HitCoverage=51%, E-value=4e-41, Identity=31%"; Hit description=RNA -directed DNA polymerase
MPNIIDDDGKQSLDDEGTDDTDTTRCVPLPDSPRPNDCLLGEARQPWSQFPSSKNRARPDSKNAWKQPALPYPTTDTGTQLWKILKNKAEKRKVGGSRGGSSEDEEGEYCADEERVEKGMSSESGPTEMSPAPTGQISNPGRDITIGVHWAAIRRLVRRHKADMLCIQETKREQIDKAMCQALWDDLDVGWEFMPAINTAGGLLGGQVNNINDFNEWIADIECEEIPSARAMEEAKRRHKPCMVFKVDYERAYDFVSWSFLSYMMKRLGFCPRWICWIEGCLKSASVSVLVNGSPTKEFIPQRGLRQASLWGKTIVNILQNADDTIFFGEATMQNVKTIKVPSKVIAKLEAIKRRFLWGEGPEHRKIAWVNWKTVCQPKDKGGLGIKDIRTFNSALMGKWHWDLFRKQEEPWAKVIISKYGGWRALEEGTRGNHDSTCEKFRFWEDPWTHNGMPLMEKYLRLYHISCQQKTIIKKMGSSNNNGWEWKLTWRRNLLDSEVEMTDTFIGEISQQQIQPRREDNWVWKHDQSGDYSTKSGDRLPTKMNLRRRQVMVNDSMCPLCGLNEEKASHLFFSCSNTLPLWWESLSWVNLATTLPQNARDNYMQHETEIPSGKKLTRWKYSSASEWPLRDDIPYWFDQHAYNNEGQGSQDEKRWSSHLHSSLTQLHDSRPLYRTSSYPEQQRQLQHQLQHCSSEPVSNLYDQHFYDSETIEDGKR

SEQ ID NO: 211065 - protein, 166 aa, Glycine max
  Coding DNA Sequence Number=SeqID_94287
  Homolog annotation: Hit_ID=Q9LHJ0; Match level="QueryCoverage=98%, HitCoverage=26%, E-value=7e-28, Identity=42%"; Hit description =Arabidopsis thaliana genomic DNA, chromosome 3, P1 clone: MMP21
MAIFHHLRLLFGGLPSDLAAAETTSDLAKVVCQCVQGMDLGALGACLAAVVCSSEQPPLHPLGSTPGDDASRIIVSVLERTTELFTDPHGAGSYEGTPNVSAIGSDASKAISREMPVKLLRASLPHTNDHQRKLLLDFAQRSVPVVGFNSYTGSSSGLVNSETVLS

SEQ ID NO: 211066 - protein, 165 aa, Glycine max
  Coding DNA Sequence Number=SeqID_94288
  Gene Ontology: Mol. function=nucleic acid binding; Biological process= DNA integration
MKIIPYASKVESLMYAQVSTRLDIALAVRMLGRYQKDLGMEHWKAAKRVMRYLQGTKDYKLTYKYSNDLESSKKQTIVTSSTMEVEFIGFYKATSQAKWLKNFDYGLKVVNSIERPLKIFGNNSATVFFSKKNRSGSRSKHIDIKILVVREDIKRELISIEDIDT

SEQ ID NO: 211067 - protein, 140 aa, Glycine max
  Coding DNA Sequence Number=SeqID_94289
  Gene Ontology: Mol. function=protein serine/threonine kinase activity; Cellular component=membrane; Biological process=protein amino acid phosphorylation
  Homolog annotation: Hit_ID=Q5ZAV5; Match level="QueryCoverage=99%, HitCoverage=16%, E-value=5e-47, Identity=61%"; Hit description =Putative serine/threonine kinase
  Pfam annotation: Domain name=Pkinase_Tyr; Domain location=1-136; Score=-168.6; E_value=0.04; Accession=PF07714.7; Description=Protein tyrosine kinase
MNPKISDFGIAKMFTQQDSEANTTRIFGTYGYMSPEYAMEGIFSTKSDVYSFGVLLFEIVSGKRNNSFYTEERQLNLVGHAWELWKKGEALKLVDPALNNDSFSEDEVLRCVHAGLLCVEENADDRPSMSNIVSMLSNKN

SEQ ID NO: 211068 - protein, 66 aa, Glycine max
  Coding DNA Sequence Number=SeqID_94290
MTNILMEKLSSIKEERLKHEAPESAHMVTHNKGSGRRGNGVLGVCKTVQMKWNGTKMNCFSVMWDI

SEQ ID NO: 211069 - protein, 407 aa, Glycine max
  Coding DNA Sequence Number=SeqID_94291
  Homolog annotation: Hit_ID=P93655; Match level="QueryCoverage=19%, HitCoverage=9%, E-value=3e-16, Identity=59%"; Hit description=Lon protease homolog 2, mitochondrial precursor
MVRNTGGLRRACNASLEPFSVEEFTKKIEDLALKFQLYEENTNTNDLDSEDFQEISLSLVNFTEEFELLEEIIPANIQWKTNNVELMFLLRIIKKKLQWKEGFKEAGESAYCTVKKGFSSQFHYADDGSFGSTKICKGFSKGCRTCMTMNACIPRSVAVVCFLTSSLVSLTTCLPHEPFVNLTLTLTALKPLSLLVSRSWFHSHSHGTETTLRSCLTLAHGVGVTVTLALTVCFSLEAFFDSEIMDLIILVVFDSVLVGFDSVLDIVLVVHGSDFKYPWGSTDPDWSPVSKDPLTAKVDNLKDKTYNKDNNIIKAMSLSTLRDVLKTSPRWRDHVQTYTKVLANFLSNPLASGGDNDEVGWPYVRSDLDPSQVKGLGMLKHMAKIRMVVQCHHKGSRMAWTIARKLI

SEQ ID NO: 211070 - protein, 582 aa, Glycine max
  Coding DNA Sequence Number=SeqID_94292
  Gene Ontology: Mol. function=protein serine/threonine kinase activity; Cellular component=membrane; Biological process=protein amino acid phosphorylation
  Homolog annotation: Hit_ID=Q17U57; Match level="QueryCoverage=96%, HitCoverage=83%, E-value=2e-83, Identity=37%"; Hit description =Receptor protein kinase, putative
  Pfam annotation: Domain name=B_lectin; Domain location=83-204; Score =62.7; E_value=1.2e-15; Accession=PF01453.15; Description=D-mannose binding lectin
  Pfam annotation: Domain name=PAN_2; Domain location=318-382; Score= -5.4; E_value=0.0048; Accession=PF08276.2; Description=PAN-like domain
  Pfam annotation: Domain name=Pkinase_Tyr; Domain location=492-582; Score=-152.1; E_value=0.0039; Accession=PF07714.7; Description =Protein tyrosine kinase
  Pfam module annotation: Pfam domain module=B_lectin::PAN_2::Pkinase _Tyr; Domain location=83-204::318-382::492-582
MTCSEQEKPHHVLLFLIYMWLWWSTTCIHVEANDSLKPGDTLNATVPGAELCSKKGKYCMSFDPITHDNQEAVYLTICAQKKDDWEVWVANRNQPVDSNSAVLSLDHKGVLKIESQDGKKKVKKSPIILYSPPQPINNTLATLLDTGNFVLQQLHPNGSKIRVLWESFDFPTDTLLPGMKLGLNHKTGGTNWSLVSWLSGQVPTAGPFKLEWEPKTRELLIIKRGGSSSSGGKRVLWASGNKLEHIPSEIRREIVPSETGDYFTLKSSDSEEEPTKWTLLSTGQLINRKGVDVARADMCHGYNTDGGCQKWDAILPSCRRPGDAFELKYGYPKWDTEVKRDEENSSYGISDCQEICWRNCSCVGFALNHRNETGCVFFLWDLVKGTNIANEGYKFYVLVRSNHQNRIKQWIWAMVATVATILIICLCILRRVLKKRKHVLKENKRNGMEIENQDLAASGRSSSTDILEVYLKEEHDLKLFSYASIIEATNDFSSENKLGQGGFGVVYKGILSTRQEVAVKKLSRSSGQGLIEFKNELTLISKLQHTNLVQLLGYCIHEEERILIYEYMSNKSLDFILFGKKG

SEQ ID NO: 211071 - protein, 758 aa, Glycine max
  Coding DNA Sequence Number=SeqID_94293
  Homolog annotation: Hit_ID=Q9M3G7; Match level="QueryCoverage=39%, HitCoverage=5%, E-value=8e-17, Identity=29%"; Hit description =Serine/threonine-protein kinase ATM
MGLWFPLVSYKLLICLRIIFPFITGFDSRDRRKSKYLSYPYIGPNQKDLPAETEDLKTPCPSQKARASSVTTNPLNGSSSYAKLGSKRFRNSWYKKFISCNTMPSHYNFMNASAEELLSGLCSTAVDCMFPVGNKSFDLVEWFFCRYRVSNYHDEAELATSQVNAKEEKLGKPEGNDLPDTKSKKRKTNRMENAVRRKRKSLSGLSDVNVNTSNGDSQRPGRKLKQKRKVEEVTLVHQLQNVEINFIGVSSKYSSAPQAAQNLCCLASEGKSEHNQREKIEAQEHQTAQINSVYTDAKKLNCSSLVIDLQFTPPAIPVDIPERNRSENTEEIVLLASNPESRVSQEGPVGSITDHSLLVSTKAEVGTVMVNKTGLMNSMGKATGLHLNTKLAVGVPLNSMGKAAAAGVHLNAKLAVGMPLNGMGKAAAGVHLNTKLAVEKKGLKNSMEKPAEKPLYTNFSTGKTGLKNSMEKAAEKPLYTKVAVEIPDLNGTGAECNSISTEFDTLNFISPELKSEQSKSLSACSRSAKTTTCNRLDDSGESLGTCVILKFAPVAYIPSKEDLMTTFCRFGPLKASETQLLKDTGSAQVVFVRSEDAAAAFHSIEQNNKFAFGCSLVDCKLHHLSATCPPVEQLVTTAQPTGFMAIPGVMTPTRPTMSMEMPGVTPTQPAGSIATPGVTPTQQPTGSKAVPGVTPILPTGSMTMPGETPPSLHFIKQNLQMMTSILENSGSSLSPKTRAKLDSEIKNLMRKVNSRTKV

SEQ ID NO: 211072 - protein, 101 aa, Glycine max
  Coding DNA Sequence Number=SeqID_94294
MDKEALCWNYTLLEQIFKVEDSEAILRTPLLNVDQQYTKICGYTSKGVHLVNSEYNRPELEAEAILRARDKFVSGCEILEVKETSSPLVFLQSFILFFSLL

SEQ ID NO: 211073 - protein, 188 aa, Glycine max
  Coding DNA Sequence Number=SeqID_94295
  Homolog annotation: Hit_ID=Q1S6A6; Match level="QueryCoverage=41%, HitCoverage=19%, E-value=3e-15, Identity=39%"; Hit description=FAR1
MDKSLKVGKEEWKEKERGSTKFCASKEAHENPRAFSCISGPIYLESSIQCPCRGYTVLKFQAFGVVTKKFDSDSENEVVTNVGNENNDDKAANMMPMNGILPIQMSWGFRDKKHFIRNNRKKDHRPLTCTNCEARLHARLDKDTDKAEVDALHRQGVRTYHIMGFMLDQKGGHIGIGFNKRDLINHIK

SEQ ID NO: 211074 - protein, 96 aa, Glycine max
  Coding DNA Sequence Number=SeqID_94296
MIPLKEYARLIETKLLRMRKALAQALEDKTYAKKEANKCPIPLSSDSDDSSDMFLRKLDEEAAKQKGKKKPWIFFINEVLCFLKINGSGIEKEKDD

SEQ ID NO: 211075 - protein, 78 aa, Glycine max
  Coding DNA Sequence Number=SeqID_94297
  Subcellular localization annotation: CTP_CleavageSite=51; ConfidenceScore=5.26e-01
MVVSGGGGGVRVSGLRLRRKRAQNTETSSKQLFMLKAIPLGLGFARSASFRAKRNSSWVGITLSMLLSLRGMPKKFIL

SEQ ID NO: 211076 - protein, 93 aa, Glycine max
  Coding DNA Sequence Number=SeqID_94298
  Subcellular localization annotation: CTP_CleavageSite=54; ConfidenceScore=5.38e-01
SFRRQAHHLVLTIAFTFASPSSPLIPTKSITCTSYPFTFLSEAFLQQVAWPGVQPSSIKGGDTSNMGNNGADDDYIAGITVAHEAWDPGPTQD

SEQ ID NO: 211077 - protein, 132 aa, Glycine max
  Coding DNA Sequence Number=SeqID_94299
  Homolog annotation: Hit_ID=Q2R037; Match level="QueryCoverage=45%, HitCoverage=18%, E-value=5e-08, Identity=47%"; Hit description =Expressed protein
  Subcellular localization annotation: CTP_CleavageSite=57; ConfidenceScore=5.79e-01
MASMSSLWPPTPSASSPPPAPSITSSTSSMSIPTPPLPPSRLLPLKLKFGKCTSIPRKTYFWHCIESFWHPSCPLSLSLERNNSARSESGFVGVVSSMASNQRLVVDWWAEDLTLLRILIFACQVSPEASKC

SEQ ID NO: 211078 - protein, 295 aa, Glycine max
  Coding DNA Sequence Number=SeqID_94300
  Gene Ontology: Mol. function=RNA-directed DNA polymerase activity; Cellular component=membrane; Biological process=RNA-dependent DNA replication
  Homolog annotation: Hit_ID=Q1T0R3; Match level="QueryCoverage=64%, HitCoverage=99%, E-value=2e-33, Identity=40%"; Hit description =Hypothetical mitochondrial protein atmg00310
MENVKAIKVILRSFELVAGYTNWGKPKAMPTMGSYYQQVVPCKVVDKPVRLQRRFLWGGGADQNKIVWIKWETVCRSKEEGGLGIKDIRNFNLALLGKWKWSLFYHNGDLWAKVLESKYGGWRNLNVASSDPTDSIWIKFWEDNWINDDISLVAKYPRLYSISNQQNHVIQQVGAHTNSGWEWDFRWRRSLFDSEVTIADSFLNDIEGKTVHPCRRDEWVWKAEPSGIYSTQSAYNLLQGEIIEASNYGVFAELWNAVKLFISGGSHYLGLTPSWLYQKIPGCISFNIHLVGLLE

SEQ ID NO: 211079 - protein, 85 aa, Glycine max
  Coding DNA Sequence Number=SeqID_94301
  Gene Ontology: Mol. function=protein serine/threonine kinase activity; Cellular component=membrane; Biological process=protein amino acid phosphorylation
  Homolog annotation: Hit_ID=Q5XTZ4; Match level="QueryCoverage=68%, HitCoverage=18%, E-value=1e-17, Identity=69%"; Hit description=Salt -inducible protein kinase
MVVEVISPAYLWLFLAFYLEGGIVNNTLRPIIPSNCDHEWRALMEQCWAPNPAARPSFTEIASRLRIMSAAAASQTKTQGNKASK

SEQ ID NO: 211080 - protein, 39 aa, Glycine max
  Coding DNA Sequence Number=SeqID_94302
MPNEGRDKYYIPTIPNSIQIKETRDGKTESRIKCKQQAN

SEQ ID NO: 211081 - protein, 103 aa, Glycine max
  Coding DNA Sequence Number=SeqID_94303
MYLSKIRASLRRLASLRRVREFMKFSKRHHFEAELLPYSRVATPWSCCVEADTHRFSLASSSLALSRGPPSSSVVAASLVLTCAPSFASCHNAKMKVMLPGLR

SEQ ID NO: 211082 - protein, 87 aa, Glycine max
  Coding DNA Sequence Number=SeqID_94304
MEPHMKINTVLHLDRVVLDHVVHYIFKTLTNELLVYLPDKTYERWSIIHNKCGLFQLGQRWHDFIGYFEIEENDSIKFIKFNKLIQY

SEQ ID NO: 211083 - protein, 288 aa, Glycine max
  Coding DNA Sequence Number=SeqID_94305
  Gene Ontology: Mol. function=transcription factor activity; Cellular component=nucleus; Biological process=regulation of transcription, DNA-dependent
  Homolog annotation: Hit_ID=Q339D4; Match level="QueryCoverage=51%, HitCoverage=31%, E-value=2e-14, Identity=31%"; Hit description =Chitin-inducible gibberellin-responsive protein 2, putative, expressed
  Pfam annotation: Domain name=GRAS; Domain location=106-288; Score= -80.5; E_value=0.00013; Accession=PF03514.5; Description=GRAS family transcription factor
MEDINRWLSFYVNGSVNHDFAIRKYCPARMEQEQRGEWQDQEAAVVFYDTELCSSSDATGGSTPCLVSSEVDDFVDGFVNMNSDDAYSMVNGGVFEYVPTTLEDSELEIHEALTTTMWEEEANLGVNQGLDLACAEAVGCRDNQQAELLLRRIWPLASPSGDALFCQRIEVENKMEAFQLLYQTTPYISFGFMGANEVIYQASQGKSSMHIVDLGMENTLQWSSLIRALASRPEGHPTLRITGLTGNEDNSNLQTSMNVLVEESSSLGMHLESQFLSLQLLLFLLWRS

SEQ ID NO: 211084 - protein, 271 aa, Glycine max
  Coding DNA Sequence Number=SeqID_94306
  Gene Ontology: Mol. function=2,4-dienoyl-CoA reductase (NADPH) activity; Cellular component=peroxisome; Biological process =metabolic process
  Homolog annotation: Hit_ID=Q9LTV6; Match level="QueryCoverage=91%, HitCoverage=83%, E-value=1e-108, Identity=77%"; Hit description =Peroxisomal 2,4-dienoyl-CoA reductase
  Pfam annotation: Domain name=Epimerase; Domain location=15-248; Score= -47.7; E_value=0.0049; Accession=PF01370.11; Description=NAD dependent epimerasedehydratase family
  Pfam annotation: Domain name=KR; Domain location=14-193; Score=-86.4; E_value=0.024; Accession=PF08659.1; Description=KR domain
  Pfam annotation: Domain name=adh_short; Domain location=13-188; Score= 54.0; E_value=5.1e-13; Accession=PF00106.15; Description=short chain dehydrogenase
  Pfam module annotation: Pfam domain module=Epimerase::KR::adh_short; Domain location=15-248::14-193::13-188
MESPFRPEILKGKVALITGGASGIGFEISTQFGKHGASVALMGRRKQVLQSAVSVLQSLAIPAVGFEGDVRKQEDAVRVVESTFKHFGRIDILVNAAAGNFLVSAEDLSPNGFRTVLDIDSVGTFTMCHEALKYLKKGGEGRSNSSSGGSIINISATLHYTASWYQIHVSAAKAAVDATTRNLALEWGTDYDIRVNGIAPGPISDTPGMSKLAPDEISSKARDYMPLYKLGEKWDIAMAALFLVSDAGLTTFSPRSQSTSSMLGMLHQIAQ

SEQ ID NO: 211085 - protein, 297 aa, Glycine max
  Coding DNA Sequence Number=SeqID_94307
  Homolog annotation: Hit_ID=Q1T1F7; Match level="QueryCoverage=44%, HitCoverage=28%, E-value=5e-16, Identity=37%"; Hit description=IMP dehydrogenase/GMP reductase
  Pfam annotation: Domain name=DUF1723; Domain location=126-175; Score =30.9; E_value=4.4e-06; Accession=PF08330.1; Description=Protein of unknown function (DUF1723)
MVKTRGLGHVLGRIVAREPEADIAGDEPMVDADAQDTGPKNGAQDIGAHDVADEPEGFPGGPRDLSVLTEYVDHVAASVWSGQERPELKLSSHGRKVHNLGRHVLAIEDMVVGTGLSPLIACSIDINNRGLISSFVERWHWETSIFHLPVGEVLIMLDDIASLLHLHIVGAIHDFQPLRTDEVVGLLVELLMVSVEALRDLTLAGWYAWGAAGLIHMYGQLNDVSLSTSRQLANYITLLQCWIYEHFSSVAECNANPDYDEVSPHVCRWIATKKTVKKVSTATYRQRLDRLRIPDVC

SEQ ID NO: 211086 - protein, 95 aa, Glycine max
  Coding DNA Sequence Number=SeqID_94308
MSYSSSYRDESLVVHRESMLENEVLGIGEESNSSFGSFVSLSLFDEENFQNLMKGPEITSVVKVVVETLSAVTLTPSLSSLMKKTLNIGNMGVIV

SEQ ID NO: 211087 - protein, 117 aa, Glycine max
  Coding DNA Sequence Number=SeqID_94309
RREAKCFALSQSTRLLLAPSGQTTLQVQAQKVLKQSPTPRAREGEALDQNLAGEKCGSCMCLMRKRRNWVGNKPRVHALIAKARLRPWMLRSSGDFASCPCASRSRGSIFVLHVLDV

SEQ ID NO: 211088 - protein, 1059 aa, Glycine max
  Coding DNA Sequence Number=SeqID_94310
  Gene Ontology: Mol. function=protein binding; Biological process =protein metabolic process
  Homolog annotation: Hit_ID=Q9LU73; Match level="QueryCoverage=99%, HitCoverage=99%, E-value=1e-162, Identity=38%"; Hit description =Arabidopsis thaliana genomic DNA, chromosome 5, P1 clone:MUL3
  Subcellular localization annotation: CTP_CleavageSite=92; ConfidenceScore=5.24e-01
MRSGACTLQQTLTAEAASVLKHSLGLARRRGHAQVTPLHVAATLLSLRASSLRRACLKSQPQTHSHSHSHPLQCRALELCFNVALNRLPTTPAAAAAGPLLHTQHPSLSNALIAALKRAQAHQRRGCIEQQQQQPLLTIKVELEQLIISILDDPSVSRVMREAGFSSTAVKSNIEDTSNSAPSVFYNSSGGGVFSSPCSPSPSENNNTASVFRQNHFLAAYTSNEFSTSPSPPLLFKKASVFPITESPPPSSSSKDDIKVVLDVLLRKKKRNAVIVGDSVALTEGLVGELMGKLERGEVPDELKSTHFIKFQLAPVSLRFMKRDEVEMSLSALKRKVDSVASSGGGAIFYVGDLKWTVEGTSETEEGGGVCGYYNPVVDHLVAEVGKLFCDSNTTKVWLLATASYQTYMRCQMRQPPLETQWSLQAVPVPSGGLGLSLHASSVHDSKVTISQNPSHMMETKFFSNNKEEQDKLNCCEECASNYEKEAQLFKPGQKKLLPSWLQSHTTEAHLKDELTQLKRKWNRLCHCLHQSKQPQNQWSNTLHGNYHSSNGKIYPYNSSYPCWPNQGSVFTDSSSISFADSPAAKPAYSSNNIVPRFRRQQSCSIEFNFSDVTQKKPSSTALDSLKGMEGNNSEVKITLALGNSTFGGSGQTVENIITTTDRTLRRAHICKLLQENVPWQSETVPSIAEALVDSKSAKPSATTWLLLQGTDSIGKTRLARAIAESVFGSVDFLLHLDMLKNNKENSATPFCEMVAGALKSHEKLVILIESLDFADAQFRKFLADGFETAKFGNLSMTEESSGQAIFILTNGDTRSNEEKKTNDSVMKLVLQISETKPTLESSPHCLGQKRRAEILDLFTKVKNPRVEEKEEGRKVFLRHSSFNHLDLNMKADEEEDDDEGEEKTGGSSPISSDLTRETVVDPLSWNGALESIENRFELNEGPEREREVADMFLSRIKESFEEVYDDDDGVVVNFTVEERVIEEIGVGCGNFTNSMFEKWLKDIFQSSLLQTVNFGDKGKEGGIGFTLCWGGKGDRKSDSDGFMGSCLPKNVQVNYFMD

SEQ ID NO: 211089 - protein, 139 aa, Glycine max
  Coding DNA Sequence Number=SeqID_94311
  Gene Ontology: Mol. function=nucleic acid binding
  Homolog annotation: Hit_ID=Q1SY00; Match level="QueryCoverage=55%, HitCoverage=23%, E-value=3e-25, Identity=61%"; Hit description=Zinc finger, CCHC-type
MHGSIRAPIQGSLQLGEASLECSKVNSCYGGAMNRKNLGGHLCKEVLGSLTLPVSILEIFVKGKEQWGHVDGTDSAPDKTTHMEAHAKWEVKDAQVITWIIGFVEPNIILNLKPFTTATKMWDYLKKIYNKNNCSHVSA

SEQ ID NO: 211090 - protein, 490 aa, Glycine max
  Coding DNA Sequence Number=SeqID_94312
  Homolog annotation: Hit_ID=UPI000051A418; Match level="QueryCoverage =88%, HitCoverage=42%, E-value=2e-22, Identity=24%"; Hit description =PREDICTED: similar to CG12753-PA, isoform A
MACGRFFMEKQVVAEFVRVLKLSRTVSIPLQLLQTVSIMIQNLRSEHAIFLWLNVFWSLKSNKWKIEQEYNFSACEDSQLNRFEPEACWTIGIPDEVVSFPLYVEAIRFAFHEENMIRTAVRTVTLNVYHVGDECVNRYITSAPHTEYFSNLVSFFRNQCMDLNRLVSETLKNPGPDSTSAIVAAVDEIEDNLYYFSDVISAGIPDVGRLITDSILMLLIFPMLLPSLRIVDTNDMQSGVVTSLYLLCCILRIVKIKDLANTIVAALFYPLETFTRFSRGKVNGYISDRGLTSVSQEPDDDNIAKCNAECLTVNVPQSSSSSGLDTESIMSEDNCSSSNLALREVLLAYVTKGDDVQVLGSLSVLATLLQTKELDESMLDRLGILPQRKQHKKQLLEGILTSLVAGRNNDMVEDLTGLPRKQALVGEASGEEQLFSSENSLMRDGSGCEPGVYLEKIKLSPSENWGSPIKTLIIAVCIPKEHCFLQFLVP

SEQ ID NO: 211091 - protein, 325 aa, Glycine max
  Coding DNA Sequence Number=SeqID_94313
  Gene Ontology: Mol. function=protein dimerization activity; Cellular component=endoplasmic reticulum; Biological process=proteolysis
  Homolog annotation: Hit_ID=Q9HZS5; Match level="QueryCoverage=95%, HitCoverage=79%, E-value=1e-121, Identity=68%"; Hit description =Probable hydrolase
MSTPKPRWRLNSGASQKALDQFDPVGGAYRQVVVIEVIAGVVQGIARRCGAVADRDVAAWALLQHKGEIFAGGKRPQRGDNLALSGPVQRHRARQLGFCRVVHQHRVAVPVVDLRAGAEAGGLRRDQLGDALFQPRAHHRRQRAHAERQGGGRRDYVGGLAGLHRSHGDDRRFLRIDIARHDGLQAHDDGRAGHHRIDGALRHCAVAAVAVQGDVHRIGRAHQGAAGEAQVAGGEAGHVVHGEHRVAGEALKQAVFNHHSGAAAAFFRRLKDQVQRAAEVRLPRQTARRRQQHGGVPVVAAGVHHPGMGAGMRQAGRFGDRQGVH

SEQ ID NO: 211092 - protein, 60 aa, Glycine max
  Coding DNA Sequence Number=SeqID_94314
MGSPREAEGRERDKKYPNTERGRGQERGLRADMVLTLWRVVEMHGGLAIVFQSSPLDDRP

SEQ ID NO: 211093 - protein, 156 aa, Glycine max
  Coding DNA Sequence Number=SeqID_94315
  Gene Ontology: Mol. function=2-oxoglutarate decarboxylase activity; Biological process=menaquinone biosynthetic process
  Homolog annotation: Hit_ID=Q15KJ0; Match level="QueryCoverage=77%, HitCoverage=54%, E-value=1e-13, Identity=33%"; Hit description =Truncated PHYLLO protein
MSFGGFLLYIESESLVLYPLALEEGHWRRDLEKLKEALQILNSPSPSSPTGFLRFQVALPPSPKTFTLFCSQPHSSSVFPLIYVSKNDADSKSLYVNLDDNVSHQKESRSQIELDELESVSILSMTLAWDEFSFSTFQEAHYSLQDSLDQVPDMPF

SEQ ID NO: 211094 - protein, 47 aa, Glycine max
  Coding DNA Sequence Number=SeqID_94316
MAYALGKDFLLEQIPFKEFQLMYQSTDPSMEKEYGEDRILPQTNVSA

SEQ ID NO: 211095 - protein, 117 aa, Glycine max
  Coding DNA Sequence Number=SeqID_94317
MTTILHLVMDNKKMRPIICKTKADLNKTFKEATKVFLTTLMKVFQIGIHNNSKLSQVSQPTLRRECEWCKTKVCLLKRKRVGVTTNIYSRKKLEKTKKRYANFDNKGSGVVYIWGRY

SEQ ID NO: 211096 - protein, 81 aa, Glycine max
  Coding DNA Sequence Number=SeqID_94318
MVGKTVVVVVTFGFLPTQCFEGSWTSKHTKACSASMLVERDARRDNVLAGRAGCMLSTLISDLSSSIVSHQLSELDALLSE

SEQ ID NO: 211097 - protein, 100 aa, Glycine max
  Coding DNA Sequence Number=SeqID_94319
MTLTLRVQRFEISFKLMLTTWVEVFLQGRNTLTCHQQCHLDESDSVGLPIVREFVDYMDSRATFTVKMVSLYKIMIMVLHERLRSPLYITFNFRVIDAFK

SEQ ID NO: 211098 - protein, 201 aa, Glycine max
  Coding DNA Sequence Number=SeqID_94320
  Homolog annotation: Hit_ID=Q5NRP5; Match level="QueryCoverage=89%, HitCoverage=56%, E-value=3e-61, Identity=62%"; Hit description =Putative mTERF domain containing protein, identical
  Pfam annotation: Domain name=mTERF; Domain location=1-187; Score= -13.3; E_value=3e-07; Accession=PF02536.5; Description=mTERF
MGRILDMLPVLLTCDPYLQFYPLLDFLLHEVPILYPDVHLSILRSPRLLVCSVNNQLRPTLCFLRELGFSGPHSLTCQTTLLLVSNVEDTLLPKIEFLKGLGFTHEEVANMVVRSPGLLTFSVEKNLGPKVEFFLREMNGDVAELKRFPQYFSFSLERRIKPRFGMLRRVGVSMNLEDMLKPHLFASSCRVKDCDVTTIAM

SEQ ID NO: 211099 - protein, 131 aa, Glycine max
  Coding DNA Sequence Number=SeqID_94321
  Gene Ontology: Mol. function=RNA-directed DNA polymerase activity; Cellular component=intracellular; Biological process=RNA-dependent DNA replication
MIAKSKIEDEHLVNLRKLFERLHKYRLRLNPAKCTFRVKSGKLLSFIVCQKGIEVDLDKVKLIATCEPLFKLLHKNQSVQWDDDCQVAFERIKRCLMNPPHDESGKKEWAVYYLSKKFTTCEMNYSLLERM

SEQ ID NO: 211100 - protein, 97 aa, Glycine max; identical to SEQ ID NO: 146548
  Coding DNA Sequence Number=SeqID_94322
  Homolog annotation: Hit_ID=Q8GU55; Match level="QueryCoverage=87%, HitCoverage=7%, E-value=2e-15, Identity=46%"; Hit description=SMC2 protein

SEQ ID NO: 211101 - protein, 70 aa, Glycine max
  Coding DNA Sequence Number=SeqID_94323
MSSSLSEVVRLSKNVQEDDRSLGSSRLSKNKCCLSENSCGQMRVNPRDSPIAQRVDYVKGQDLWGITYMV

SEQ ID NO: 211102 - protein, 151 aa, Glycine max
  Coding DNA Sequence Number=SeqID_94324
MTKLMDRAIGGAIAILGSRHHRLELLKVDATVCDLYCGDADADKWVDTQIGHYIGIGTPFFFFFFFFSSHSFKVCDLYCGDADADKWVDTQIGHYIGIVLLLLLLLLQFSLPLEHAIELVGGDLAVAVGFEAVENCLEFVHVFKVEKEFSF

SEQ ID NO: 211103 - protein, 117 aa, Glycine max
  Coding DNA Sequence Number=SeqID_94325
  Gene Ontology: Cellular component=extracellular region; Biological process=cellulose and pectin-containing cell wall organization and biogenesis
  Homolog annotation: Hit_ID=Q8L5G5; Match level="QueryCoverage=99%, HitCoverage=59%, E-value=4e-41, Identity=59%"; Hit description=Alpha- expansin 3
  Pfam annotation: Domain name=DPBB_1; Domain location=27-115; Score =104.0; E_value=4.3e-28; Accession=PF03330.8; Description=Rare lipoprotein A (RlpA)-like double
MAQVCLLLVGLLTMFSSAYGYGYGGGWVNAHATFYGGSDASGTMGGACGYGNLYSQGWCLPGSIMVTATNFCPPNNALPNNAGGWCNPPMHHFDLSQPVFLRIAQYRAGIVPVSYRR

SEQ ID NO: 211104 - protein, 110 aa, Glycine max
  Coding DNA Sequence Number=SeqID_94326
MMMTEVVGESGDSDDGDNRIGAGGNDDDNDNRDNRMVAMMVVVTMEWKWCERVVVVTTTMTEVMTMVVVEAKKVRCNGNSDDNGGNSGGGDGCGDGDNNDEVWWRPQQSW

SEQ ID NO: 211105 - protein, 88 aa, Glycine max
  Coding DNA Sequence Number=SeqID_94327
  Subcellular localization annotation: CTP_CleavageSite=32; ConfidenceScore=5.06e-01
MALMHITYKAGTAQGTSLSSHSLRLYTSLSVKASSLINFLNNHYYFSNTEDDVNIKEAMEDLNYIPKQLFWKCIGIPKIYLGITYSRI

SEQ ID NO: 211106 - protein, 44 aa, Glycine max
  Coding DNA Sequence Number=SeqID_94328
  Gene Ontology: Mol. function=sequence-specific DNA binding; Cellular component=nucleus; Biological process=regulation of transcription, DNA-dependent
  Homolog annotation: Hit_ID=Q7X9H8; Match level="QueryCoverage=88%, HitCoverage=13%, E-value=4e-09, Identity=72%"; Hit description=MADS -box protein AGL30
  Pfam annotation: Domain name=SRF-TF; Domain location=9-43; Score=9.8; E_value=0.032; Accession=PF00319.9; Description=SRF-type transcription factor (DNA-binding and dimerisation domain)
MGRVKLKIKRMENTNGLLATYAKRKNRIMKKAAELAILCEHPCT

SEQ ID NO: 211107 - protein, 378 aa, Glycine max
  Coding DNA Sequence Number=SeqID_94329
  Gene Ontology: Mol. function=inositol or phosphatidylinositol phosphatase activity; Cellular component=cytosol; Biological process= sulfur metabolic process
  Homolog annotation: Hit_ID=Q38945; Match level="QueryCoverage=94%, HitCoverage=100%, E-value=1e-117, Identity=58%"; Hit description=PAP- specific phosphatase HAL2-like (3'(2'),5'-bisphosphate nucleotidase) (EC 3.1.3.7) ...
  Homolog annotation: Hit description=(3'(2'),5-bisphosphonucleoside 3'(2')- phosphohydrolase)
  Pfam annotation: Domain name=Inositol_P; Domain location=62-374; Score=156.6; E_value=6.5e-44; Accession=PF00459.15; Description =Inositol monophosphatase family
FSDSETEARDVSVRVFLAMEEDKYAKELEVAVRVVHVACALCGRVQERLLATTNDHVLAKDDDSPVTVAEIFGVQNVSIIAEEDIQTISKDESASLLEAVVNTVNESLAFASKYGFQSPETTLGTSEVLEAIARCNSTGGSRGRYWVLDPVDGTLGFVRGDQYAIALALIEDGKVVLGVLGCPNYPVKTEWLSYHYQHHQTAPESSLTTPDTGGKGCVLYARKGSGEAWLQSLIDGDNMLEWSNCARLIRVSSIEDPALATLCEPVERANSNHSFTAGLAHSVGLSMVKYAAIARGDAEIFMKFAKCGYKEKIWDHAAGVVIVEEAGGVVTDAGGRPLDFSKGMYLEGLDRGIIACSGVTLHEKLIDAVYASWDSSNL

SEQ ID NO: 211108 - protein, 295 aa, Glycine max
  Coding DNA Sequence Number=SeqID_94330
  Gene Ontology: Mol. function=methyltransferase activity; Biological process=metabolic process
  Homolog annotation: Hit_ID=Q9LDW4; Match level="QueryCoverage=98%, HitCoverage=100%, E-value=4e-85, Identity=57%"; Hit description =Arabidopsis thaliana genomic DNA, chromosome 3, P1 clone: MJK13
  Pfam annotation: Domain name=Methyltransf_11; Domain location=121 -236; Score=65.2; E_value=2.1e-16; Accession=PF08241.2; Description =Methyltransferase domain
MGKTTSSRDWTRIYLIYGMDQWQTFVFLLCQAILFSVLSILYLLYFNDISHTFQSLLKIVAVPGGAARFAAGFTGSVMALSALCLFYAAANFFYSAVPLHSEMTQRIVDAVSDWSTVRQVLDLGCCGRGILLNAVAARLKKEGSSGRVIGLSGPNKAKLSATLRAAKVEGVEEYVTCRTGDATKLPFTDGSFDAVVSGTFVHTVGRGSTPDVATAERGRAVAEVVRVLKEGGVGVVWDLVHVPEYVRRLQDMKMEDIRVSERVTAFMVSSHVVSFKKPTHHVHGPPEVRLDWRFC

SEQ ID NO: 211109 - protein, 842 aa, Glycine max
  Coding DNA Sequence Number=SeqID_94331
  Gene Ontology: Mol. function=DNA binding; Cellular component=beta -galactosidase complex; Biological process=DNA integration
  Homolog annotation: Hit_ID=Q1SLU3; Match level="QueryCoverage=95%, HitCoverage=94%, E-value=1e-124, Identity=43%"; Hit description =Integrase, catalytic region
  Pfam annotation: Domain name=zf-CCHC; Domain location=159-176; Score =14.6; E_value=0.0039; Accession=PF00098.13; Description=Zinc knuckle
  Pfam module annotation: Pfam domain module=RVT_2::zf-CCHC; Domain location=455-682::159-176
MASTNPSALEDSLNPHSPYYVHPSENPSISLVSPLLDPTNYNSWCKSMSTALSAKNKLEFVDGSLPQPAPNHALHTAWKRSNNMVVSWLIHLVSPLIRQSILWLDNVVDIWRDLKSRYSQGDLLRISELQQEVASVKQGRGGRTFHGNGRGSNADKSGKVCNYCGIIGHTETECFKKHGYPPGHRLHKALVCTINNDSDLNTWLLDSRATDHIASSLDLYSECKQISPIIVSLPNGEQLIARYSGTVHISEFLVLTNVLYLSNFNFNFNLIFISKLTNSMHYQVVFLANKCLIQEISTKRMIGTIDVEYGLYKLKSTSSHHNNTSLAILNPSNYVNSCNTILLIYDTADSPSPTPLPPQPKPISVDQPYTEPTSSEHSLCKTDRVRTKPIKYNDYQTSFASTTITNHPGTKHPISFVISYNKLSSHYHSFILNVSANYEPKSYTEACKHDSWVRAMHDEISALERNHTWVLTDLPQHKNVIGCKWARLVAKGYTQIEGLDYLDTFSPVAKITTVRLLLALAASNKWFIRQLDVNNAFLHRDLNEKVYMVLPPSMKSTKPGQANRQWYARLSTFLVAHGFKQSVADYSLFTFKRENSFTTLLVYVDDIVLSENDLSVISDITKLLDDTFKIKDLGNLKYFIGFEVACGTSGINICQRKYALDLLIDTDMLNFKPFNASPTTAHYTALYRIRQYIKAALGLGIFFSSTSELQLKAFSDSDCVGCINTRKSITGFSVYLGSSLISWKSKKQATVARSSSEVEYRALAIVTCEIQWLTYLLHDFGIIHKLALVFCDNKSALHIAANHVFHERTKHIEIDCHLVHDKLLMFTQKLQHNNLLMFTQKL

SEQ ID NO: 211110 - protein, 403 aa, Glycine max
  Coding DNA Sequence Number=SeqID_94332
  Gene Ontology: Mol. function=isomerase activity; Cellular component =chloroplast; Biological process=protein folding
  Homolog annotation: Hit_ID=Q7XIJ9; Match level="QueryCoverage=77%, HitCoverage=71%, E-value=1e-132, Identity=76%"; Hit description =Putative peptidyl-prolycis-trans isomerase protein
  Subcellular localization annotation: CTP_CleavageSite=45; ConfidenceScore=5.05e-01
MAFPLSPSFNPSIARNRIACFSKKQHRHVITKDTEVVVVDRDTARATSAGAMLERIMKRLRSVAVVPIVIASVQISALVAPLVDYVASPGAAEAVLYSPDTKVPRTGEVALRKAIPANANMKAIQDTLEDISYLLRIPQRKPYGTMEGNVKKALKIAVDEKNSILASIPAELKERASLVHASLIEGKGGLQTLLQSIKEQDADKVSVNLASTLDTVAELELLQAPGLSFLLPEQYAQQYPRLSGRGTVAFTIEKGDGSTFSPVGGEQKNTATIQVVIDGYSAPLTAGNFAKLVMDGAYNGTKLNCINQAVISDNGVDKNTGYSVPLEIMPSGQFEPLYKTTLSVQDGELPVLPLSVYGALAMAHSEASDEYSSPYQFFFYLYDKRSAGLGGISFDEGQFSVFG

SEQ ID NO: 211111 - protein, 38 aa, Glycine max
  Coding DNA Sequence Number=SeqID_94333
MTKFFIHLMKNQNGKIEATFIRNGNMDSKTYISKQNMA

SEQ ID NO: 211112 - protein, 366 aa, Glycine max
  Coding DNA Sequence Number=SeqID_94334
MVLVKGSFSRESVEGKSEVQVFRDERPFRLFMSQLPPNATEKVGKSVAVATEVGTSERAASCPKKHSMLKEKCLPSPITLSKYMWVNIEMGIYFSCYNHKSDLTNLISWRSISDMMNLKTCPITLRTVRSDATPLVEFVFMNQEGMNRDFFYISREKRLKQPMLEFQLVVTSTLGNLVALINQKIFNNNFQAWIVTQHLQGSSNIEGLKDQLLKGEDFLNVAFQANMKLVDDNKNLEDQVPALSNDAKGWETRSLSVEALVRSWDIDISKLRSALSNANKEMNEANAEKECIQQKAFDDVYNAHEVGFNHCLLQMLQMCDVLDSNVFDIDKDDDADLSPSRPTTPVEETPTEEAHAKDVENVEPKD

SEQ ID NO: 211113 - protein, 307 aa, Glycine max
  Coding DNA Sequence Number=SeqID_94335
NVHLREAHRSWEPEANPLGRGEAESTTIGLPRATNLSVHSDVVPPTRNTLGRQLSQFKNPFAPSIMEATLHSNWENLTIDKYDGTTDLEEHLDIYTTQVSLYTKEDMILYRVWVEAVLAKKDNDWPDYNKALVVNILAKPKRANTPPKADHSKRCRGGIDLSLAGGDTKNMQDDRKGGGAEAALGREKKDPSTSQSGIGWDKGFIWLYTKFGHEGPLQKRLKIRYVIVDAHTSYNILLGHPSLNVLGAIVSTPHLAMKLCPHAREGTPEAVHYMEAGGKAKEVEELKLDPKTNDDNLVILIEGRTTF

SEQ ID NO: 211114 - protein, 152 aa, Glycine max
  Coding DNA Sequence Number=SeqID_94336
MVVFEGWGTSKVLLAPELLCLHRSTSDLATIVIPRRITPERERSKGCLVKRAWFGVIMGWVTLWEVFRQSLILKATKADCRDLKKDYLRKILTDEGSRLSFAFVVDLVLGFPLLKRERNLVLSFNSWKVVMGDDNEVVIVGFASSEVEHQFG

SEQ ID NO: 211115 - protein, 558 aa, Glycine max
  Coding DNA Sequence Number=SeqID_94337
  Gene Ontology: Mol. function=RNA-directed DNA polymerase activity; Biological process=RNA-dependent DNA replication
MDPRDKENMMFNIKSTNYCYRVMPFEVEECQSNISALNGQNFLGETWPKPGSLCGRHGGQVRQCDNSFGRSRKNLRSAQKGIHANLDKCQTILEMKSPQNIKEAKCLADKIVSLSGFLPRIAKKIDCLPLSFNQSHKCGVGTTRPEEEVPGYEKGSPQIGQHRPSPPTILSKPQDHFDFINQFHPSPPYFEQEWWTLHVDNSSNKYGSEAGVILEGPTRVARAYSLRFRFKATCNQAKYEALLAGMRLAKELLRYYHAFEKLKGELEEVQLKTFILHSVPRPSVSGKECLQGEKGSHGWKKEILNYLMGKGFSSPLLKCLDQYQAEDVLRELHEGIYDLYVRERTMATIVLKDGYYWLTFRTNYSNFFSSSLLNEFFGGLGIRHPQTNEQAKAVNKVLWAYICTPQCTTQETPFWLTYGANAMLPVKVGQVSLQRHYFVEAEKNEALQVDLDLIDQVREDVEGNLVWRACGKAQKPLSDGKLTPNCEGPFRIRHNLKNRAYRLKELFGKYPPWPRSNFKAHKQFPLEYPPRSRSKFKDHEQFPPKYPARLRSNFKAHK

SEQ ID NO: 211116 - protein, 46 aa, Glycine max
  Coding DNA Sequence Number=SeqID_94338
  Gene Ontology: Mol. function=hydrolase activity, hydrolyzing O -glycosyl compounds; Biological process=carbohydrate metabolic process
  Homolog annotation: Hit_ID=Q1S5H4; Match level="QueryCoverage=97%, HitCoverage=10%, E-value=2e-14, Identity=82%"; Hit description =Glycosyl hydrolases family 17, putative
MEVKMMFLKKCDSGRNLGVEAIKIVRVEVDQEGEVGVVKELEEWTE

SEQ ID NO: 211117 - protein, 103 aa, Glycine max
  Coding DNA Sequence Number=SeqID_94339
MQVALQNQTKERPQLPPKMCKRGDLSIGHKHDCSTTLVRSRPGCTRLNNRPGSIHCGFVVPKMPQGNKEVLKRALSPPPTRRIGLRWLNFRPTPSKLSNMSTA

SEQ ID NO: 211118 - protein, 42 aa, Glycine max
  Coding DNA Sequence Number=SeqID_94340
VWHGDFGQSWHDSARGQDGVVQQGDAWEKSEGKERWRKDLLN

SEQ ID NO: 211119 - protein, 73 aa, Glycine max
  Coding DNA Sequence Number=SeqID_94341
  Gene Ontology: Mol. function=hydrolase activity, acting on ester bonds; Biological process=lipid metabolic process
  Homolog annotation: Hit_ID=Q9AYM5; Match level="QueryCoverage=66%, HitCoverage=18%, E-value=4e-10, Identity=82%"; Hit description =CPRD49 protein
MHIRIHKLLVLHQFSNEFLAALNPVQRNQEEPMNPVEIEYADALMELCEEMSIKAISLWSAIQTRDDWLDDSF

SEQ ID NO: 211120 - protein, 53 aa, Glycine max
  Coding DNA Sequence Number=SeqID_94342
MPSVDEVGSALSVGFGDGERSTCLPWSPQKGVEHLDIGLLVLALLIFSNCGVE

SEQ ID NO: 211121 - protein, 259 aa, Glycine max
  Coding DNA Sequence Number=SeqID_94343
MTDKRKVLGKNNEETRIYFTWNLEMERVLAGVLRDQRNLGNKGDGGWKRSALNTAAAVLSTSFNVNVTSDNVKNHIKLWRSWYGISHKSAKPFRFKVLQNWDDIVDLCAKDRATGHGAETAMDADEAMSRETNEVEFMGLGATAIDLEESSSNTKEKRQGSTSSGTHPHKRKMGEKEGIAASLDKMTNSFNGMVEKMDGKVDDEDIQEVLREAALIPDLNRQQWAKAIKWLADDPKPLAIVKALPIHQKTDYVLTHLGE

SEQ ID NO: 211122 - protein, 52 aa, Glycine max
  Coding DNA Sequence Number=SeqID_94344
MWRPKTVTQVISSYTNYILLVYCDSHVDGTNNGAIIVMVAAMMVVVAVAILT

SEQ ID NO: 211123 - protein, 85 aa, Glycine max
  Coding DNA Sequence Number=SeqID_94345
  Subcellular localization annotation: CTP_CleavageSite=54; ConfidenceScore=5.30e-01
MEAHPGEPNFAWASVTGYKYVQQHKRAISFSFSSTKPSPNTPNLLLHHHWSPVTAMSRLCLSSDHHTEKNILIGVESSKLNSRIR

SEQ ID NO: 211124 - protein, 575 aa, Glycine max
  Coding DNA Sequence Number=SeqID_94346
  Gene Ontology: Mol. function=nucleic acid binding; Cellular component= intracellular
  Homolog annotation: Hit_ID=O81013; Match level="QueryCoverage=22%, HitCoverage=47%, E-value=4e-14, Identity=36%"; Hit description =Putative C2H2-type zinc finger protein
  Pfam annotation: Domain name=zf-C2H2; Domain location=117-139; Score =17.7; E_value=0.041; Accession=PF00096.16; Description=Zinc finger, C2H2 type
  Pfam annotation: Domain name=zf-C2H2; Domain location=405-427; Score =19.2; E_value=0.015; Accession=PF00096.16; Description=Zinc finger, C2H2 type
  Pfam annotation: Domain name=zf-C2H2; Domain location=54-76; Score =17.5; E_value=0.05; Accession=PF00096.16; Description=Zinc finger, C2H2 type
  Pfam module annotation: Pfam domain module=zf-C2H2::zf-C2H2::zf-C2H2; Domain location=117-139::405-427::54-76
MDQKDKHTVSHQGRGESSKKENMKRSLLGPCKAEVESTTADEATAAKSPSPMLRECNICGKVFSSGKALGGHRRSHFQKHQKKVKVRFTNHSSKAGDSSNINRANNCDYDADDDGKRICCICKKEFPTKNALFGHMRSHPERSWKGVSPPTRSPNKNSSSSSLSSYTFSSQNSDSMEKNMEEYRDDDYVDCVGGGGGNIVIIDLSTFTSPSWLKTDVRGRKCIGAYEAAETLTYLSAYSKYFCSESNRVSPKKDEVLSKSAPPLIKNGKRKVGESSSSKKHKVKKIKFYLNGELKIGKKNDGDGEFDDDEGEKLNRCKGLSKSGVGRILYMDDEVEEEEGVDEAFDDVITEVVAPAKVQDHVDERKVKRVVDHKGKNSKKLVMKFKAKDTEYENGGQEKEKVGGYKCGACGKKFSTFQGLGGHRSVHKEKNTEIMDESNRSKAVVADQEDNSSSSSNMHKVDEATMNEAPLPTDETTANEKAPLLADEACQSSPCTKKLDFDLNELPCVIEKFSPLPFSDSDVLKTHSAFSALGTVASPPSPSAAESLKHHGFYCLWERGRNYGWATGRGVGGSE

SEQ ID NO: 211125 - protein, 112 aa, Glycine max
  Coding DNA Sequence Number=SeqID_94347
  Homolog annotation: Hit_ID=Q2PYY0; Match level="QueryCoverage=47%, HitCoverage=15%, E-value=5e-18, Identity=83%"; Hit description =Mitochondrial carrier-like protein
MCRIKVSHFISFKLCLLLLFFFLIIPSYYDRGILHLYQQQTGNEDAQLTPLLCLGAGACVEIIAMSATYPMDMVRGRINVQVHQWVIHSWSNSNQNLHSITASFSNTPINMH

SEQ ID NO: 211126 - protein, 59 aa, Glycine max
  Coding DNA Sequence Number=SeqID_94348
MAYGGQQRGRRGDRGGRSMNGKKEDHDGGVSGDATNQFGKVNEKEADLDLKTVDLKTPP

SEQ ID NO: 211127 - protein, 223 aa, Glycine max
  Coding DNA Sequence Number=SeqID_94349
EEEDRNDDFIQNPPSVDYEACDESTPSFQIPVSAAPVSQIPPQPTTMKPPSRSTIPTISNEHMTQYFMPPLAIPPMPIETSPIQELAEINPQIQAITDKLNALVDQHVPLFIQATNIDTKLTLMLHKKEALEIDLRLSEEQHIKDLKSWITIRDQLSQLEVELAIDPANTWDILSTTNLRASSSILDSMATKDNPFVAPARLGELIPLAISNWLAWASCPCPK

SEQ ID NO: 211128 - protein, 60 aa, Glycine max
  Coding DNA Sequence Number=SeqID_94350
MGEVHEGLCGAHQSGNNMKRMINQYGYYWPTVTEECFSAKVAIALSELSGLNAYPLLSMT

SEQ ID NO: 211129 - protein, 55 aa, Glycine max
  Coding DNA Sequence Number=SeqID_94351
MDKSLKVGEDESEGEGERGHKIYGSNKDCIIPPLENDLTSNSEVLETLSFFPQHL

SEQ ID NO: 211130 - protein, 333 aa, Glycine max
  Coding DNA Sequence Number=SeqID_94352
  Homolog annotation: Hit_ID=Q1SDS1; Match level="QueryCoverage=35%, HitCoverage=25%, E-value=1e-09, Identity=33%"; Hit description=IMP dehydrogenase/GMP reductase
MTPSTEDVKRAMQGLFAVLQLFRKTPFLPREKGGANWDQLLASKEEASVNWFPRWKEERTGVLILCGGFLNVPLIGTRGCISYNPVLSIRQLGYPMRGAPIEEEIAPVISRGFNETNVETLRKDKELRGSNNGPIGGYCKWLRTAKGEEVEAPEEDEEENAELRNVNIATTKALEQETERARREEHGRNKFRGALWGSNNELKLRREERDQSRVDSLILKDELKACLRSKRNLSQRLCETETNMLAIISKYQEELNLATAHEHQVVDEYAQVYIEKEARGRVIDALHQEATMWMDRFALTLKGSQELPRLLAKAKALVDIYSAPEEIHGLLSY

SEQ ID NO: 211131 - protein, 252 aa, Glycine max
  Coding DNA Sequence Number=SeqID_94353
  Gene Ontology: Mol. function=metal ion binding
  Homolog annotation: Hit_ID=Q2HRJ4; Match level="QueryCoverage=81%, HitCoverage=54%, E-value=1e-14, Identity=26%"; Hit description=Zinc finger, RING-type
  Pfam annotation: Domain name=zf-C3HC4; Domain location=201-239; Score= 23.3; E_value=0.00061; Accession=PF00097.15; Description=Zinc finger, C3HC4 type (RING finger)
MALLTGDVSLTRWLEDPTEPNTTLSWNVIHGTGMITQDIFWSSSYYVALGNLDEDVEVALNLSIRASLHNTTNAFYKCDLANGPCSLNLLFSDGSAAVLVTPGPQQARLLSCGLTLLVFGAFNFLNKLQCAHEDRAGVRSEGTERQRAPLLPHKDDDLSSWGSSYESLPQDEKDLGFLPGGPIDGKTLVDGETSNNTRHLCAICFDAPRDCFFLPCGHCVACFACGTRIAEAAGTCPVCRRNMKKVRKIFTV

SEQ ID NO: 211132 - protein, 303 aa, Glycine max
  Coding DNA Sequence Number=SeqID_94354
MAYFSSWHYNISENYCQLKKHVAIEEEIALKETVVAVEPISTKTARDAQETKYKERSELGGKLEENNFHYHVEDSVLSKEKHHERMVNFCLDDIDSGEAISSTKAYTCFMEAKATAFIQNAELHPPSIRHLRVPILPPWADGKARMSKFINSELKLDQRHRKSDIYDHKLCFVRVHLHPFKEGCFEEGAVICMDFKIITTTIIIADTTTNMIIVMITVIATNMIVAITTTTTVSNDSGGGHFGCQDGGHGDDRGDGSGGGHDNNSHVGGATGGHGSMVVVKVTMRVVVETVISGGSGDIHDND

SEQ ID NO: 211133 - protein, 225 aa, Glycine max
  Coding DNA Sequence Number=SeqID_94355
  Gene Ontology: Mol. function=heat shock protein binding; Cellular component=cellular_component; Biological process=protein folding
  Homolog annotation: Hit_ID=Q9M034; Match level="QueryCoverage=88%, HitCoverage=57%, E-value=2e-60, Identity=61%"; Hit description=Heat shock protein 40-like
  Pfam annotation: Domain name=DnaJ; Domain location=4-67; Score=130.3; E_value=5.5e-36; Accession=PF00226.21; Description=DnaJ domain
MGVDFYKILQVDRSAKDEDLKKAYRRLAMKWHPDKNPNNKREAEAKFKQISEAYDVLSDPQKRGVYDQYGEEGLNGVPMGAGGFPGGGGGGSSGDGGATSFRFNPRSADDIFSEFFGFSRPFGGGMPDMGGRAGGSGFSRGGPFGEDIFAQFRSAAGEGSGHMPRKGAAIERPLPCSLEDLYKGTTKKMKISRDVSDASGRVLQVVKSRKNSFSHELGKIVSPTS

SEQ ID NO: 211134 - protein, 124 aa, Glycine max
  Coding DNA Sequence Number=SeqID_94356
METISKRFEELDVCSKVTLKSKLQEISYPDLDSMCVLVEKNSNSSVKHSASSSEQPIQRKNMSMLDQFHPCIHDFIVNIIDVKADGMSEDSWSLVCNYLHKELTKWSNEYINLIGGINTFEELK

SEQ ID NO: 211135 - protein, 138 aa, Glycine max
  Coding DNA Sequence Number=SeqID_94357
  Subcellular localization annotation: CTP_CleavageSite=39; ConfidenceScore=5.35e-01
MWSSPPSCTMSFTGSSKGDSGTTGSRHHGQALHTERSVHSKCRWGRWNVLSYFNLAPTFHTFDLNVDQARLIYGLREKLAQCPYSLSDQLTLSVKKANEKAQGRAYHEHRAKRVIKPPLLLRPGLHVQREVSVKSKLP

SEQ ID NO: 211136 - protein, 71 aa, Glycine max
  Coding DNA Sequence Number=SeqID_94358
MSIEENEEVGEAKGEKKERHWKENSSMRESANNSNSSDAIVLEDLFNSVGFGRHLAKGYRSKSVEKLCISF

SEQ ID NO: 211137 - protein, 96 aa, Glycine max
  Coding DNA Sequence Number=SeqID_94359
MDELKDLIKQVAPRGIPPYGVDEIQMVTRLFFRKPSHHEYSEKVIKFEIIELKTNEDVMKVLIESNYWKKIGPIEILVVFSKPLPQMEGELSLSQN

SEQ ID NO: 211138 - protein, 164 aa, Glycine max
  Coding DNA Sequence Number=SeqID_94360
  Gene Ontology: Mol. function=zinc ion binding; Cellular component =integral to membrane
  Homolog annotation: Hit_ID=A0FK64; Match level="QueryCoverage=74%, HitCoverage=48%, E-value=2e-43, Identity=68%"; Hit description=PHD4
  Pfam annotation: Domain name=C1_3; Domain location=109-139; Score =8.2; E_value=0.055; Accession=PF07649.3; Description=C1-like domain
  Pfam annotation: Domain name=PHD; Domain location=110-160; Score =55.1; E_value=2.3e-13; Accession=PF00628.19; Description=PHD-finger
  Pfam module annotation: Pfam domain module=C1_3::PHD; Domain location= 109-139::110-160
FSQCSQFHAIAHLSRQSSPWLFQSSFINFCYLWYSGCLAVWKRLFSLINDLPSVFEVVTDRKPVKDKPTADSGSKSRGSAKRSSDGQVKSNPKFVDEGYEEDEDEHNETLCGSCGGNYNADEFWICCDICERWFHGKCVKITPAKAESIKQYKCPSCSLRRGRP

SEQ ID NO: 211139 - protein, 147 aa, Glycine max
  Coding DNA Sequence Number=SeqID_94361
  Homolog annotation: Hit_ID=Q1STT2; Match level="QueryCoverage=50%, HitCoverage=17%, E-value=5e-12, Identity=44%"; Hit description =Lipocalin
MAKELGGIGFRNTYGFNLVLLGKQGWNLLTNPYTIISKLLKDKYYPRGDFLEAKVGSTHLTLDVVSVFIVLQGKQHVMHVSDFDRILTCIYNMIINEMRTKLNVLYSYCAARFVYYASFSFFIKKQKSEKDISIKLVNLISALSYAN

SEQ ID NO: 211140 - protein, 45 aa, Glycine max
  Coding DNA Sequence Number=SeqID_94362
MGSKQRSCGSATARERLRWTQELHDRFVEAVNRLGGPDSQDEKGF

SEQ ID NO: 211141 - protein, 181 aa, Glycine max
  Coding DNA Sequence Number=SeqID_94363
  Gene Ontology: Mol. function=nucleic acid binding; Biological process= DNA integration
  Homolog annotation: Hit_ID=Q1S1G2; Match level="QueryCoverage=96%, HitCoverage=11%, E-value=3e-23, Identity=34%"; Hit description =Integrase, catalytic region; Zinc finger, CCHC-type; Peptidase aspartic, catalytic
MHPKCSSGAIKKIKEEQNKNQVVRFLRGLNDQYSGVRSQLMLLDNLPNVNRVFALVAQQEQQFATEIASMPKAFLVVSDDTSDSKRNQGSSNGWNNRYTFKKCSWCRKMGHTIDICYRKHDFPAGFKFKNSKNIAPRSAYMVMAERNETNCPDDSSGKDTQGDARFGFTMSQYQNLMALLP

SEQ ID NO: 211142 - protein, 234 aa, Glycine max
  Coding DNA Sequence Number=SeqID_94364
  Gene Ontology: Mol. function=nucleic acid binding; Cellular component= oxygen evolving complex; Biological process=DNA integration
MDQELEALTRNNTWVLVDKPPNKNLVGCMWVYKVKHKQDGTVERYKARLVVKGYTQIKGNDISEINKVKRQLHAQFRIKDLGEAKFFLGLEIARSSKDIVLNQRKYALELLSDSGLLCYRHQEVVHRVLRYIKGSPGCGLFYPASNAHKLTTYSDSDRAGCIYSRKSITRYCLYIGSSLISWRSKKQTTAARSSYEAEYRAIAATDLQAAEPSLVSLFYDNRSIIHIAHDPSFH

SEQ ID NO: 211143 - protein, 132 aa, Glycine max
  Coding DNA Sequence Number=SeqID_94365
  Gene Ontology: Mol. function=hydrogen ion transporting ATP synthase activity, rotational mechanism; Cellular component=proton -transporting two-sector ATPase complex; Biological process=ATP synthesis coupled proton transport
  Homolog annotation: Hit_ID=P52612; Match level="QueryCoverage=63%, HitCoverage=18%, E-value=7e-38, Identity=90%"; Hit description =Flagellum-specific ATP synthase
DAFNLFKRHQKQALAVKSDHFAFHFPRFLAILTLNYTGRAQRQLQAGGFKHQTGGAGQSAITTNRWQLRHLRLKVVEGIEPAGHPHRQRLYIRRDVASGHRAGASRAGSAWRPDSLPRAAGRPDGRAAAASR

SEQ ID NO: 211144 - protein, 141 aa, Glycine max
  Coding DNA Sequence Number=SeqID_94366
AWDRYADNVLGRKILPERNVKLYITEFDEFRREIERRNWHKELTNFSEGSIDVVIVKEFYANLYDPEDKLPKQGRACPPTPDGLPLKILRKNLTTLAQTWSVLSFSNLAPKSHTSDITLYRDKLIYGLVMQMDMNLGSLIS

SEQ ID NO: 211145 - protein, 81 aa, Glycine max
  Coding DNA Sequence Number=SeqID_94367
  Subcellular localization annotation: CTP_CleavageSite=43; ConfidenceScore=5.54e-01
MVHCYQASRRSSMTTDLPPLLMFPRTQVPSGVANCRNLPFGRRATRGSQVHLPRKENARSRHQRLFEENVGKTGKGVVYEL

SEQ ID NO: 211146 - protein, 280 aa, Glycine max
  Coding DNA Sequence Number=SeqID_94368
MTGEVPTELCALPRFRSKLQLDKLFDGFRASVKGVVSRIYVKFPTQAGLIDGQGSDLRPFIHCHDMSAFSRCRGPTVFGVVTNTAVVSMARTRPFGEKLTLVWLMPLVLRVRVRLGVCFVLIALLSDLADFILKFGHYFHLDVALGSFTQFVHATGYSSSAMRPTSSILRTESFDKGVEAIYGPRGSPVSGSYQILVWICCPIVLLEVEWFPPQGYICLHNVVDKRMLTDSPLLHVIPLGCVQARCQMRMRVCEGGLAFDARPSERIDERPWCMFYRSPM

SEQ ID NO: 211147 - protein, 44 aa, Glycine max
  Coding DNA Sequence Number=SeqID_94369
MASMPYALRLVESSLQGPEDDSVSYLFLSVSLRMFDKGDQVLDA

SEQ ID NO: 211148 - protein, 151 aa, Glycine max
  Coding DNA Sequence Number=SeqID_94370
MSSTASDMYARAYYYDSSVRHPRQVTQMQERITTVTPLHVTHDEWHCMTPMMSDIHARAYYHHDSTMCHPQQVTYMQKHITMSPVRATHSKWHVCMSTVLKTQVGQFHGQSFTGLAKPKYRPPTAKAMYERAQHLRYTQDLSNPSIVLADC

SEQ ID NO: 211149 - protein, 82 aa, Glycine max
  Coding DNA Sequence Number=SeqID_94371
  Homolog annotation: Hit_ID=Q00M75; Match level="QueryCoverage=37%, HitCoverage=5%, E-value=1e-09, Identity=96%"; Hit description=PPR -repeat containing protein
MSASFVHRLPRIPRSEAFIISFNLCEALPEKFMCEVSVKSKSLWAMGYEVLRASPGAAVKLCLGDLLVMGSNPETVSLHMQG

SEQ ID NO: 211150 - protein, 118 aa, Glycine max
  Coding DNA Sequence Number=SeqID_94372
  Homolog annotation: Hit_ID=Q1T097; Match level="QueryCoverage=53%, HitCoverage=5%, E-value=2e-07, Identity=40%"; Hit description =Transposase family tnp2, putative
MNYIPSNRCWKCNRCYSGTSGLKDSFVEVVEEFINKASQKDCYHNDGGIKFPCVKCDCTWILEDRVVKRYNRRHERELKNWSLTLNARASLSASRPLTQEARLVQEATLEASCHMQTH

SEQ ID NO: 211151 - protein, 333 aa, Glycine max
  Coding DNA Sequence Number=SeqID_94373
  Gene Ontology: Mol. function=protein serine/threonine kinase activity; Cellular component=cytoplasm; Biological process=protein amino acid phosphorylation
  Homolog annotation: Hit_ID=Q4PKE6; Match level="QueryCoverage=77%, HitCoverage=60%, E-value=1e-123, Identity=84%"; Hit description =Calcium-dependent protein kinase
  Pfam annotation: Domain name=Pkinase; Domain location=1-91; Score= -108.6; E_value=0.043; Accession=PF00069.15; Description=Protein kinase domain
  Pfam annotation: Domain name=efhand; Domain location=138-166; Score =32.7; E_value=1.3e-06; Accession=PF00036.22; Description=EF hand
  Pfam annotation: Domain name=efhand; Domain location=174-202; Score =20.1; E_value=0.008; Accession=PF00036.22; Description=EF hand
  Pfam annotation: Domain name=efhand; Domain location=210-238; Score =34.2; E_value=4.5e-07; Accession=PF00036.22; Description=EF hand
  Pfam module annotation: Pfam domain module=Pkinase::efhand::efhand::ef hand; Domain location=1-91::138-166::174-202::210-238
MAPEVLKRNYGPEIDIWSAGVILYILLCGVPPFWAESEQGVAQAILRGLIDFKREPWPSISESAKSLVRQMLEPDPKLRLTAKQVLEHPWLQNAKKAPNVPLGDVVKSRLKQFSMMNRFKRKALRVIADFLSNEEVEDIKDMFKKMDNDNDGIVSIEELKAGFRNFGSLLADSEVQLLIEAVDSNGKGTLDYGEFVAVSLHLRRMANDDHLHKAFSYFDKDGNGYIEPDELRNALMEDGADDCTDVANDIFLEVDTDKMGCFPLGAVRVTKDWCSQNMFIKVRISCTSNSALRFGHSILLPVVSSKVYSGMLTTSIICLSQHEPGRYAGSGSA

SEQ ID NO: 211152 - protein, 309 aa, Glycine max
  Coding DNA Sequence Number=SeqID_94374
  Gene Ontology: Mol. function=protein serine/threonine kinase activity; Cellular component=cytoplasm; Biological process=protein amino acid phosphorylation
  Homolog annotation: Hit_ID=Q96294; Match level="QueryCoverage=69%, HitCoverage=41%, E-value=2e-98, Identity=83%"; Hit description =Calcium-dependent protein kinase
  Subcellular localization annotation: CTP_CleavageSite=62; ConfidenceScore=5.37e-01
MSFINILKQQRNLSLMVSIPTKQPSHFSFYVADAECRVDSRKPNCTNFNLPNNSRNPTTNSRQVTPPNSKPNPRNALNRIQIQRTWLEEYGEAKINCLERRILLLVREQEVLRLEVAVDDPVLVAELHDLDDRPRDGGGGALGVVPAGDDPVEEFAALAELHDEVDGIVVLTGLAERHDARALRQVAHDGDLAAHVLDVHGCPELPLRDALTREQLARVAVDAEVRHAELAAPELAVHEVPVLDVLFRHAGKHRDRGLLLGGGGGGATSAALAVVGVGEARFDVLAGHSGRGSAAVAHGSRDRGGGEVL

SEQ ID NO: 211153 - protein, 173 aa, Glycine max
  Coding DNA Sequence Number=SeqID_94375
  Gene Ontology: Mol. function=transition metal ion binding
MCDSVMDKLLNIQGKTKDGLNTHRDLAGMGIRDQLHPRSDGKKIYLPLACHTLSRKEKISLCHCFCHVKVSRGFSGSNVFQGYFDDVKESRVKQSFKQRFKNQVSRFKTQESSFKNQDSRIIKIKIQDSRFKNQEEDSIKISIKKFLKTLSSTRSFHKIITKEFYSLVIDYQK

SEQ ID NO: 211154 - protein, 215 aa, Glycine max
  Coding DNA Sequence Number=SeqID_94376
MKLFVTEFDEFRTELVRRNWHRMLTNLMEGSIDVALMKEYYAKLYVPEDKPPKQVRVRGHLIKFDADSLNTFLETSVVLEPRETLPPGLAMEDAEEGPHYSGINLESSFMMLNQVDSSSFDDDKDDDKKPKRMISRLSQQGTSFVVQVEGTSTWVVVTENKRGYISCGSVQVEGTSTWLFKENKEGYIPCGSLLVKVFTRLKRNLKDRRSLREWM

SEQ ID NO: 211155 - protein, 79 aa, Glycine max
  Coding DNA Sequence Number=SeqID_94377
MNIEENLPCHHALTRHQLVQREDCIFYACFALWDTTCLYGCKIYRQVHWHLQTKIMIVNESKSMFYSNYKVINVSKLKY

SEQ ID NO: 211156 - protein, 108 aa, Glycine max
  Coding DNA Sequence Number=SeqID_94378
MTTTKNKYEGRCAMPPIIKLNLNRRYVHLTTNVGMGTMSNLGSKEDSFPSRKYTTGAQRRGNQHIGNDDVRVFRHKLDIMKRHEFVWEPYPSTVISLLPPVCLVGSLA

SEQ ID NO: 211157 - protein, 51 aa, Glycine max
  Coding DNA Sequence Number=SeqID_94379
MEAKAQKWWPRGENLQMPWVFAFLNEGGEFWVERNSPSLVFMFPDAGVLAQ

SEQ ID NO: 211158 - protein, 91 aa, Glycine max
  Coding DNA Sequence Number=SeqID_94380
MLPFVHSLLLFSLRFHEGEGTGVWCCGGRRWHMRYAMLGAFWCTADHADQMDEDQWMYEGIMPEEVDMDENEEECGVNEPHVDCSNLFNTS

SEQ ID NO: 211159 - protein, 155 aa, Glycine max
  Coding DNA Sequence Number=SeqID_94381
  Gene Ontology: Mol. function=transferase activity, transferring glycosyl groups; Biological process=metabolic process
  Homolog annotation: Hit_ID=Q589Y1; Match level="QueryCoverage=95%, HitCoverage=33%, E-value=2e-48, Identity=54%"; Hit description =Glycosyltransferase NTGT5b
MESLHTQKPHVCVPFPAQGHVNPFMQLAKLLHCVGFHVTYVNTKFNHNRLVRSHGPDFVKGLPNFQFETILDGLPPSDKDATQDVPTLCDSTRKTCYGPFKEMAMKLNDSSPEVPPISCIIADGINGFAGRASTCGFVGYLQYEELAKKGILPFK

SEQ ID NO: 211160 - protein, 159 aa, Glycine max
  Coding DNA Sequence Number=SeqID_94382
  Gene Ontology: Mol. function=protein binding; Biological process =defense response
  Homolog annotation: Hit_ID=Q2YE88; Match level="QueryCoverage=81%, HitCoverage=21%, E-value=6e-20, Identity=73%"; Hit description=NBS -LRR type disease resistance protein Rps1-k-1
MYHNVEAYVLESFIICDFQSLDVLPHSVENEIKELGVLSNLHGQFCIINLENVSQSDEALEASIMDKKHINSLWYKWSRCNKNSTDFQIEIHETFQIINCELLVSSLPMDFAIQTLEICKSNKVALHVLPLLVENIVVEGSSMMESMIETITSIQSTCL

SEQ ID NO: 211161 - protein, 116 aa, Glycine max
  Coding DNA Sequence Number=SeqID_94383
  Homolog annotation: Hit_ID=Q2YE88; Match level="QueryCoverage=54%, HitCoverage=5%, E-value=9e-07, Identity=50%"; Hit description=NBS -LRR type disease resistance protein Rps1-k-1
MAATMADPEFVNLIHGKKLKKKLLQMLEIIARVITDTNVKLWFNALKDIVSEIDDLTMFPPKLLLKSRKIVKFDILKIEDYVKWSLLKKPFQFGISGSKILLISRNESTTFVVQTA

SEQ ID NO: 211162 - protein, 85 aa, Glycine max
  Coding DNA Sequence Number=SeqID_94384
MAHYRLKKRRCEMLLKNSLSDTDWLSEPHSLSEAASSLSECKTLEDYQSESSALSSTQPARPARMLVGKCLESLELDRAARGLCI

SEQ ID NO: 211163 - protein, 69 aa, Glycine max
  Coding DNA Sequence Number=SeqID_94385
MACDSFFTQDVFSSHHNISRWVRSPPATDEAEAAALLEAIKWIKEMNLHNVINVGICFILVKKRHGSVY

SEQ ID NO: 211164 - protein, 408 aa, Glycine max
  Coding DNA Sequence Number=SeqID_94386
MAKPNSAKPGCFSDFFQLLFCAAENGNSSPMHPSDHHIAKPYATEVVHSHKDAMAKNATKPGVVARLMGLDSLPNTNLASNTNTTLHSVPRSRSVNFVDYLLKFDTSQPNQVKTSASFREVPSLLQHKNKNHDLVVFYWDDESEDQEVVSFLRKQEMGLGESRQRKKQGSKNKEIANVMKERNHTKRKKISKFENEPRVVLPLKHSSKVRNHNEAKVLAQVSACSKSCSNSRRKCGSGPSGLRTSSNLPTKQKKVFSEPKCTKKTKKQQSTKKIDTEFSTENFSPISVLDDYDYSFLYDPDFPDYTSPLMPKTKCESSEQLFLSDNVGDRASKNKGYSYPDINRKEEYFSELTVKLHNLTQNEMRESDFTPKRMCESESYGKICLEYEHTIFDILLHEVVNELVELSC

SEQ ID NO: 211165 - protein, 65 aa, Glycine max
  Coding DNA Sequence Number=SeqID_94387
MVIELVETIEGEKATKCKCCFCHLKTELPKLLTSFKDENIVVLGIGNRVIFIQRFAPTLLTHNGF

SEQ ID NO: 211166 - protein, 72 aa, Glycine max
  Coding DNA Sequence Number=SeqID_94388
  Gene Ontology: Mol. function=protein binding
  Homolog annotation: Hit_ID=Q70YJ5; Match level="QueryCoverage=72%, HitCoverage=24%, E-value=6e-13, Identity=62%"; Hit description =Putative Cf2/Cf5 disease resistance protein
  Pfam annotation: Domain name=LRRNT_2; Domain location=6-44; Score =53.4; E_value=7.7e-13; Accession=PF08263.3; Description=Leucine rich repeat N-terminal domain
MEIMCIEREREALLQFKAALLDRYGMLSSWTTADCCQWEGIRCSNLTSHNLMLDLHNGTISIIFFSFSSIKT

SEQ ID NO: 211167 - protein, 152 aa, Glycine max
  Coding DNA Sequence Number=SeqID_94389
  Gene Ontology: Mol. function=helicase activity
  Homolog annotation: Hit_ID=Q8LML8; Match level="QueryCoverage=97%, HitCoverage=10%, E-value=1e-34, Identity=45%"; Hit description =Putative DNA helicase homolog
MTIDSRLVVPYNPWSLLKYDCHINVEVCSGIKSIKSLYKYVYKGHDRVAMEVHRGSHVDEVQQYIDARWICALEALWKIFRFILYRIYQCVDRLQIHLPHHHQVRFYRHQRITDVLNDDRNSKTMLTQFFALIYRDRQARNYLYREIAKHYC

SEQ ID NO: 211168 - protein, 231 aa, Glycine max
  Coding DNA Sequence Number=SeqID_94390
MALEDLELLTQKLRDQLEESITEKGLALPLKPEVGPSATRVSTKKSCFNPLGQNPDMGDSEKCGLHIDENLPHLVVLRRVCEGSSVVHNIPLGNDQVKVSVEEVQDVDARIPVPIQEDKLEAKRPAKPADRSDLDVDPLYLMTLTIPQLFLKPLQVSWNATVFGMYNDNFPLYMKHEYLIEIAHGSRCLNIYVIQLWIMHMSKTNMRAGNVFVFGFLEPKSIQKSGQPQFE

SEQ ID NO: 211169 - protein, 185 aa, Glycine max
  Coding DNA Sequence Number=SeqID_94391
  Gene Ontology: Mol. function=transition metal ion binding
MPYCGVIEEIWELNYVKFIVCLSKCKWVDSNISVQTDDFIFTLVDLKKLAYQNESFIMVEQAKQVFYVQDPCHERWHMATPPSSPPPPLEKATSLLSMSKKTRKATQLRSLATRPVGAKIPVVHVDLATGKAAGPHKKKLRTHLGIATRDKVDVTYNNWKQVCVAQKDLIWADIQIYLIFLKHPS

SEQ ID NO: 211170 - protein, 73 aa, Glycine max
  Coding DNA Sequence Number=SeqID_94392
MANYTNFFGSWLCKFIKCRLQRSKAEMLYELLISCLFPKEEGCKRTPTIGCSLGSGKPAASIKENKTTTMSSF

SEQ ID NO: 211171 - protein, 108 aa, Glycine max
  Coding DNA Sequence Number=SeqID_94393
NKRNEFSQHSRTSGSNSKSPECELSEEERPASDEFTLVDKGSSSSSGLASAVFFTVSSCSLSFDASDAEMLPSGVQKSVRISKDMLTAIKRRICFVFLVKLVLAYNIH

SEQ ID NO: 211172 - protein, 53 aa, Glycine max
  Coding DNA Sequence Number=SeqID_94394
MYLIHEKHEEEVAAVNEKIQELHEMVKEAKAKLETEVGPVTTRVLEKKEAMLE

SEQ ID NO: 211173 - protein, 224 aa, Glycine max
  Coding DNA Sequence Number=SeqID_94395
MESGIYRRGVKLCILFYRTVHKPPSSESTYGQKMWSSVEDGLTSGVVALTSRRGLSSPQAWTSVVQAASIKLSRMDMPSILQTKSDVCVRLTRSSLAYVSLVEWLHIGDAVHAGHLISSDFLSAESSCFHVCFLGVHHTRKASKYSFGFVVPLYRSRLSGFHPKGMQCVSGKFVVLGASDMSLQPIMAFSFLRSFSWRHFIFAMRVEAFKRGLESEAKPSANNG

SEQ ID NO: 211174 - protein, 76 aa, Glycine max
  Coding DNA Sequence Number=SeqID_94396
MVSGIEEEDNPIHASTVSGMPVIGVTIKENPTNVVSPSRQELDDHLLIICLAKRDEHLEAKKHAGDGKPSKGKCHS

SEQ ID NO: 211175 - protein, 108 aa, Glycine max
  Coding DNA Sequence Number=SeqID_94397
  Gene Ontology: Mol. function=RNA-directed DNA polymerase activity; Cellular component=mitochondrion; Biological process=RNA-dependent DNA replication
MVLKKPELVCQKIAWSVEMSELGIKYESRGPMKAQCLADLMAKLATTIETKSFRWKLYVDGLSNTKGSGIRVILESLEGVILEQSLQFEFETTNNQAEYEAFLVKQKK

SEQ ID NO: 211176 - protein, 476 aa, Glycine max
  Coding DNA Sequence Number=SeqID_94398
  Gene Ontology: Mol. function=RNA-directed DNA polymerase activity; Biological process=RNA-dependent DNA replication
MERFSSISVQIQDLSLEVALTSMLMALKFGPFSDSLCKKSPTTLDEFRSRVVGFIQMEEIIRFKEKVCGESSSKPTEQEIKTESNRVINMITGDGSLNLACKHYVHNLKTTPITFTDEAFVGIDSTIILYWSSFKQLDIPESQNESFSKQLICFPRETTDTMGHINLLTTFGDKKGSKTIMISGKIITVRADQATTRECYAASLKIAKGKKGGRAQSTIVACTSLTNNLGEAELDPREEELRVEPTEEVKPFQLSNEPSYCTKLGCQMSREVKESIAQVLTENVNLFPCFIRKRKLDLERGKIVDEKAKKLLNAGFIKEVQYPTWLANEYNQILMFKPDEEKIVFMTDTTNYCYSVMPHEHHLSSKRLSRDLYEIRKYNMRLNLEKCIFSVQGGKFLGFMLTHRGIEANPKKCVTIIEMRSPNTWKEFQRLTCQLATLSIFSTRAYDMARPFFKLLTKKEWVEWNEECEANFLKLK

SEQ ID NO: 211177 - protein, 169 aa, Glycine max
  Coding DNA Sequence Number=SeqID_94399
MRAKTYQKRDDKRYNNWIKVRNFQASDLVWRKCGKSRKDAKEGKLAANWKGPFKFHLSGKAIPRTWNASHQVLLQLMLLFNGTLYLSFRNQPQFVVHVLVDIEEKKVSFLEEVYGLSSSLEIVDFMSLKDLNHNFVKITLQFLHIHLEESKLLVKAFNLLLEVFSIILD

SEQ ID NO: 211178 - protein, 104 aa, Glycine max
  Coding DNA Sequence Number=SeqID_94400
MTRKRRKPAVPGVLWRMFRGRARTLSDTIISLLPPPPPPPPLVCHCRGCGCLGCTVDAEKFLLRPDDPSDYCKLLSKCFVVVSGNAPSPLPFFFPPSSRLSQHM

SEQ ID NO: 211179 - protein, 180 aa, Glycine max
  Coding DNA Sequence Number=SeqID_94401
  Gene Ontology: Mol. function=oxidoreductase activity, acting on the CH-CH group of donors; Cellular component=glyoxysome; Biological process=fatty acid metabolic process
  Homolog annotation: Hit_ID=Q96329; Match level="QueryCoverage=86%, HitCoverage=43%, E-value=3e-66, Identity=64%"; Hit description=Acyl -coenzyme A oxidase 4, peroxisomal
  Pfam annotation: Domain name=Acyl-CoA_dh_M; Domain location=119-180; Score=9.4; E_value=0.0048; Accession=PF02770.9; Description=Acyl-CoA dehydrogenase, middle domain
  Pfam annotation: Domain name=Acyl-CoA_dh_N; Domain location=38-138; Score=18.1; E_value=9.6e-06; Accession=PF02771.7; Description=Acyl -CoA dehydrogenase, N-terminal domain
  Pfam module annotation: Pfam domain module=Acyl-CoA_dh_M::Acyl-CoA_dh_ N; Domain location=119-180::38-138
MKMPSYFNLPALDVSVAFPQATPASNFPPCASDYFHFNDLLKPEEQAVRNKYWEKAEFPFHVIPKFAALRIAGGTIKGYGCPGLSITGSAVATAEVARVDASCSTFYLVHSSLAMLTIALCGSEAQKQKYLPSLAQMKTIACWVGGGWILDGQKRWIGNSHGDPNIHEFSLIALYSSLAP

SEQ ID NO: 211180 - protein, 260 aa, Glycine max
  Coding DNA Sequence Number=SeqID_94402
  Gene Ontology: Mol. function=DNA binding; Cellular component=nucleus; Biological process=regulation of transcription, DNA-dependent
  Homolog annotation: Hit_ID=Q1RW37; Match level="QueryCoverage=88%, HitCoverage=93%, E-value=3e-31, Identity=32%"; Hit description=Tumor- related protein, putative
MTDANAASFEAFLQGWMVRQRGYLDELLSAQQHYQEMQDDDDVRQLINRVICHYGQYFEEKSKIAHQNVLLVFSPPWFSSLERTFLWVGGFKPGVSFQVVNTALEDLSEEQKERLSLLNQETKVKERALNDELAKLHESVAAPPLVDMARSHGRVCFSRSFMAEEGSSVPSTFRETLENLVANADALRTNTSLKIFQVLRPAQIVSFLVAVAELQIRIRSWGLDKDSQNGGQGMDTCIGLKPFSIMMVDDVHWAVSMFSI

SEQ ID NO: 211181 - protein, 205 aa, Glycine max
  Coding DNA Sequence Number=SeqID_94403
  Gene Ontology: Mol. function=oxidoreductase activity, acting on the CH-CH group of donors; Cellular component=glyoxysome; Biological process=electron transport
  Homolog annotation: Hit_ID=Q6J513; Match level="QueryCoverage=99%, HitCoverage=44%, E-value=3e-89, Identity=78%"; Hit description =Putative short-chain acyl-CoA oxidase
  Pfam annotation: Domain name=Acyl-CoA_dh_1; Domain location=28-191; Score=60.9; E_value=4e-15; Accession=PF00441.14; Description=Acyl -CoA dehydrogenase, C-terminal doma
MENKIGLRIVQNGDIVMRKVFVPDDDRIEGVNSFQDTNKVLAVSRVMVAWQPIGLSMGIYDMCHRYLKERKQFGAPLAAFQISQQKLVQMLGNIQAMILVGWRLCKLYESGKMTPGHASLGKIIDDKLLTIFQSWITLRARETAALGRELLGGNGILADFLVAKAFCDIEPIYTFEGTYDINTLVTGREVTGFASFKSVAQKSRL

SEQ ID NO: 211182 - protein, 493 aa, Glycine max
  Coding DNA Sequence Number=SeqID_94404
  Gene Ontology: Mol. function=cellulose synthase (UDP-forming) activity; Cellular component=membrane; Biological process=cellulose biosynthetic process
  Homolog annotation: Hit_ID=Q6XP46; Match level="QueryCoverage=100%, HitCoverage=46%, E-value=0.0, Identity=79%"; Hit description =Cellulose synthase
  Pfam annotation: Domain name=Cellulose_synt; Domain location=250-493; Score=-153.9; E_value=9.1e-05; Accession=PF03552.5; Description =Cellulose synthase
  Pfam annotation: Domain name=PHD; Domain location=19-68; Score=13.3; E_value=0.0027; Accession=PF00628.19; Description=PHD-finger
  Pfam annotation: Domain name=zf-C3HC4; Domain location=20-65; Score =6.2; E_value=0.036; Accession=PF00097.15; Description=Zinc finger, C3HC4 type (RING finger)
  Pfam module annotation: Pfam domain module=Cellulose_synt::PHD::zf -C3HC4; Domain location=250-493::19-68::20-65
MTESEEAGAKPMNTLGGQVCQICGDNIGNNVNGDPFIACDVCAFPVCRACYEYERKDGNQSCPQCKTRYKRHKGSPAILGDQEEDGGADEGASDLNYNSENQNEKQKIERMLGWQMAHGRAEEAVAPNYDKEVSHNHIPLLSGGQEVSGELSAASPERLSMASPGGRGKRVHNLQYSSDLNQSPNIRVGDPGLGNVAWKERVDGWKMKQDKNVAPMSTGQATSERGAGDIDASTDVLVDDSLLNDEARQPLSRKVSIPSSRINPYRMVIALRLVILCIFLHYRITNPVPNAYALWLISVICEIWFAISWIFDQFPKWLPVNRETYLDRLALRYDQEGEPSQLAAVDIFVSTVDPLKEPPLVTANTVLSILSVDYPVDKVSCYVSDDGAAMLTFEALAETSEFARKWVPFSKKYNIEPRAPEWYFAQKIDYLKDKVQPSFVKDRRAMKREYEEFKIRVNGLVAKAQKVPEEGWVMQDGTPWPGNNTRDHPGMIQ

SEQ ID NO: 211183 - protein, 505 aa, Glycine max
  Coding DNA Sequence Number=SeqID_94405
  Subcellular localization annotation: CTP_CleavageSite=52; ConfidenceScore=5.00e-01
MDTTDSQSETFKSYCSKSQVVSFIWAVSRSILPSELLGTPPTWRIMRRNISNASVLKYIEGKNKFFHQEFKNWNDAVHGVKRKLLEKWIFWYFSFLVVPLVEANFYVTESEQGKQDIYYYRKSVWEKLAASTVSCFKDWRYSYLDDVAVHNILKGRPFGFSKLRLQPKENGVRMVANLEGSSRIPLLHSMGVRNCKTKGKEPNKLGSSVFDYNDVYKKLCPFLVGQKKRSASMPSLFIVKCDVLKAFDSINQDKLLDIMKDFLLKDVYFLKQYDQVVCTKKSLQVQKQFTMQDETSNNSHTQSTSFASFHSWHGVFVNQERWKSVKKKALYADLVQHVKRNVLQFDGKFYLQGVGIPQGGVLSSLLCSMYYGHLERHVIFPFLEKTLESGSCIENNFGQTNCDDKVSSSCYLLMRFIDDFLFISTSKKQAASFFSRLERGFRGYNCYMNNKKFGANFDVEHTSDSPLNRVYVGEDGATSFLQWSGLLINCSTMEIQADYTKLIFI

SEQ ID NO: 211184 - protein, 122 aa, Glycine max
  Coding DNA Sequence Number=SeqID_94406
  Homolog annotation: Hit_ID=Q5Z9P5; Match level="QueryCoverage=94%, HitCoverage=26%, E-value=1e-31, Identity=62%"; Hit description =Putative brain and reproductive organ-expressed protein
MSAPSAARLKLVSSPELKAVFSIDDVKLPPWLDGMCLAEYLPNLEEYLGKQVLEAVSLIEVRRHFIEALSSPFGRPVEADAVSSRDTYSQIARVFCRKATFLAASGVFTFLKSHVWPKEKFE

SEQ ID NO: 211185 - protein, 143 aa, Glycine max
  Coding DNA Sequence Number=SeqID_94407
  Gene Ontology: Mol. function=hydrogen ion transporting ATP synthase activity, rotational mechanism; Cellular component=proton -transporting ATP synthase complex, catalytic core F(1); Biological process=ATP synthesis coupled proton transport
  Homolog annotation: Hit_ID=P22778; Match level="QueryCoverage=94%, HitCoverage=56%, E-value=2e-31, Identity=53%"; Hit description=ATP synthase delta chain, mitochondrial precursor
  Pfam annotation: Domain name=OSCP; Domain location=64-143; Score= -71.7; E_value=0.1; Accession=PF00213.9; Description=ATP synthase delta (OSCP) subunit
  Subcellular localization annotation: CTP_CleavageSite=47; ConfidenceScore=5.52e-01
MALCNRVRSGISLFTKSTFLTSQRSTLQRSLVAPFISLASRNYANVPGQKETKVKVPLALFGGSGNYASALYIASVKANAVEKVETELLQFVEAVKNSPIFSQFIRDLSVAKDVRVKVIQDICGEAKFSDVTKNFLGMISFVF

SEQ ID NO: 211186 - protein, 96 aa, Glycine max
  Coding DNA Sequence Number=SeqID_94408
MDSSVGFIRPLALELQQLAFAALYLSTPGVQKSATMKAAVAVIEGKLRVFQDAGIKTPRLRATIPSSPFRETINQDPIAARPVRGDLLRQLSNNRQ

SEQ ID NO: 211187 - protein, 248 aa, Glycine max
  Coding DNA Sequence Number=SeqID_94409
MQVGDYFMFYLLRNTSIFLPAPRGKHNQVAGPPISDLCFEMLMGSSKFHHQKYGEQKRERADADDLPVKKQKCYSSYSTTCPGGFSINLDFTSESSMQVIRHHGTRDYDASVSEVPKSTRTGTVTRKLESEGEQGLNCITPRLGKRSRPFKWQRRSYKKQKQSSPEENSLNTHCNVLPTNTDSMHAGSQSNTTGLSYHAKLQMPWQCSCCLILQSLPAVPRRTEIKRQSIFYNQEYSHEVFPKKRIHH

SEQ ID NO: 211188 - protein, 372 aa, Glycine max
  Coding DNA Sequence Number=SeqID_94410
  Homolog annotation: Hit_ID=Q10R20; Match level="QueryCoverage=98%, HitCoverage=98%, E-value=7e-40, Identity=32%"; Hit description =Expressed protein
MEPAKIDWKRLEWSFVEDELYEHINAPKWVDFLSLDHSLDDHADEAWFCKPDCKHPKTAEDFLRSATPSKKGFSPGYVSENLPSGDKIRRYRDVKIKRRVPAMSSASPQADKFRFNQESENQNPNLFTPPPTKEVNPVKEAIKSSEEKKKLVDNDDTLEDHKVPSLRSTLSAKNLFAGRPILNQITEFCNELKKLAIRAKERENAENLSPKESEEVVEKTPCSVQALAESDQKEKERKPLLEVSKTERLEGMSVKGKQQRKKRPDEAENNNMSITLDLENLKHKREGTLQQIRTNPPSPQCFSAARGLNKPIPSKASKSRLMERGILGEIEQNKEIVKESPAEKSRSTSIVDGRETKALDMFWFLKPCTLSG

SEQ ID NO: 211189 - protein, 75 aa, Glycine max
  Coding DNA Sequence Number=SeqID_94411
STLEDPLVVLTREVRGKQARWRAEINIVLDTFFRLDPLTSSAAPLVVLTREVKGKRARWRAETNIIFYTIWRPDP

SEQ ID NO: 211190 - protein, 191 aa, Glycine max
  Coding DNA Sequence Number=SeqID_94412
MIGTGCIGTSCIGVDSSKSAYGIGIGVIGGARLCGSQVLSGRPLWLSGHSLLDGRWIGRVSDVGRKAGVGISFLLLGPTCSESPIARAGRSGIIELSPFQAYLDPLARKYQICEARGHVPPPLGILFKGLMLLRTSTAKRNFSMLSTIEESGRASISGSRAKREIKALSATVVFSQAQCMTGAKLKSTYSR

SEQ ID NO: 211191 - protein, 266 aa, Glycine max
  Coding DNA Sequence Number=SeqID_94413
  Gene Ontology: Mol. function=RNA-directed DNA polymerase activity; Biological process=RNA-dependent DNA replication
MKADIEAMKDQMTSMMEAMLSMKQMMERKGGVRQHERFTHGAYPYGLPPNYTPPNTMHMPNENANHTVLVPFKGQQPQLGHTPFAQPVGDAGEEPQDYAQGDFEPYPMFTAEGPECSGMPQPNAAEASQQRPLQPLHFSIGRLPLAVEGREKLDFIKERLRAIEGIRDYPFLNMAKLCLVPDFDKYKGTTFPKNHLKMYCHKIGAYSRDEKLLMDFFQESLARATVTWYTNLEASRIHSWKNLIAAFMRQYQYNTDMALDRTQLQT

SEQ ID NO: 211192 - protein, 80 aa, Glycine max
  Coding DNA Sequence Number=SeqID_94414
MFISPPPSSAELPMAGKCEKRRSRNESRHRLITERVKTEEISVFIFTFLLSPIKEYWAFRRKQPSSPGRAGRQPPPPFFL

SEQ ID NO: 211193 - protein, 88 aa, Glycine max
  Coding DNA Sequence Number=SeqID_94415
MAPKKLLAKRARRDAIGEGSSAAPQGWSFLNERRVQLRDGEYAEFQEEIAKRKWTQLATPMAKYDHEIVMKFYTNAWPTEEGVRDKSS

SEQ ID NO: 211194 - protein, 166 aa, Glycine max
  Coding DNA Sequence Number=SeqID_94416
MWAFLTGHPIDWAHLIHYRMHKALRSSAPLPYPQLVTLLLRHFEIPLDSEPFVQVKCSFAIGAGAVTSFGYRKDMDGQWLKKDAQPAQDERTPSPLPQRDDSSALMHEVLSELRGLRTYVGERFDSLDGRIDAIDARFEGMDTHITQLEEDVSYLRRCFNLPPPSS

SEQ ID NO: 211195 - protein, 66 aa, Glycine max
  Coding DNA Sequence Number=SeqID_94417
MADTYSAPEEIHRLLSYLRIKSLPHFISSMHCMLVSSFVTGSRKVHITFLTVHIGHCAPKCASKKR

SEQ ID NO: 211196 - protein, 198 aa, Glycine max
  Coding DNA Sequence Number=SeqID_94418
MGEAEEVQEKMKADMEAMKKANGHNDGGHDEHEEDNGSQCEPDAPIYPQPNESSNLSYGRQRFRMYGRPLLCANSKQAPLHAIWLASQLTPPNVAYTPNENVNNSTSILIESQQPQSDHAHVSQPMGETHEMPHHNLADFEPCLGYATKGQAIGDIPLQNTLKGPQYHPQPHPLHSTAGKNPHAMAEMGEVGSSRGKA

SEQ ID NO: 211197 - protein, 140 aa, Glycine max
  Coding DNA Sequence Number=SeqID_94419
  Subcellular localization annotation: CTP_CleavageSite=31; ConfidenceScore=5.33e-01
MAEPSKKRKGVSSQSQRHSKTQETQIPSSISSSSLFSSEEQRIRYTNLFSSFSIIDPKFIDMDFFSNESCECIQAFENSNLIPFMSLKFPIYTELVKAFYYNLEIQEGTLISEVYGITQVIDQSLFYDLTQLSSEGVPFE

SEQ ID NO: 211198 - protein, 64 aa, Glycine max
  Coding DNA Sequence Number=SeqID_94420
FGAKSLSTMPTLDAHDLVGAHVQGHHEHVVSEGMFLRSDGGGTGGGRRDPFRCLDNENNNNYGG

SEQ ID NO: 211199 - protein, 34 aa, Glycine max
  Coding DNA Sequence Number=SeqID_94421
MERVLGGKFKVGAHIETSEIVAIKMKLNRLKGTE

SEQ ID NO: 211200 - protein, 51 aa, Glycine max
  Coding DNA Sequence Number=SeqID_94422
MDEFDILVSLILSQTHLCLFNFHWNRPALLSVDFQDRSIRDYSSCTLVGVP

SEQ ID NO: 211201 - protein, 100 aa, Glycine max
  Coding DNA Sequence Number=SeqID_94423
MLQNFTDYAIILFLTVGMLLNFTDYLTMGVMYLEAVKRRLHATKQWSPDEIRRYAINSWGFGLDGGGCMNNARQSIRGAPDLMVEDARTALGNQFMGLWT

SEQ ID NO: 211202 - protein, 122 aa, Glycine max
  Coding DNA Sequence Number=SeqID_94424
MAEMGKLDHLKERPRAIEGGEDYAFANLEELFLVPNIITPPKFKVPDFDEYKGTSCPKNHLKMYCRKMGAYTKDEELLIHSFQESLTGVAVTWYTNLEPSRVHSWKDLMVAFVRLCQYNGFG

SEQ ID NO: 211203 - protein, 177 aa, Glycine max
  Coding DNA Sequence Number=SeqID_94425
NQNFPCDHQKASTSTLTLSTLFGLCFWAAFRASSVDYKNKGETKDIELVELEQAQIGADPSSETSNKSENYKEEAQNATQKHKPKKVESVNADAKAFGGDSTVLKIGNSAKVVIKQDMKGRRHKYGFNNNKREKVEKKRVVDDETGDKNQLDEHQERLRKKLALEEERTFAANEQLS

SEQ ID NO: 211204 - protein, 69 aa, Glycine max
  Coding DNA Sequence Number=SeqID_94426
MDERPSQRVNLLLSHKDSKSSLLSFIGLKVMQSYSVRALGRRLQVDWARDPREGPRVLMSLRVDFEPMS

SEQ ID NO: 211205 - protein, 68 aa, Glycine max
  Coding DNA Sequence Number=SeqID_94427
MSLPSAVHVFSIIKCEASGDWEARYSVVFQIGSFAKRKKRRSRDESRHREKGRTDEISVLSLLSSYLR

SEQ ID NO: 211206 - protein, 70 aa, Glycine max
  Coding DNA Sequence Number=SeqID_94428
MEPSTKYRKDLKIYESTTINFFACDHHCVFDIHFIPPLERQTCGRQRHSSRKHIWTVRFTQEMLDAPEPL

SEQ ID NO: 211207 - protein, 61 aa, Glycine max
  Coding DNA Sequence Number=SeqID_94429
  Homolog annotation: Hit_ID=Q5VKS3; Match level="QueryCoverage=50%, HitCoverage=12%, E-value=3e-08, Identity=90%"; Hit description=MADS -box protein GmNMH7
MGDCLNELGMEDLRLLEEGMDKAAKVVRERKRCIAALTCVCGKHKGAATESLNSYVRWGMI

SEQ ID NO: 211208 - protein, 377 aa, Glycine max
  Coding DNA Sequence Number=SeqID_94430
  Gene Ontology: Mol. function=chitin binding; Cellular component =extracellular region; Biological process=chitin metabolic process
  Homolog annotation: Hit_ID=UPI00006A17C9; Match level="QueryCoverage =99%, HitCoverage=100%, E-value=3e-46, Identity=31%"; Hit description= UPI00006A17C9 related cluster
LHALAFRGLHVLTFIGLHVLAFRGLHVLPFIGLHVLAFRGLHALAFRGLHVLTFRGLHVLAFRGLHVLSFRGLHALTFRGLHVLAFRGLHILALRGLHVLAFKGLHVLAFRGLHVLAFRGLHAFTFRGLQALTFRGLHALTFRGPHSLAFRGLHVLTFRGLHILTFRGLHVLTIRGLHALTFKGVHVLAFKGLHVLAFRGLHTSSPSEDCTSSTSENSTPSPSKDYTTTCPRLQRTACYCLQRTARPHLQWTAHPRLQRNPRPRLQRTTRPRLQRTARPLHQRASEDCTSSPSEGYTPSSLEGYTSSPSADYTSSPSEGLHVLAYRGLNIVTLSGLHALTFRGLHVLLFRGLHVLAFRGVHALAFRGLHVLALRGLH

SEQ ID NO: 211209 - protein, 256 aa, Glycine max
  Coding DNA Sequence Number=SeqID_94431
  Gene Ontology: Mol. function=DNA binding; Biological process=DNA recombination
  Homolog annotation: Hit_ID=Q8PIJ3; Match level="QueryCoverage=77%, HitCoverage=45%, E-value=7e-67, Identity=67%"; Hit description =Integrase/recombinase
MVKVGTSYVPINVSFSPKVGPGLPGINRDTRIYLFCEVIFRHSHTYVKSGEQGMMPKLSVHVMQDGERVPMLHDESGLPLFYPTLYATSQLRNAGVAVNTIRNKLADLIVLLRWEFANRRNLISDFQAGRFLTIADVVSLRDFTKLDMRNWKSDGQSTGKPCVRVPSFLEATIASSRALAAIGPQQHFNRLSTIADYLEFTASVVTQYRNSHQIAQEIARMVTAIRKHRPRGLAKHLEEEPERRSPPTEVVNRFMA

SEQ ID NO: 211210 - protein, 428 aa, Glycine max
  Coding DNA Sequence Number=SeqID_94432
  Gene Ontology: Mol. function=membrane alanyl aminopeptidase activity; Cellular component=integral to membrane; Biological process =proteolysis
  Homolog annotation: Hit_ID=Q26D55; Match level="QueryCoverage=99%, HitCoverage=34%, E-value=2e-75, Identity=36%"; Hit description =Conserved hypothetical transmembrane protein
MGGLALVLQVLTNNKFVGYALLIVVMIGQGVLGMLDYTQNLYNFGSWPNAPYSDMNGYGHFLTGQLAFQGYWALFLLTLMCLASAFWVRGVSQGLRQRLALAGRRLRGPTGAFAAVAALAFVGVGSWLYWSTNIRNEFLSPDQQLDLQARYERELSKYRNLPQPRIVAVDNRVDLFPESQSMVIDANWTVRNTHATPIQDVHVSMGDDKQLVALDLGGQTLSMHDADLGYRIYRLQKPLQPGENRSVHFRVVQKPNGITAGQAPSNIVDNGTFFNSRVLPSFGYNEGAEISDRNERRKRDLGEPRRMPKLEDEAARANTYIANDADWLDFRTTVCTAPDQVALAPGYLQHETTVNGRRCFSYAMDRPMLNFYAYLSARWEVRKAKYKDIPIEVYFDPAHGYNVDRMIEAVQKSLAYYEANFTPYQHRQ

SEQ ID NO: 211211 - protein, 116 aa, Glycine max
  Coding DNA Sequence Number=SeqID_94433
  Gene Ontology: Mol. function=nucleic acid binding; Biological process= DNA integration
GVMDGQNDRVIVDALQALAQATGNPNRGEATGAAEEIEKIFQVMACPEGKKVSFGTYTLVEEAEYWWENTCQCLEAEGQDVTWIFITWDVFKRVFLEKYFCEDVRNKKEMEFLELK

SEQ ID NO: 211212 - protein, 152 aa, Glycine max
  Coding DNA Sequence Number=SeqID_94434
MRGGINYNPVLAIRQIGYPMRDSAKILQRVRKAWNRVERKDKELRGSSNGVIGDYHKWLKSKTQGITWLPKIKGLSGKEVEIPEESEEVQALKAELERTRVVKEKLKVAVTRVRKECDELKDINIAMVEALERETKKARKEEWSRNKFRGAL

SEQ ID NO: 211213 - protein, 113 aa, Glycine max
  Coding DNA Sequence Number=SeqID_94435
MGEVEEAQEQMKADMKALKEQMATMMEAMMSIKEIMEVNVAAIAATSTIAEVDLTSPIWLQPNKSSNLRYGRSRRQRVGRYRRPSFSAKKQACISTIWLASQLCTTQCGIHSQ

SEQ ID NO: 211214 - protein, 136 aa, Glycine max
  Coding DNA Sequence Number=SeqID_94436
  Homolog annotation: Hit_ID=Q84VH5; Match level="QueryCoverage=75%, HitCoverage=15%, E-value=3e-27, Identity=65%"; Hit description =Envelope-like protein
MKRESALSLHYKLFEGTHVPDIVSTSGKAAASGAVSKDALIAELKDTCKVLEATIKATTEKKMELERLIKRLSDSGIEDREALIEDVAVRAWRQGEQKADVTRDVLTSWKRLVADRRCRSELLHSSRSMETGGAES

SEQ ID NO: 211215 - protein, 109 aa, Glycine max
  Coding DNA Sequence Number=SeqID_94437
MGAIVVAVEGMGANTPLHQVGTGHRSRCRVSNSVTSGKNEEGEGRGEGRGDAVLDCAYMVNEKGRSRAVKVWQKLQAQVDKLSDARLEEAFYQNTKALQSFQCLDANTY

SEQ ID NO: 211216 - protein, 80 aa, Glycine max
  Coding DNA Sequence Number=SeqID_94438
MDLKVESVFYASNLVFAATEEKHHRGSASLIKQHRGLRRCRRAHMEKRSEDVMKPPSPAWTMMEATNLGMRVVGAERKSA

SEQ ID NO: 211217 - protein, 217 aa, Glycine max
  Coding DNA Sequence Number=SeqID_94439
  Homolog annotation: Hit_ID=Q2HU26; Match level="QueryCoverage=86%, HitCoverage=83%, E-value=3e-39, Identity=47%"; Hit description=CCT
  Pfam annotation: Domain name=CCT; Domain location=128-166; Score =82.6; E_value=1.2e-21; Accession=PF06203.4; Description=CCT motif
  Subcellular localization annotation: CTP_CleavageSite=4; ConfidenceScore=5.26e-01
MYAQSSTASPLPSPLPSPSSFFPEVTEFETLSQLNNSETSYYYNRVLAPIPSTATTMAPIIPFLLSLLSCSTPMSMLPLGEFAVLKINGMQHNHHSDSPLSSESSMIIEGMSRACRYSPEEKKVRIERYRSKRNQRNFNKKIKYACRKTLADSRPRIRGRFARNDEIDKNTTLQWSQIGAGEEEDEEDENWVTMLDSLVAANFAQESHGTSTFGLFY

SEQ ID NO: 211218 - protein, 45 aa, Glycine max
  Coding DNA Sequence Number=SeqID_94440
MKGFEFRHETKDNGAQRCMEIAQLFVCRVGRETSNGSLELVELRA

SEQ ID NO: 211219 - protein, 74 aa, Glycine max
  Coding DNA Sequence Number=SeqID_94441
MKWKIGRTKKTDRMTSEAAKEIAEKIERFIGGAGLTWFLCRPWTLGSGVTIKQYFGPTLRTSCTSSSMALEDLE

SEQ ID NO: 211220 - protein, 69 aa, Glycine max
  Coding DNA Sequence Number=SeqID_94442
MKKKKVEAAGVLISEAYALSDEMEESGREFAIHARAQCAISSLSESFVSSRTQLAKRKFTNSRLERKWR

SEQ ID NO: 211221 - protein, 264 aa, Glycine max
  Coding DNA Sequence Number=SeqID_94443
  Gene Ontology: Mol. function=sugar binding; Cellular component =cellular_component; Biological process=biological_process
  Homolog annotation: Hit_ID=Q9M7M4; Match level="QueryCoverage=85%, HitCoverage=93%, E-value=6e-61, Identity=52%"; Hit description =Mannose lectin FRIL
  Pfam annotation: Domain name=Lectin_legB; Domain location=38-244; Score=160.5; E_value=4.4e-45; Accession=PF00139.10; Description =Legume lectin domain
  Subcellular localization annotation: CTP_CleavageSite=71; ConfidenceScore=5.03e-01
MAIWNTSHVLTNKPIFLIPLLVFVTMLFMLPNKVNSAHSVSFTFNKLGGDQKDLIFQGDATSNNNVLQLTKLDNKGNPQLTLLQLLEFPSSLHDSTIPPHSGGRLLGLFPDSNALKNSSSSNNETAIDFKASSDKVVAVEFDTYHNWDSWDPYYKHIGIDVNSIRSKATAQRNWQNGKIATAHISYNSASKRLTVVAFYPATKAVTLSHDIELNKVLPEWVRVGISASTGAHKQKNTILSWSFTSSLKNNGVQKKEDMYIASVA

SEQ ID NO: 211222 - protein, 57 aa, Glycine max
  Coding DNA Sequence Number=SeqID_94444
MGEKMLILEYMQTMRVPRVFCVARWLVIHICEGPTPLDIGRASNRIWNGSFFISGWL

SEQ ID NO: 211223 - protein, 515 aa, Glycine max
  Coding DNA Sequence Number=SeqID_94445
  Homolog annotation: Hit_ID=Q8H0I1; Match level="QueryCoverage=49%, HitCoverage=42%, E-value=8e-22, Identity=32%"; Hit description =Hypothetical protein B57
MDSGAVQSEVHENDEHYPHIVVSEQVTHGAEEDHFDEEKKSVLNKVKAKAKKIKDTIKKHGHQVLDRGHVYNNEDQHTLDDDDLEEDEEMAEDPQVHETPIQESEDVKTAIPTSEQLEYLGKSGIDFGGTAVMGEEPRHDALLGGISSATEIDQNIAKTFSVEEKAEIPKENLERSIGLEEAPHAPGSTIEAYTPPNYETKITDPSVIGKDEIEEITPVEESFAKMNVHEKPTPEPIVPLAEKHDQFVSHLSAATQTRYPSSESHDDQFKQETTSTNINRNLENPTETGITFNTITTTVEEQPHYEANIDEVVSPKDVIDSEAGSGEKVEIKDKVVTNEEQGDASNMPDSTAQHGKNIAHSLSEKLAPVYDKVAEVGGAVKSKVTRTSTGGVGTETKNEVSVKDYLSEKLKPGEEDKSLSEVISEALHKRKEEPVKKEDENLNGGDDKMCEESSVKSPGKGVVGKLKGVVGSWFGKSEEKGEDLSKSTNSGAEVEQVHQVVGGNKSSPFEEQGTR

SEQ ID NO: 211224 - protein, 467 aa, Glycine max
  Coding DNA Sequence Number=SeqID_94446
  Gene Ontology: Mol. function=helicase activity; Cellular component =intracellular; Biological process=metabolic process
  Homolog annotation: Hit_ID=Q7G2B3; Match level="QueryCoverage=84%, HitCoverage=80%, E-value=1e-138, Identity=57%"; Hit description =Pentatricopeptide, putative
  Pfam annotation: Domain name=PPR; Domain location=144-178; Score =13.3; E_value=0.2; Accession=PF01535.11; Description=PPR repeat
  Pfam annotation: Domain name=PPR; Domain location=179-213; Score=7.4; E_value=1; Accession=PF01535.11; Description=PPR repeat
  Pfam annotation: Domain name=PPR; Domain location=214-248; Score =11.7; E_value=0.31; Accession=PF01535.11; Description=PPR repeat
  Pfam annotation: Domain name=PPR; Domain location=249-283; Score =24.0; E_value=0.00054; Accession=PF01535.11; Description=PPR repeat
  Pfam annotation: Domain name=PPR; Domain location=284-318; Score =32.5; E_value=1.5e-06; Accession=PF01535.11; Description=PPR repeat
  Pfam annotation: Domain name=PPR; Domain location=319-353; Score =42.1; E_value=1.8e-09; Accession=PF01535.11; Description=PPR repeat
  Pfam annotation: Domain name=PPR; Domain location=354-388; Score =40.3; E_value=6.8e-09; Accession=PF01535.11; Description=PPR repeat
  Pfam annotation: Domain name=PPR; Domain location=389-423; Score =55.2; E_value=2.2e-13; Accession=PF01535.11; Description=PPR repeat
  Pfam annotation: Domain name=PPR; Domain location=424-458; Score =21.6; E_value=0.0029; Accession=PF01535.11; Description=PPR repeat
  Pfam module annotation: Pfam domain module=PPR::PPR::PPR::PPR::PPR::PP R::PPR::PPR::PPR; Domain location=144-178::179-213::214-248::249 -283::284-318::319-353::354-388::389-423::424-458
MNAITLLGPKRVQNFSHSLIILRRLCSHPFDGNGFEFIEEPLKKLGPDYDTNVDERLHLKEDWGYNRKQFSLRKGFLETVKLDAKRVLEVLRQDGPGLDARLVLGELHVRLSGLLVREVLFGILKHINCENKTSQQEGYQHTVNAYHLVMNIYAECEEFKALWRLVDEMVEKGLPATARTFNILIRTCGEAGLAKSLVERFIKSKTFNFRPFKHSYNAILHGLLVLNQYKLIEWVYQQLLLDGFSSDILTYNIVMYAKYRLGKLDQFHRLLDEMGRNGFSPDFHTFNILLHVLGKGDKPLAALNLLNHMREMGIEPTVLHFTTLIDGLSRAGNLDACKYFFDEMIKNGCIPDVVAYTVMITGYVVAGEIEKALKMYQYMISREQVPNVFTYNSIIQGLCMAGKFDEACSMLKEMKTKGCSPNSFVYNTLASCLRNAGKTADAHEVIRQMTEKGKYADIHSRFRGHKA

SEQ ID NO: 211225 - protein, 37 aa, Glycine max
  Coding DNA Sequence Number=SeqID_94447
  Gene Ontology: Mol. function=protein serine/threonine kinase activity; Biological process=protein amino acid phosphorylation
  Homolog annotation: Hit_ID=Q1SW54; Match level="QueryCoverage=97%, HitCoverage=3%, E-value=2e-10, Identity=81%"; Hit description =Protein kinase
GYLDPDYYTSQQLTEKRDVYSFGVLMVKLITARKPIE

SEQ ID NO: 211226 - protein, 130 aa, Glycine max; identical to SEQ ID NO: 185217
  Coding DNA Sequence Number=SeqID_94448
  Gene Ontology: Mol. function=actin binding; Cellular component =intracellular; Biological process=cell division
  Homolog annotation: Hit_ID=Q8H2B6; Match level="QueryCoverage=99%, HitCoverage=94%, E-value=3e-61, Identity=88%"; Hit description =Pollen specific actin-depolymerizing factor 2
  Pfam annotation: Domain name=Cofilin_ADF; Domain location=5-130; Score=207.2; E_value=3.9e-59; Accession=PF00241.10; Description =Cofilintropomyosin-type actin-binding pr

SEQ ID NO: 211227 - protein, 878 aa, Glycine max
  Coding DNA Sequence Number=SeqID_94449
  Gene Ontology: Cellular component=peptidoglycan-based cell wall; Biological process=polysaccharide catabolic process
  Homolog annotation: Hit_ID=Q9FHC2; Match level="QueryCoverage=9%, HitCoverage=32%, E-value=2e-12, Identity=40%"; Hit description =Genomic DNA, chromosome 5, TAC clone:K24M7
  Pfam annotation: Domain name=zf-CCHC; Domain location=780-797; Score =11.8; E_value=0.011; Accession=PF00098.13; Description=Zinc knuckle
  Pfam annotation: Domain name=zf-CCHC; Domain location=806-823; Score =10.1; E_value=0.021; Accession=PF00098.13; Description=Zinc knuckle
  Pfam annotation: Domain name=zf-CCHC; Domain location=832-849; Score =14.3; E_value=0.0044; Accession=PF00098.13; Description=Zinc knuckle
  Pfam module annotation: Pfam domain module=zf-CCHC::zf-CCHC::zf-CCHC; Domain location=780-797::806-823::832-849
MQSEFSDAKKHREEENPQTLASPEHGTEKKKKKKRKRKKITEESNEQPQVEVCPKPFADSLVSIVPQEENAETSTQNPNPPPRKKKKKNSVQGAEQVQTLDPSILLGVEPDVTKEEGAQQASDLPAETITQNRAPTPKKNKKDVQGAQQQLPICDPSNPTGVEPNFAKEEATQQGDANETAVPGINEERPGPDSMPLEDTPRKKKSAGKKKNVLIKPHGAKLELESKESNNTEHPQQCSSDSELKMKMKKGAEANAENSALCPKPELALPNDKSIPIDSVVNKRTVPTEAKVEDPQACSKPKLASSIDLPAPTNPEKKKEAEPIQNPEARVEPPQPQSCPASCAESPGNPAIPIDQSRRKQKSKRGKEKIIMCSEEKVENQGSSLHMDITLNQVPDQVQQGQTTPISLQPASLTDHTIPVHPATPIDPEQTMKKKKKKQRKNALEWEELNDNKNCTELPEISIQTSPCLIEASPIDPAIPMGSCLTIPICPAISADPEQEMSKKKKKRKSVLKSEAAEPNEHNKLPEAAPPDAPVQKSIYHIDAPSIDPIIPMGPSPPVDTETPIDQGQEMTKKKRKKKKRIVIITEGTETNEHGVKPSETPVERFTYPTVATSIDPKIPVLAPPIDTATPINQSQKTGKKKRKMSALISKGAEPNEHDDKPAGTPVQRSIHSIAEPSIDPTIPTSQAPPVDPATLVDPEPMTKKKRKKRNSALKNEGLESEKHNADPTAETPVQKTEGSTTENFKGRCNAGPAGKTPVQRTDSLRVTKSPFKHHGESSLRCRACRQPGHRFQQCQRLKCLSRDEEVCFFCGEIGHSLGKCNVSQAGGGRFAKCLLCYEHGHFSYNCPQNGHGIDPKVLEDNGAINRKYPGKNLGGNG

SEQ ID NO: 211228 - protein, 476 aa, Glycine max
  Coding DNA Sequence Number=SeqID_94450
  Homolog annotation: Hit_ID=Q43588; Match level="QueryCoverage=40%, HitCoverage=98%, E-value=2e-63, Identity=62%"; Hit description=PAR -1b protein
  Pfam annotation: Domain name=PAR1; Domain location=2-192; Score =402.7; E_value=5.4e-118; Accession=PF06521.2; Description=PAR1 protein
MASNFSLRTLMIFSLAFWLALKGTLGGIECETLSHDTCSFAVSSAGKRCVLEKRVKRTGEEAYTCRTSEIEADKLKDHIETEQCIKACGLDRKSLGISSDSLLESTFTQKLCSPHCYQCCPNVVDLYFNLAAGEGVFLPKLCEAQGVNARRGMAELKSSGIVAPGPVHGVQFAAAPPINPVELTIEPAVAPKCPCLLVNKKISPLEVDAVLLSHPDIAQAVAFGVPDDKYGEERFSKKNLAAFKVPKKVFFTDSLPKTATGKILRRLVEEFSDPGLDKIAWISRFLGWDRGICDLSVFVSDKEMKGGFATVASDPFVVAVVAKALIAGKTVENLDIDPGVYPLGDVLRQRPVGAKLVGELGPLSEVPTMPRCCNLKSASRHRKTKGQIEIQLLEAMSARDRGKVCKTFQKGVHLEVHVYLGLDKGGLVLRKKWVTLCESGDGFFKMFDGGLLGVVFQHSGSRSDHLLGMLSTNYED

SEQ ID NO: 211229 - protein, 188 aa, Glycine max
  Coding DNA Sequence Number=SeqID_94451
MIAETEPFGSEENGEEEEKEGMVEICVPDRGSTHNRKGETNVEEKDVATEWLCVGPVTGSWEGVGGKCVVLVNGKVKSCHGKGRQREEEDGLVTLGSKGGIGGDFAKAEDGEGCLGTMIFSIRRMSSSLEAMEVWAAVVEVWIAASLVMAASRRSTQAVESSVSAIEEWQVGPIVSGGSLKFETKDNL

SEQ ID NO: 211230 - protein, 68 aa, Glycine max
  Coding DNA Sequence Number=SeqID_94452
  Gene Ontology: Mol. function=transcriptional repressor activity; Biological process=regulation of nitrogen utilization
  Homolog annotation: Hit_ID=Q10L97; Match level="QueryCoverage=53%, HitCoverage=11%, E-value=6e-10, Identity=78%"; Hit description=NAD dependent epimerase/dehydratase family protein, expressed
MSIMCSSSYSIEISHWLEKFGNGVSGDKLVGEASRIVVAEACVQALDLEVTENQVYEVNSVELKRTDS

SEQ ID NO: 211231 - protein, 302 aa, Glycine max
  Coding DNA Sequence Number=SeqID_94453
  Gene Ontology: Mol. function=DNA-directed RNA polymerase activity; Biological process=transcription
  Homolog annotation: Hit_ID=Q9SMT8; Match level="QueryCoverage=80%, HitCoverage=49%, E-value=2e-43, Identity=40%"; Hit description=RNA polymerase III subunit-like protein
  Pfam annotation: Domain name=RNA_pol_Rpc82; Domain location=9-256; Score=81.6; E_value=2.5e-21; Accession=PF05645.4; Description=RNA polymerase III subunit RPC82
MVELTFVRETLCKLLTARFVERCPAPEPVVSTSFKETTTRKRGAKSAKIFEAPETLEQRVVDAAVPGDVIRFSLAADTRCSVDRETNSDDAQMISVEEEVAKEGQILWRANFEEFIRHLRHKVLIENVRTQHDDGTATVLSAVLEATRSVQKKVKTENSVPLSLDTIITEVMKTDTGRTMTVDRIRASLVQLGCSPSMILEESYSIDLKKIIEPARNEEVESIVLKRYGTDGYRIFRLLAKDCCFHDTDQMFIVVVLVLFNTRGANCWKNCLNCGHTLAHLSCSLFGGCLKCNLEGGGLVPH

SEQ ID NO: 211232 - protein, 128 aa, Glycine max
  Coding DNA Sequence Number=SeqID_94454
MEEIPLFSEKMKLAQKAASQGKWMGRLQGNNEGRQGKPAQVNDRGALNLVLDVAIWLVMRIDKELAVQRDEKDLTCLQLLSKMPQVFRSHTSMGPVKSLIYLVKRVRIYNLDTRSYDPFVELYEVKRK

SEQ ID NO: 211233 - protein, 60 aa, Glycine max
  Coding DNA Sequence Number=SeqID_94455
MEEREQKIFIPDKFSARLPFSTGDIPPHMNKEEKTETPSFLSKNTSLEKILLVRDRTFDL

SEQ ID NO: 211234 - protein, 518 aa, Glycine max
  Coding DNA Sequence Number=SeqID_94456
  Gene Ontology: Mol. function=monooxygenase activity; Cellular component=membrane; Biological process=electron transport
  Homolog annotation: Hit_ID=Q1S498; Match level="QueryCoverage=94%, HitCoverage=94%, E-value=0.0, Identity=71%"; Hit description =Cytochrome P450
  Pfam annotation: Domain name=p450; Domain location=46-515; Score =209.1; E_value=1e-59; Accession=PF00067.12; Description=Cytochrome P450
MEFFLGLCGVLVAFSAALCLLLLLILTFYWVVFPNQTLKKLKKCGLGGPTPSFPLGNIEEMKRKNNIQSSIVSSNFSHDIHSSVFPYFSSWQKSHGKVFVYWLGTEPFLYVAEPEFLKKMSTVVMAKKWGKPSVFRTDRDPMFGSGLVMVEGNDWVRHRHIVAPAFNPINLKAMANMMVESTNQMIDRWANQINTGNPEFDVEREITATAGEIIARTSFGMKDGNARDAIAKLRALQMTLFKTNRYVGVPFGKYFNVKKTLEAKKLGKEIDELLLSIIESRKNSPTKNSQQDLLGLLLQGNHQVDGRSGKTLSSREVVDECKTFFFGGHETTALAITWTLLLLAMHEDWQNQLRDEIRQVVGGYEKLDITSLSGLKKMKCVMNEVLRLYPPAPNVQRQAREDIKVDDITVPNGTNLWIDVVAMHHDPEVWGNDANEFRPERFMDDVNGGCNHKMGYLPFGFGGRMCVGRNLTFMEYKIVLTLLLSRFTFKLSPGYNHSPSIMLSLRPSHGLPLIVQPL

SEQ ID NO: 211235 - protein, 127 aa, Glycine max
  Coding DNA Sequence Number=SeqID_94457
MGLINPFSIKELKMEKGTKARAEFVKARVVAKKDYVDFSATLRKALKANDTLLGEAIKFASNLAIEFKRLSQDLSQFTKERDGGDVGMAHTKMLLESAKKTIYSKHVAGLNMVEKDVRNELMVLVVL

SEQ ID NO: 211236 - protein, 151 aa, Glycine max
  Coding DNA Sequence Number=SeqID_94458
MIVYMRDLELYIMPKSELEEKGHFEGVEDKSLGEEEVEGEKRLNETDESLGKVEEEMRDFDDAKEESNKAATFASRLIQDFFNKQSLDSRILQDQAFPQNKGKCNRLPEGKFEKLLLKRVLNLNFEHVIDYQQRNSENSNSKIITLQNITV

SEQ ID NO: 211237 - protein, 69 aa, Glycine max
  Coding DNA Sequence Number=SeqID_94459
MLYQYVAITPNCHPCGCVRPPILGRLGGIVGPCYVSRHRECCFLRKTIHHGYLEPSSKEDEDDPSKDPS

SEQ ID NO: 211238 - protein, 110 aa, Glycine max
  Coding DNA Sequence Number=SeqID_94460
KSIQETTKGTLITRKLPFIPTLVFPVLLDSEQTRPTTKFNKSKTKYKFVEPTETHHRHITAQCSSQESAMRKETLGRSQEEGARSADLRSEEAAIGEGEEKGSKTQTLEN

SEQ ID NO: 211239 - protein, 160 aa, Glycine max
  Coding DNA Sequence Number=SeqID_94461
MEVPCNGNALPQLPPGMRHSGGGGDDERDLRFGIWRDTKSPENTIETDSSLVSFSLVEVLGDVLTLFDDDEREIESTNKQVHDCEDPCVNDYIGDDVLNEIDRITKHIVDQYKDPEAGVDHPSYDIPLDYGGLNVEGDVATKVMIDFFGHVGDDNQDVEE

SEQ ID NO: 211240 - protein, 87 aa, Glycine max
  Coding DNA Sequence Number=SeqID_94462
  Gene Ontology: Mol. function=transition metal ion binding; Biological process=aromatic compound metabolic process
KNVCDSVIGMLLNIQGKMKDGLNTRQDLAEMGIRVQLHLMSDGKEKMSFCQCLRRVKVPQGYSSNIKSLVQLKDLNLNYTVGGLEEG

SEQ ID NO: 211241 - protein, 57 aa, Glycine max
  Coding DNA Sequence Number=SeqID_94463
MSLELLLHCAVRASSPLFIVGIKDLQLRCAVPPSRPTASAHRQQEAAPIAEDTPVVT

SEQ ID NO: 211242 - protein, 137 aa, Glycine max
  Coding DNA Sequence Number=SeqID_94464
  Gene Ontology: Cellular component=integral to membrane
  Homolog annotation: Hit_ID=Q2HTM6; Match level="QueryCoverage=58%, HitCoverage=31%, E-value=8e-10, Identity=38%"; Hit description =Sodium/calcium exchanger membrane region
MSKDEIEFLLSLEIHGTLFHAQILVEHKANEEQEHCSSHVKEHIPNEGHDVKGGEDGVEVDVILADMEGNGGLKDVGGVVVEGEEGDDMHVEGEVKVRGELCGDEGEVVLSSGDEDAKVELEEKREEGDGERGGFRK

SEQ ID NO: 211243 - protein, 114 aa, Glycine max
  Coding DNA Sequence Number=SeqID_94465
MGSCCHQTPTIEGGATIWICLDHSSTDYRFNDDTYVEPHIPKVPVAPAAAPTHDPSDVEQPRHAMEACQTIVERLERLLNLRIVTASTEMHEVMEDYLRITRGVTAESNVYVRS

SEQ ID NO: 211244 - protein, 103 aa, Glycine max
  Coding DNA Sequence Number=SeqID_94466
MANKVLELNMEGPEEIGAEARAGKDEVGVDGATVEGAKAGKAEDDRASDLLPLAFQGPRKVTVGSSRLSKDNESEVTRLALHKAVMRAGKPSREESYCAIIEI

SEQ ID NO: 211245 - protein, 117 aa, Glycine max
  Coding DNA Sequence Number=SeqID_94467
MDNKCSELGVAGLGRTGAGAEGGRVDADADGADMEGTKEGGAEEDGTSDPLPLDLWVPRKVTEGSSRGYINLGLTDNKRGYISCGSVLVEGTSTRFKENKGGYIPCGSLLVKGFLQG

SEQ ID NO: 211246 - protein, 211 aa, Glycine max
  Coding DNA Sequence Number=SeqID_94468
MTNLDLHPKRPGTATQIMYSAGRYFRREMYNYGSIDVAIIKEFYANLYDPEDKSPKQVRVRGHLIKFDVDALNTFFWTSVIEEGESLSAYSRFAQFRPDPQELAACLCIPGKGFELNADGLPLKILRKNLNMLAKTWSVHSFSNLASTSHTSNITLDRARLIYGIIQKMDMNLGYLISSQISLIAQHDSSRLGFPALITTLCKARESPLTL

SEQ ID NO: 211247 - protein, 120 aa, Glycine max
  Coding DNA Sequence Number=SeqID_94469
MAASDHVIGCTLCGGAHGSGLCIPTEETSHEVNYMGNQPRQNFNAGGFSGFQHGQPYQQHNQWRTHPGNQLNKDQGQLPNKPRQKGPSLSERTTKLEETLAHFMQVSLTNHKSIESATKI

SEQ ID NO: 211248 - protein, 519 aa, Glycine max
  Coding DNA Sequence Number=SeqID_94470
  Gene Ontology: Mol. function=monooxygenase activity; Cellular component=membrane; Biological process=electron transport
  Homolog annotation: Hit_ID=Q1S498; Match level="QueryCoverage=94%, HitCoverage=94%, E-value=0.0, Identity=71%"; Hit description =Cytochrome P450
  Pfam annotation: Domain name=p450; Domain location=45-516; Score =210.4; E_value=4.1e-60; Accession=PF00067.12; Description=Cytochrome P450
MEFLGLTGVLVAFLAALCLFLLLILTFSWWVFPNQTLKKLKKCGLGGPIPTFPLGNIKEMKRKNNIQSYAVSSNLTHDIHSYVFPYFSSWQKSHGKVFVYWLGTEPFLYVAEPEFLKKMSTVVMAKKWGKPSVFRTDRDPMFGSGLVMVEGNDWVRHRHIVAPAFNPINLKDMANMMVDSTNQMIERWFSQINSIGNSEIDIEREIIATAGEIIARTSFGMKDDNARDVFDKLRALQMTLFKTNRYVGVPFGKYFNVKKTLEAKKLGKEINELLLSIIETRKNSPKKNSQQDLLGLLLQENNNQVDGRSGKTLSTQEVVDECKTFFFGGHETTALAITWTLLLLAMHEDWQNQLRDEIRQVVENTEELDISILAGLKKMKWVMNEVLRLYPPAPNVQRQAREDIKVDDITVPNGTNLWIDVVAMHHDPEVWGNDANEFRPERFMDDVNGGCSHKMGYLPFGFGGRMCVGRNLTFMEYKIVLTLLLSRFTFKLSPGYNHSPSIMLSLRPSHGLPLIVQPL

SEQ ID NO: 211249 - protein, 910 aa, Glycine max
  Coding DNA Sequence Number=SeqID_94471
  Gene Ontology: Mol. function=subtilase activity; Cellular component =cytoplasm; Biological process=proteolysis
  Homolog annotation: Hit_ID=Q6ESI7; Match level="QueryCoverage=94%, HitCoverage=62%, E-value=0.0, Identity=66%"; Hit description =Putative tripeptidyl peptidase II
  Pfam annotation: Domain name=Peptidase_S8; Domain location=3-498; Score=119.1; E_value=1.3e-32; Accession=PF00082.12; Description =Subtilase family
MIEALFPENGCGDDSGVDPAAAGLQVTSDGKPKIIDILDCTGSGDIDTSKVVKADADGCISGASGASLVINTSWKNPSGDWHVGYKLVYELFTENLTSRLKKERKKKWDEKNQEEIAKAVKQLTDFDQEHIKVEDAKLKKVREDLQNRLDLLRKKSESYDDKGPAIDAVVWYDGEVWRVALDTHSLEDDPDCGKLANFIPLTNYSLFFRTEKKYGIFSKLDACTYAVNVYNDGNVLSMVTDSSPHGTHVAGIAAAFHPEEPLLNGVAPGAQLISCKIGDSRLGSMETGTGLTRALIAAVEVISTIDIDLSLIFVFDHKCDLINMSYGEPTSLPDYGRFVDLANEAVNKHRLIFVSSAGNSGPALSTVGAPGGTSTNIIGVGAYVSPAMAAGAHCVVEPPSEGLEYTWSSRGPTTDGDLGVSVSAPGCAVAPVPTWTLQRRMLMNGTSMASPSACGGIALLISAMKAEGIPVSPYSVRKALENTSIPIGDSPEDKLSTGQGLMQIDKFDIFTNFAFMEVLVNDPSSRGIYLREANACRQPTEWMVQVDPKFHEDANKLEELAVFEECIELHSSDKTVVKAPEYLLLTHNGRTFNVFVDPTNLNDGLHYYEVYGIDCKAPWRGPLFRIPITITKPMAVTDRPPQVSFSKMLFQPGHVQRKYIEVPHGASWVEATMNASSFDTARRFFVHTVQICPLQRPITRRNVINFSSPTAKSFTFRVVGGQTLELVIAQFWSSGIGSPETTSIDLEVVFHGIKVNKEEIVLDGSEAPIRIDAEALLASEKLAPVAILNKIRVPYRPIDAKISSLSSDRDKLPSGKQILALTLTYKIKLEDGAEIKPQIPFLNDRIYDTKFESQFYIISDSNKAVVQLNKIPIYVFCPMRASPGAAVKLCLGDLLVMGSNPETASLHMQG

SEQ ID NO: 211250 - protein, 188 aa, Glycine max
  Coding DNA Sequence Number=SeqID_94472
  Homolog annotation: Hit_ID=Q6ESI7; Match level="QueryCoverage=34%, HitCoverage=4%, E-value=1e-09, Identity=51%"; Hit description =Putative tripeptidyl peptidase II
MGTEDSDESTATVVVRVRMEETIGANLCLGHERSQESGLIQVAERGIVVVVVVVATTTERSAVHCFGDNPIASSEGGSGSVFPSRAVELCLCCAVKDVKDSVVQGRAGQSNCLVVNSRNAIRMQHLSDEVYRTTKNTSPRSIVQINLSFRSIFHLSKIVMHNSIKTQSRNHGGWCRKKPLKFNTEVVS

SEQ ID NO: 211251 - protein, 224 aa, Glycine max
  Coding DNA Sequence Number=SeqID_94473
  Gene Ontology: Mol. function=RNA-directed DNA polymerase activity; Biological process=RNA-dependent DNA replication
  Subcellular localization annotation: CTP_CleavageSite=26; ConfidenceScore=5.23e-01
MMSSKTNISLKGQSTGWGGSVGCNSRCSNGPSREGNVGGRDSGGLNRIVHAVCTPSKAQYGELVDALEFRSMVTTAFIRIRAQQLRWMKWRKTSGVLCDAKVPIKLKGKFYRTAVRPAILYGTECWAVKSQHENKVGVAEMRMLRWMCGKTRQDKIRNEAIRERVGVAPIVEKMVENRLRWFGHVERRPVDSVVRRIDQMERRQTIGGRGRPKKTRGYQKGSRN

SEQ ID NO: 211252 - protein, 94 aa, Glycine max
  Coding DNA Sequence Number=SeqID_94474
MADHATRKTTTDRLEDAITRLTHSQASLSDKYSELLGKVDSILDHLRLRDTNSNNPNAHTSSAQRNHVKLDIPRYNVTTAALLSKDDRLARYSS

SEQ ID NO: 211253 - protein, 76 aa, Glycine max
  Coding DNA Sequence Number=SeqID_94475
  Gene Ontology: Mol. function=oxidoreductase activity
  Homolog annotation: Hit_ID=Q0WSU6; Match level="QueryCoverage=92%, HitCoverage=21%, E-value=6e-11, Identity=48%"; Hit description=SRG1 -like protein
MFEFGTSVLVPSVQELAKQAIINVPEKYLRPNQDSHVIVDSTLTLPLIDLSKLLSEDVTELEKLNNACKEWGFFQV

SEQ ID NO: 211254 - protein, 1380 aa, Glycine max
  Coding DNA Sequence Number=SeqID_94476
  Gene Ontology: Mol. function=RNA-directed DNA polymerase activity; Cellular component=chromatin; Biological process=chromatin assembly or disassembly
  Pfam annotation: Domain name=Chromo; Domain location=1301-1349; Score= 28.0; E_value=3.3e-05; Accession=PF00385.14; Description='chromo' (CHRromatin Organisation MOdifier
  Pfam annotation: Domain name=RVP_2; Domain location=338-455; Score= -31.8; E_value=0.0003; Accession=PF08284.2; Description=Retroviral aspartyl protease
  Pfam annotation: Domain name=rve; Domain location=998-1154; Score =114.8; E_value=2.5e-31; Accession=PF00665.16; Description=Integrase core domain
  Pfam annotation: Domain name=zf-H2C2; Domain location=939-980; Score =15.7; E_value=0.003; Accession=PF09337.1; Description=His(2)-Cys(2) zinc finger
  Pfam module annotation: Pfam domain module=Chromo::RVP_2::Retrotrans _gag::rve::zf-H2C2; Domain location=1301-1349::338-455::103-193::998 -1154::939-980
MADHATRKTTTDRLEDAITRLTHSQASLSDKYSELSGKVDSILDHLRLRDTNSNNPNAHTSSAQRNHVKLDIPRFDGRDPLGWIFKITQLFDYQNTPEEERITVASFYLDGAALSWYQWMFRNGFITSWTGFLQALESRFAPTFYDDPKGALFKLAQRGTVNDYLTEFERLANRVIGLPPPFMLSCFISGLSPEIRREVLALQPISLPQATALAKLQEDKLRDRRRVFSRPTESSFPSTQPTNPSIKAKAPFVQRTPEEIAFKREKGLCYNCDERWNSTHRCKGRVLLFIADSPSPETTDSDPEPLPLPDDEHQDAQDQVTDETFPHISLHALSGFPSSETFRLYGTINHARLTILIDSGSTHNFLQPRIAHFLRLPVRPTSPLRVLVGNGSVLDCNQLCSNTPLSLQGHFFNVSFHLLPISGADAVLGIEWLKQFGPVITDYTALIMKFHHLGQAIELHADVSNRPELVSVPQVKRLVRTGSTSALFHLNLLPVTRPEPPRHHLPQHHLPHPDPAIENLLRRYHQIFETPTTLPPPRTVTHHINLLPSSSPINVRPYRYPHFQKTEIEKQVSDLLAAGLIRTSTSPYSSPVLLVKKKDGTWRMCVDYRALNAVTVRDRFPIPTIDELLDELGQSSWFSNGHEQLAHTLPETLCHGKGVEPDPSKIQAMLQWPTPTSVRELRGFLGLTGFYRKFVRNYASIALPLTTLLCKDGFEWNEDSQAAFDALKSAMTRAPVLALPNFSEPFTVETDASQTAMGAVLVQRDHPVAFFSKVFGPRLTHASTYIRELHTIVTAVRKWRQYLLGRSFTILTDHKSIQELMTQVIQTPEQHYYLSKLLGFDYTIRYKSGASNIVADALSRAPPPSGQLLLLSVPHLDFISDLQQSLHSDQEFQTLLSKIQAQPSDYPNHQLHNGLILSQGRIWLPNTNPYIPTILREYHATPLGGHMGVAKTTHRLESSFTWQNLKTDVKRFVRECKVCQQTKTSTRRPGGLLQPLSLPTGVWEDISMDFITHLPASHGYTVIFVIVDRFSKGVHLGALPTHFSAYKVATLFIDLVCKHHGFPRSIVSDRDPVFLSSFWRELFRLHGTLLRMSTAYHPQTDGQTEVMNRVLEQYLRSFVHSQPANWFRYLALAEWSYNTSLHTSSGFTPFEVIYGKPPPSLPHYLPGHTTNEAVDTLLTSRQEIHTKLRQRLLKAQEVMKHHADSKRENVSFTVGQWVYVKLRPHRQRSVTGDTHSKLSKRFFGPFQILERIGPVAYCLRLPDNARIHPVFHCSLLRAHHGPTPSSLDTWPLQVVDHRPIPHPLCFLDSKMDHTTSPPTRLVLTQWKGQPPEDTTWEPWSELRDSYHLEDKVVFGEGGIDMPMHNPAPEATNPSPGITRT

SEQ ID NO: 211255 - protein, 39 aa, Glycine max
  Coding DNA Sequence Number=SeqID_94477
MEINDGVGISGNILTLKLERNFDRMGWKDKGLVIPPVQN

SEQ ID NO: 211256 - protein, 87 aa, Glycine max
  Coding DNA Sequence Number=SeqID_94478
  Gene Ontology: Mol. function=oxidoreductase activity
  Homolog annotation: Hit_ID=Q9SB32; Match level="QueryCoverage=97%, HitCoverage=24%, E-value=8e-16, Identity=43%"; Hit description=SRG1 -like protein
MADMFLVHTLPINARNPRLFPNFPQPLRDNLENYSLELKKLCLTIIERMTIALKIEPNELLDYIVEDLFQSMRWNYYPPCPQPENVI

SEQ ID NO: 211257 - protein, 551 aa, Glycine max
  Coding DNA Sequence Number=SeqID_94479
  Gene Ontology: Mol. function=transcription regulator activity; Cellular component=nucleus; Biological process=regulation of transcription
  Homolog annotation: Hit_ID=Q69JJ6; Match level="QueryCoverage=72%, HitCoverage=77%, E-value=1e-67, Identity=44%"; Hit description=TA1 protein-like
  Pfam annotation: Domain name=HLH; Domain location=365-415; Score =32.1; E_value=1.9e-06; Accession=PF00010.16; Description=Helix-loop -helix DNA-binding domain
MSDKEKFEVDRNEDHVSYSSGMHSDWRFGGSNLANSSVGFVGLGNNSMNVSRGDLIGSSSCSSASMVDSLSPNYWENPTSSQKLGFCDINNVHNNGGSSSTVAIRKDGFGFGRVGQDHHGTLEMGWNHANSMLPNGPVMFPHSLSQFPTDSGFIERAARFSCFSGGNFGDMVNSYGIAQSMGLYGARDAIAGHGLKSVIAGGQSQGGDMNVVEDVPPSVEHLVAAKGSPLKSDRRSEGHVIFQDEGKQSLVRNANESDRAESSDDGGGQDDSPMLEGTSGEPSSKGLNSKKRKRSGRDGDNDKANGAQELPSEGAKGNSENQQKGDQQPISTANKACGKNAKLGSQASDPPKEEYIHVRARRGQATNSHSLAERVRREKISERMKFLQDLVPGCSKVTGKAVMLDEIINYVQSLQRQVEFLSMKLATVNPRLDFNIEGLLAKDILQQRPDPSTALGFPLDMSMAFPPLHPPQPGLIHPVIPNMTNSSDILQRTIHPQLAPLNGGFKEPNQLPDVWEDELHNVVQMSFATTAPPTSQDVDGTGPASQMKVEL

SEQ ID NO: 211258 - protein, 642 aa, Glycine max
  Coding DNA Sequence Number=SeqID_94480
  Gene Ontology: Mol. function=DNA binding; Biological process =regulation of transcription
  Homolog annotation: Hit_ID=Q5NB82; Match level="QueryCoverage=89%, HitCoverage=64%, E-value=1e-166, Identity=52%"; Hit description =Nodule inception protein-like
  Pfam annotation: Domain name=RWP-RK; Domain location=612-642; Score= -4.4; E_value=0.069; Accession=PF02042.6; Description=RWP-RK domain
MDKKGKDRDRVLPIIIIYSTLSSSNFSSKSSNLYHKAFSICEKKMSEPEEENNQDYVPRSKPAEEGGGGCTTMDFDLDLETSWPLDHMAFGSNPMSPFLFSTSSDQPYSPLWAFSDGEDPKLPASAFSDCHKIFSCDSNSIAEKPVENDDNKKNLPPLVPMPPVENLDGYCVIKERMTQALRYFKELTELNVLAQVWAPVRNGNRYVLTTSGQPFVLDPHSNGLHQYRTVSLMYMFSVDGENDGSLGLPGRVFQQKLPEWTPNVQYYSSKEYPRRDHAQHYNVRGTLALPVFEPSIQSCVGVLELIMTSPKINYAPEVDKICKALEICNEGRQNALSEILEILTVVCETLNLPLAQTWIPCKHRSVLAQGGGVKKSCSSFDGSCMGKVCMSTTDIAFYIIDAHLWGFREACVEHHLQQGQGVAGRAFLSHSMCFCSNITQFCKTDYPLVHYALMFGLTSCFTICLRSSHTGNDDYVLEFFLPPRITDFHEQKTLLGSILAIMKQHFQSLKIASGVELEDGSIEIIEATIERVHTRHESIPITPSIKSPPRLDTSPNMGEEVPQDPSEQQILMYCNDMNDGRSLGKNADGIDHMPSIETKNIKKPLERKRGKTEKSISLEVLQRYFAGSLKDAAKSLGGMFIL

SEQ ID NO: 211259 - protein, 437 aa, Glycine max
  Coding DNA Sequence Number=SeqID_94481
  Gene Ontology: Mol. function=ubiquitin-protein ligase activity; Cellular component=ubiquitin ligase complex; Biological process =protein amino acid phosphorylation
  Homolog annotation: Hit_ID=Q6YYY2; Match level="QueryCoverage=73%, HitCoverage=83%, E-value=2e-38, Identity=32%"; Hit description =Myosin heavy chain-related-like
MEQLSQPSLQPHHVSDHLLHSDTVPYIEVVLRENQQDDEYFKERVERLESEREERNGVMFKASESLTSTKESLSSVIEGLEGEKDATFVENGNGEWSDVESRMLLEDARLISRLAIEVETRVDRYKEMRRKEKRELESSLISLTEENRDVNNLLRIALLEKEALEKRIKGHDHKRMPLLQFGLQKVGFGFMMGGGNNEQSTENSFAKSDSSECEEEVVSLASTVERIMKNLRLETTQLRRSLEESRSDTERLQCLTEKQAKEIEENKLYIKELEDRERILAQNVEEFLMEIKAAEEEIARWKEACELEVEAGKKEIEERNKVVAALKQELHKTKAALNISNGKLRLKEELAVTAIAAQEAAERSLRLADTRAVELRRQVEELTRQLEEAEKHEHNSHKVRRICWPWQVFKLSSGNIASKSWKCQKDATRNASLNLMN

SEQ ID NO: 211260 - protein, 896 aa, Glycine max
  Coding DNA Sequence Number=SeqID_94482
  Gene Ontology: Cellular component=chloroplast thylakoid membrane
  Homolog annotation: Hit_ID=Q9FF91; Match level="QueryCoverage=99%, HitCoverage=99%, E-value=1e-129, Identity=35%"; Hit description =Arabidopsis thaliana genomic DNA, chromosome 5, P1 clone:MRO11
  Pfam annotation: Domain name=SLH; Domain location=490-547; Score =16.5; E_value=0.0077; Accession=PF00395.10; Description=S-layer homology domain
  Subcellular localization annotation: CTP_CleavageSite=45; ConfidenceScore=5.45e-01
MASITAPNSLQIRLAFSPSNSTKFPILLHSRFPHFDRRRIRLFCVANNENGSDNVLIRVGSDGSPNSEVKKNKSNNGGVVGVGVAGILLLSGLAFAALFVSRRNSARQMKPLTTHQEQEVLLSSDDCNDKIEQVNSGTMEEQGNGNVEGRIDVSRDCSSTEYDKIPNSHRIIDDSNAGSQLVYDIHNKDNDSDAMKHISVQEELQIESAADEESVLPEGAMVLNGSESENPVDSFDSSTAVDSQNSITELKENPSFVEPKKVSNFDAEPLPVISEEQDEITDSSGNRSSGIVADNETVLVNIAVSTQSNKTTSFPAVIPEDWEESAQSVSTKENLDLNNMPQVLHQSSLAEQSFSENDLFTKSFVSSIDAFLDEQVKNDNNEVDICRSETSNFGAFYSAPGIPAPSAVSSVVQVLPGKVLVPAAVDQVQGQALAALQTLKVIEPDVQPSDLCTRREYARWLVSASSALSRKTISKVYPAMFVDSVTELAFDDITPEDPDFSFIQGLAEAGLIESRLSRCYDRPLSTNEDYGPFYFSPESPLSRQDLVTWKIDLEKRQLPEADRKPHKPVTKAQAAIALAAGDAFDIVNEELACFESESMDENAVASHSALVAQVEKDINASLEQKLSIEREKINAVERMAEEARCELERLRAEREEERISLIEERAAIESERNVFSRLKHEVEDQLQNLISDKVEIAYEKDRISKLRELAEVQNKEITQLQYELEVERKALSMARAWAEDEAKRVSEHTLALERARDSWERNESKAAVDDFHEDLAGVTLLNTEEQLSVQDTVDRAENLLDKLKKMAVEVGGRARDMIDKIIHIISQFVSRLREWACKTGKQAEELKQSAISKAGKSAHEVQQSALEFGFTIKEEAKRVAGDCREGVEKLTQKFKP

SEQ ID NO: 211261 - protein, 77 aa, Glycine max
  Coding DNA Sequence Number=SeqID_94483
MVVLSLLDYVQLTVVGTSTKGVVKGLEGEKDETFAENDKGEWLGVESRMLLEEARLRLAIEVVTTVDRYKEMRGRRR

SEQ ID NO: 211262 - protein, 509 aa, Glycine max
  Coding DNA Sequence Number=SeqID_94484
  Gene Ontology: Mol. function=triacylglycerol lipase activity; Biological process=lipid metabolic process
  Homolog annotation: Hit_ID=Q1RN82; Match level="QueryCoverage=99%, HitCoverage=98%, E-value=0.0, Identity=67%"; Hit description =Calmodulin binding heat shock protein
  Pfam annotation: Domain name=Lipase3_N; Domain location=9-76; Score =97.7; E_value=3.4e-26; Accession=PF03893.7; Description=Lipase 3 N -terminal region
  Pfam annotation: Domain name=Lipase_3; Domain location=109-239; Score= 101.1; E_value=3.2e-27; Accession=PF01764.16; Description=Lipase (class 3)
  Pfam module annotation: Pfam domain module=Lipase3_N::Lipase_3; Domain location=9-76::109-239
MSILCGVPLLECVYCLACARWAWKRCIYTAGHDSETWGLATVEEFEPVPRLCRYILAVYEDDIRHPLWEPPGGYGIIPDWLILKKAYEDTQGRAPPYMLYLDHDHADIVLAIRGLNLAKESDYAVLLDNRLGKRKFDGGYVHNGLLKAAGWVMDAECEILKELVEKYPNYSLTFTGHSLGSGVAAMLSMVVVQNHDKLGHIERKRVRCYAIAPARCMSLNLAVRYADVINSVVLQATVKHKLHLTTNILILRYFLVLIHANCQILYFEITALFLDQDDFLPRTATPLEDIFKSLFCLPCLLCLRCMKDTCIPEEKMLKDPRRLYAPGRLYHIVERKPFRMGRFPPVVRTAVPVDGRFEHIVLSCNATSDHAIIWIEKEAQRALDGPGYNCFLFISPAPMVLRFEMLMREKDSIMEIPANQIMEMQETLARHSEEYKAALQRAKTFDVPHAYTPESQYGTFDEEGEESSRRSQGESSFGSTNRSTVDETWDEMIERLFDKDEHGHILLMK

SEQ ID NO: 211263 - protein, 204 aa, Glycine max
  Coding DNA Sequence Number=SeqID_94485
  Gene Ontology: Mol. function=transcription factor activity; Biological process=regulation of transcription, DNA-dependent
  Homolog annotation: Hit_ID=Q2ZPR6; Match level="QueryCoverage=84%, HitCoverage=80%, E-value=6e-48, Identity=53%"; Hit description =Regulatory protein, TetR
  Pfam annotation: Domain name=TetR_N; Domain location=20-66; Score =51.6; E_value=2.6e-12; Accession=PF00440.13; Description=Bacterial regulatory proteins, tetR family
MTTETKRARGRPRVFDPDDALDKALQIFWNRGYEGTSLAELTETLGVNKPSLYAAFGNKEELFMKALSKYATGPVAFVKDVINEPTARAVAQRFLYEAADFLTQSSHPKGCMIVQGALSGGESAEMIKQVLIQYRAGYENFLTKRFEQAKQDGDLPTDANPQALAKYLATLHQGMSVQATSGASKEDLLAIADLALSAWPKAST

SEQ ID NO: 211264 - protein, 73 aa, Glycine max
  Coding DNA Sequence Number=SeqID_94486
MLLSSNVIHIFVRVVMLVRMIRAHLFAAAQVKSCPGMHSGCTIASSSGCARTVGPPPGSRGGLGTHKRKLLAP

SEQ ID NO: 211265 - protein, 230 aa, Glycine max
  Coding DNA Sequence Number=SeqID_94487
  Gene Ontology: Mol. function=chitin binding; Cellular component =extracellular region; Biological process=chitin metabolic process
  Homolog annotation: Hit_ID=UPI000044A8F0; Match level="QueryCoverage =93%, HitCoverage=99%, E-value=1e-39, Identity=32%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GLHTLAIRGLHVLAFRGLHALAFRGLHILVFRGLYVLAGRGLHVHTLRGLHVLAFKGLHALAFRGMHALAFKGLHVLTFRGLHVLAIRGLHVLTFRRLHDAFVGLHAFTFRGLHILAFRGLHALAFRGLHALTFRGLHALALRGLHILTFRGLHVLTFRGLHVLPFRGLHTLTFVGLHALTFRGLHVFAFRGLHALAFRGLHVLAFRGLHALAIIGPYIYVFRELMVLHP

SEQ ID NO: 211266 - protein, 762 aa, Glycine max
  Coding DNA Sequence Number=SeqID_94488
MDELANKIQDEFYGIDAAFGEPYSLRGFSTKENDVQEISLQALTDIDHRLAYFSEKLVNLHVLYIYLLAEESDLEAMDSTNNCILANLFEKAMTFDLLSGILDSEVRELDSFMDTLQEEIVDARHKIFSCKHLTEVFFMMDKKLHDSEESVKQFQQQLLELKMQSSQLQKTIEAFRHENCEAGKALNLSGNGQLTNVKAKSNEQMVEQRRYILRMLEKSLARELELERKLAESRNNEDLKLKLHYTEQVAFYMEEAAEVVWGRFLEADNTTEVLMGISKGIMGRLQVTEFNLNGSMQRENELRSKVQILIDQLKAKDAALEKLEKCNVESVKEKSEVLALREKVKFLEEEQKEFELQINNVTAENEACHEHLIEMENFVDSLKESIDIAENRAESAEAKVTQLTETNLELTEEVSFLKGSASTAEKKVGSLEKQLRELDIQLQNAKASSEASQEQQNMLYTAIWDMEILIEELKSKVAKAETNKESAAEQCFVLSETNLELNKELDLLRSRTVSLKTSLDQASNTRSSRAKEIDCKAKLIMDMVMQLASERERINNQENKHLVEKLKNTKIDASLDASNNGLNNRNEDQASNNDSSNDNSAKSSDEEGIDHFNKTFQAGDSWVLNLIVLLMTLHVELMNAYKLSLGFYGFQLCLFKNLDEYVDEEGASSVTRVTSSISADKPANWRNLTFLSVAMFVPLISVLAFWWTTFVSTQLPNSLWHKSYLEHFILGYALIAQEIRTMQQSSLSKAWFPFRDGYSLCP

SEQ ID NO: 211267 - protein, 180 aa, Glycine max
  Coding DNA Sequence Number=SeqID_94489
  Homolog annotation: Hit_ID=Q1RWU1; Match level="QueryCoverage=48%, HitCoverage=24%, E-value=1e-09, Identity=38%"; Hit description =Resistance-like protein HAAS-2-related
MIISLNDPSCLLHLPTTAKPIDHVPSTFDKDAVKMLLMHHRAILTILKATMAKRAGLCVWVDTTYLLHLIDNTIFANKSSTHIHVTYLMYIDNLDACHEYAWGVVALTYLYDHLSYGSQYTSKQCGGYMTLLMVFHPYTIPSKDGPPPRGSMASEAMQSLLDLRVVPKGTSHHQLIHQAL

SEQ ID NO: 211268 - protein, 163 aa, Glycine max
  Coding DNA Sequence Number=SeqID_94490
  Gene Ontology: Mol. function=nucleic acid binding; Cellular component= intracellular
  Pfam annotation: Domain name=zf-C2H2; Domain location=100-123; Score =22.0; E_value=0.0021; Accession=PF00096.16; Description=Zinc finger, C2H2 type
MPVAKLPASGTIDFRKTDDGSDSLDTIIRQAIGKEPLLSFPRAGDSPVQWIQLLNALDQQAFKLVSGSADSKSNILMKSFICLTELPGWPLLSPVKVQLQKCNKCSREFCSPINYRRHIRVQHRLKKLDKDSEKNRDLLGAYWDKLSIEESKEVVSFKNVMLE

SEQ ID NO: 211269 - protein, 287 aa, Glycine max
  Coding DNA Sequence Number=SeqID_94491
  Homolog annotation: Hit_ID=Q9FHB8; Match level="QueryCoverage=77%, HitCoverage=88%, E-value=1e-50, Identity=46%"; Hit description =Genomic DNA, chromosome 5, TAC clone:K24M7
MSGGVGPTGSDISLPQEQEVGHKEPQEQHSLKNLHKTITTTPHKPTFLSFRHLNCLAVVVVLSASGMVAPEDFAFVLFSIIYMYFLSKMAFPSLLPSKEEPLVFNPKNKVLALYVFVGAIIGLYAPIAYILEGIFEGDKEGIKAAAPHVFLLSSQVFMEGVAFSGRFSTPMRAFVPVFYNSRRIFTIVDWLRSEINKVNEVHSGSDRRIFVGRVLAVANMAFWEGSSLQAGLYARTPRSVRPLRLIRHAPVKAKLKGQVLVTALLQARYLGSKSGSSENLRKTALQG

SEQ ID NO: 211270 - protein, 642 aa, Glycine max
  Coding DNA Sequence Number=SeqID_94492
  Gene Ontology: Mol. function=nucleic acid binding; Cellular component= intracellular; Biological process=chromatin modification
EVPGSSILEALTTLRKQGFSSLPQYYLRAGTALLNIVQSRPSSFPISSQELFSILDDSSEKTFLVGSAVSMQRYVFDGEAGKIGLEPKNLVACTSFLLEQKLVKAWLADKDAEALRCQKLLVEEEEAAQKRKAEILERKRQKKLRQKEHKARERLEDDTEIKENISSTGEDVLPAEASSGTCDFEAQNPDIFADHSPPPHVTSRCLDTNEVVEGDTVSGYDFDTDQYIERQASRGHNRRRIMAARWQGLPKSQWAKANGSHAGQNSQMSKLGVIQKHGTNRDQRAAPIVNGSKVWSRKPKPETNGVVLKAKLQKEPDKGKSHEVLIGSVSVSLDYCSSHSQGNLVAAQRDCVVENLAKQNTAQEKPVKHDSFQGSNGRLTVKLWRPVSQLGTKDPLPLQNGETEADVINGKYDQNLSGQSSLRLCSIDGSDIGFEDNFSHTGAKVDSESLRLTSHAAKAFLAQRWKEAISSNHVKLVVTPDCQSSNADRFNILANTENRLPATSGVAKSKPKTKPEKGMKIKYIPKQKEATYNNDDRYISSDCGDSNLEGDISGGNDADGGDHDNVVTSMMVTTIMIVMVKGGGGGDDNDGNSDINAGDNSGDDNDDDDGNNDGNVTMMMMSDGGGNDGSDIGSSGGSNAYF

SEQ ID NO: 211271 - protein, 59 aa, Glycine max
  Coding DNA Sequence Number=SeqID_94493
MIKIEDKNDNNVFECLKLSGPPELNEYDSDHALSTRFALSASLNFLVDLLHAKRELTAK

SEQ ID NO: 211272 - protein, 237 aa, Glycine max
  Coding DNA Sequence Number=SeqID_94494
  Gene Ontology: Mol. function=oxidoreductase activity; Cellular component=integral to membrane; Biological process=metabolic process
  Homolog annotation: Hit_ID=Q6RVV4; Match level="QueryCoverage=84%, HitCoverage=63%, E-value=1e-85, Identity=80%"; Hit description=Short- chain dehydrogenase Tic32
  Pfam annotation: Domain name=adh_short; Domain location=30-181; Score= -1.6; E_value=7e-06; Accession=PF00106.15; Description=short chain dehydrogenase
MWPFSRKGASGFSSSSTAEQVTEGIDGTGLTAIVTGASSGIGTETTRVLSLRGVHVIMGVRNMLAAKDVKETLLKEIPSAKVDAMELDLSSLESVKKFASEFKSSGLPLNMLINNAGIMACPFKLSKDKIELQFATNHLGHFLLTNLLLDTMKKTSRETKKEGRIVNVSSEAHRFTYSEGIRFDKINDESSYSNWRAYGQSKLANILHANELTRRLKVSWLLLCSGVIYKLSGGIVN

SEQ ID NO: 211273 - protein, 177 aa, Glycine max
  Coding DNA Sequence Number=SeqID_94495
MERKRKNRSSSATAGSIPEAATSEAIEPSSNAIRGSENRVPVPLDTSSSQEVILAAGKIMMEEEKATNGAVTRHMLGPQFVNKLICDLNQSNEDSYKPWCIEDVSLFILPSKLGYDINQCKLIFAPTLFEEHWSCYAFEPKRNLEDSTKPICGWVRHPKNEIREEILKAAGVWGKLC

SEQ ID NO: 211274 - protein, 1003 aa, Glycine max
  Coding DNA Sequence Number=SeqID_94496
  Gene Ontology: Mol. function=protein serine/threonine kinase activity; Biological process=protein amino acid phosphorylation
  Homolog annotation: Hit_ID=Q1T627; Match level="QueryCoverage=98%, HitCoverage=98%, E-value=0.0, Identity=57%"; Hit description=Protein kinase
  Pfam annotation: Domain name=Pkinase; Domain location=400-696; Score =291.8; E_value=1.3e-84; Accession=PF00069.15; Description=Protein kinase domain
  Pfam annotation: Domain name=Pkinase_Tyr; Domain location=400-696; Score=125.3; E_value=1.7e-34; Accession=PF07714.7; Description =Protein tyrosine kinase
  Pfam module annotation: Pfam domain module=Pkinase::Pkinase_Tyr; Domain location=400-696::400-696
MLTWWGKSSSKKTKKKANKESFFDTLHRKLRISSEGKVNIRSGGSRRHCNDTISEKGDHSPSGSRSPSPSKVARCQSFIDRPHAQPLPLPGLHPSSVGRVDSEISISSKSRLEKVSKPSLFLPLPTPGCIRCRPNPADLDGDMVTPSVFSDCSADSDEPADSHNRSPLATDCETGTRTAAGSPSSSMLKDQPPTVSLLNSTGVKKPGNILSNHMSSTSPKHRPLRNHVPNLQVPPHGAFYSTPDSSLSSPSRSPLRAFGTDQVLNSAFLAGKPYPEVNFVGSGHCSSPGSGHNSGYNSMGGDMSGPLLWQPSRGSPEYSPVPSPRMTSPGPSSRIQSGAVTPIHPKAGGTPTESQTHRLPLPPLSVSNSSPFSHSNSAATSPSMPRSPARADNPSSGSRWKKGKLLGSGSFGHVYLGFNSESGEMCAVKEVTLFSDDPKSMESAKQFMQEIHLLSRLQHPNIVQYYGSETDSSYRIFVSGGLSDNIEVGISRQYLFLWFLIEASESPLEQVDDKLYIYLEYVSGGSIHKLLQEYGQFGELVIRSYTQQILSGLAYLHAKNTLHRDIKGANILVDPTGRVKLADFGMAKHITGQSCLLSFKGTPYWMAPEVIKNSNGCNLAVDIWSLGCTVLEMATTKPPWFQYEAVAAMFKIGNSKELPTIPDHLSNEGKDFVRKCLQRNPYDRPSACELLDHPFVKNAAPLERPILAPEVLDPVSGIIQGAKALAIHAFGNTRTIFYSESSILGYLQDLYPHSPFHAKIVIESKGMKDIHISNWFTQHRMESDLFWFILGGRVERSLAAKAAGQGKNLSSLDSDRLSIHSSRFLKTNPRESEIHIPRNISCPVSPIGSPLLRSRSPQHRNGKMSPPISSPRTASGASTPLAGGSGAIPFGNHSKQPIYFQEGFGSIPKSSNGVYINGHSHHDSSVDIFRGMQIGSHIQPELVSSENDVLVNQFARHPHAEPYDFQSVLADRVGRQLLREHVKINPSIDLSPNSSLLSRPNGL

SEQ ID NO: 211275 - protein, 523 aa, Glycine max
  Coding DNA Sequence Number=SeqID_94497
  Gene Ontology: Mol. function=citrate transporter activity; Cellular component=integral to membrane; Biological process=citrate transport
  Homolog annotation: Hit_ID=Q1RU51; Match level="QueryCoverage=99%, HitCoverage=98%, E-value=0.0, Identity=67%"; Hit description=IMP dehydrogenase/GMP reductase
  Pfam annotation: Domain name=ArsB; Domain location=14-361; Score= -209.8; E_value=0.018; Accession=PF02040.6; Description=Arsenical pump membrane protein
  Pfam annotation: Domain name=CitMHS; Domain location=16-477; Score =361.9; E_value=1e-105; Accession=PF03600.6; Description=Citrate transporter
  Pfam module annotation: Pfam domain module=ArsB::CitMHS; Domain location=14-361::16-477
MALASVPKVVFGLIAFAIFWVLAVFPAIPFLPIGRTAGSLLGAMLMVIFQVITPDEAYDTIDLPILGLLFGTMVVSTYLERADMFKYIGKLLAWKSRGAKDLLCRICVISAISSALFTNDTSCVVLTEFILKIARQHNLPPTPFLLALASSANIGSSATPIGNPQNLVIAVQSKISFGNFLIGILPAMVAGVVANAIILLIMFWKLLSVHKDEEDAGAEDVVEEYDSHRFSPATMSHYSSLNSQEWSSHLDAITVQNSPQVQILRNRSIANASESNGISSNTFDTARISSVSRDGTNGVASMAKEETSPSNSSAGVDTLIPPSERKTNFIIKWKRVLWKSCVYIITVGMLVALLLGLNMSWTAITAALALIVLDFKDATPCLEKVSYSLLIFFCGMFITVDGLNKTGIPSALWDIMEPYSHVDRASGIAILAIVILVLSNLASNVPTGRVAASAAAISKADEKKAWLILAWASTISGNLSLLGSAANLIVCEQAIRAPNLPYTLTFWSHLKFGLPSTIIVTAI

SEQ ID NO: 211276 - protein, 504 aa, Glycine max
  Coding DNA Sequence Number=SeqID_94498
  Homolog annotation: Hit_ID=Q6K6Z8; Match level="QueryCoverage=52%, HitCoverage=60%, E-value=3e-52, Identity=48%"; Hit description =Hydroxyproline-rich glycoprotein-like
MGTVNNTVDTVNAAASAIVYAESRIQPTTTVPKKRWGSCWSLCWCFGPHKNSKRVGNAVLVPEPVEPIGPVGFHPATAAPNPSTAIVMPFIVPPSSPASFLQSDPPSATQSPVGLFSLSSLTVNASGGPASIFAIGPYTYETQLVSPPVFSTFTTEPSTAPFTPPPESVQLTTPSSPEVPFAQLLASSLDRNCKSNGTNQRFALSNYEFQPYQQYPGSPGTQLVSPRSIISTSGSSTPFPDRHPVLEFHKGEAPKLLGFENFLTHKWNSRLGSGSLTPDSAGQGSRLGSGSFTPDAVKLASQLGSGCLTPDGLCQDSRFGSGSLTPDAVAPTARNDIDIGKQISEVTSIVNSENECQPKAALVDHRVSFELTGVDVPRCLANKSGSSLLGNMSGSSQGTLVEDPVDIEKIQKNSNSSCAFCSRKTSNASNDKSCNSPGEGAEQCCRKHHSFNSSKEFNFDNRKGVVSDTPANSSNWWTNKKIVGKEGRSSNSWTFFPMLQSEII

SEQ ID NO: 211277 - protein, 41 aa, Glycine max
  Coding DNA Sequence Number=SeqID_94499
MVEWGPELHTSAWRSVFDKKGDLQNKCKAGVVVTLQIIPGL

SEQ ID NO: 211278 - protein, 1067 aa, Glycine max
  Coding DNA Sequence Number=SeqID_94500
  Gene Ontology: Mol. function=methyltransferase activity; Cellular component=nucleus; Biological process=nucleobase, nucleoside, nucleotide and nucleic acid metabolic process
  Homolog annotation: Hit_ID=Q1T631; Match level="QueryCoverage=98%, HitCoverage=99%, E-value=0.0, Identity=63%"; Hit description=MT-A70
  Pfam annotation: Domain name=MT-A70; Domain location=769-912; Score =144.1; E_value=3.8e-40; Accession=PF05063.5; Description=MT-A70
MDSSDSGRGYSKRERDDEDWEFSDKRKDRSRKFGANGGDDGEGSDGGARRKRSSRTTTDGDDYDSRSKQGAKKRQEESTLEKLSSWYEDGELDDKAARKRGGGDGEFHESVVSKEDGKGEGGGGGREKGGHDGKSSRRKWDEVDVGSVRKVQDEKGDLRSGKRDSSRDRERSESSRSEHGESKASGGGGDRVAKSSSKEDRRGDSERGKNKGKSDLGDVGWEERVEKPRHHRAAAGYDVAETWDRSLNAVEEDGHVRVRDKSIRESGNSNRSRTPDKSGKRHQDLETSEADYERSGSFKRKEHEGDGYKDDRSKGKDDTWNDRRKDRESSKESWKRRQPSNTDKDSKNEEGAFDDNRDWELPRHGYERMDNERPHGRFGGRKDASRGEAVKTSTKFGISNDNYDVIEIQTKFYDYGKSESVSNHTKRTETHQQYNAKSGANDEEWAYHQDERGRKSDLSGSGTPGEDLKERYADDDYDFYGGRGRGQKGGVSARVTGGQSSSTGGSQPQYGNSESGSFNRAGPQGIKGNRVGRGGRIRPTGRDNQQVGIPLPMMGSPYGPLGMPPPGPMQPLSHGMSPAPGPPISPGVFMSPFTPGVWPGARGVDMNIIGVPPAVSPVPPGPSGPRFNAANIGNPPNPVMYYNQSGPGRGIPPSISTPGFNPTGSMGRGAPPDKTPGGWAPPKSSGTLGKAPSRGEQNDYSQNFVDTGMRPQNFIRELELTNVVEDYPKLRELILKKDEIVEKSASAPMYYKSDLKEFELSPEFFGTKFDVILVDPPWEEYVHRAPGVADHMEYWTFEEIMNLKIEAIADTPSFIFLWVGDGVGLEQGRQCLKKEHCLMGIKGTVRRSTDGHIIHANIDTDVIIAEEPPYGSTQKPEDMYRIIEHFALGRRRLELFGEDHNIRAGWLTVGKELSSSNFNKEAYVKSFADKDGKVWQGGGGRNPPPEAPHLVVTTPDIEALRPKSPMKNQQQLQQQNSVSISLTSASASNRRPAGNSPQNPTALGVNQEASSSNPSTPAPWGSPLEGFKGREGSVLPSDDKVMDMYGFHGPASANYLDFESYRQMNLL

SEQ ID NO: 211279 - protein, 449 aa, Glycine max
  Coding DNA Sequence Number=SeqID_94501
  Gene Ontology: Mol. function=binding; Cellular component =intracellular; Biological process=RNA processing
  Homolog annotation: Hit_ID=O64858; Match level="QueryCoverage=91%, HitCoverage=75%, E-value=1e-134, Identity=55%"; Hit description =Expressed protein
  Pfam annotation: Domain name=DUF946; Domain location=2-436; Score =698.7; E_value=4.2e-207; Accession=PF06101.2; Description=Plant protein of unknown function (DUF946)
MNHHLQSITHWFWSSKSQKIKQDKDGYIWLPTAPDGYKTLGHVVTTTPEKPSLDKIRCVRSDLTDQCERNSWIWGPAKSSDEKGFNVHEVRPSNRGTQAPGVLVGTFFAHNCEAPSPLPIACLKNTSMNFSSSMPNLPQVRALVQAYSPFMYLHPDEDFQPASTKWYFTNGALLVKKGEESKPVAIDPTGSNLPQGGNNDGEFWLDLPSDKANKERVKKGDFKSCQAYVHAKPMFGGTFTDLVMWVFYPFNGPGTAKVGLIDIPLGKIGEHIGDWEHVTLRVSNFNGELKRVYLSQHSKGQWVEAPQLEFQSGNKAVCYSSLNGHAIYPKVGLVMQGLDGIGIKNETKRSEKVIDMGVGFEVVSGEYLGSAIVEPPWLNFFRQWGPKITYDIAKVLDKLEKVFPALQGLEDSLPKELLGEEGPTGPKLKRNWSGDEPAFSGVPTTLKSM

SEQ ID NO: 211280 - protein, 275 aa, Glycine max
  Coding DNA Sequence Number=SeqID_94502
  Gene Ontology: Mol. function=oxidoreductase activity, acting on the aldehyde or oxo group of donors, NAD or NADP as acceptor; Cellular component=mitochondrion; Biological process=metabolic process
  Homolog annotation: Hit_ID=Q9SAK4; Match level="QueryCoverage=89%, HitCoverage=38%, E-value=3e-82, Identity=63%"; Hit description =Succinate semialdehyde dehydrogenase, mitochondrial precursor (EC 1.2.1.24) (At-SSADH1) ...
  Homolog annotation: Hit description=(NAD(+)-dependent succinic semialdehyde dehydrogenase)
  Pfam annotation: Domain name=Aldedh; Domain location=4-257; Score= -61.5; E_value=4.7e-13; Accession=PF00171.12; Description=Aldehyde dehydrogenase family
MGRFVVGQFEHGVLAAKFRNSGQTCVCANRIIVQEGIYEKFANALRDAVQNMKVGDGFSEGVSQFLLNQLPVDIAYLASLFFQGNIHSYGLQKMSHGVTHFISISKQGPLINEAAVKKVESLIHDATSKGAKVILGGKRHSLGLTFYEPTVISDVNSDMHISREEAFGPVAPLLRFKTEEEAIRIANDTNAGLGSYVFTNSIQRSWRVAEALEYGLVGVNEGVISTEVAPFGGFKQSGLGREGSKYGMDEYLEMFWVNGYGLIPGIQNNVILHWV

SEQ ID NO: 211281 - protein, 33 aa, Glycine max
  Coding DNA Sequence Number=SeqID_94503
MAGTLCPSSGQHTSLCASHKHFQYFLTNVNPET

SEQ ID NO: 211282 - protein, 110 aa, Glycine max
  Coding DNA Sequence Number=SeqID_94504
MGEKHVQFHQTPKKLKWVVGNRLKDRNFALNFKHLDAVGKWEKRVASASATERREDYKGDREVSRIEVPCGKGDMVSFALGYGRNEASRRDEGGGRKQCRTMVRVDMQGK

SEQ ID NO: 211283 - protein, 291 aa, Glycine max
  Coding DNA Sequence Number=SeqID_94505
  Gene Ontology: Mol. function=3-phosphoshikimate 1-carboxyvinyltransfer ase activity; Cellular component=chloroplast; Biological process =aromatic amino acid family biosynthetic process
  Homolog annotation: Hit_ID=UPI00006B1A78; Match level="QueryCoverage =90%, HitCoverage=69%, E-value=5e-56, Identity=45%"; Hit description =putative 3-phosphoshikimate 1-carboxyvinyltransferase
  Pfam annotation: Domain name=EPSP_synthase; Domain location=12-291; Score=-133.2; E_value=1e-05; Accession=PF00275.10; Description=EPSP synthase (3-phosphoshikimate 1-carboxyvinyltransferase)
  Pfam annotation: Domain name=MazG; Domain location=1-73; Score=29.2; E_value=1.7e-06; Accession=PF03819.7; Description=MazG nucleotide pyrophosphohydrolase domain
  Pfam module annotation: Pfam domain module=EPSP_synthase::MazG; Domain location=12-291::1-73
MAMLTEEVGEVARIIARRYGEQSEKESDKSKDLGEELADVLFVTLCLANQTGDTEMLTKALSENSEVVDIHHAGTAMRFLTSYFSILEGRDTILTGSGRMKERPIKNLVNALRDLGADIEYMENEGFPPLRIKGKLENGLEINLVGDITSRSYIEMTLDIITRFGIKATFTGNVIKVEPFANPSSVIHYEVESDWSSASYFYSICALGRKTIHLKSFYKQSTQGDSAIANIYEKFFGITTTFSEEEHKITLKADPDFSFPEKIELDMNDCPDIAQTLCVTAAALKIPFAIS

SEQ ID NO: 211284 - protein, 178 aa, Glycine max
  Coding DNA Sequence Number=SeqID_94506
  Homolog annotation: Hit_ID=Q1SZY4; Match level="QueryCoverage=37%, HitCoverage=17%, E-value=4e-08, Identity=43%"; Hit description =Peptidase S8 and S53, subtilisin, kexin, sedolisin; Zinc finger, CCHC- type; Peptidase aspartic, catalytic
MEEDNIDGAFVEKPYFEKDEGNKKGGSLKKFPPCPHCNSNHLEYFCWYRPSTRCRPAINMVMQRKFVKIKQTNKHNKPKLLSMKSMKNKKKSIYLMLFAVQQAKGPSGEGQSPRVEKDEGPEAETLSRLLNVAEGPDMMRIQKLVKYRLKAQVEKAEGPSGERQSLRVEKDEDPSGEG

SEQ ID NO: 211285 - protein, 406 aa, Glycine max
  Coding DNA Sequence Number=SeqID_94507
  Gene Ontology: Mol. function=drug transporter activity; Cellular component=membrane; Biological process=multidrug transport
  Homolog annotation: Hit_ID=Q1T635; Match level="QueryCoverage=96%, HitCoverage=85%, E-value=1e-159, Identity=67%"; Hit description =Multi antimicrobial extrusion protein MatE
  Pfam annotation: Domain name=MatE; Domain location=233-396; Score =119.2; E_value=1.2e-32; Accession=PF01554.9; Description=MatE
  Pfam annotation: Domain name=MatE; Domain location=48-174; Score =62.4; E_value=1.5e-15; Accession=PF01554.9; Description=MatE
  Pfam module annotation: Pfam domain module=MatE::MatE; Domain location=233-396::48-174
MDAPLLLAKGEGAALVTENGDYVAVRELKEVKKVFWIETKRVWQIAMPIVFNIWCQFGVNSVTSMFVGHLGDIQLSAISLINSVIGTFAFGFMLGMGSATETLCGQAFGAGQFLGQQEDIADLAGSFSILVIPQFLSLPFNFPTQKFLQAQSKVNIIAWIGLVALILHIGMLWLLIYVLDFGLAGAALAFDITSWGITVAQLVYVVIWCKDGWTGLSWLAFKDIWAFVRLSLASAVMLCLEVWYMMSVIVLAGNLDNALVAVDSLSICMNINGWEAMLFIGVNAAVSVRVSNELGLGHPRAAKYSVYVTVFQSLFLGIFFMAIILATRDYYAIIFTNSEVLHKAVAKLGYLLAVTMVLNSVQPVVSGVAIGGGWQALVAYINIGCYYLFGLPLGFLLGYEANLGVE

SEQ ID NO: 211286 - protein, 123 aa, Glycine max
  Coding DNA Sequence Number=SeqID_94508
MSKNLSHCATTSVKQLNSVSKDKDTNFILAILPSDWLLAKNPSSETCQKKECKRYQTLIVSTKDSDSPGKVKKTLIVLTKDSDSDSLGKVKKTLIVLTKDSDSPGKVKKTLIVLTKDIGVFEM

SEQ ID NO: 211287 - protein, 320 aa, Glycine max
  Coding DNA Sequence Number=SeqID_94509
  Gene Ontology: Mol. function=transcription factor activity; Cellular component=membrane; Biological process=regulation of transcription, DNA-dependent
  Homolog annotation: Hit_ID=Q0K419; Match level="QueryCoverage=98%, HitCoverage=97%, E-value=1e-100, Identity=57%"; Hit description =Transcriptional regulator, LysR-family
  Pfam annotation: Domain name=HTH_1; Domain location=7-67; Score=62.4; E_value=1.4e-15; Accession=PF00126.17; Description=Bacterial regulatory helix-turn-helix protein, lysR family
  Pfam annotation: Domain name=LysR_substrate; Domain location=91-299; Score=129.0; E_value=1.3e-35; Accession=PF03466.10; Description=LysR substrate binding domain
  Pfam module annotation: Pfam domain module=HTH_1::LysR_substrate; Domain location=7-67::91-299
MLSRITQRQLEYFVASGEAGSIIGASERIHVSSPSISAAITHIESELGVQLFVRHHAQGVSLTAIGHQVLKEAKLILEQMSNLYTIASESLNNVRGPLRVGCLDTLAPMLTPELVFGFGRAFPGVRITLVEGNHEQLLKQLRAADIDIALTYDLVPASDIAFQSLAQLPPYVMVGEHHPFASQSAVTIQDLATVPMVLLDMPWSREYFLSLFSEAGVTPNIVMRSGNMEVVRAMVANGVGFGIANVRPKANLSQDGKRVIRVRLAGVNRPMLLGYATVAHVQQSMVVNAFAERCRMFISDQYIPGMAAPSYFDPQVVRVA

SEQ ID NO: 211288 - protein, 318 aa, Glycine max
  Coding DNA Sequence Number=SeqID_94510
  Gene Ontology: Mol. function=acetylornithine deacetylase activity; Cellular component=cytoplasm; Biological process=arginine biosynthetic process
  Homolog annotation: Hit_ID=Q02DX2; Match level="QueryCoverage=94%, HitCoverage=78%, E-value=1e-121, Identity=72%"; Hit description =Putative peptidic bond hydrolase
  Pfam annotation: Domain name=M20_dimer; Domain location=170-284; Score=106.0; E_value=1.1e-28; Accession=PF07687.4; Description =Peptidase dimerisation domain
  Pfam annotation: Domain name=Peptidase_M20; Domain location=66-278; Score=80.5; E_value=5.1e-21; Accession=PF01546.18; Description =Peptidase family M20M25M40
  Pfam module annotation: Pfam domain module=M20_dimer::Peptidase_M20; Domain location=170-284::66-278
MLTSRNLLEHLVAFDTTSRESNLALIDFCWRYLSGLGVTCELMHNAERSKANLYARLGPAGSGGVMLSGHSDVVPVDGQTWTVPPFALTERDGKLYGRGTADMKGFLACMLAAVPHFLAQPLRQPLHLAISYDEEVGCLGVRSLVKALAQRSDRPAICLIGEPTELRRVLGHKGKLAMRCEVQGAACHSAYAPQGVNAIEYAAKLIQRLTVIGERLAAPERQDARFDPPFSTVQTGVIHGGRALNIVPDACSFDFEVRTLPQEDAQQVANELVTYAQQTLEPQMRAVQPASAIRFSPLSAYPGTGYRRAQCRGTADCP

SEQ ID NO: 211289 - protein, 79 aa, Glycine max
  Coding DNA Sequence Number=SeqID_94511
MAVQCTRLLSLWGLVDPGYFTFKLAPSRTAPSRLALVKICILLSYETIINQSHRHLHKTTLKLLVSRYKPVSKNQNYPL

SEQ ID NO: 211290 - protein, 79 aa, Glycine max
  Coding DNA Sequence Number=SeqID_94512
MLLWRRRQPSRDGEAVPTRENKQEEGKEEGVDEDKGGFEGFKKQKKLDEEATSMWKRFTKGCCVRATFNKKQEVMSARD

SEQ ID NO: 211291 - protein, 314 aa, Glycine max
  Coding DNA Sequence Number=SeqID_94513
  Gene Ontology: Mol. function=lysine permease activity; Cellular component=membrane; Biological process=amino acid transport
  Homolog annotation: Hit_ID=Q2KUM2; Match level="QueryCoverage=54%, HitCoverage=82%, E-value=6e-47, Identity=56%"; Hit description =Probable amino acid efflux protein
  Pfam annotation: Domain name=LysE; Domain location=2-180; Score= -15.7; E_value=0.006; Accession=PF01810.9; Description=LysE type translocator
PAGGALANVCLGIAIANGVFILAAFSGITLFHPESISFIVIQLAGCAYLLYVGLLFIRFAGMNSLSACSVKTAESVTQPAGASNHYRELGMGFLSGILNPKNALFYVSLATLIGGGDAMVNVKVVYGIWMFSVVLLWDLLVAAFIGNRLVLQHFSRLLPWLERISGMMLIGLALSVIVALFMSDSASTSIGLLLFPALTQLDLTGPFEVFSRAPDTEVHLIWKNLDLVVLDRGMAIQPTTTFKTCPALDIICVPGGPGQINLMEDEEVLSFIRAQSKQAKLVTDDALGFAGSAGTISAEPVTSVLYATAPYTGA

SEQ ID NO: 211292 - protein, 56 aa, Glycine max
  Coding DNA Sequence Number=SeqID_94514
MKLVWCPESALKAYLDTVKSCEKLKELGVPELLSAMAAGWNTKFIVESWSYEGRFR

SEQ ID NO: 211293 - protein, 125 aa, Glycine max
  Coding DNA Sequence Number=SeqID_94515
MTSFTCHSSAFEELLVLIMYIFRLCLAQCSGGAESPGELLADLIYQLLAYITWKLMLCQMDAAEACYQQLKCGIGRSLALFSEWRRGRRGEERYISQMKIARLFPGLGKDRRGHGWIQASRSPAV

SEQ ID NO: 211294 - protein, 63 aa, Glycine max
  Coding DNA Sequence Number=SeqID_94516
MATSPSRLDAASDDLSGSWFLQKVVSAEKREGSGGFGKKIRHESAEKNQTCDFQDFNAEIESG

SEQ ID NO: 211295 - protein, 271 aa, Glycine max
  Coding DNA Sequence Number=SeqID_94517
  Gene Ontology: Mol. function=kinase activity
  Homolog annotation: Hit_ID=Q1SBL6; Match level="QueryCoverage=76%, HitCoverage=43%, E-value=4e-11, Identity=30%"; Hit description =Putative phytochrome kinase substrate 1, putative
MVISAATSNNNNIHQLQSFNSQNNNYHLCDASFSSYLNNKEEILAESGHGYVSSRKDPLGVKKEDDGELEYLKLKSEISFSKNSSHGKTTSRNMFNVDPEANHSVKVTRPHATKISIKKDVYFQSPEKLGVGLSKENSLALSEKSRNSLEVFGSPILSSRSKSLSFDKKFAKTSSSSWDVAPKIEETDFSAISGGNYNDVDSDASSNFNVNIDSEKKKNNLGIKIAAGIATAASALAISAIIIFLISRRNMKYQKKIFRKRMSIEMDGYRT

SEQ ID NO: 211296 - protein, 144 aa, Glycine max
  Coding DNA Sequence Number=SeqID_94518
  Gene Ontology: Mol. function=transcription factor activity; Cellular component=chloroplast; Biological process=regulation of transcription, DNA-dependent
  Homolog annotation: Hit_ID=Q9MTH2; Match level="QueryCoverage=63%, HitCoverage=16%, E-value=4e-20, Identity=50%"; Hit description=Sigma factor 3 precursor
MIDNTQMPFGEVSTVSTKFESFRAQHFRMLMENLCVLEETFVDSEALRLEKAIILQLGKVLAELEKIRTAIEEDTKPVASLSTWVETSGVDEKVLQQLLHCGYYCWDELIQSSRSLVVYLARKYRGMGIALDDLLQVCSKCHCS

SEQ ID NO: 211297 - protein, 78 aa, Glycine max
  Coding DNA Sequence Number=SeqID_94519
MRAQSSKLSPQVLLIEVRGKLQVSCHFVRSHCHCYCLGSSKQVHNKLLTLLAIILEFGALVCVVYARIKLPYHKYDVA

SEQ ID NO: 211298 - protein, 412 aa, Glycine max
  Coding DNA Sequence Number=SeqID_94520
MQSEEHVQKQQEEKVVVPEDSAEGTRDDVKGPCANDGGIESQSPVDPPSNEGAESVALPNGSDNEDTSQVVTSDALNSSSDLSESDKMAVESEAKSEAKDNPIAEDIPIEVDKLDKTVWEELPVGVIDEDINDVSIEKEEHDDVRSGSLPAMVNDSAQEGSDSKNYAMMELPLRLHEEHERDNEMNISNGETRSENEIFIEELPVGLHDEDTTISKDKRDDQAKPKTYKEKLKEQEEVHSSRVKIEYPEEGELNGDAPMDIRVECKSGEEAGTDTKLLPLTTQVSDNEPENEDEETPEMVAEEAISADDKYFSFDCFDQNSLPYLPNSSCGQEVPQTYNNDYPFSEIYGSLLDESSPQIMDSFYSTLGTPLNTPPFLGQEDYPILSMMEEEEQGLLGEELKNLELQTTCKEP

SEQ ID NO: 211299 - protein, 257 aa, Glycine max
  Coding DNA Sequence Number=SeqID_94521
MYTGSWLLHLPRLLLLFLVLLILLQTHQLHPGAERPVVHIDPATGKADGPHRKKLRTYLGIVARDKVDITYENWKKVSTAQKDLIWDDIQRLLTVGQKGSYFRLWARDGADHDGVDDTVCEKYGISKENWAQFRQTRRDPSWEKLLAENTKKKLEEAAQSGSIDGVIDPSSPVRRHVKWKMARTKKTGEMTKEAAKEIAEKIDSFKEQATQESFVPYGRQDVLTAAIRRSEHLGRVRAAGAGVTIKHYFGSTPRVFQ

SEQ ID NO: 211300 - protein, 76 aa, Glycine max
  Coding DNA Sequence Number=SeqID_94522
MVSMCGEDWLIGQVSTNDALNPAPVDILLGQEFVAAMSKNNVGVSSAQPSFQLQNNALKRTTKFESEPTLFFYIDS

SEQ ID NO: 211301 - protein, 121 aa, Glycine max
  Coding DNA Sequence Number=SeqID_94523
  Gene Ontology: Mol. function=peptidase activity
  Homolog annotation: Hit_ID=Q84SE0; Match level="QueryCoverage=77%, HitCoverage=24%, E-value=1e-34, Identity=72%"; Hit description =Putative TPA: Cgi67 serine protease
MLSLQWTDKWPSESSTYADIEAIYECLETKYGVSQEDVILYGQSVGSGPTLHLAAKLPRLRDVVLHSGILSGLRVLCHVKFTFCLDIYKNINKIKKVKCPVLLIHQVYGQSTLPIILEFFP

SEQ ID NO: 211302 - protein, 125 aa, Glycine max
  Coding DNA Sequence Number=SeqID_94524
MPLTQMDNKEGLLRRTLALSFVCKSPPQARDFPMKDKLAGCRGPEGRTPRIVLNEMATLLVRWSIPAPRDEATSIQGKSEVLERDGSMSYNVQAAFLPEGFFRKPGHLPNIPEGWNNMMKKAAKV

SEQ ID NO: 211303 - protein, 55 aa, Glycine max
  Coding DNA Sequence Number=SeqID_94525
MKNDHEMRGGGCTAARPSELLASSRSNLAHPSELVTSSLSFLVAQASQGPEKVTK

SEQ ID NO: 211304 - protein, 102 aa, Glycine max
  Coding DNA Sequence Number=SeqID_94526
MNLTRSRSFDTSYGVLDDVTSRIGFNIMQLARQSSNEHQAATSNQQPTPSSNEEDEATTACDRGSNNVHKKKKKNQRRKKKQRNNGKKRKKTKQKRKRTKHK

SEQ ID NO: 211305 - protein, 297 aa, Glycine max
  Coding DNA Sequence Number=SeqID_94527
MTRSTLPPSSPISLFVSLMCVAFACATSLNKIEHCELDCASSTVEGLNVVGDCEPKCSQGLKIPTQIEKEGQDAIKEYLDTVFSNALFGGGSIETGQNKETQIEDKGEKNVDADKSAYTAPKEPGVEHKLAIPSHIEEQGEDAIKEYLDNLFSNALFGTDSTQTGHNQEARPDRYSVEPDSKTQIKHEGESMNAQKSSYKLPKEPGEEQLLDGDLAVNVDLEIVGDGEYVLKIKRVNPSLTNHDEVERAKHMAQNGAMLLHYGEILQDMGEKLISQSQASLYSVFKIPTPPKLKSDQ

SEQ ID NO: 211306 - protein, 98 aa, Glycine max
  Coding DNA Sequence Number=SeqID_94528
  Gene Ontology: Mol. function=catalytic activity; Biological process =metabolic process
  Homolog annotation: Hit_ID=Q01CB8; Match level="QueryCoverage=84%, HitCoverage=26%, E-value=4e-09, Identity=38%"; Hit description =Homology to unknown gene
MTTYTTTPDHNIQLTTQGMTQALRVGEHLRHVIGNDDCFPNWRVQFYVSPYTCTQSMLHELKRCFLKKRIIDVREESRIREKDFRNFHVKERMNYFKE

SEQ ID NO: 211307 - protein, 123 aa, Glycine max
  Coding DNA Sequence Number=SeqID_94529
MTYTKKTDQMMFEAAKEIANKIDSMEEEASQDSIVAHEHPGRVRAAGADVTIEQYFGPAPRTSHTSSSMSPKDMEQLRQKIRDQLEEWITEKVTRQVLALPPEPEDGRSTTHVSTKENVVIWF

SEQ ID NO: 211308 - protein, 124 aa, Glycine max
  Coding DNA Sequence Number=SeqID_94530
MGQDNRKCGAVEKSEALAPTYPQFVMRNSDLRSSSFCDADISGKGADDHVGLYLSIELGVPNDAVRITGRCLHMLPDSWVMIAKGGAVDKSEAFAPTYPQFVMRKSDLRSSYKSETKIVSVFFN

SEQ ID NO: 211309 - protein, 516 aa, Glycine max
  Coding DNA Sequence Number=SeqID_94531
  Gene Ontology: Mol. function=acyltransferase activity; Biological process=metabolic process
  Homolog annotation: Hit_ID=Q6CZN2; Match level="QueryCoverage=99%, HitCoverage=90%, E-value=1e-160, Identity=54%"; Hit description =Putative acyltransferase
  Pfam annotation: Domain name=Acyltransferase; Domain location=62-192; Score=35.5; E_value=1.9e-07; Accession=PF01553.11; Description =Acyltransferase
MFSVDQLLNTYWPGQQPAHWQKSLLKWAVREQEFQDFAQRYPHLKGVDMVEQVLEHLDVRCELSERDLEQIPTHGPVVIVANHPLGALDGLALLAAVSQVRRDVKIVANRMLMMLEPINNLMLPVDNMGNRTSREQLTRMQQHLDNQGALIIFPAGEVSRLSSRGVRDRHWHHSFLRLAARARAPLVPVHVAGRNSLAFYAAAKVAAPLALLMLVREMFRQRGTRIKLHIGEQIPFANWHDGHTPGKELAKRLRKHLYRIGQGRRGLFLTEAAIARPEDRAELKKALLESERLGTLPDGKQIYLWRRNGASWVPLLRELGRLREIAFRAVGEGSGRRRDLDKYDDDYYHLILWDDEALEIVGAYRFIPGAEQLARRGLQGIYSDSLFHYDERMLPIIQQGLELGRSFIQPAYWGKRGLDYLWMGIGAYIARYPQTRYLFGPVSISGTMPLAARDLLVAFYRLYFPTDLPLAKSRRPYPASLPEVLAQFTGDNYADDLRRLKHLLANLGTAIPTLYK

SEQ ID NO: 211310 - protein, 87 aa, Glycine max
  Coding DNA Sequence Number=SeqID_94532
  Subcellular localization annotation: CTP_CleavageSite=34; ConfidenceScore=5.52e-01
MAFGARKLSSPSSSSSGDKNLKHTNDKIGNSKLSASSTKGRGSVGRIKRKSNKRGHDHEGENVKMGYIMRPKVSTKVDALDKSVLAA

SEQ ID NO: 211311 - protein, 137 aa, Glycine max
  Coding DNA Sequence Number=SeqID_94533
  Homolog annotation: Hit_ID=Q94B17; Match level="QueryCoverage=35%, HitCoverage=5%, E-value=1e-17, Identity=79%"; Hit description =Putative beta-galactosidase BG1
MALVIGPLLGILGRIALEKLPNLVGQTFIDYNDIANLLYISFFALEKQEAVGALWNFSFNDRNGEAIVVAGGVQALIENEYGPESRQVGVVGHAYTNWAAKMAVGLAIGVPWVMCKQDDALDPVVTHVKFLAPLLTH

SEQ ID NO: 211312 - protein, 264 aa, Glycine max
  Coding DNA Sequence Number=SeqID_94534
  Gene Ontology: Mol. function=protein binding; Cellular component =integral to membrane; Biological process=defense response to fungus
  Homolog annotation: Hit_ID=Q1SWI7; Match level="QueryCoverage=96%, HitCoverage=89%, E-value=7e-65, Identity=37%"; Hit description =Leucine-rich repeat
  Pfam annotation: Domain name=LRR_1; Domain location=113-135; Score =15.5; E_value=0.19; Accession=PF00560.23; Description=Leucine Rich Repeat
  Pfam annotation: Domain name=LRR_1; Domain location=142-164; Score =9.5; E_value=4.7; Accession=PF00560.23; Description=Leucine Rich Repeat
  Pfam annotation: Domain name=LRR_1; Domain location=166-189; Score =10.7; E_value=2.9; Accession=PF00560.23; Description=Leucine Rich Repeat
  Pfam annotation: Domain name=LRR_1; Domain location=17-39; Score =13.9; E_value=0.58; Accession=PF00560.23; Description=Leucine Rich Repeat
  Pfam annotation: Domain name=LRR_1; Domain location=191-214; Score =2.5; E_value=96; Accession=PF00560.23; Description=Leucine Rich Repeat
  Pfam annotation: Domain name=LRR_1; Domain location=239-261; Score =6.3; E_value=19; Accession=PF00560.23; Description=Leucine Rich Repeat
  Pfam annotation: Domain name=LRR_1; Domain location=41-63; Score =10.1; E_value=3.7; Accession=PF00560.23; Description=Leucine Rich Repeat
  Pfam annotation: Domain name=LRR_1; Domain location=65-87; Score =11.7; E_value=1.8; Accession=PF00560.23; Description=Leucine Rich Repeat
  Pfam annotation: Domain name=LRR_1; Domain location=89-111; Score =20.8; E_value=0.005; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1; Domain location=113-135::142 -164::166-189::17-39::191-214::239-261::41-63::65-87::89-111
YSPAISFVPKWIFKLKKLVSLQLHGNEIQGPIPCGIRNLTLIQNLDLSGNSFSSSIPDCLYGLHRLKSLDLRSSNLHGTISDALGNLTSLVELDLSYNQLEGTIPTSLGNLTSLVALYLSYNQLEGTIPTFLGNLRNSREIDLTFLDLSINKFSGNPFESLGSLSKLSSLWIDGNNFQGVVKEDDLANLTSLTDFGASGNNFTLKVGPNWIPNFQLTYLEVTSWQLGPSFPLWIQSQNKLKYVGLSNTGIFDSIPTWFWEAHSQ

SEQ ID NO: 211313 - protein, 103 aa, Glycine max
  Coding DNA Sequence Number=SeqID_94535
MRLFCSLGQNTLTSLGKVLVTTLVTACYRAWGLTDSNENFSQSRLENTDFFGKGAANETFSQSQPEDASISGKGAGINETLGLIRILVMDLKRANLAALTLVN

SEQ ID NO: 211314 - protein, 283 aa, Glycine max
  Coding DNA Sequence Number=SeqID_94536
  Gene Ontology: Mol. function=chitin binding; Cellular component =extracellular region; Biological process=chitin metabolic process
  Homolog annotation: Hit_ID=UPI00006A17C9; Match level="QueryCoverage =97%, HitCoverage=100%, E-value=1e-24, Identity=27%"; Hit description= UPI00006A17C9 related cluster
  Subcellular localization annotation: CTP_CleavageSite=30; ConfidenceScore=5.05e-01
MLSHKGGPLGTSTLSFRGLHVLTFRGLHVLAFRGLHVLTFRGLHALAFRGLHALTFRGLHVLAFKGSCTFIFRGLHVLASRGLHVLAFKGLHILAFRGPYVLTFRGLMSSPSEDYTSSPSEGYAPLPLEDYTSSASEDYTALPSEGHVPSSSEDYTSSPPEDYIGLHFLAFRGLHALAFRGLHVLAIRGLHVLSFKELHVLTFRGLHTLIFRGLYVLPLRGLHVLTFGGLHTLAFKGLHVPLFRGLQALAFRGRHVLAFEGLHTPSPLEGYASSLSEGSTSAP

SEQ ID NO: 211315 - protein, 105 aa, Glycine max
  Coding DNA Sequence Number=SeqID_94537
MGEVEEVQEQIKTDMEAMKEQMATMMEAMMSMKKIMEINAAAIAATSTIVELGGQAVGGIPLENTLEGPQYHSQPHPLHSTVGKNPHAMAEMGEVGSFRGKAQGR

SEQ ID NO: 211316 - protein, 102 aa, Glycine max
  Coding DNA Sequence Number=SeqID_94538
MIFLKTCLPKSFYSLEHDGSWVKKGARNVGEEGHEGEDSSLLSKIMDRFDGLQTFVGERFDTFELQVDMCFNEMESRMTKVEEHVSYIRSSFDLPPPPLPSS

SEQ ID NO: 211317 - protein, 270 aa, Glycine max
  Coding DNA Sequence Number=SeqID_94539
  Homolog annotation: Hit_ID=Q47522; Match level="QueryCoverage=15%, HitCoverage=53%, E-value=7e-19, Identity=100%"; Hit description=LacZ protein
DLPSQWLLFLSAVPPVQLLTGWCVTAKAPPDISAGKCSGRVPFAIQAAQLLGRAIGAGLFAITPAGERGMCCKAIKLGNARVFPEFDRTEVIVIRDPFTGIDETKDVVEQATEYLEDVSDVIINLTGGTSLLGYMIERVRDRIRNGKRITTVLAADERPYQEQVQNPYVIGKVIEIEQTDQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 211318 - protein, 52 aa, Glycine max
  Coding DNA Sequence Number=SeqID_94540
MEDDGKVLPKHSNKQSKKELQTKLCVVEYFGSKMGHGRGLCMEGGNEKSIRF

SEQ ID NO: 211319 - protein, 77 aa, Glycine max
  Coding DNA Sequence Number=SeqID_94541
MATIVVSSFCCKIPSLVGVLLGFEVDLGMVVATYPTAGGRHETHECIFQGRKNARSRHQRLFKENVRKTGKGVIYEL

SEQ ID NO: 211320 - protein, 75 aa, Glycine max
  Coding DNA Sequence Number=SeqID_94542
MGSSQAPSLKKRFYQVKAAINAFLAFHDRKESPVVAILADLYDTFDRRCEKSSARIVCCTPALYIWLVSHLFCQE

SEQ ID NO: 211321 - protein, 44 aa, Glycine max
  Coding DNA Sequence Number=SeqID_94543
MGPGSYYQPLTLDAELSRDIFLNSYANLTSLEMICLFVHAQDIK

SEQ ID NO: 211322 - protein, 111 aa, Glycine max
  Coding DNA Sequence Number=SeqID_94544
  Subcellular localization annotation: CTP_CleavageSite=24; ConfidenceScore=5.03e-01
MFAHSIKGCRPLGRTCGVLIPSPCVNTTPEPFHLKVCRSRLFRFFRRFPQINIGGDSARIPFVEHASRESRVALPPKGNWKGGLVSSLEEFESRSKGKTTLRAIGLRSTPN

SEQ ID NO: 211323 - protein, 158 aa, Glycine max
  Coding DNA Sequence Number=SeqID_94545
MERVLTDVLRDQRNLDNKGDEGWKRSALNAAVAVLSTSFMLMSHQIMSKTVSNYGHRGMVLVTGHGAETVVDAEKAKSRETNEVELMGLGATAIDLEEPSSNTKGKRQGSTSSGTHPHKRKMGEKEGIAASLDKMANSFNRMVEKRDGKVDDEDIQEV

SEQ ID NO: 211324 - protein, 323 aa, Glycine max
  Coding DNA Sequence Number=SeqID_94546
  Homolog annotation: Hit_ID=Q2S0F2; Match level="QueryCoverage=31%, HitCoverage=67%, E-value=3e-11, Identity=40%"; Hit description =Photoactive yellow protein
GARQHLGRGTAATRGEIDEDPVAVADPARRRRIGRDDAAQFGRMMFERGEQVAGIARPGERQEMLHRVRVHHRDRAAAVALDQADGAGVQKLEKLFLARPIAHRRGLAFDEDIAARNAGCREQTQPDPGRAHPQREDIGDDVVDLGLVLEPLRDEKIVHALRHRIEERHAHDSRGIKARHPRLGRVIDLDERVGFEPDHAERQGVAVLDAHRVELGQPDIIKTVLFQYHSHGLPATALWGGGAGCARLAHEMLAVGFHRARADIQPRRDLFRGQPLDDLAQDLAFAVRERGEALLEQGRLQDPVADRRHRAEQPLCLERLFEQ

SEQ ID NO: 211325 - protein, 112 aa, Glycine max
  Coding DNA Sequence Number=SeqID_94547
MSFPAFRISSLGRAELAWASTPCTKWFKKERGSAVFTQGTSPPHLRTPALTGFWFLLTLGHHCVLFASILVSLPPHTRDGLRPRLCSEIMGQATLPLSPFSLYPKVCPPSAR

SEQ ID NO: 211326 - protein, 184 aa, Glycine max
  Coding DNA Sequence Number=SeqID_94548
  Gene Ontology: Mol. function=pyruvate kinase activity; Cellular component=coated vesicle membrane; Biological process=glycolysis
  Homolog annotation: Hit_ID=Q1S8N3; Match level="QueryCoverage=98%, HitCoverage=39%, E-value=1e-67, Identity=71%"; Hit description =Pyruvate kinase
  Pfam annotation: Domain name=PK; Domain location=1-181; Score=-113.5; E_value=2.3e-10; Accession=PF00224.11; Description=Pyruvate kinase, barrel domain
MQAVKKGDTIFIGKYLFTRSETASVWLEVSEEKGEDVTCLICIDLPTLADKDKEVISTWGVRNNIDFLSLYTRHVEDIRHAREFLSKLGDRKQTHIYAKIENTEGLQHFDEILREADSIILARGNLGIELPSEKAAIYKCNMVGKPVVVTRVVDSMTDNLRPTRAEATDVAKQCWMEVMQFSLE

SEQ ID NO: 211327 - protein, 127 aa, Glycine max
  Coding DNA Sequence Number=SeqID_94549
  Gene Ontology: Mol. function=nucleic acid binding; Biological process= DNA integration
  Pfam annotation: Domain name=zf-CCHC; Domain location=107-124; Score =19.7; E_value=0.00055; Accession=PF00098.13; Description=Zinc knuckle
MTEGITNAKDFLDKLEKCFEKSDKAKTSTLLHHLISIKYNGKKIREYIMEMSHIVSKLKGLKLELSKDLLVHSLPVQYSQFKEKGKKRKRFEAASGSDQKKPIIDKDKCFFCRKSKHQKKDCPMYHT

SEQ ID NO: 211328 - protein, 106 aa, Glycine max
  Coding DNA Sequence Number=SeqID_94550
MVNLDVVQVKENLAHETLPLRIKDMRTKHLRGKEILLVKNSPRQDKFRLGKFELDQLAQASQISPGRVLRSTNTSSNIKQPFLPTSLPLNPPPTTPSSTSTTTYHQ

SEQ ID NO: 211329 - protein, 93 aa, Glycine max
  Coding DNA Sequence Number=SeqID_94551
MDSLGWGGPFDAPPKIEVRGGKAFGHCLEGRGHYPLFDQGVPTNPKRIKVIPKWPTTPSVEGRRPEFQESLDLRSNPFQKEGNDAILPHKGIG

SEQ ID NO: 211330 - protein, 152 aa, Glycine max
  Coding DNA Sequence Number=SeqID_94552
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=84%, HitCoverage=8%, E-value=1e-20, Identity=41%"; Hit description=Chromo
  Pfam annotation: Domain name=Chromo; Domain location=71-125; Score =30.0; E_value=8.4e-06; Accession=PF00385.14; Description='chromo' (CHRromatin Organisation MOdifier
MARISPKLNARYYGSFKILETIGKMTYKLQLPPTSSIHPMFHVSLLMKAVGTYEAEVDLPTELEDDRADIIEPEVVLASRRVIKHGERLKKWLIQWKGKPVDEATWEDEISIWSQFPTLCLEDKTIAQGGGIDTTICEELREPLVHEGNQGR

SEQ ID NO: 211331 - protein, 444 aa, Glycine max
  Coding DNA Sequence Number=SeqID_94553
  Gene Ontology: Mol. function=3'-5' exonuclease activity; Cellular component=intracellular; Biological process=mRNA catabolic process, nonsense-mediated decay
  Homolog annotation: Hit_ID=Q8GWN3; Match level="QueryCoverage=86%, HitCoverage=66%, E-value=1e-157, Identity=68%"; Hit description =Putative nucleolar protein
  Pfam annotation: Domain name=3_5_exonuc; Domain location=80-249; Score=202.4; E_value=1.1e-57; Accession=PF01612.11; Description=3' -5' exonuclease
  Pfam annotation: Domain name=HRDC; Domain location=299-377; Score =44.1; E_value=4.6e-10; Accession=PF00570.13; Description=HRDC domain
  Pfam module annotation: Pfam domain module=3_5_exonuc::HRDC; Domain location=80-249::299-377
MGLTKPKVPFHVSTIKKPQHEYNIFVDNTNLPFNHVWLKWSHGEKRFIHPLESLSVMSFVDTDVGDVVPVKAPPIESTPFKLVETVQDLKELAAKLHSADEFAVDLEHNQYRTFQGLTCLMQISTRTEDFIVDTLKLHSSIGPYLREVFKDPSKRKVMHGADNDVVWLQRDFGIYICNLFDTHQASKVLKLERKSLEYLLCHFCDITANKEYQSADWRLRPLPYEMLRYAREDTHYLLYIYDFMRIELFSMLKEPESVDAPLVEVYKCSYKVCMRLYEKELLTEKSFLRIYGLQGAGFNAQQLAVVSGLFKWRDFVARVKDDSTGYVLPNKSILEIAKQMPVTANNLRLLVNSRHPYVEHNLDSLVNIIRHSIQNTAAFEEIAQLLKTGHDVATIAQQLTRHPAQEHNRHPIRIGSQVMEVLPLLLKKPRQAIRIGRVIGGGFR

SEQ ID NO: 211332 - protein, 74 aa, Glycine max
  Coding DNA Sequence Number=SeqID_94554
MNNGEIDDDMVTDLIVGSKRGKKIIAVKTTTMINMDNEASTNTILEGNQQLESEEHFLMVDLEQWLNFVLEEVF

SEQ ID NO: 211333 - protein, 201 aa, Glycine max
  Coding DNA Sequence Number=SeqID_94555
  Homolog annotation: Hit_ID=Q1SPB9; Match level="QueryCoverage=32%, HitCoverage=11%, E-value=1e-07, Identity=42%"; Hit description =Transposase
MDAWGSLKDFPSQSKYKGCLKMFGIVCSLWEYFVEYVKNTWLIPHKECFVKAWTDKVMHLGNTTSNRLSFVDMGSNEPFADMFVQQKFDVILKCFAGVNIIGKVTIKSKLREIAYPDITSMCPPFDKKSSKASGQKLKLEKIHKRNIFMLDEFHVNLNPYILDIVDVKVDGHCGYRAVASLLGMGEDTWPLVRNNLLKELR

SEQ ID NO: 211334 - protein, 54 aa, Glycine max
  Coding DNA Sequence Number=SeqID_94556
MALGDMAARPGELLLHPEGSKDKDTNFVQAILLFDRVTSKNQVKPRKHEDIEVL

SEQ ID NO: 211335 - protein, 314 aa, Glycine max
  Coding DNA Sequence Number=SeqID_94557
  Gene Ontology: Mol. function=oxidoreductase activity; Cellular component=integral to membrane; Biological process=electron transport
  Homolog annotation: Hit_ID=Q0BGT9; Match level="QueryCoverage=99%, HitCoverage=40%, E-value=8e-66, Identity=43%"; Hit description =Aldehyde oxidase and xanthine dehydrogenase, molybdopterin binding
MPGVVDLVLTRQWSMNNMVGLDHDMSLNTVIVVAASYWQAKKAADLLEVDWLPGAGQALSGSAIAAENLAMLDGDTLVPAVDRGEAPALIRGAEQDSRLHEARYGAPYVAHATLEPCNATSHYEEGRIETWGPFQGQDMVRNVLAKMFGLKPTDVVVNTTYLGGSFGRKYLPDAVMHATAASRAVGKPVKVIYPREIDIRHEYYRPGCISHYRALLDENGYPQALWARYAGQSLFWQMRRETVHEAGGWDESMVECVYSTPYRIPHLKVEAGIVEQPISLSYLRGVGSVASLFFLESLFSELSHKAKRDEYQYR

SEQ ID NO: 211336 - protein, 131 aa, Glycine max
  Coding DNA Sequence Number=SeqID_94558
MERSMIDAASGGALGDMTHAEARNLTEKMASNSQQFNARNDAIFLRGVHEVAMNSSSSTKNKNLGGKLDALVNLVTQLAMNKKSTFAPVARDYGLCSSTDHHTDLYPSLQQYGVNEQPEAYAANIYNRPPQ

SEQ ID NO: 211337 - protein, 131 aa, Glycine max
  Coding DNA Sequence Number=SeqID_94559
  Subcellular localization annotation: CTP_CleavageSite=39; ConfidenceScore=5.40e-01
MAVDHQEPQQQQQHQPSMFPWKLRRRVPLLRRRKGQTVRLGGKKRWRRISGLLRMFRRMRLRWLKLQYVRMLKRLKEHYRNIVKDLVEAGSTIETFQQRLFMESTFAIPVGVNLSTYPSRFGSDRPRTIFM

SEQ ID NO: 211338 - protein, 652 aa, Glycine max
  Coding DNA Sequence Number=SeqID_94560
  Gene Ontology: Mol. function=lithium ion binding; Cellular component =integral to membrane; Biological process=calcium ion transport
  Homolog annotation: Hit_ID=Q9LJI2; Match level="QueryCoverage=98%, HitCoverage=99%, E-value=0.0, Identity=57%"; Hit description=Na/Ca,K- exchanger-like protein
  Pfam annotation: Domain name=AWPM-19; Domain location=162-270; Score=- 61.2; E_value=0.1; Accession=PF05512.2; Description=AWPM-19-like family
  Pfam annotation: Domain name=DctM; Domain location=125-582; Score= -245.0; E_value=0.081; Accession=PF06808.2; Description=DctM-like transporters
  Pfam annotation: Domain name=Na_Ca_ex; Domain location=154-288; Score= 123.7; E_value=5.2e-34; Accession=PF01699.14; Description =Sodiumcalcium exchanger protein
  Pfam annotation: Domain name=Na_Ca_ex; Domain location=494-636; Score= 114.2; E_value=3.7e-31; Accession=PF01699.14; Description =Sodiumcalcium exchanger protein
  Pfam module annotation: Pfam domain module=AWPM-19::DctM::Na_Ca _ex::Na_Ca_ex; Domain location=162-270::125-582::154-288::494-636
MKAPNALFGAKRRKFQGIFNALCSMVVLFFFYNREDIISNPILRQSSYFTNHGLPQNAILRDGSSLVHRRMVEISANTSGVAGENDLGVSSSGLCSGLVQHDGYSSPCEFLKVNPQCSSDGYLDYLKFFYCTCLGFSLFGYLVLGVWLAALFYLLGNTAADYFCPSLEHLSRLLKLPPTVAGVVLLPLGNGAPDVFASIAAFVGAESGDVGLNSVLGGALFVTTIVAGTVSLCVADKEIGIDRRCFIRDVSFFLITLVSLLLILFVGKVGVGAAIAFVSIYIVYAFIVAANEILRKHARRLKLDAVTPMLPVQGSVFSLGSEEDTSIYSSLLEDTESDPPRLPPSLPQWMWSSNVAIYSNQANKINFLDDERPPWGWSDGSTENTRTSFTVSKLFLMMEIPLAIPRRLTIPMVHEEVWSKPYAVASASLAPILLAILCSTQDNVSNQGVILSYCVGVTLGCTFGILAYKYTVSDHPPPQFLLPWVLGGFLMSIVWFYIIANELVALLVAFGVIFGINPSILGLTVLAWGNSMGDLMSNISLALDGEDGVQIALSGCYAGPMFNTLIGLGISLLLGAWSKKPSLYVVPEDSSLFYTMGFLITGLLWALVVLPRNNMHPNRILGMGLIALYLIFLSFRMCTAMGFITIAGLSLS

SEQ ID NO: 211339 - protein, 286 aa, Glycine max
  Coding DNA Sequence Number=SeqID_94561
MGAVYSNDQELTDHIIRDGRSFSDPKLSRVVRGSSKEECGINGRTEIETRSRPPSPTGRKQCHSSSVAGMKGQHGWKPLNIDQYDETINPNDHIEVDDESLWDLMARFSWIAVKIRDLKPIVAFHAIIAALKLKALADSLCKNRPTGMDELRCRVIGFIQIEDLSNFCDKLGVKHLVSSIEHPQTNGQEEAANNGEIQGILGREVAYYSMGIFLHSLIDNKGDSFQTDLWHLHPDSDGGTTLKYKRRLAKEGQLKSMHQGPFRVFTTPQNEAYQLEELDGKAIPRT

SEQ ID NO: 211340 - protein, 48 aa, Glycine max
  Coding DNA Sequence Number=SeqID_94562
  Homolog annotation: Hit_ID=Q0PEL6; Match level="QueryCoverage=93%, HitCoverage=3%, E-value=2e-07, Identity=54%"; Hit description =Putative integrase
MTGDESKFTHISPKKSGHVTYGDNNKGRILGVGKIGLKHSLLSVSQLW

SEQ ID NO: 211341 - protein, 210 aa, Glycine max
  Coding DNA Sequence Number=SeqID_94563
  Homolog annotation: Hit_ID=Q1SV26; Match level="QueryCoverage=36%, HitCoverage=10%, E-value=3e-21, Identity=63%"; Hit description=Zinc finger, CCHC-type; FAR1; Zinc finger, SWIM-type
  Subcellular localization annotation: CTP_CleavageSite=54; ConfidenceScore=5.37e-01
MDLSFLQSPHAQSFLRSSKAQYQMINNTMGEGNTSTRDMSTINNTMGEGSTSTRDMSTDKINVDLNEYPIEDISLENGYSGTVSEHFDHDIVANDVLEVEEIETYEKENIVSSSQNIEINEFAEEVDRDETYNETNIVPFVGQIFLSEEEAFAFYKRYAYQHGFSVRKGRFITRNGIMRRRDFFCHREGRSSLKIIEPLKEQRNRESTRV

SEQ ID NO: 211342 - protein, 67 aa, Glycine max
  Coding DNA Sequence Number=SeqID_94564
MKWETNEHKNTFGGEGGGDLIYCNTGGDAIPPLHLITMRDTNLPGARLGAPCVWAPVSVCQCVCVCV

SEQ ID NO: 211343 - protein, 133 aa, Glycine max
  Coding DNA Sequence Number=SeqID_94565
MSPWPSIRVGQQDLSELDEVQVLCGVNHEDLKELFHVSKTIREATMMTKELHFDIKTPKKKKIAFLNTFDLEGAKGFKEKQALNGPLKKTKSRLHRKKLDNNISQALFAFMDEEEPRKDNCHRRRRTTEDNDY

SEQ ID NO: 211344 - protein, 260 aa, Glycine max
  Coding DNA Sequence Number=SeqID_94566
MKFLSWMQNKLGGKQDNRKPNAHTTTTTTTTTYHPKQEPREEFSDWPHGLLAIGTFGNKTAIKEDLDDQNTQEDPSSSEEIADFTPEEIGNLQKELTKLLRRKPNVEKEISELPLDRFLNCPSSLEVDRRISNALCSESEDKEEDIEKTLSVIIDKCKDICADKRKKAMGKKSISFLLKKIFLCRSGFAPTPSLRDTLQESRMEKVLRTMLHKKICTQNSSRSPLVKKCIEDKKMTRKKNEDESDERNGDGCKWVKTDSE

SEQ ID NO: 211345 - protein, 127 aa, Glycine max
  Coding DNA Sequence Number=SeqID_94567
  Gene Ontology: Mol. function=nucleoside diphosphate kinase activity; Biological process=pyrimidine ribonucleoside triphosphate biosynthetic process
  Homolog annotation: Hit_ID=Q6Z7E5; Match level="QueryCoverage=73%, HitCoverage=50%, E-value=1e-18, Identity=51%"; Hit description =Putative outer arm dynein intermediate chain 1
  Pfam annotation: Domain name=NDK; Domain location=44-127; Score= -41.0; E_value=0.00031; Accession=PF00334.9; Description=Nucleoside diphosphate kinase
MENSLFFPLVLQMRSPSVGFTGILVLLVFLSACCSSTHGSLETEKTFAIIKPDGLLGNYTDDIKRTIVEYGFRILKEKIVQLDEGTVKSFYAEHSSKSFFSSLIKYMTRYEVCHSHAMIVLMNDDGI

SEQ ID NO: 211346 - protein, 348 aa, Glycine max
  Coding DNA Sequence Number=SeqID_94568
  Homolog annotation: Hit_ID=Q1RTL8; Match level="QueryCoverage=87%, HitCoverage=41%, E-value=2e-64, Identity=43%"; Hit description=IMP dehydrogenase/GMP reductase
MTGKRIDCVDGSDLKGCFYKLEVLLKHVPPFLGSLLGLEVDGSGKSYHTELISLKDEKDKDKVAKAKDGYFVKSHIYTVKIPQFRGGSVFSIKIRWSQKILFHDGQLSLCVPFSFPSYVNPAGRKISKKEKIFLKVNSGATTEVLCKTTSHPFKELLRQAGKLNLSYEAEVPAWSSTDLSFSYSVSSNDIFGAVLLQSPFLRDFDEREIFCLYLYPGNSPDRKVFKKDVVFVVDISASMKGTPLDNTKNALLTSLSQLSAQDTFNIIAFNGTVYLFSSSMERATEEAILNATTWVDTNFIANGDTNIMLPLTQDLVSVLDLLVMLNIKIKGRFVAGMVYLDQHILCRV

SEQ ID NO: 211347 - protein, 117 aa, Glycine max
  Coding DNA Sequence Number=SeqID_94569
  Gene Ontology: Mol. function=helicase activity; Biological process =protein amino acid phosphorylation
  Homolog annotation: Hit_ID=Q1SN45; Match level="QueryCoverage=95%, HitCoverage=7%, E-value=5e-24, Identity=47%"; Hit description=AAA ATPase
MPYPEDANCPAYLDNSLILVELNYNNEELRSEFEHLFSHMTAVNKDEGGMFFLYGYGGKGKTYIWKTLASSLRADNKIVIMVASSGIASLLLPGGRTAHSNFKIPVPVFEDSTCNIH

SEQ ID NO: 211348 - protein, 240 aa, Glycine max
  Coding DNA Sequence Number=SeqID_94570
  Homolog annotation: Hit_ID=Q9AGU6; Match level="QueryCoverage=42%, HitCoverage=41%, E-value=5e-39, Identity=76%"; Hit description=HutC -like protein
MGLFEVRADDAHDLVDFRFGFERGAGSSALGGLQEGFAQMAFEHFGHQPRGRAAQGGQLLQQRAAFRAFVDGALQRQRLALDAAQARGDAFFLCGGMGHGGLRITRGLSPAPLAAPGQRPAGATLCAAQADDRAADPYRRVAGALPRAVGKRAGAGTGLFPHDGEPRVARADGRGSAGADAGRGHVRGPAQGPVGAVRRQQHRRRDHGARPSAPQPRGAPGRGAGGQRAGGGRSTSAKAS

SEQ ID NO: 211349 - protein, 65 aa, Glycine max
  Coding DNA Sequence Number=SeqID_94571
  Subcellular localization annotation: CTP_CleavageSite=55; ConfidenceScore=5.30e-01
MALKSTLRLMKTLRPSLASLAQSSWSLLSNALRRVSGIITTRRVITDKGSPYLPYSSEVIHIGIP

SEQ ID NO: 211350 - protein, 181 aa, Glycine max
  Coding DNA Sequence Number=SeqID_94572
  Gene Ontology: Mol. function=signal transducer activity; Cellular component=membrane; Biological process=signal transduction
  Homolog annotation: Hit_ID=Q39CQ8; Match level="QueryCoverage=52%, HitCoverage=17%, E-value=2e-10, Identity=42%"; Hit description =Methyl-accepting chemotaxis sensory transducer
NDVPQHAQRADLRADGGGAVRADVGPHRVGAAAPGGAALAANGRRRGRLVRMKSKAYATDKSSHFAVFGCGRGRTSGKRAYEEFKLAQGVAVVRAGDRGRGAGPGWLGCLGTTRRDAGRAQDRIAPRARPGGQYRAQWQATRRRGGAVRRTGQAQCGAAPRAAALWCGRLRRRVRRRLCVA

SEQ ID NO: 211351 - protein, 76 aa, Glycine max
  Coding DNA Sequence Number=SeqID_94573
  Subcellular localization annotation: CTP_CleavageSite=25; ConfidenceScore=5.08e-01
MNHFFRKVPGRGFPGVFRKTFGYFRKNTSSGNFPENVLPELPEEPLTGLLKDFGVSLFRHFFRRTLVFSPLVFYPK

SEQ ID NO: 211352 - protein, 60 aa, Glycine max
  Coding DNA Sequence Number=SeqID_94574
MVFRGPTIGGESKECVLSAFSDLFEHGTPALKKGRASLTPIFKSMSREQSKKKPLVGEFC

SEQ ID NO: 211353 - protein, 97 aa, Glycine max
  Coding DNA Sequence Number=SeqID_94575
  Subcellular localization annotation: CTP_CleavageSite=49; ConfidenceScore=5.10e-01
MAHIGIVTILIPELTLEVHKAAASTTSTTASTSTGVATYPSAGGRRETRGMRVPRKEYARSRHQRLFEENVGKTGKDAIYELFSERFGSCIYARGRY

SEQ ID NO: 211354 - protein, 188 aa, Glycine max
  Coding DNA Sequence Number=SeqID_94576
MTSRDRAANRSCASWGTLGRRQSLTQVIAGEAWTCSRSINFNGDASCRRSTSLCCPCIQPVSGHPWRSSEKQGSASAWDADRVCLGTGSTPWRRFRQRLRTHIAVALMLGAGVGTAMVMLSIVLQASSDPVPGRSGSLFRPHLDVRPGAQHAAAPDPGQGLTWPDAKALLDQRYAWNQAAMAGGPKAC

SEQ ID NO: 211355 - protein, 131 aa, Glycine max
  Coding DNA Sequence Number=SeqID_94577
MAKIQGPKEENKTYSNIYKEEWTQPWPMGSKIYPKVHENPKDFFIRSSPILLETLAHGSGNWSFPSEDYITAARVLRVVRLLFTEAEIVGFHFQFFRVTVHAHGTIHSHFCVAISFQLMYFIFVVNGRLNL

SEQ ID NO: 211356 - protein, 204 aa, Glycine max
  Coding DNA Sequence Number=SeqID_94578
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=98%, HitCoverage=13%, E-value=2e-52, Identity=47%"; Hit description=Chromo
  Pfam annotation: Domain name=RVP; Domain location=74-175; Score= -14.5; E_value=0.1; Accession=PF00077.10; Description=Retroviral aspartyl protease
MTSAEMQLRRERGLSFTCDDKFSPSHRCPNKQHFVLQWEEEDDPALQPDPPDEVETVGDPSFQIHHLSYNALKGSSGLGIMKCRLGVQILLDSGSSDNFLQPRLAQCLKLPVEPIPNLQVLVGNGNALTAEGLIQDLEVKIQGHTLKLPVYLLPVSGADLVLGAAWLATIGPDLSDYSTLTLKFYLGNQFITLHGERPSLPQQA

SEQ ID NO: 211357 - protein, 221 aa, Glycine max
  Coding DNA Sequence Number=SeqID_94579
  Gene Ontology: Mol. function=protein serine/threonine kinase activity; Cellular component=membrane; Biological process=protein amino acid phosphorylation
  Homolog annotation: Hit_ID=Q1S7H1; Match level="QueryCoverage=88%, HitCoverage=22%, E-value=1e-67, Identity=62%"; Hit description =Protein kinase; EGF-like, subtype 2; S-locus glycoprotein; Curculin- like ...
  Homolog annotation: Hit description=(Mannose-binding) lectin; N/apple PAN; Type I EGF
  Pfam annotation: Domain name=B_lectin; Domain location=71-184; Score =163.6; E_value=5.2e-46; Accession=PF01453.15; Description=D-mannose binding lectin
MAMLTILLLSKLLSLFSKFAVATDTITQSEFLEDNTTLVSNNGTFELGFFTPGSSSSPNRYVGIWYKNIPIRTLVWVANRDNPIKDNSSKLSINTQGNLVLVNQNNTVIWSTNTTAKASLVVAQLLDSGNLVLRDEKDTNPENYLWQSFDYPSDTFLPGMKLGWDLKKGLNWFLTAWKNWDDPSPGDFTRSTLHTNNPEEVMWKGTTQYYRSGPWDGIGFS

SEQ ID NO: 211358 - protein, 321 aa, Glycine max
  Coding DNA Sequence Number=SeqID_94580
  Homolog annotation: Hit_ID=Q47522; Match level="QueryCoverage=14%, HitCoverage=59%, E-value=2e-21, Identity=97%"; Hit description=LacZ protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSIAGAAAQDPLEAVAQRRARCDEGQRLAQTQRLLRAVGGQDGSSLGCGRRSLSTSDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGK

SEQ ID NO: 211359 - protein, 43 aa, Glycine max
  Coding DNA Sequence Number=SeqID_94581
MSLEVTSSLTSFVLNGIAMTGMLEVVSNPWRFTVGNWLCDSDL

SEQ ID NO: 211360 - protein, 194 aa, Glycine max
  Coding DNA Sequence Number=SeqID_94582
  Gene Ontology: Mol. function=3-dehydroquinate dehydratase activity; Biological process=aromatic amino acid family biosynthetic process, shikimate pathway
  Homolog annotation: Hit_ID=Q8ZAX1; Match level="QueryCoverage=73%, HitCoverage=94%, E-value=2e-58, Identity=80%"; Hit description=3 -dehydroquinate dehydratase
  Pfam annotation: Domain name=DHquinase_II; Domain location=5-148; Score=301.7; E_value=1.4e-87; Accession=PF01220.9; Description =Dehydroquinase class II
MADKFHILLLNGPNLNLLGTREPEKYGSTTLTEIVNGLENQASALDITLSHLQSNAEHQLIDRIHQARGNTDFILINPAAFTHTSVALRDALLAVQIPFIEIHLSNVHAREPFRHHSYLSDVAVGVICGLGADGYAFALQAAAFLNWKSLKAKNRFASAVPHRRRLIPSCSRPTRCRHSTQPALANAVATAPAA

SEQ ID NO: 211361 - protein, 168 aa, Glycine max
  Coding DNA Sequence Number=SeqID_94583
  Gene Ontology: Mol. function=3-dehydroquinate dehydratase activity; Biological process=aromatic amino acid family biosynthetic process, shikimate pathway
  Homolog annotation: Hit_ID=Q8ZAX1; Match level="QueryCoverage=68%, HitCoverage=76%, E-value=3e-43, Identity=78%"; Hit description=3 -dehydroquinate dehydratase
MAERFAGVHVGQVDLDERDLHRQQRIAQRHAGVRERRRIYQNEIGVAARLMDAIDQLMLGVGLQMAQGNIQCGCLVFQSVNNLCQRRAAVLLRLTRPQQIEIGAVQKQNVKLIRHCAAKIFNPKSTNSGIRDRNMSAGTQKKFPPAARVFRTNTRAARSSAPPGAEFL

SEQ ID NO: 211362 - protein, 208 aa, Glycine max
  Coding DNA Sequence Number=SeqID_94584
MSCLVIITLTFLCRSVSWCMPPTRHTLDPDMSNRALGFPALITGLCQSFGVPVTPSKVIQPPITRAFIEKYCMPRQAQGDAPQAADAPPPPHQADPAGSLGMERYLQHLVRQQAANHRGQVQIHECLYQLSLSSRPRASFPLCVSQPTLRREGDARLAGCVFHERNTRGVATNVYLRKTSEKPEKTRSTNFLVKGSGVVFTHGEGVGP

SEQ ID NO: 211363 - protein, 63 aa, Glycine max
  Coding DNA Sequence Number=SeqID_94585
MNMLLTRHRLFCSTRTYCFGDGKAVDDPPQKWYVAAIFEKIARLTEVMPKPNDSKKSKRSWNK

SEQ ID NO: 211364 - protein, 94 aa, Glycine max
  Coding DNA Sequence Number=SeqID_94586
MAVLASVVAVSSPSALENKFDGGTTCDVATCVHALWKPMTMHHNGHDLVWLLPQWCMAKCERRYTMTDAHRSTLVLAKHEKKGKELTVRKEKER

SEQ ID NO: 211365 - protein, 61 aa, Glycine max
  Coding DNA Sequence Number=SeqID_94587
MDTSEPYTWAMKGILHEPQPYTGAMRGTVHEPQVNIEADQKFSPIDVFNKKRWTSPRISMD

SEQ ID NO: 211366 - protein, 585 aa, Glycine max
  Coding DNA Sequence Number=SeqID_94588
  Gene Ontology: Mol. function=translation initiation factor activity; Cellular component=cytoplasm; Biological process=multicellular organismal development
  Homolog annotation: Hit_ID=Q9XGW1; Match level="QueryCoverage=100%, HitCoverage=68%, E-value=0.0, Identity=64%"; Hit description=Protein PINHEAD
  Pfam annotation: Domain name=DUF1785; Domain location=267-319; Score =100.9; E_value=3.8e-27; Accession=PF08699.1; Description=Domain of unknown function (DUF1785)
  Pfam annotation: Domain name=PAZ; Domain location=320-457; Score =175.0; E_value=1.8e-49; Accession=PF02170.12; Description=PAZ domain
  Pfam module annotation: Pfam domain module=DUF1785::PAZ; Domain location=267-319::320-457
MPVRQMREGSEQHIVIKPHLQNPMNGAKKVPRAVQNGKGSPPPPLSQQELPHNQTSPHARNKGRRRSRGGGRKCDQGDVLMRPIVTSGVENGSTMCGEKEMSYPTSSKSLSFAPRPGYGQVGTKCIVKANHFFAELPDKDLNQYDVSITPEVSSKAVNRSIIAELVRLYKESDLGMRLPAYDGRKSMYTAGPLPFSWREFKIKVVDDEDGVNGSKREREYRVVIKFVARANLHHLGQFLAGKCADAPQETLQILDIVLRELSSKRFCPIGRSFFSPDIRTPQRLGEGLESWCGFYQSIRPTQMGLSLNIDMASAAFIEPLPVVEYVDQLLGKDILSRQLSDADRIKIKKVLRGVKVEVTHRGSVRRKYRVSGLTSQPTRELVFPVDENSTMKSVVEYFQEMYGFTIKYSHLPCLQVGNQKKANYLPMEACKIVEGQRYTKRLNEKQITALLKVTCQRPRDRENDILQLKYNESGKEKNCLPQVGQWNMMNKEFNPEPVIPIYNAKSEHVEKALKYVYHVSTNKTKGKELELLLAILPDNNGSLYGDLKRICETDLGLISQCCLTKHVFKITKQYLANVSLKINVK

SEQ ID NO: 211367 - protein, 191 aa, Glycine max
  Coding DNA Sequence Number=SeqID_94589
  Gene Ontology: Mol. function=serine-type endopeptidase activity; Biological process=proteolysis
  Homolog annotation: Hit_ID=Q1H1V5; Match level="QueryCoverage=71%, HitCoverage=19%, E-value=1e-22, Identity=44%"; Hit description=ATP -dependent protease-like protein
RANLTAGVKQPVIEEKDPGFAALFGMLETATGESAQWPEFLRLRAGSVHRADGGMLLLHLRDLMQDEGNGSALLEKLYRFMRNHEVQIEDWANHAQQGAGGNRHGTLPVHVKIVMIASREDYYDCLEAQPDFFDFFPIKVEFEDRVSSHTGQLCLDCRIHCTQMPAAIYAQDRRGPGAYQYAFCASGSTDA

SEQ ID NO: 211368 - protein, 286 aa, Glycine max
  Coding DNA Sequence Number=SeqID_94590
  Gene Ontology: Mol. function=translation initiation factor activity; Cellular component=cytoplasm; Biological process=multicellular organismal development
  Homolog annotation: Hit_ID=Q9XGW1; Match level="QueryCoverage=99%, HitCoverage=31%, E-value=1e-146, Identity=82%"; Hit description =Protein PINHEAD
  Pfam annotation: Domain name=Piwi; Domain location=1-247; Score =319.2; E_value=7.4e-93; Accession=PF02171.8; Description=Piwi domain
MGGRNTVLVDAVSCRIPLVSDIPTIIFGADVTHPENGEDSSPSIAAVVASQDWPELTKYAGLVCAQAHRQELIQDLYKMWHDPVRGLVSGGMIRDLLISFRKATGQKPLRIIFYRYACASLEPNYQPPVTFIVVQKRHHTRLFANNHRDRNSTDKSGNILPGTVVDSKICHPTEFDFYLCSHAGIQGTSRPAHYHVLWDENNFTADGIQSLTNNLCYTYARCTRSVSVVPPAYYAHLAAFRARFYMEPDLQQENGSSGGGSRATRAGGVKPLPALKENVKRVMFYC

SEQ ID NO: 211369 - protein, 107 aa, Glycine max
  Coding DNA Sequence Number=SeqID_94591
MRVHCNQASRRPSMITDSPPLLMFPRTREKKREQRRSHGKECTLIDWPNSLKTVLSGVANCRNLPFGRKATRDSWQSFPRKEYAQSRHKRLFEENIGKTGKYVVYVL

SEQ ID NO: 211370 - protein, 104 aa, Glycine max
  Coding DNA Sequence Number=SeqID_94592
  Gene Ontology: Mol. function=lipid binding
  Homolog annotation: Hit_ID=Q9LTR5; Match level="QueryCoverage=79%, HitCoverage=5%, E-value=7e-17, Identity=45%"; Hit description =Similarity to bactericidal permeability-increasing protein
MATLHLVDIGNNLVGSIRLNDFQMSLKWSNIGNLRVYLIQPVVWTLIETVFLPYANARLSKGLPLPIIHGFTLQNAEIILSTSRIAVCSDVAFADSNKRFLQFH

SEQ ID NO: 211371 - protein, 323 aa, Glycine max
  Coding DNA Sequence Number=SeqID_94593
  Gene Ontology: Mol. function=endonuclease activity; Cellular component=chloroplast; Biological process=tRNA processing
  Homolog annotation: Hit_ID=Q8L633; Match level="QueryCoverage=77%, HitCoverage=64%, E-value=9e-84, Identity=62%"; Hit description =Ribonuclease Z, chloroplast precursor
  Subcellular localization annotation: CTP_CleavageSite=35; ConfidenceScore=5.11e-01
MQISLSNLAFKTPQLFPIHHPIFPPKPPLNHQVSTQSHVNNVLKGSSGYLSEISKVIDHEEQYRVARSQVSRKVLDLEGYSIEGLSVGGQETCIIIPEFKCSFDIGSGKLMAYIGMLNANSILEKGGLPMYVASRGLFNLKPPTVFVPPCIKEDVEKLLDIHRTMGQVELNAEVVALDVGMFHLSFVNDQEISSRNDVQNFILGETYEIRNNLVVRPFKTQHVIPSQGYVVYSIRKKLRKQYAHLNGKQIEKLKKSGVEITDMILSPEVAFTGDTTSDFMLDPCNADALRAKILITEIGIYIFDPQDIRQAASKLQSRLSAKV

SEQ ID NO: 211372 - protein, 97 aa, Glycine max
  Coding DNA Sequence Number=SeqID_94594
MGIAPTRHPVDPEKSNRALGFPALVTGLYQSYRMPVPPRQGYVIIGIAPARHPVDPKKVPVTSSKGIRPPADRAFIKKYCVPRQAQGETPQQHWDGR

SEQ ID NO: 211373 - protein, 68 aa, Glycine max
  Coding DNA Sequence Number=SeqID_94595
MSEKLCYACFATASDGYGSKMLNDFKNRLVSELNNSKPVIFKGRCGTLKKLMAEEHDQVENITEVNSS

SEQ ID NO: 211374 - protein, 363 aa, Glycine max
  Coding DNA Sequence Number=SeqID_94596
  Homolog annotation: Hit_ID=Q9FKI3; Match level="QueryCoverage=93%, HitCoverage=74%, E-value=2e-46, Identity=37%"; Hit description =Arabidopsis thaliana genomic DNA, chromosome 5, P1 clone:MXH1
  Pfam annotation: Domain name=IQ; Domain location=78-98; Score=24.3; E_ value=0.00042; Accession=PF00612.17; Description=IQ calmodulin -binding motif
MGFTGELVRSVFSKNRSDGSHENKRMIQLQLRALKSRFHSPYMRACLNDEGDTESEETVENVAQNRPSSNSKKSLNEEEAAVLIQSAFRGFLLRRQNGEIKSQTGKDEFNLVTESPDKKSIGTSIDVQTSNSTEVFSVEGEIKGICHRIQRRTRTQAIKQKEDWDDSTVSSYVSKMRMQNRMEASTRRERALAYAFSQQLRICSKRKSPKFNSMESNMSWSWLERWMATRLPETSSVESHAMKQYDPSNGSHKFTIMTRFFDAAGEEKESCGSNEVPLHFDNYSINSREEKVSFKPHTPKTNFKARRTVSRRKTVPSYQFHEEQPKVSKRDGSGDASKDIKQKQKQVGSRTEIALSTSKASNV

SEQ ID NO: 211375 - protein, 436 aa, Glycine max
  Coding DNA Sequence Number=SeqID_94597
  Gene Ontology: Mol. function=lipid binding; Cellular component =integral to membrane; Biological process=defense response to bacterium
  Homolog annotation: Hit_ID=Q9LTR5; Match level="QueryCoverage=69%, HitCoverage=22%, E-value=8e-50, Identity=35%"; Hit description =Similarity to bactericidal permeability-increasing protein
  Pfam annotation: Domain name=LBP_BPI_CETP; Domain location=37-216; Score=98.4; E_value=2.2e-26; Accession=PF01273.15; Description=LBP BPI  CETP family, N-terminal domain
MAPFFVLFLLASSLTQGYAQFQPKNEAFISLLITQNGLDFVKELLVNKAISSLVSLRLPNIEKTAKIPVVGNVYMVLSNITIYHIDVPSSHVKPGETGISIIASGVTCNLSMNWYYSYSTWLVPVKISDRERNLISATAGKVEGMEVGLTLGLENQEGSLKLKLKDCGSNVKDISIKLDGGASWLYQGIVDAFEDKIGSTVENAIAKKLTKGISSLDSYLKSLPREVPVDDHASMNVTFVNDVLFSDSSVGFETNGLFIERKISLPILDLDHKNSKLPILCTNSSKMLGITLDEAVFNSATALYYDAKFMHWIVDQIPDQSLLNTAGWRFIVPQLYKKYPNHDMNLNVSLSSPPVVEISNQKAGATIFADMAIDVLEEDEVIPVACISLAGVDVKWSSASLIVQHWAALFNTLFFLLTEANPYQSLLVLSFILKLG

SEQ ID NO: 211376 - protein, 237 aa, Glycine max
  Coding DNA Sequence Number=SeqID_94598
MADTELSTACVDRLEAAMAKLAAIQTSTAADQTSITSKLDVIIRILNTMVPKQPSPSSASAKSPPMPPLLPKTINPTSSSAKPPPTAETTSPPPTAETTLPPFPMATFHLPVNKHHALFFESLPVASHRSHTKSSSRGILPSDIHFSLSVVCAATIRDTNLNHPFLLLIFVILVTAKGLCLHNHLQALILTPIFIWDPDALSWKPVIGVVIILVAVIVVVIIAVIVMVIVAVIVVGM

SEQ ID NO: 211377 - protein, 136 aa, Glycine max
  Coding DNA Sequence Number=SeqID_94599
  Gene Ontology: Mol. function=hydrogen ion transporting ATP synthase activity, rotational mechanism; Cellular component=proton -transporting ATP synthase complex, catalytic core F(1); Biological process=ATP synthesis coupled proton transport
  Homolog annotation: Hit_ID=Q9THV9; Match level="QueryCoverage=100%, HitCoverage=36%, E-value=7e-62, Identity=70%"; Hit description=Atp synthase beta subunit
  Pfam annotation: Domain name=ATP-synt_ab_N; Domain location=1-56; Score=44.3; E_value=4.1e-10; Accession=PF02874.13; Description=ATP synthase alphabeta family, beta-barrel domain
MPNIYNALIVKGRDTVGQQINVTCEVQQLLGNNRIRAVAMSATEGLMRGMEVIDTGAALSVPVGGATLGRIFNVLGEPIDNLGPDFFGGAGVGKTVLIMELINNIAKAHGGVSVFGGVGERTREGNDLYMEMKESG

SEQ ID NO: 211378 - protein, 293 aa, Glycine max
  Coding DNA Sequence Number=SeqID_94600
  Gene Ontology: Mol. function=uroporphyrin-III C-methyltransferase activity; Cellular component=intracellular; Biological process =cobalamin biosynthetic process
  Homolog annotation: Hit_ID=Q1H3L5; Match level="QueryCoverage=98%, HitCoverage=58%, E-value=1e-102, Identity=67%"; Hit description =Uroporphyrin-III C-methyltransferase
  Pfam annotation: Domain name=TP_methylase; Domain location=167-293; Score=70.7; E_value=4.6e-18; Accession=PF00590.10; Description =Tetrapyrrole (CorrinPorphyrin) Methylases
MYAQGEIEYMPAEFHAEQLTSACLVIAATDDEAVNEAVSVAAKRLNIPVNVVDAPALCTFTMGSIIDRSPVVIAVSSEGNAPVLARHIRSKIETMLPAAYGRIAAIAGEFREQVKVRFTNVPARRRFWEEVLNGPLVERVLSGQEQAARELLGELLSQREDTPVRGEVYLVGGGPGDPDLLTFRALRLMQQCDVCVYDKLVSKEVMELVRRDAELIYVGKSRDQHTLPQEEINQLLAKLALEGKRVLRLKGGDPFIFGRGGEEIETLMQHGVPFQVVPGITAANGVSAMPGFR

SEQ ID NO: 211379 - protein, 538 aa, Glycine max
  Coding DNA Sequence Number=SeqID_94601
  Gene Ontology: Mol. function=calcium ion binding; Cellular component =mitochondrion; Biological process=protein amino acid phosphorylation
  Homolog annotation: Hit_ID=Q1SMD3; Match level="QueryCoverage=91%, HitCoverage=93%, E-value=1e-107, Identity=32%"; Hit description=TonB box, N-terminal; Tetratricopeptide-like helical
  Pfam annotation: Domain name=PPR; Domain location=125-159; Score =35.9; E_value=1.4e-07; Accession=PF01535.11; Description=PPR repeat
  Pfam annotation: Domain name=PPR; Domain location=209-243; Score =19.4; E_value=0.013; Accession=PF01535.11; Description=PPR repeat
  Pfam annotation: Domain name=PPR; Domain location=244-278; Score =43.2; E_value=8.7e-10; Accession=PF01535.11; Description=PPR repeat
  Pfam annotation: Domain name=PPR; Domain location=279-313; Score =47.1; E_value=5.8e-11; Accession=PF01535.11; Description=PPR repeat
  Pfam annotation: Domain name=PPR; Domain location=314-348; Score =42.1; E_value=1.9e-09; Accession=PF01535.11; Description=PPR repeat
  Pfam annotation: Domain name=PPR; Domain location=349-383; Score =28.5; E_value=2.3e-05; Accession=PF01535.11; Description=PPR repeat
  Pfam annotation: Domain name=PPR; Domain location=385-419; Score =16.9; E_value=0.073; Accession=PF01535.11; Description=PPR repeat
  Pfam annotation: Domain name=PPR; Domain location=421-455; Score =47.6; E_value=4.1e-11; Accession=PF01535.11; Description=PPR repeat
  Pfam annotation: Domain name=PPR; Domain location=456-490; Score =31.1; E_value=3.9e-06; Accession=PF01535.11; Description=PPR repeat
  Pfam annotation: Domain name=PPR; Domain location=491-525; Score =19.0; E_value=0.017; Accession=PF01535.11; Description=PPR repeat
  Pfam annotation: Domain name=PPR; Domain location=90-124; Score=44.1; E_value=4.8e-10; Accession=PF01535.11; Description=PPR repeat
  Pfam module annotation: Pfam domain module=PPR::PPR::PPR::PPR::PPR::PP R::PPR::PPR::PPR::PPR::PPR; Domain location=125-159::209-243::244 -278::279-313::314-348::349-383::385-419::421-455::456-490::491 -525::90-124
MQFLKLPRLLMPYVRRIHLHSQPLPSQSTCKFDSIDDAVALFHRMVDMHPLPSIVEFTKILGTIAKMRYYATAIDLYTLMEYKGVVPFTVTFNILINCFCHMGQMDFAFSVMGKILKWGCRPNVVTFTTLMKGFCVNDKMLDALYIYDEMVARRIRFDDVLYGTLINGLCKSKIGKPRAAVQLLQKMEERQLVKPNLIMYNTVVHGQRKEVTSLLNGFCLNNKVDEARELFNVMIERGEQHDIINYNILMNGYCLNNKVGEARKLFHMMVERGEQPDTITYTILMHGYCLIDKVDEARNLFHGMIERGLVPDVWSYNILIKGYCKFERVGEAMNLLEDMFLKNLVPNIITYNSVVDGLCKSGGILDAWKLVDEMHYCCQPPPDVTTYNILLESLCRIECVEKAIAFFKHLIFERSFAPNVWSYNILISGCCKNRRLDEAINLFNHMCFKNLVPDIVTYNILLDALFNGQQLDKAIALLVQIVDQGISPNLRTYNILINGLHKGGRPKTAQKISLYLSIRGYHPDVKTYIINELCKGGL

SEQ ID NO: 211380 - protein, 470 aa, Glycine max
  Coding DNA Sequence Number=SeqID_94602
  Gene Ontology: Cellular component=integral to membrane
  Homolog annotation: Hit_ID=Q5ZBZ3; Match level="QueryCoverage=99%, HitCoverage=66%, E-value=1e-129, Identity=52%"; Hit description =Putative dymeclin
MGSALSTPDTAEHLVGSFVGDVSIPLSSDFWQKLLELPFDAELPSQRLHQACQLLVQNNRNTRHLAKILFHLACYLQESISTSGVLQLVYEKAVNAVYLTSVFLKHLIESAQDGDVELYLSLHDSESIPKNILRDQTIENLVMRNVLNFIASVDVSPNTYFLHLELLNFMIIAISTQLLCGPSPGPNDVNPFLDAAMAQDSHLVTSVVCNLLLNYITRPRVPFNRASYSIFYDRSQNSVLKRVGSAAANIVLLPFSYLISSSSEGSRNPIADSSLQVLLVLIHYHKCLVSEGYSVLKNQVSASSDSSPKDNTYFSDNPYCRALERAIDCEYKEGNAHSDQHVKLPFAPLFDTLGMCLADETAVLLLYSFLQGNSTFLEYVLVRTDLDTLLMPILEALYDARRMTAYQIYMLLIILLILSQDTSFNAGIHKLILPTVPWYKERLLYQSSLGSLMVIILIRTIQYNLSKLRV

SEQ ID NO: 211381 - protein, 253 aa, Glycine max
  Coding DNA Sequence Number=SeqID_94603
  Gene Ontology: Mol. function=sequence-specific DNA binding; Cellular component=nucleus; Biological process=regulation of transcription, DNA-dependent
  Homolog annotation: Hit_ID=Q9LUH8; Match level="QueryCoverage=96%, HitCoverage=70%, E-value=8e-38, Identity=38%"; Hit description=Heat shock transcription factor-like protein
  Pfam annotation: Domain name=HSF_DNA-bind; Domain location=1-120; Score=12.9; E_value=3.8e-11; Accession=PF00447.8; Description=HSF -type DNA-binding
MANKNDRILHLQGFRKVDPDKWEFANEGFLRGQKHLLKNIRRKKTLTNQQQALPIDHCVEVGRFGSLDGEVDALRRDKQVLMVELVKLRQQQQNTRNNLQSMENRLKRTQKQQQQMMKFLTRAMQNPNFLQQLVQQREWRKDLEEAATFSNKRIRSDVEECSSFVKLEHEEEHNNDITSSELEVSDMDLVIMNTEEEEEKLLGAEIESINEEVLWEELLNEGTEEDVLIGLEEDDEDIVVLAEELGYLASTPK

SEQ ID NO: 211382 - protein, 48 aa, Glycine max
  Coding DNA Sequence Number=SeqID_94604
  Homolog annotation: Hit_ID=Q338B0; Match level="QueryCoverage=75%, HitCoverage=10%, E-value=5e-07, Identity=61%"; Hit description=HSF -type DNA-binding domain containing protein, expressed
MNPNNDGPMILVKEEFPEGVAIAPQPLEGLHEIGPPPFLTKTYDIVDD

SEQ ID NO: 211383 - protein, 87 aa, Glycine max
  Coding DNA Sequence Number=SeqID_94605
MPEIKRKYCYAIRPLGSSRMFLQKAVASGGSNLARLGELGGKLLPYFPINRGRSGGERGLALLVLCIHLKLGRKIVSMKKIQAEALQ

SEQ ID NO: 211384 - protein, 397 aa, Glycine max
  Coding DNA Sequence Number=SeqID_94606
  Gene Ontology: Mol. function=protein binding; Cellular component =extrachromosomal circular DNA; Biological process=cell adhesion
  Homolog annotation: Hit_ID=Q8XDD4; Match level="QueryCoverage=98%, HitCoverage=94%, E-value=1e-121, Identity=54%"; Hit description=YchP protein
NSDSDTTLGQQAGIWAFNHFRDEVATRVADEGQSLLSPYGQAQIDLNVDMEGNFSGSGASLLTPWADRYNYLTFSQLGVHQTDDGLVGNAGLGQRWVAGSWLLGYNGFVDRLFDSGLQRASLGTEAWSDYLRLSANYYTPLSGWRNRNPFQQQRLARGYDVTTQGYLPFYRQLGVSVSWQQYLGNNVDLFNSGNSYHNPSALTLGVSYTPVPLVTVSASHKTSNEGESQDQLGLRLNYRFGVALSQQLNPDNVAAARSLRGSRYDLVTRSNTPVLEFRQRKTLSVFLATPPWQLNAGESLPLKLQIRSAHPISKVSWQGDTQALSLTPGADPNDPQGWSIIMPAWDASPEANNSYRLSVTLEDSKQNRVTSNWITLQVQPPVMLEQGGENRFDLLAP

SEQ ID NO: 211385 - protein, 118 aa, Glycine max
  Coding DNA Sequence Number=SeqID_94607
  Gene Ontology: Mol. function=metal ion binding; Biological process =metal ion transport
  Homolog annotation: Hit_ID=Q1SBH5; Match level="QueryCoverage=84%, HitCoverage=43%, E-value=1e-13, Identity=40%"; Hit description=Heavy metal-associated domain, putative
MENDKCRSKALKIAAASQGVHSVALEGESRDQVVVTGDTIDSVCLTNKFRKKFSNATLISVADANASDEQQGGGGGEQKVETTLEKKLPIAYCYANFPPPCPLYVVDHDPYPNTCSIL

SEQ ID NO: 211386 - protein, 71 aa, Glycine max
  Coding DNA Sequence Number=SeqID_94608
  Subcellular localization annotation: CTP_CleavageSite=53; ConfidenceScore=5.17e-01
MSLWRWGGEHGDSAQTGTSVAPLQSPATGLPGRKKRPAPQLFKSGLIREQRCRPSMVKLLTGSNALANTDS

SEQ ID NO: 211387 - protein, 181 aa, Glycine max
  Coding DNA Sequence Number=SeqID_94609
IYVSSIFGQDVLDIVSDIVDPAASILHLTFILPCALCSNSSIFGQDVLDIVSDIVDPAASILHLTFYLALCIVQPDLIPLHNVGHHVRAVMQVRSATFIIRVIKHSGICSGNSKILQVASRFQDVKTSHHLLSATSLFQDVKTSHVTSAFCSPCLHALTAASSIPVAYISHQQQQSPSSPF

SEQ ID NO: 211388 - protein, 91 aa, Glycine max
  Coding DNA Sequence Number=SeqID_94610
  Gene Ontology: Mol. function=protein serine/threonine phosphatase activity; Cellular component=protein serine/threonine phosphatase complex; Biological process=protein amino acid dephosphorylation
  Homolog annotation: Hit_ID=O24078; Match level="QueryCoverage=77%, HitCoverage=22%, E-value=2e-09, Identity=50%"; Hit description =Protein phosphatase 2C
MFWTKWLEVMNVTLRRQQSMYLNTDFEFLKKEDHNGGSYCGRVDMECKEGMAEVLTSDHKPSREDERDKIETRVSNQEAIDITCPFCVGNN

SEQ ID NO: 211389 - protein, 125 aa, Glycine max
  Coding DNA Sequence Number=SeqID_94611
  Gene Ontology: Mol. function=zinc ion binding; Cellular component =intracellular
MKQGDWLCPNFFEERINQLKEDNNHLPLKKGDWICNKIQDVCNAKKGLPIVKLIPGSGNVTQVLFNYTGILFQFLCIYINFRRNMVFLKCDHRRLIVSKASSSSLQPQPEDIDHDKNSKFAFVAH

SEQ ID NO: 211390 - protein, 78 aa, Glycine max
  Coding DNA Sequence Number=SeqID_94612
MANEKVEEKVVSEEEKHKSKKQATNKGKVVVNHPPMEHLPYLHALSKKDKERQYKLFLDIFKRLQINIPFSEALEQMP

SEQ ID NO: 211391 - protein, 189 aa, Glycine max
  Coding DNA Sequence Number=SeqID_94613
MTEGCGEGFCLANLPGDAFSLWGNFFEAKKQMMADAKFAGLLGLGKPLVEILPPGQLRGFARVGLARVGGAGLWPRAKFRIGWPPPPPREGRIKATRAESQWIVAARPLCHLQYPVAYLSRLQRILPAARWELRFKASRRANPPHEGHQRHVPLGGRGPLLLVGKRTAGARVASSPDSDLEAFSHNPTH

SEQ ID NO: 211392 - protein, 690 aa, Glycine max
  Coding DNA Sequence Number=SeqID_94614
  Gene Ontology: Mol. function=protein binding; Cellular component =membrane; Biological process=defense response
  Homolog annotation: Hit_ID=Q1SWW3; Match level="QueryCoverage=98%, HitCoverage=96%, E-value=1e-130, Identity=54%"; Hit description =Disease resistance protein
  Pfam annotation: Domain name=LRR_1; Domain location=439-461; Score =11.9; E_value=1.7; Accession=PF00560.23; Description=Leucine Rich Repeat
  Pfam annotation: Domain name=LRR_1; Domain location=571-592; Score =4.4; E_value=42; Accession=PF00560.23; Description=Leucine Rich Repeat
  Pfam annotation: Domain name=LRR_1; Domain location=594-616; Score =7.2; E_value=13; Accession=PF00560.23; Description=Leucine Rich Repeat
  Pfam annotation: Domain name=LRR_1; Domain location=618-640; Score =10.6; E_value=3; Accession=PF00560.23; Description=Leucine Rich Repeat
  Pfam annotation: Domain name=LRR_1; Domain location=642-664; Score =7.0; E_value=14; Accession=PF00560.23; Description=Leucine Rich Repeat
  Pfam annotation: Domain name=LRR_1; Domain location=665-687; Score =0.3; E_value=2.5e+02; Accession=PF00560.23; Description=Leucine Rich Repeat
  Pfam annotation: Domain name=NB-ARC; Domain location=150-460; Score =150.7; E_value=3.8e-42; Accession=PF00931.13; Description=NB-ARC domain
  Pfam module annotation: Pfam domain module=LRR_1::LRR_1::LRR_1::LRR _1::LRR_1::LRR_1::NB-ARC; Domain location=439-461::571-592::594 -616::618-640::642-664::665-687::150-460
MAEAVLEVALEKLSSLIEKELGLFLDFDRDMKKLRSMFTTIKATLQDAVEKQFSDEAIKDWLPKLKEAAYELDDILDECAYEALGLEYQGVKSGQSHKVQCSCLSSFHPKHVVFRYKIAKRMKRITERLDEIAEERQKFHLTKTALERTRIIEWRQTSSIISERQVYGREEDTKKIVDVLMANADAYHSESLLVYPIVGLGGLGKTTLAQLIFNHKMVINKFEIRMWVCVSEDFSLNRMTKAIIEAASGQACENLDLDLLQRKLQDLLRGKRYLLVLDDVWDDKPNNWQKFERVLACGANGASILVTTRLPKVATIMGTMPPHELSMLSEDEGWELFKHQVFGPNEEEQVELVVAGKEIVKKCGGVPLAIKALGGILRFKRKENEWLHDIKTDEFGKVRSFKMHDLVHDLAQSVAKDILKLDHCYHLQKLPNNLIQLKALQQLSLNNCWKLSSLPPWIGKLTSLRNLSTYYIGKEKGFLLEELRPLKLKGGLHIKHMGKVKSVLDAKEANMSSKQLNRLSLSWDRNEESELQENMEEILEALQPDTQQLQSLTVLGYKGAYFPQWMSSSPSLKKLVIVRCCKLNVLASFQCQTCLDHLTIHDCREVEGLHEAFQHLTALKELELSDLPNLESLPNCFENLPLLRKLTIVNCPKLTCLPSSLNLSSLERLTIDACPELKKLTFPILDHDDE

SEQ ID NO: 211393 - protein, 116 aa, Glycine max
  Coding DNA Sequence Number=SeqID_94615
MASCSHRGLSEKRLPGLLIAVSDFTGGSSLCRSWWLRLIGSSLDHDPHRFTSAWRLFKGVVVALAKVLKFHGNIKMLKLGWCQLFMVLPGGVDSAVSPCFVASSPDSMGRVASPTS

SEQ ID NO: 211394 - protein, 81 aa, Glycine max
  Coding DNA Sequence Number=SeqID_94616
MASKDLTRNESGSDHQYSMDEYCMAIKKVLRKSPSLHQCAKEQLGLVILSDDEALHDSAEIIAVEMDGDNKEEDFPYYPQG

SEQ ID NO: 211395 - protein, 199 aa, Glycine max
  Coding DNA Sequence Number=SeqID_94617
  Subcellular localization annotation: CTP_CleavageSite=44; ConfidenceScore=5.51e-01
MEAGTALSLRLHTRIPIPINTANSNTLLFQPRFTLSSHSPSSFSAYSYRGPTPKRPFLADWVSQNDDVVRTLPIYVGSASLFAILLNRSLSGIAPVVDAGRHVPSLSLSLSLALCLAQLIQKMHEIEFLNCGLLLGLVWLCSQSRADLLTLGLAVTNILAGLVWLSVKPKSITVVNPRGVECKSLCATLPEVARNELLW

SEQ ID NO: 211396 - protein, 85 aa, Glycine max
  Coding DNA Sequence Number=SeqID_94618
MLVTHVWAIQQASAKDPGRPVHSAPHEHTQHPTYERGQKLVPKTLEGQCTVLPTNMHNMHMPMHFQHQSTFHFHVIHNKNIISSQ

SEQ ID NO: 211397 - protein, 162 aa, Glycine max
  Coding DNA Sequence Number=SeqID_94619
DLVLSVWPQFLCSNRFPCHAKRAEAALSEISKTERKNGKKKKQATTKPSGISSSIDSPSPEIDTMAGIGGEGNRPPRRTLGDYAYQQRPKHYNNMFVPPFSNKVVELKPALLSLIAVYLRVFPFSLAGTMMSKSPEEAIAIIDSVAASDYQSHHDRGSIQRK

SEQ ID NO: 211398 - protein, 112 aa, Glycine max
  Coding DNA Sequence Number=SeqID_94620
  Gene Ontology: Mol. function=transition metal ion binding; Cellular component=cytoplasm; Biological process=fucose metabolic process
MQVDESAYEEGVEQFLEFASERSRLDEDEKYEFEEMHKCPRCGVSWHKVKDDNECNSVKSTKKGPPAKVLWYLLIIPRFKHLFANGDDTKDLTWHADERNCDGMVCHPTNSS

SEQ ID NO: 211399 - protein, 259 aa, Glycine max
  Coding DNA Sequence Number=SeqID_94621
  Gene Ontology: Mol. function=protein binding; Cellular component =intracellular; Biological process=defense response
  Homolog annotation: Hit_ID=Q1S351; Match level="QueryCoverage=99%, HitCoverage=33%, E-value=3e-92, Identity=65%"; Hit description =Disease resistance protein; AAA ATPase
MTLFHHYALLDSNSLNTPDEDIVEQVVKSCKGLPLAIKVIGRSLSHRPYELWQRMVEELSHGHSILDSNIELLTYLQKILDVLEDNTVIKECFMDLGLFPEDQRIPVTVLIDIFAESYGLDDDGIEAMTIINKLESMNLVNVLIARKNTSDTDSYYYNNHFIVVHDLLRELAIYQSAQEQLEGSKRLIIDTKENKNEWGLGEKQQGMISRILSNCFRYCSKQKPPQIHARTLSISIDETCNSHWSHMQPAKVKVLILNF

SEQ ID NO: 211400 - protein, 65 aa, Glycine max
  Coding DNA Sequence Number=SeqID_94622
MDQVQRQAFSKGLSVSTNHRGVRRDLRMPDRRKEAIPLFWVLSFYGENNINGQDLGMRIRLSEAK

SEQ ID NO: 211401 - protein, 258 aa, Glycine max
  Coding DNA Sequence Number=SeqID_94623
MLIIIDQYKEKVNLAASHGQMLEDEQAKVSTLRVEREAREGVIELLHKEAMKWMDRFALSLNESQELPRLLAKAKAVPDTYSAPDEEVQEQMKAMKDQMTTMMSMRKMMEVNKATVLATSTAIEVDSIHPSGINQVNHAVLDMIGQGGEALGSTGNPHFVQVQSKHPFSPYGLPPNYAPPNVAHAPDENVDNSAPIPIKSQQPQSGHANVSQPMGETHEVPRDHTLVDFEPHLGYATEGQAFGGIPLPNTLGGPQYRP

SEQ ID NO: 211402 - protein, 111 aa, Glycine max
  Coding DNA Sequence Number=SeqID_94624
MRVGTHMLTAKIMNIFGMSGMNHSGRVFAPPKLLTRSKDKGKAKVDQQVANHRGRMQLNDCFYQYTLHQHRQDPNPYPWPTLEKFRATVAWPGDRSNFQDEAGPTDAQGAA

SEQ ID NO: 211403 - protein, 85 aa, Glycine max
  Coding DNA Sequence Number=SeqID_94625
MLLKESISDVQKCFRLVVNHLLALGKTFEREKLNVKFLNVTLFGKLRECELELGRLNGEEEVDKKNKGLVLKTSTSHHEASDEDC

SEQ ID NO: 211404 - protein, 456 aa, Glycine max
  Coding DNA Sequence Number=SeqID_94626
  Homolog annotation: Hit_ID=UPI00005F8C1A; Match level="QueryCoverage =46%, HitCoverage=72%, E-value=1e-16, Identity=37%"; Hit description =COG0100: Ribosomal protein S11
  Subcellular localization annotation: CTP_CleavageSite=67; ConfidenceScore=5.27e-01
MPISVNFGDVRTDKIDGKAYQQPVSFTLSCTNLPSNALKLQLQGNAASFDSGALRASVSGLGIAFFKSNAESGNTGSGTAINETYVVNGTIAARYAEANFSGKLIEPPLCQINGEKPIMVEFGSVVISQINGDSYRKPVSWTLTCSNNPDKSMRVQISGTGSAFNSALLATSQRDLAIQILSGKNGENALALNNWLPFTFPALPVIQVVPAMEAPRVDGIRWVNASQVEITWSVVDVGMISGYARCNSSERTCAAGIGVSAWFIGHGTVFSAAGGPQIYVDQGESLASVAERFIRFNGRGGKFLRNSDTRYYSSYCGSFVTASATVTDYSGMVAPWAPCVNIPVVPVSCSVSGAALNINHGTLAPAAVNGAKASVNFSLFCNRDVNISFALAGGINILKLSNNISTLLSLADGSLNKPQLVRANVTTPFTLISTLSSTTPSPGNFTGSTVVFINYL

SEQ ID NO: 211405 - protein, 80 aa, Glycine max
  Coding DNA Sequence Number=SeqID_94627
KHYGCPGSPGIPFSTKRGVWWPPSLPRPAQLAQASSARPGELGYFNLKQEIAQKPLEQPRFKNHYLHPHFTNYTPFGFFL

SEQ ID NO: 211406 - protein, 125 aa, Glycine max
  Coding DNA Sequence Number=SeqID_94628
LDGGGRMNSARQSIHGSLNKIENGELGNRARQSIRGAPDSMVEDASTAPGNQCMGLRIRLEIGDLANSARQSIRGSPDSILDGGGRMNSARQSIHGSPNKIENGDLANSARQSICGAPDSMVEDA

SEQ ID NO: 211407 - protein, 57 aa, Glycine max
  Coding DNA Sequence Number=SeqID_94629
MRPPFDHFKMFNTHFHGIRKVLERFGKKTAKNTKVGGELIKKGGALRKLHPEHPRSR

SEQ ID NO: 211408 - protein, 125 aa, Glycine max
  Coding DNA Sequence Number=SeqID_94630
  Gene Ontology: Mol. function=nucleic acid binding; Biological process= DNA integration
FTLITKKPNSAILAKELEHRNHANKVCHHTFQSALSDELFNDYCSYKEAKEIWDSFVLKYPTKDVVRQWFIISNYYHLTMIEDKDIKVQINKYHNLLENTTLPDEFVFKLLVEKLPESQTSYNNS

SEQ ID NO: 211409 - protein, 149 aa, Glycine max
  Coding DNA Sequence Number=SeqID_94631
  Gene Ontology: Mol. function=nucleic acid binding; Cellular component= nucleus; Biological process=DNA integration
MVQDKPTQNRNRVMKNVNPPKPRANLAEGDDMIVAVISQVNVVTSVTKWVVDSKAINHICADRSALTSYTVVGNGIEQVYLSDSRTTLVLGKIKVFLKPTSGKTLDLSDALHVPTIRVNLVSILSLRKVGVKVSFKSNKIVMTKNTKLL

SEQ ID NO: 211410 - protein, 115 aa, Glycine max
  Coding DNA Sequence Number=SeqID_94632
MAAEWRRKRERRRHFKEKMSLEEAHHHRRLWKRAWRKKEMNEGRGREEHKILCSKRALKSERIGSKLGPWAQKSTLRFMRTLGPFSAALAQSSWSLLLMALGTGPFLGRIASTSV

SEQ ID NO: 211411 - protein, 87 aa, Glycine max
  Coding DNA Sequence Number=SeqID_94633
MELNDNDVVEKNDAGIIVDEDDDIIKSVISSIDKEIVSSDEKDKEVAGNATEGTCACENLGEFNRFAYLNEIGCVTFFDEIQEYAHI

SEQ ID NO: 211412 - protein, 151 aa, Glycine max
  Coding DNA Sequence Number=SeqID_94634
MMLDQLELTKIFHNEGAVFHYESTKLKTLELYKENLSKVGDEKVEYNFLCKEAKLKKNICNKSLLHNKVDKIMQEKANKKKTRSQAQQQEEELIKKEKKTKKKHEQVGVSNPPEIQSDVALCGACRSWIFFINGVIYFLKMNGSRMEKEER

SEQ ID NO: 211413 - protein, 94 aa, Glycine max
  Coding DNA Sequence Number=SeqID_94635
MLVATPHVFLSWKTHPPLMLLHLDLFGPTSTTSTSGKKYGLFIVVGYSRLMEACLWGFYGGWIFELQWGPLMVIFHHGDAAEDKGKEVRGGAIH

SEQ ID NO: 211414 - protein, 86 aa, Glycine max
  Coding DNA Sequence Number=SeqID_94636
MWGIPFILEPNQALTCIMSSHSTSFEPKSRLIINLDPGGDACRPARPGELSSPRRAGLLPPEATAFWRNLLEGPNGPGCYLHPHFY

SEQ ID NO: 211415 - protein, 139 aa, Glycine max
  Coding DNA Sequence Number=SeqID_94637
  Gene Ontology: Mol. function=zinc ion binding; Cellular component =integral to membrane
  Homolog annotation: Hit_ID=Q06A74; Match level="QueryCoverage=72%, HitCoverage=41%, E-value=8e-42, Identity=82%"; Hit description=PHD6
MEKENLCLYGFPTEQWEVNLPAEEVPPELPEPALGINFARDGMQEKDWLSLVAVHSDAWLQSVAFYFGARFGFDKADRKRLFTMINDLPTIFEVVTGSAKKQTKEKSSENNGNKSKSSSKGVHIFGLSRSGKCLIIIIC

SEQ ID NO: 211416 - protein, 61 aa, Glycine max
  Coding DNA Sequence Number=SeqID_94638
MASRMMKKHMTENAMHDTTFKSWTSVENRVRECGEERDGLGGGGGSPEGPWRWWPGSVGGG

SEQ ID NO: 211417 - protein, 270 aa, Glycine max
  Coding DNA Sequence Number=SeqID_94639
MGDKLHRREGNSPDHQLRPLNDRSVIKEMNGAKRSAEAVGCKKESVGERSALEGRTRASSAGRSGSENVGLSNANVGENPMPRKPKGSSARFVHGGDGGARLAERWLSVQGRKVPCFFRVIRGRENASSQSSSTRRYSAEVIHAILPGKARTTFNKWVPVPETDTGVPPHKGGRSDQARATVYQKHRSPQSREPTTEAPVNGGRNYNGPKVAKFLVGLGEIDMSVKMRTTCTWTERPYEASLFPGIGFGLFLRSLGGGQRRPPSGGARAI

SEQ ID NO: 211418 - protein, 247 aa, Glycine max
  Coding DNA Sequence Number=SeqID_94640
  Gene Ontology: Mol. function=unspecific monooxygenase activity
  Homolog annotation: Hit_ID=O04892; Match level="QueryCoverage=50%, HitCoverage=33%, E-value=2e-34, Identity=52%"; Hit description =Cytochrome P450 like_TBP
NWRCGMNRKLGYGAQLRANLDPTKGVGRLRQQDGGHGSRNPLRRRGGRCKTQGASPGGAVVGADLGGTGEARLIALCARTPKGNRVKIPERDVAADGTLPTLETAQPEVGSSGWKSTARRVVSASGRWNNVGKGSRQNGSVTSGKGLALRAGHGGPSPEPVGCRWTARAASAARAGRRVPVGGRIGNGPFGASSPGVEQSTQNCALNVKVKKFNQARVNGGSNYDSLKRNHSQGNGLGGISGERRPC

SEQ ID NO: 211419 - protein, 141 aa, Glycine max
  Coding DNA Sequence Number=SeqID_94641
  Homolog annotation: Hit_ID=Q1SKD7; Match level="QueryCoverage=80%, HitCoverage=29%, E-value=1e-10, Identity=31%"; Hit description =Ankyrin
MAPKKISMKRSRRDAATKGSSAAPEFDSHRFRSAKHQQRFEAIKGWSFHRERRVQLREDEYKNFQEEIARRHWTSLVTPMAKFDPEVVLEFYANAWLTEEGVRDMRSWVRGQWIPFDADALSQHDHLDPDVDDTAAQQCPA

SEQ ID NO: 211420 - protein, 72 aa, Glycine max
  Coding DNA Sequence Number=SeqID_94642
MVTKGGVVDKNGAFAPTYPQFDMRNSDMTTLVSACQSDLGSPNDEVRITARCLRMPMDSQVTIAKGRAVDKS

SEQ ID NO: 211421 - protein, 111 aa, Glycine max
  Coding DNA Sequence Number=SeqID_94643
MEAFMAQVAWLGVQPSPLGGGEALIAQEPQPEAQPQSEVTPEATPQTSPAATPLVEVSEDKDGIADIDYAADMEAAQSTWDSWPITAQDTPQPAQDASSSPHDEPTPAQDD

SEQ ID NO: 211422 - protein, 104 aa, Glycine max
  Coding DNA Sequence Number=SeqID_94644
  Subcellular localization annotation: CTP_CleavageSite=30; ConfidenceScore=5.51e-01
MQQQQQQSMHCSSHTFLPQAVDQRNKSSKVASLRGVAILAITSKHSNNAAAIAINALQFTNLSRRKDSKIEEMGYLKIGQETRKTKADNIWTSFLRRPCPINFH

SEQ ID NO: 211423 - protein, 314 aa, Glycine max
  Coding DNA Sequence Number=SeqID_94645
  Homolog annotation: Hit_ID=O81643; Match level="QueryCoverage=42%, HitCoverage=14%, E-value=4e-17, Identity=40%"; Hit description =Villin-1
MPNIFNVHRMSVQAQIHEGGNSSRYRKFVEEKGIVDETYNENLVALFRVQGASLDNMQAIQVDEALKSNLLCSIGAGLLADIYVGWNQNKIIIRIIIFPSVVLETPTWLPVSMREGNEPDIFWDALGGKAKYPKGKEIQGFIDDPHLFALKIMRGKACLIDGFISHTHLLEFQLKRLQGGSKQNWRRLKTTMQRCNWTNLTGLVCITPVAGLVQSWAAIVIGILSGSIPWVTMMILHKKSTLLQKNGTERGTSLSKRGREKGTERVMEMEGGGDIFLDSDLVVVEDTHSSPLLIRVSFFLYLRVHTFTWQWAGW

SEQ ID NO: 211424 - protein, 87 aa, Glycine max
  Coding DNA Sequence Number=SeqID_94646
  Homolog annotation: Hit_ID=Q1S1N3; Match level="QueryCoverage=56%, HitCoverage=15%, E-value=1e-07, Identity=53%"; Hit description =Calcineurin-like phosphoesterase family protein, related
  Pfam annotation: Domain name=DUF1723; Domain location=44-87; Score =30.2; E_value=7.2e-06; Accession=PF08330.1; Description=Protein of unknown function (DUF1723)
MNGLDITDWSNARSMVKIPPSKSTAKIPSNELSISDVAKVEQVKIGNTLVTSLVERWRPESHTLHLLVGECTMTLEDVAHQLSLRVD

SEQ ID NO: 211425 - protein, 205 aa, Glycine max
  Coding DNA Sequence Number=SeqID_94647
ATQGSFVPHGCQDVLTAAIGHPEHPGRVRAAGAGVTIKQYFGSAPQTKSDAAAHGIIQPDAVPDLVPDAISGTCTASRASGWSLRSCPLVAMGRVYEGSIVVHNTPLLPGQVKVGVEEVTDADAPVPIPTYEVSLVGQVDDPLYLMTLNIPELFLRLYQVTWDATMFGPQSIQRSGQSQFESGSYIKSWMQSSKRDVYLGAYLNG

SEQ ID NO: 211426 - protein, 214 aa, Glycine max
  Coding DNA Sequence Number=SeqID_94648
  Gene Ontology: Mol. function=chitin binding; Cellular component =extracellular region; Biological process=chitin metabolic process
  Homolog annotation: Hit_ID=UPI000044A8F0; Match level="QueryCoverage =91%, HitCoverage=100%, E-value=3e-30, Identity=29%"; Hit description= PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MSLAFRGLHALAFRGLHIQPFKGLHVLTFIGLHTLTFRGLHVLPFRGLHVVAIRGLHVPTFRGLHVLTFRGLHALHFRGYIGIHVLTFRGLHVLPFRGLRALAFVGLHALTFKGLHVLAFRRLHTLALRGLHILPFRGLYALAFRGLHVLAFRGLHALAFRGLHVLAFRGLHILPFRGLHVLTFIGLHALTGLHALAFIGLYICAFRELKVLRP

SEQ ID NO: 211427 - protein, 88 aa, Glycine max
  Coding DNA Sequence Number=SeqID_94649
MRKDLNTVSAVLRKKTMRKRIRRVELISIGEIKRKLKKKKIASYESRFDEEMSKIGRFEGLRMEERRKEEEAVQGFLKNVVFIDQDAL

SEQ ID NO: 211428 - protein, 75 aa, Glycine max
  Coding DNA Sequence Number=SeqID_94650
MRWKASMTFQGLTKPHQGRVVKGRLRDLQWSMAVVREMKGWKLAAVTEIGLFGIFNSMSMKLFQGWRSLHHRFIY

SEQ ID NO: 211429 - protein, 536 aa, Glycine max
  Coding DNA Sequence Number=SeqID_94651
  Gene Ontology: Mol. function=nucleic acid binding; Biological process= transport
  Homolog annotation: Hit_ID=Q8H6Q8; Match level="QueryCoverage=72%, HitCoverage=50%, E-value=4e-42, Identity=35%"; Hit description=CTV.20
MNTCASRVLLKPQKGETTLFIIDMTKANVSLPRTIKWDEVTLPEKWVMDKVTPSVPRPAPIIEQIKQDNSDKVEITFNRRNSFSSTIEASRSEYESAIRENLDYPWIQDIIGDPTTNVITNWQIKDDINEEVTSKDIKSLMEQANYRNKYLQVLGESIKAKASSKQRTHEESPSNILIEKPLFKPFKVSEKEKQKIRKLRKHKSLTEGVGDNNSELLNKIDSLLKFTPKTPQPSEESSKMRTRNTSKLINVINEDSDQNSEQTSEEGSISGKDINPINSKHWKTPSKLNYQRPIATDLLLEGRGESNFKSFSANNFYEWNIDAQTKCNIMNTLQHMTMVATAYQTSHECSEETIIDILVAGFSGQLKGWWDNYLTNDKKEIHDAVNTLIFTIAQHFIDDPSLWKDRSVELLSNLKCRTLADFRWYRDTFLTRVYTREDSQQPFRKEKFLAGLPRSLGDKVRDKIRSQSVNGDIPYESLSYSQLISYVQKVALKICQDGKIQRQLAKEKAQTKRDLGSFCENFWITCLSKAKEETES

SEQ ID NO: 211430 - protein, 233 aa, Glycine max
  Coding DNA Sequence Number=SeqID_94652
  Homolog annotation: Hit_ID=Q1SQ19; Match level="QueryCoverage=24%, HitCoverage=17%, E-value=3e-08, Identity=50%"; Hit description=F-box protein interaction domain
MVILVGEMFCHALLFTHWDPLMDSLRVAISSVPYLRVLKGCLSLARDYKRTHFVVWLMKEFGVEKSWTQLLNRNGSSLNRENEIVGELYKCRATRRSSRECCILDGKSPIVESITSLRSDSSSMGERNPHRCNPHFESMSAQVFLGSLVKPISLNDSGLIEIIWVDDSSILGFWVDDPAWVGDPDVEEELFLTVGLSRASLKPFPVLRPLLWEVSDALGGMGIFLKEFTSEMI

SEQ ID NO: 211431 - protein, 135 aa, Glycine max
  Coding DNA Sequence Number=SeqID_94653
  Subcellular localization annotation: CTP_CleavageSite=33; ConfidenceScore=5.74e-01
MPPKASDTSQRRGRSTGKGFKLALLKPTVKKSSSSTSGSPTQAGSSTQKPKIEESSTQIISIKPESFTQEPPKPSTSKQTKADYAFPIETLQALQDIGFTKLPRKTWADIDSKWGLQRWGFLSPFPHGTTSLSVT

SEQ ID NO: 211432 - protein, 106 aa, Glycine max
  Coding DNA Sequence Number=SeqID_94654
MRSLKGTTLSEAEQEQSNHALTVAIASAVVAEAVVTAAHAAAEVVHLTGQRKENSEESQPVQTAFRGYLDMGRGYAFSLWKDMVEMYDRNDGSRKRMGFQIIDTLT

SEQ ID NO: 211433 - protein, 118 aa, Glycine max
  Coding DNA Sequence Number=SeqID_94655
  Subcellular localization annotation: CTP_CleavageSite=62; ConfidenceScore=5.38e-01
MSPPPLGPHNHSQTHLKLSGQLPLPALVSADLHTTNSLKLSRTWTFLSLELSNYASIGGFVRARALSAILNRLTHISEFRLSAAFLAQRIDQSGALSDMDLRSVNKHSSSFFQILPCA

SEQ ID NO: 211434 - protein, 429 aa, Glycine max
  Coding DNA Sequence Number=SeqID_94656
  Gene Ontology: Mol. function=transferase activity, transferring phosphorus-containing groups; Cellular component=membrane; Biological process=two-component signal transduction system (phosphorelay)
  Homolog annotation: Hit_ID=Q9HZG4; Match level="QueryCoverage=98%, HitCoverage=57%, E-value=7e-88, Identity=42%"; Hit description =Probable two-component sensor
  Pfam annotation: Domain name=HATPase_c; Domain location=173-288; Score=135.5; E_value=1.5e-37; Accession=PF02518.16; Description =Histidine kinase-, DNA gyrase B-, and HSP90-like ATPase
  Pfam annotation: Domain name=HisKA; Domain location=62-127; Score =82.3; E_value=1.5e-21; Accession=PF00512.15; Description=His Kinase A (phosphoacceptor) domain
  Pfam annotation: Domain name=Response_reg; Domain location=309-428; Score=116.2; E_value=9.3e-32; Accession=PF00072.14; Description =Response regulator receiver domain
  Pfam module annotation: Pfam domain module=HATPase_c::HisKA::Response_ reg; Domain location=173-288::62-127::309-428
MRDVQLMFGQQAFHLYHWTLPFRDRLGEVAGVIGGWVDVTERNALLQELQLAKDTADKANRSKSEFLASMSHEIRTPLHAIIGLLELETRSQPCETLSENIRVAYSSARALLSLIGDILDLSKIESGQYQPTPETVYLPDVIDQAVTLFRNKAESKGIDLRVEMDIAAYWVQTDPLMINQILSNLLSNAIKFTDRGSVTVVLMQGIGQEEEGCEFVIEVSDDGCGMTEEQQQAIFEPFVQVGERQQQQIGTGLGLSICRNLAELLDGELIVESTPGEGSVFSFYFRAPAGEPRDQTQPHLSQPLVTDKLSVLVIDDHAPNRLLLGKQLELAGHQVVVSESAVEALKLWQQDPLRFDLIITDCNMPGMNGFEFAQALRQHERQHHLPPIMLYGLTASAEQHIMQRCLQAGMNDCLFKPLNLDTLLAQITH

SEQ ID NO: 211435 - protein, 108 aa, Glycine max
  Coding DNA Sequence Number=SeqID_94657
MRSMDRELGHARCTQQHCWCTQQLEEGSFENLPEEPYSGSFPEEPYSERTICVLPEEPSSGKLQKEGSSGRTICSTERTFFRRSYWKNFFRELFQKKVLPVEQIISVE

SEQ ID NO: 211436 - protein, 187 aa, Glycine max
  Coding DNA Sequence Number=SeqID_94658
MDDSDMLTLVIQEMSKEFPTLMETLVHERDQMLQLTLVIPVCYNLAEGSGVLDMVMVLTSSAYPSHPNDLKSKYHGDVNFLPWPLPLYLVKIRPCEETVDDLRYYFKGYMSSTLLKVASENSSVVAVVGKGHLQGIKKHWKQPVVMKDLMTVPSPKPVVSATRIVTSVGAAVAGVSIISGIYLSCKK

SEQ ID NO: 211437 - protein, 90 aa, Glycine max
  Coding DNA Sequence Number=SeqID_94659
MMKEKKEFPKGGFSGFRSFKALVQMLLVGRSTLNLDAVTAALRENKRMMRTKNVDDEHHAIVVVESERGRNHSRKHDGSKGILKSQLHPQ

SEQ ID NO: 211438 - protein, 875 aa, Glycine max
  Coding DNA Sequence Number=SeqID_94660
  Gene Ontology: Mol. function=transmembrane receptor activity; Cellular component=membrane; Biological process=defense response
  Homolog annotation: Hit_ID=Q2HS00; Match level="QueryCoverage=94%, HitCoverage=84%, E-value=0.0, Identity=43%"; Hit description=TIR
  Pfam annotation: Domain name=LRR_1; Domain location=610-631; Score =2.1; E_value=1.2e+02; Accession=PF00560.23; Description=Leucine Rich Repeat
  Pfam annotation: Domain name=LRR_1; Domain location=633-654; Score =0.7; E_value=2.1e+02; Accession=PF00560.23; Description=Leucine Rich Repeat
  Pfam annotation: Domain name=LRR_1; Domain location=656-678; Score =3.2; E_value=73; Accession=PF00560.23; Description=Leucine Rich Repeat
  Pfam annotation: Domain name=LRR_1; Domain location=698-720; Score =4.7; E_value=38; Accession=PF00560.23; Description=Leucine Rich Repeat
  Pfam annotation: Domain name=LRR_1; Domain location=721-743; Score =6.1; E_value=20; Accession=PF00560.23; Description=Leucine Rich Repeat
  Pfam annotation: Domain name=LRR_1; Domain location=745-769; Score =6.7; E_value=16; Accession=PF00560.23; Description=Leucine Rich Repeat
  Pfam annotation: Domain name=LRR_3; Domain location=610-629; Score =37.0; E_value=6.7e-08; Accession=PF07725.3; Description=Leucine Rich Repeat
  Pfam annotation: Domain name=NB-ARC; Domain location=209-457; Score =50.9; E_value=1.5e-13; Accession=PF00931.13; Description=NB-ARC domain
  Pfam annotation: Domain name=TIR; Domain location=53-180; Score =174.9; E_value=2.1e-49; Accession=PF01582.10; Description=TIR domain
  Pfam module annotation: Pfam domain module=LRR_1::LRR_1::LRR_1::LRR _1::LRR_1::LRR_1::LRR_3::NB-ARC::TIR; Domain location=610-631::633 -654::656-678::698-720::721-743::745-769::610-629::209-457::53-180
MARKQNNENALTITCCHLLVQQLEFVLAEQQMISAVASSSSSSSMLSPKKYDVFLSFRGEDTRRNFTSHLYEALKQKKVETYIDEHLEKGDEISPALIKAIEDSHVSIVVFSKNYASSKWCLVELIKILDCKKDRGQIVIPVFYEIDPSDVRKQTGSYEQAFAKHEGEPSCNKWKTALTEAANLAGWDSRTYRTDPELLKDIVADVLQKLPPRYQNQRKGLVGIEEHCKHIESLLKIGPTEVRTLGIWGMGGIGSSFLSNVNEKSDKLENHCFGNSDMSTLRGKKALIVLDDVATSEHLEKLKVDYDFLEPGSRVIVTTRNREILGPNDEIYQVKELSSHHSVQLFCLTVFGEKQPKEGYEDLSERVLSYCKGIPLALKVMGASLRRKSKEAWESELRKLQKISSMEIHTVLKLSYDGLDHSQKDIFLDIACFFKGRERDWVTRVLDAFDFFAASGIEVLLDKALITISEGNHIEMHDLIQEMGWEIVRQECIKDPGRQSRLWRQEEVQNILKYNRASGKCNFFYLIKGTDVVEGIILSLRKLTEALRLSFDFLAKMTNLRFLQFYDGWDDYGSKVPVPTGFESLPDKLRYLHWEGFCLESLPLNFCAEQLVELYMPFSKLKKLWDGVQNLVNLKIIGLQGSKDLIEVPDLSKAEKLEIVNLSFCVSLLQLHVYSKSLQGLNAKNCSSLKEFSVTSEEITELNLADTAICELPPSIWQKKKLAFLVLNGCKNLKFFGNEIVHLLSSKRLDLSQTNIERLSALPPSLKYLMAEGCTSLETNFTQHLVLHHMIQSRIPYLHKHPSNPGYYNNHECFFFPGDRITKACGFCTGDSSITIPYLPKSDLHGFIYCIIFSEGIYGKRSSVLSCSINQDGIQ

SEQ ID NO: 211439 - protein, 98 aa, Glycine max
  Coding DNA Sequence Number=SeqID_94661
MKLTSNKVVYSLDRGYIICKVISLISSCVIIEIVAVPPYRSQSHNVKGGSRATPALCPNSDRTVTMSPRRRSWYWPKVLYGPHCLSLKGNWEVSLLTD

SEQ ID NO: 211440 - protein, 224 aa, Glycine max
  Coding DNA Sequence Number=SeqID_94662
MDLFKSFGYEDLAISAKSLLDYGCLESILIPPFDRFKGFNPSINEAINLNQAEMMDYIAIKITTCPSNFTAQNYPCHVMKLLPEDHRDYPCLFNDEYESWDVQGTTQYQYSLMRAQIQGYQWFFSESDKREFDLIQETHDTRLFLPLYNGKFFIPFPVDHNNKLVQFFLKEKKDKEIYEASGCHGQQTPPFPSTDLSMEDSSEIFCSGNIQDEEDVTITKSTKN

SEQ ID NO: 211441 - protein, 273 aa, Glycine max
  Coding DNA Sequence Number=SeqID_94663
  Gene Ontology: Mol. function=nucleoside-triphosphatase activity; Cellular component=nucleus; Biological process=protein transport
  Homolog annotation: Hit_ID=Q9LZF6; Match level="QueryCoverage=71%, HitCoverage=53%, E-value=4e-97, Identity=63%"; Hit description=Cell division control protein 48 homolog E
  Pfam annotation: Domain name=AAA; Domain location=199-273; Score= -3.9; E_value=0.00042; Accession=PF00004.19; Description=ATPase family associated with various cellular activities (AAA)
MNRHPPLTTLLLVWPQALSLIGTVFCIVLRSVISLALVILEQITNSPWNKFLFMMYYGLVIEGSKYLYVNVVCCSGMWEIDIGVPDEVERLEVLRVHTKNMKLLDDVDLERIAKDTHGYVGADLAALCTEAALQCIREKMDVIDLEDESIDAKVVEVPNVSWEDIGGLENVKRELQETVQYPMEHPEKFEKFGMSPSKGVLFYGPPGCGKTLLAKAIANECQANFIHVKGPELLTMWFGESEANVREIFYKTRQSTPCVLFFDELDSIATQLG

SEQ ID NO: 211442 - protein, 117 aa, Glycine max
  Coding DNA Sequence Number=SeqID_94664
  Subcellular localization annotation: CTP_CleavageSite=83; ConfidenceScore=5.26e-01
MLPVSSLSLSHHKTTTTIAEATCHCAFFKFSFNKPHHHRTPLLFPNHLPNASPPLLRTTTSLRRNAAADPPPGFSGVADVIVVGAGVAGSALAYTLAKVRPSDFGSSRHLTCCAFWV

SEQ ID NO: 211443 - protein, 127 aa, Glycine max
  Coding DNA Sequence Number=SeqID_94665
  Gene Ontology: Mol. function=oxidoreductase activity; Cellular component=integral to membrane; Biological process=electron transport
  Homolog annotation: Hit_ID=Q8GTX7; Match level="QueryCoverage=73%, HitCoverage=15%, E-value=2e-41, Identity=86%"; Hit description =Putative Squalene monooxygenase
MKKQYQSGFVKKNWSETSHMERTMILLCYVYDGRCVHVIERDLREPDRIVGELLQPGGYLKLIELGLQDCLEQIDAQRVLGYVLFKDGKKTKLPYPLENFHADVAGRSFHNGRFIQRMREKAATLHQ

SEQ ID NO: 211444 - protein, 69 aa, Glycine max
  Coding DNA Sequence Number=SeqID_94666
MVNETPTLDDLQLDDDDIGVEIPDGVTTNEGFDPALCLVGQFLTDRQTDCLYWRQRAKVNNIASLTRED

SEQ ID NO: 211445 - protein, 79 aa, Glycine max
  Coding DNA Sequence Number=SeqID_94667
MTDDEFEDEREKKGMVESRQKHERVGEGRGGAAALGGEENEMQIILGSVRKEGFYPYLYYSTSTINSEDYFILWWRLSL

SEQ ID NO: 211446 - protein, 481 aa, Glycine max
  Coding DNA Sequence Number=SeqID_94668
  Gene Ontology: Mol. function=transferase activity, transferring glycosyl groups; Cellular component=membrane
  Homolog annotation: Hit_ID=Q6ZJW6; Match level="QueryCoverage=90%, HitCoverage=87%, E-value=2e-84, Identity=40%"; Hit description =Putative fringe-related protein
  Pfam annotation: Domain name=DUF604; Domain location=202-455; Score =472.2; E_value=6.3e-139; Accession=PF04646.3; Description=Protein of unknown function, DUF604
  Subcellular localization annotation: CTP_CleavageSite=71; ConfidenceScore=5.31e-01
MQLFHKPSKGQSLINSILVSSSFCALYLIVSVLLLGPSKLVHVNRSSSQDVSTTPTTLDHLVFGIASSKISWFKRKDYVKLWWNNNNNNNNTNKTMKGCVFLDSLSDEDNGRNENDTSLPPLCVSQDTSRFRFTHKGGLRSAIRVARVVGETVALYNDSEVRWYVFGDDDTVFFPENVVKMLSKYDHELWYYIGAHSEVYEQNRVFGFGMAFGGAGFAISSSLAKVLAKVFDSCIERYPHLYGSDGRVYSCLAELGVGLTHEPGFHQVDLKGNTFGILAAHPLTPLLSLHHPDYTDPIFPNMTTKQALKHLFEAANVDSQRMLQQAICYDRWFSWTVSVSWGYAVQVFPNHMLLPDVLKVQETFKQWRKGNMLAKSYTFNTRELHPDPCKRSTVFFLDNVSSGKDGIISSYKKSFQNCSIDDDVSPKKLEVIKVVTNKLDLDIKQLRAPRRHCCDVLPSTARDQMEIAIRECKDEELVYMH

SEQ ID NO: 211447 - protein, 58 aa, Glycine max
  Coding DNA Sequence Number=SeqID_94669
MGDSRVKECATSSARVDFKYPERRMMWCVANGAVTVPSNSWPKLFTRELHTGHSTVSE

SEQ ID NO: 211448 - protein, 174 aa, Glycine max
  Coding DNA Sequence Number=SeqID_94670
  Gene Ontology: Mol. function=magnesium ion binding; Cellular component=chloroplast; Biological process=metabolic process
  Homolog annotation: Hit_ID=Q672F7; Match level="QueryCoverage=94%, HitCoverage=29%, E-value=3e-54, Identity=62%"; Hit description=E -beta-ocimene synthase
  Pfam annotation: Domain name=Terpene_synth; Domain location=1-159; Score=143.2; E_value=7.2e-40; Accession=PF01397.11; Description =Terpene synthase, N-terminal domain
MINDRNADTWVKLELVDHVKRLGISYHFDKEIGKALHRQRSMHETALCFRLMREYGYDATSDIFERLKDNNSNLKGSLSRDVKGMLSLYEVSFLSYEGEQILDEAKAFTSFHLRGALKEGRSNTMLLEQVNHALELPLYHRIQRLEARWYIESYAKRKDANRVLLQYCAVNASK

SEQ ID NO: 211449 - protein, 60 aa, Glycine max
  Coding DNA Sequence Number=SeqID_94671
MEAMFSEKRERFRYKNMREREKFGCDWRRRRLGDEGGLAVMYHTILFLKPIEKAYTIMEE

SEQ ID NO: 211450 - protein, 55 aa, Glycine max
  Coding DNA Sequence Number=SeqID_94672
GPIKPIDRSEPDDDLIYQMTLMIPQLFLKPMQDNVVTRFYFLHNKSDNYLKGMVN

SEQ ID NO: 211451 - protein, 334 aa, Glycine max
  Coding DNA Sequence Number=SeqID_94673
  Gene Ontology: Mol. function=sugar binding
  Homolog annotation: Hit_ID=Q1T2V3; Match level="QueryCoverage=99%, HitCoverage=100%, E-value=4e-93, Identity=55%"; Hit description =Concanavalin A-like lectin/glucanase
  Pfam annotation: Domain name=Lectin_legB; Domain location=27-234; Score=33.7; E_value=1.1e-12; Accession=PF00139.10; Description =Legume lectin domain
MAPFPTSHYFRAFTFSILFLKTLAFDPIPLFSYAGFGKDLKFKPNVALFGNAKVLNEGSGIHFSGFGSSRGTGRIMYKKPIKLSQVSLEDGGGLAFVMAPKGSQGNVFYQSSSSGLNDGKFEVVGVEFSASKSGRKGVSSSCDVNMNIGGSVVAKKSNTSIGEKLHVWIDYEASSRRLEVRLSQHGKARPSYPLMWHSIDLSNVLKENEMFVGFSSVKGNNDSQACDLYSWSFVLRNFPHSMHSEPLDPKVFVKNTESPVAKQRSDCFLSVLAAMIFGTGCGALTAFIVLYLWTIFGNNKRAVVPEESLVEPVDVDYRKKVKIVVDKTIEDGKK

SEQ ID NO: 211452 - protein, 160 aa, Glycine max
  Coding DNA Sequence Number=SeqID_94674
  Gene Ontology: Mol. function=structural molecule activity; Cellular component=protein complex; Biological process=microtubule-based movement
  Homolog annotation: Hit_ID=P29512; Match level="QueryCoverage=81%, HitCoverage=29%, E-value=3e-72, Identity=96%"; Hit description =Tubulin beta-2/beta-3 chain
  Pfam annotation: Domain name=Tubulin; Domain location=45-160; Score =18.2; E_value=2e-09; Accession=PF00091.15; Description=TubulinFtsZ family, GTPase domain
MREILHIQGGQCGNQIGAKFWEVVCAEHGIDPTGRYGGDSELQLERINVYYNEASCGRFVPRAVLMDLEPGTMDSVRSGPYGQIFRPDNFVFGQSGAGNNWAKGHYTEGAELIDSVLDVVRKEAENCDCLQGCGVGGFGLGLCGFVGKVKDGGFLWVVPD

SEQ ID NO: 211453 - protein, 90 aa, Glycine max
  Coding DNA Sequence Number=SeqID_94675
MFCENAPIIWGQIWGKIEFIGVEFGFGFSLIEKVGFEDRIGRGLGEWGEEGDRMRRLNPPPPHPIVMPDNEDINIHIILNEFTISILYKY

SEQ ID NO: 211454 - protein, 111 aa, Glycine max
  Coding DNA Sequence Number=SeqID_94676
  Gene Ontology: Mol. function=transition metal ion binding; Biological process=cytoskeleton organization and biogenesis
MTKNKGYDINKYSFYTKSQDDESTMQNNGVSLKDEFQYFVIVNDDNPRLASIPYFGVIKEIWELNYVKFIVFIFKCKWVDNNIGVRTNDFGFTLVDLKKLAYQNESFIMVE

SEQ ID NO: 211455 - protein, 160 aa, Glycine max
  Coding DNA Sequence Number=SeqID_94677
MTSEATCQIDDRIDSLKEQSTHGSFVSHGHQDPDVVLDAISRNRTPVEPKDPDTVTSDKLGLYVDDNPPCLVSLGRIYEGSTIVHHIPLGNDLVKVGVEEVQDVDARSPIPTEEVKLEGQILNTFLAWSTHLTFFRKGFVTNKMLTVVGSSGLRIIKNGG

SEQ ID NO: 211456 - protein, 145 aa, Glycine max
  Coding DNA Sequence Number=SeqID_94678
  Gene Ontology: Mol. function=electron carrier activity; Biological process=electron transport
MLSMMISGPRHLGNDIDVYLSSMIEDLRKLWDKGKNVRDSVIDTLLNIQRKTMDGLNTHQDLVEMGKCDQLHPRSDGKKIYLSPPCHTLSRNEKTSFCQCLRRVKFPQGYSSNIKSLVQVKDLKLVSLKSHDCHILMQQFLVVAI

SEQ ID NO: 211457 - protein, 74 aa, Glycine max
  Coding DNA Sequence Number=SeqID_94679
  Subcellular localization annotation: CTP_CleavageSite=51; ConfidenceScore=5.32e-01
MTMITPSSKLTLTKGNKSWYRAPPRVVNCKPENSSIERLSGLPSGSALFVEAMTSQQLMLSIQEEDFIELNDIA

SEQ ID NO: 211458 - protein, 78 aa, Glycine max
  Coding DNA Sequence Number=SeqID_94680
  Gene Ontology: Mol. function=protein dimerization activity; Cellular component=nucleus; Biological process=regulation of transcription, DNA-dependent
  Homolog annotation: Hit_ID=Q9XHQ5; Match level="QueryCoverage=53%, HitCoverage=10%, E-value=5e-09, Identity=69%"; Hit description=G-Box binding protein 2
MVVLDIWICVVVVNNNDAYAFGHGFGLVVSNYVCVLAECDELVQHAEALKEENASLQSEVNRIKSDYEQLVSENSALK

SEQ ID NO: 211459 - protein, 152 aa, Glycine max
  Coding DNA Sequence Number=SeqID_94681
  Gene Ontology: Mol. function=transition metal ion binding; Biological process=cytoskeleton organization and biogenesis
DVAVDVEMGDRLENMIHDLGQECFKLAHALKYDTWESDLKKLLYPGCMKSWTLFSMVFSLVDMKARYGWSDKSFTSLLKVMQVKDDDKYSSDESIKKDPSMKVLWYLPIIPRFKHLFANGDDAKDLTWLANGRKFNGMLRHLTDYSQWKKIN

SEQ ID NO: 211460 - protein, 90 aa, Glycine max
  Coding DNA Sequence Number=SeqID_94682
MVALIPLVENFNKPYKIPNEHQNTLRQIIKSFEFVLGEEVEEGPKRVDEKKRSEKQSERSRLRGWWDGSPMDLESLAARGGRSCGAIVTV

SEQ ID NO: 211461 - protein, 66 aa, Glycine max
  Coding DNA Sequence Number=SeqID_94683
  Subcellular localization annotation: CTP_CleavageSite=26; ConfidenceScore=5.10e-01
MGTWGNGSSPKRAGSFTLNRLARIKRSMNNSSQMKLGYDMYNDCNANVPDEMRIGQWHVSLQNGGQ

SEQ ID NO: 211462 - protein, 123 aa, Glycine max
  Coding DNA Sequence Number=SeqID_94684
FRALLEHKISCSSLPLPSFISFFLQALIHGLLWCGISSLSSFSIPLPFIFYKAKESIDEEDPRPTSSNGAYIMATLHAVVEVVGEKNTQRRVVFRVVGLSVKVVGGGWWSAKEGGRVVKGKDE

SEQ ID NO: 211463 - protein, 447 aa, Glycine max
  Coding DNA Sequence Number=SeqID_94685
  Gene Ontology: Biological process=protein modification process
  Pfam annotation: Domain name=Transposase_24; Domain location=204-334; Score=-21.5; E_value=0.041; Accession=PF03004.5; Description=Plant transposase (PttaEnSpm family)
MPRKNNLRKNNARFVDEEHHDEVEHCDEEHRDEDVHHYIQQLINSLNKSQSESHGTESNHLNNSASTNAEQGSLKTRNVRGPTLLRDIWTMPPGKTIDVQFNRRNQAIGKEGRKLASFLGIIARNPELAPLNIDDWRCFDKEEKNKLVDLVRKKFSIPERGVEFVKKSLGKKWKDYKCDLRSMYFTKYKTKHTLLKHRPNHIPRDQWIGLVSYWVSDKGKRRSQANKSNRAKQKMPHTGGSKSIGTLMNEKAKDGIEPTRAEVFILTHKERKDGRPLDAESIKTLDLIQEKLCNGETSNEQDLDSVAWEGDVYSQVLGSERSGYIRGLGLGPTPSLLWGDKFSLGNISMNNNNMSNEMVPKLEQEMKELKERHEEEMNQMKELNQKQVAELTIMRQNQEKMMLELSFMREVMCRFMHTELPTPNFNRSYGQVSDSNGGRERAPRVPH

SEQ ID NO: 211464 - protein, 88 aa, Glycine max
  Coding DNA Sequence Number=SeqID_94686
MKHREGDGTGHHQPIANLPCNTGDCGPEVRLCVQCAGVWRRRKPTSAAAPRVPKVFKAYMRLWKHQQENRAKLVECGLKQWELDEITS

SEQ ID NO: 211465 - protein, 231 aa, Glycine max
  Coding DNA Sequence Number=SeqID_94687
  Gene Ontology: Mol. function=cysteine-type peptidase activity; Cellular component=nucleus; Biological process=proteolysis
  Homolog annotation: Hit_ID=Q7Y095; Match level="QueryCoverage=87%, HitCoverage=29%, E-value=1e-40, Identity=40%"; Hit description =Putative TNP2-like transposase
  Pfam annotation: Domain name=Transposase_21; Domain location=108-231; Score=-9.2; E_value=7.9e-14; Accession=PF02992.5; Description =Transposase family tnp2
MDRCWMKASHITDKIFTRLLVVLALVNLKARFGWSDKSFTELLVLSKKMLPRDNMLPKNHYEMKKILCPVGMDYQKIHACPNDDILYINQFAEMRKCPTYGVSQYKLKDDECSNDGTTSNSRLANCMKQKYIMMCMMIAGPRQLGNDINKYLSLLIEDLRKLWVDKVDVYDGNLQQTFRMHAIIFCTINDFLAYGNLSGYSVKGHHACPICEKEITYIQLKHGKKTVYTRH

SEQ ID NO: 211466 - protein, 352 aa, Glycine max
  Coding DNA Sequence Number=SeqID_94688
  Homolog annotation: Hit_ID=Q1SDG1; Match level="QueryCoverage=33%, HitCoverage=9%, E-value=2e-14, Identity=37%"; Hit description =Integrase, catalytic region; Zinc finger, CCHC-type
MEERFSTIKPPSFKGKKCDYWKERMIAHFEPIHKDLWNVVENGDYIPYDDQLNEIPRGQWTEEKKLRLLLNSKARNVMLYALSEKKYTKGSQEIVLRALKNLDSMSLEELVGTIKVHEQELQQDKGPKREKSLALSKLEKGQDKKKHYKIKEKKGLMSTLQDLDGTSSNEDDEEANKCLMTIQLLRNLNQIKKMRALDRRLQEDWARNAREGSRVLMSLRTHLLLEVASPFIFLFSIPLQSNLKKQRNLLMKKIQGLQAPHGATSDKFRNGYDGKGTTNTFMANTNGPKMIWVLKKKIIPVANVLDSKKQMFIMVPRQWLLTTHDKRKVYVPMSNSLSWWNSHFHRKSKKKG

SEQ ID NO: 211467 - protein, 273 aa, Glycine max
  Coding DNA Sequence Number=SeqID_94689
MDTSDAATGYQDATALACTLHPTVDFSINRILEKPSKVQGQEEHTKQYPQGFMPLTKLLPVHPTDLYLSQEDLTSLGNLHAQMYKRDQATAYPSRRHILRATDVKMVVDKVFPLQLIWDATKKKGFKLYYNEEISSRQIKVEVVNCLLSWSSLFSEPPPLVMMEVTNLCTAMSFKCYIQLGSITSMMLVFALQRMPTTTSSAKVVDDTIVHGVIIDLTNTSIMDETPEASNAAIVDEVVHHIQELVSKQSKTSNEATLRDNGEPDVIIVYSSS

SEQ ID NO: 211468 - protein, 676 aa, Glycine max
  Coding DNA Sequence Number=SeqID_94690
MKVEDSSILEDYREEQMAADDSDFLETISSWKTKLSKNMKAKIRKCFKEPISTHTKDIMLVVKSEPEEILNSQEFPSSCEEIQNSLEFPPSSEEILDCQKFSPSGEEIQDCQEFSPSLEAIQGSQEFPPYSEEIENNQAIPFFIEDSVALVEVKSEVPETDCYGEPDDYSIIESQETEIIHDWNLENELNEWQEHVDFIPLRMVRPSCMDIVINNSQLSNDQSPYMPAIEFESEEYITNPDLHYISPQEISLVEDHNSDIHDNQPDGDTDTAVSLPNAVTHKDLDCSNDEFTTGAKDQVECISTIEHDCSNDEFTAGAEDQVEHNSTIENDCSNDEFTAGAEDQVEPSSTIEHDCCNDEYSTTGAEDQVELSSTIEHGPNPDGCLVRHSDDPPEYEEKQSFASVNIDEKRHANVATDELTSWDECDGSSKLHCPEKLLSTRKAISPSSEERLCKAVESVDLNHKKKLKCKGKLYFSEKTDKMNGTDEGFDDITGTRPNDIPNKISVIPRNKRVSHPRGISKVPHSSRHATRIGCNSVQSCSKSAIAFTQQQMHDAECLAMRLTKELKSMKDIVDDMLRSEFCLNTSLRHKVNEARMAVKNATRAEEATKRCLAFMSRDCSRFCKIMKLTDDGPSPQKPPQEVVRKERKKIAFADEAGGKLCQVKFYEDAQYLSESN

SEQ ID NO: 211469 - protein, 166 aa, Glycine max
  Coding DNA Sequence Number=SeqID_94691
  Gene Ontology: Mol. function=hydrolase activity; Biological process =intracellular signaling cascade
  Homolog annotation: Hit_ID=Q69L69; Match level="QueryCoverage=85%, HitCoverage=19%, E-value=2e-10, Identity=34%"; Hit description =Calcineurin-like phosphoesterase-like protein
MASTIAPLLWKQHLHRSGEVTNNVIQSYCQAMPSPDPRIEPLLVQDGFLDVAKLRQVKIDDVLVNALVERLVTNQTYYDWEQMCKEYIGVIPPKNAQVGSTLKLKWLKEHMLTLPAKPTPQQLASHCKAYILGLIGGVLMSKKSRNRVHLIYLPLLANLDQVGQYS

SEQ ID NO: 211470 - protein, 253 aa, Glycine max
  Coding DNA Sequence Number=SeqID_94692
  Gene Ontology: Cellular component=chloroplast thylakoid membrane
  Homolog annotation: Hit_ID=Q1T2U5; Match level="QueryCoverage=80%, HitCoverage=99%, E-value=2e-79, Identity=76%"; Hit description=SOUL heme-binding protein; Bacterial regulatory factor, effector
  Pfam annotation: Domain name=SOUL; Domain location=57-240; Score =169.7; E_value=7.4e-48; Accession=PF04832.3; Description=SOUL heme -binding protein
MSLPRIFQITNASITCKSLYIRSIPRHYPNHSLLSPNSQHTHFRSLSLMGLVFGKISVETAKYEVIKSTSEYEIRKYAPSVVAEVTYDPSQFKGNKDGGFMILANYIGAVGKPQNTKPEKIAMTAPVITKDSVGGDGETIAMTAPVVTKEGGGEGEEGNKNNKMVTMQFVLPAVYGKAEEAPKPTDERVVIREEGERKYGVVKFGGVASEQVVREKVEKLRESLEKDGFKVVGEVQSSLDNSCVQDQRGYDPG

SEQ ID NO: 211471 - protein, 102 aa, Glycine max
  Coding DNA Sequence Number=SeqID_94693
MVITQALCNRYTKTQSYMQCGIMSVKNLVGPLGVHDKTNHILLGQATLTSTDLKEHSNRVYLPPRVRLRRVRQSASLLIQVQPKKYFNMQTLSMNYTKHTTP

SEQ ID NO: 211472 - protein, 160 aa, Glycine max
  Coding DNA Sequence Number=SeqID_94694
MEEKRKRLQQEAMYIEDSTMIVDPPSPIVRHVKQKMTCTKRNGQMTSNVAQEISNKIKTHGTFVPHGCHDLLNISIGRPEHPGRVCATGTGVTISQYFGQASCASNSSSALINPQQFLDMIKDLKEELRREVEEENKKSLEKIKEFKEAIIVELSQRASW

SEQ ID NO: 211473 - protein, 142 aa, Glycine max
  Coding DNA Sequence Number=SeqID_94695
  Gene Ontology: Mol. function=transition metal ion binding; Biological process=RNA-dependent DNA replication
MPYFGVIEEIWELDYSEFRVSIFKCQWVNRNTDVNQGEMGFTLVDLHKVSYKDKPFIMAEQARHVFYVQDPCDSRWSVSKATPPRSPLHSDDPSEDMSRSSKRSTRLRSLMLEAWISQDQWLMSILPLGEDHAHIKKSFIAI

SEQ ID NO: 211474 - protein, 118 aa, Glycine max
  Coding DNA Sequence Number=SeqID_94696
MTMHYMSLSLVHLFTLTDSLPIVVRKISIPCLGRLLEEDLKVEKFTLDPNKKFVSQQLHETDKEESDWEDEVKPRKNIFPKGNVKNFVQPKNHKGGETDLSNKKRVKYAKAASEDKRD

SEQ ID NO: 211475 - protein, 57 aa, Glycine max
  Coding DNA Sequence Number=SeqID_94697
MKNDHENEMRGGGCTAARPNELLASSRSNLAHPSELVTSSLSFLVAQASQGPEKVTK

SEQ ID NO: 211476 - protein, 324 aa, Glycine max
  Coding DNA Sequence Number=SeqID_94698
MGEVDEVQERMKAGIEALKEKMATMMEAMMSMKKIMEVNAVVAAATSVIAEVDLTLPSGLNQINHPTLDMVGQGSKELRSTGAPHFVQVQNKHAFPPYGLPPNYTPPNVARTPDENNSTPILIESQQPQSDHAHISRPMGETHEVPHHNLVDFEPYLGYATEGQAVGGVPLPSTFESPQFHPQPQPFHFATGRIPPAMAKKGKLDHIKEMLKDIEGGGDYAFANLAELYLVSDMVIPPKFKVSDFDMYKETTCPKNHLKMYCRKMGGYVRDEKLLMHFFQESLTGVAVTWYTNLEPSQVHSWKDLMMAFIRQYQYNSDMDPDRT

SEQ ID NO: 211477 - protein, 154 aa, Glycine max
  Coding DNA Sequence Number=SeqID_94699
  Homolog annotation: Hit_ID=O48717; Match level="QueryCoverage=70%, HitCoverage=84%, E-value=2e-08, Identity=37%"; Hit description =Expressed protein
  Pfam annotation: Domain name=PetM; Domain location=82-150; Score =47.3; E_value=5e-11; Accession=PF08041.2; Description=PetM family of cytochrome b6f complex sub
MVLGEGGVWWTSRFGREVKKEHSINAKEELHGCREGKRRNNTDAEKKGVTEGQLEKRIIYKGVLSFGGLKASNGVVSLGFPMSTEKCFAKVVSSVKTTTSNGKGKSGGALSSTCNAVSKIFMIATIINGLVLVGVVVGFVLLRVEAWVKEFEAK

SEQ ID NO: 211478 - protein, 180 aa, Glycine max
  Coding DNA Sequence Number=SeqID_94700
  Homolog annotation: Hit_ID=Q40538; Match level="QueryCoverage=20%, HitCoverage=64%, E-value=3e-07, Identity=86%"; Hit description =Nicotiana tabacum (clone 5) activating factor DNA sequence
VLIGYMYYFQLLNPDCKSAQRLKAMVSFTSLTEEEKDKANQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 211479 - protein, 74 aa, Glycine max
  Coding DNA Sequence Number=SeqID_94701
METLLKTLLSLVDVYIELIDGEDESNPREKPEETTTIRDDALRWLTMLRLGGIDGNPVMRGTRRRTTYAYMSSN

SEQ ID NO: 211480 - protein, 533 aa, Glycine max
  Coding DNA Sequence Number=SeqID_94702
  Gene Ontology: Mol. function=binding
  Homolog annotation: Hit_ID=Q6Z5N1; Match level="QueryCoverage=84%, HitCoverage=68%, E-value=4e-35, Identity=27%"; Hit description =Putative potyviral helper component protease-interacting protein 2
  Pfam annotation: Domain name=HEAT; Domain location=74-110; Score =30.9; E_value=4.6e-06; Accession=PF02985.12; Description=HEAT repeat
MDALAQEQEANAQIGAALCLAAAVEAAPDPDAEALRRSALPRLGKLVKSEACRARAALLVLIGSVVGAGGASSRGAVNWLVPCLVEFLGSKDWTVRKAAAEALAKVASVERDLASQHKVLCLNSLQNRRFDKIKVVRETMNRALETWKEVTEDAPAYVKSECASVGVLGHGRGVLGHGRVEDLRFLPTLEGTDDGKSQCVSKSSPDVGSKLSSKTAPANRSPPSVISFMSSMKRESSLKSNEKHLRMGTLNHQGHEKSSNEKRETPFSRSSHSNLSREDDIKRCDVEVSKPPPYQNGVNSRAEIKRVLFSKVSDEKMRRFSSSKSCVVPCIDDDDLDANEVCESPQDVEDFALIREQLLQIENQQSNLLDLLQRFIGSSQSGMNSLESRVHGLEIALDEISQDLAVPGARVSNIDATEDTCCKLPGTDFLSSKFWKKTEGRYSTSRFSLGSIPSTNAVHNATNKDGSREILTANNSRLQHGKGGYFVNPSAEVQSDLKGHHTYKVSKNMVQDAMRRYDGIQPATESLRNQNIR

SEQ ID NO: 211481 - protein, 76 aa, Glycine max
  Coding DNA Sequence Number=SeqID_94703
  Gene Ontology: Mol. function=binding
MSSRRHSLSGPPPLSGTESTQNLGVRVITCLNKLSERDAFTGAAAELESIARTLNHDSFSSFLSCIHNTDSSSKAP

SEQ ID NO: 211482 - protein, 280 aa, Glycine max
  Coding DNA Sequence Number=SeqID_94704
  Gene Ontology: Mol. function=oxidoreductase activity, acting on the aldehyde or oxo group of donors, disulfide as acceptor; Cellular component=mitochondrion; Biological process=metabolic process
  Homolog annotation: Hit_ID=P52901; Match level="QueryCoverage=92%, HitCoverage=65%, E-value=1e-119, Identity=81%"; Hit description =Pyruvate dehydrogenase E1 component subunit alpha-1, mitochondrial precursor
  Pfam annotation: Domain name=E1_dh; Domain location=71-278; Score =231.5; E_value=1.8e-66; Accession=PF00676.10; Description =Dehydrogenase E1 component
  Subcellular localization annotation: CTP_CleavageSite=57; ConfidenceScore=5.72e-01
MALSRLSHRSIGSTLTKPFSAAAASAASSRSISTSDTPLTIETSVPFTAHNCDPPSRAVATSSSELLTFFRDMALMRRMEIAADSLYKAKLIRGFCHLYDGQEAVAVGMEAAITKKDSIITAYRDHCIFVGRGGTLLEVFAELMGRKEGCSKGKGGSMHFYKKESGFYGGHGIVGAQVPLGCGLAFAQKYSKDESVTFAMYGDGAANQGQLFEALNIAALWDLPAILVCENNHYGMGTAEWRAAKSPAYYKRGDYVPGLKDRSAFDQIISLTLSLKLEHV

SEQ ID NO: 211483 - protein, 160 aa, Glycine max
  Coding DNA Sequence Number=SeqID_94705
  Gene Ontology: Mol. function=phosphoenolpyruvate carboxylase activity; Biological process=tricarboxylic acid cycle
  Homolog annotation: Hit_ID=Q6Q2Z9; Match level="QueryCoverage=42%, HitCoverage=6%, E-value=9e-24, Identity=80%"; Hit description =Phosphoenolpyruvate carboxylase
MVLMKLDLRQESSRHAETIDVITRYLDMGTYSEWDEEKKLDFLTRELKGKRPLVPPSIESFQGVVDFLAQELFNQNASIILHTYTITLQKKMREKERERGRETERGRERRRVTNRDRRNERWSETDTARTSVKQYRNTARTSTNRRTPNGSHSRRWRSMD

SEQ ID NO: 211484 - protein, 38 aa, Glycine max
  Coding DNA Sequence Number=SeqID_94706
ENEGPIRKKVIWLRKVIKPIVRGHCQIPLRVDQALYGS

SEQ ID NO: 211485 - protein, 57 aa, Glycine max
  Coding DNA Sequence Number=SeqID_94707
MWVPRERFPADFRREEKEKSDFRQEDDKEKREGKALGLRRPHPLPKEKTRLLAKPPD

SEQ ID NO: 211486 - protein, 123 aa, Glycine max
  Coding DNA Sequence Number=SeqID_94708
  Homolog annotation: Hit_ID=Q1SPJ4; Match level="QueryCoverage=100%, HitCoverage=8%, E-value=3e-39, Identity=71%"; Hit description =Thiolase
VGGLIRLTFGAALSFGLAHYGSSEFELMAEELLMSDSVVKATLRMSVKIHLMLNSKMLIDANGDRIVATSLLEASNLVVLKDSSVIHSNANLGVHGQGFLNLSGAGNLIEAQHLILSLFYSIN

SEQ ID NO: 211487 - protein, 98 aa, Glycine max
  Coding DNA Sequence Number=SeqID_94709
  Subcellular localization annotation: CTP_CleavageSite=40; ConfidenceScore=5.29e-01
GVKRFLLSQIPFSDGMLPSFSFQSPLPMGGVTVSWMIVVMCGGKGNVGAIIWGLGVSLVGKGLWGRWEVTEKATMESLSAVPSDNQTHRVLQHEKLSA

SEQ ID NO: 211488 - protein, 94 aa, Glycine max
  Coding DNA Sequence Number=SeqID_94710
MQYHMPPPQLFIARSGSLRHAKVLSPLREGLNCWDSTHEEGRCDHWSEPTLGWVGGISTWVHPPIMVLVQVLLTMIVLCQFSSSYKKFDLTLGG

SEQ ID NO: 211489 - protein, 45 aa, Glycine max
  Coding DNA Sequence Number=SeqID_94711
MKAAIKWINKLACGELSAAYCAQQSDNCAYFFGKNQGIHPSEWAG

SEQ ID NO: 211490 - protein, 610 aa, Glycine max
  Coding DNA Sequence Number=SeqID_94712
  Homolog annotation: Hit_ID=Q57PJ4; Match level="QueryCoverage=42%, HitCoverage=87%, E-value=2e-79, Identity=55%"; Hit description =Putative multidrug resistance efflux pump
  Pfam annotation: Domain name=HlyD; Domain location=368-606; Score =131.7; E_value=2e-36; Accession=PF00529.10; Description=HlyD family secretion protein
  Pfam annotation: Domain name=Rick_17kDa_Anti; Domain location=80-123; Score=40.4; E_value=6.1e-09; Accession=PF05433.5; Description =Rickettsia 17 kDa surface antigen
  Pfam module annotation: Pfam domain module=HlyD::Rick_17kDa_Anti; Domain location=368-606::80-123
MGGGLCFGPAAYCSDIASFLMIKRFVAVALAGITLAGCVNNDTLSGDVYSASEAKQVQSVSYGTLVSVRPVKIQGGDDSNVIGAIGGAVLGGFLGNTIGGGAGRSLATAGGAVLGGVAGQGVQGALNKSDGVELEIRKDDGNTIMVVQKQSASRYSVGQRVVMASNGSQPGNQRHHLIDLFEADAGEDVVTRRVDHVFDLLNDRLSLTGQLDALGAAIVSAGGAADPAYAPATAAQYRWLSPAESATALAGVDEYCATSPSGFVSTQAASDAGRSTRARCAPGETDLFQAAMMPRVNLRAHRDGAADRSGVRCLTVLPAAVQSGAAGLLFLAADSSAAARLDLLRRCWWMWNYYMQAPWTRDGKVRAELVDVTPEVSGRISALAVRDNQFVHKGEVLLTLDPVPWQIALTNAQAQLAKAQADLAKAQHEADRRASLPRNVISAEDMDAARLNANAAAATAKAAQAMLDQARWNLQQTTVTAPTDGWVSNLTLRAGNYATAGTPLFALVDSHSYYVMGYFEETKLRHIQPGAAAQIVLYSNGARLQGQVESIGRAIYDQSIASDGGLVPDIKPNVPWVRLAQRVPVRIRLNAVPDNVPLVAGTTCTISVAH

SEQ ID NO: 211491 - protein, 76 aa, Glycine max
  Coding DNA Sequence Number=SeqID_94713
MHFSPEFELLENIILANIKRKANNVDLPFSLRTRKSYSGRSGLERELHNLTMQMREILFYEDQQGILERLQKFVSL

SEQ ID NO: 211492 - protein, 161 aa, Glycine max
  Coding DNA Sequence Number=SeqID_94714
  Gene Ontology: Biological process=response to biotic stimulus
  Homolog annotation: Hit_ID=Q9SWS4; Match level="QueryCoverage=53%, HitCoverage=57%, E-value=6e-29, Identity=68%"; Hit description =Ripening related protein
  Pfam annotation: Domain name=Bet_v_I; Domain location=34-161; Score =30.5; E_value=2.3e-08; Accession=PF00407.9; Description=Pathogenesis- related protein Bet v I family
MLFNIMSFAYFTFITRVGAKSKHRISKHQEYLHGGVVRVPMECIEGYDDAMAKWVKDRVIGAAGRLGSLGNLRPVTTYHESIESVDEPNKTITYKIFGEDIDHQYKVFKVIFQAIHKDHGGAFIKWTIEYERVGEEVDLPFGFIEYLNKGSRDVDGHLLKA

SEQ ID NO: 211493 - protein, 155 aa, Glycine max
  Coding DNA Sequence Number=SeqID_94715
MALGVMAARPGKLLLKPEVTLLAQASCYFTPKLFGGPGEPEASLGEPGFRKKLKMIFCPPFWVFFIFLIKTLNDHLFCTVTGVQHFSEDPLMVKVDHLKKERKKKWDDKNQEEIAMAVKQLADFDHTWPTEAEIAMANENQKKKKIKKRSLPHGT

SEQ ID NO: 211494 - protein, 154 aa, Glycine max
  Coding DNA Sequence Number=SeqID_94716
MECLEGAWETLEGNTRCQFWGTIRFTATSLVHPDEPARTLQRTVEWILPTPTPYRLVEPVQLIEVTSSEEDPEEDPEELPPEPAVDALDFLEGDEDPLPEVDSPEEVMPASEADSTEDSGPREMATGGGSSSLWTVPWTSFIYFLRVGVSRTDC

SEQ ID NO: 211495 - protein, 114 aa, Glycine max
  Coding DNA Sequence Number=SeqID_94717
MRLHQHEENDIKRKGIALRASSSFIQEESDKEDLTETEEDDDDFRLFVKRFNKFLRNKRNKRESNINTKKKEEDSSLAPTCYESNQRGHVRFDYLVFERKIEKSDKRNLKEKKA

SEQ ID NO: 211496 - protein, 84 aa, Glycine max
  Coding DNA Sequence Number=SeqID_94718
MDGEELPSPMNSDQRAESSHVTVRSQDKLTAEINQGTWGRMQVGIGSQPTDRSPFPALNKQRTSLQGSPVSFAFAVSFTIVCFK

SEQ ID NO: 211497 - protein, 68 aa, Glycine max
  Coding DNA Sequence Number=SeqID_94719
MTIRISRELPVFNFERLDELCTRIGHPCEKLRPFEFLEYFCCAISSLSIYYVPNSDIRVKIYDHSNFS

SEQ ID NO: 211498 - protein, 46 aa, Glycine max
  Coding DNA Sequence Number=SeqID_94720
MDTSEPYTRAIRGTVHKPQENLGAYQKFLPEVYPSLPPLSQSILVF

SEQ ID NO: 211499 - protein, 138 aa, Glycine max
  Coding DNA Sequence Number=SeqID_94721
IWLRASISPTRCPSPPARSCHRDIGIAPLVDPEKSNRVLGFLALITGLCQFYGVPVAPNKVIRPPINRTFIKKYCTPQAGAGQDTTTACGWPTVGNRRTAATSRAHKLIYKGWRVAYDPWPTSRRPSPKPKVSKVLGP

SEQ ID NO: 211500 - protein, 101 aa, Glycine max
  Coding DNA Sequence Number=SeqID_94722
  Gene Ontology: Mol. function=serine carboxypeptidase activity; Biological process=proteolysis
  Homolog annotation: Hit_ID=Q1EP77; Match level="QueryCoverage=80%, HitCoverage=16%, E-value=1e-14, Identity=54%"; Hit description =Serine carboxypeptidase (Carboxypeptidase D), putative
MALCSVFLNLHLLFFVCLTIEALGVAKPSVASYLSQEILAGQEADRVHGLPAQPPVKFNNMVVISLSMKLKEEHCSICFLRPLTNQNKNPFSYGSMKCSLS

SEQ ID NO: 211501 - protein, 318 aa, Glycine max
  Coding DNA Sequence Number=SeqID_94723
  Homolog annotation: Hit_ID=Q1RUD8; Match level="QueryCoverage=37%, HitCoverage=25%, E-value=1e-10, Identity=36%"; Hit description=IMP dehydrogenase/GMP reductase
QDTRHPCPLQSHRSCTEKRRIDWYQLLAGIGGRTINWFPRWKEGKEGVLFSCGGYPNIPLIGTRGCINYNPALAIRQLGYPMRGAPTEESMSPFLVRDFGAQNFKAIQRIHKAWETPLRKDQELRGVRNGIIGGYHEWLKVHIRGLDWLAKLKVVSEESFEAPEEDEEVQALKNELGKAKLAKEKFKLAATHIRKECAGLREENATTAKALEQETKNARKEEYGHNKFRGALWGSNSELKLRREERDQSRVHSMVLKEKLVACSRSKRSLSQRLCETETNMLAIIAKYQEELSLATAHKHRVADEYAQVYAEKEARGR

SEQ ID NO: 211502 - protein, 376 aa, Glycine max
  Coding DNA Sequence Number=SeqID_94724
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=99%, HitCoverage=36%, E-value=2e-74, Identity=53%"; Hit description=Chromo
MKFQGSINGLGVQILLDNGSSDNFLQPRLSQCLKLPIEPIPNLQVLVGNGNALTAEGLILDLEVKIQGHTLKLPVYLLPVSGADLVLGAAWLATIGRHLSDYSTLTLKFYLGNQFITLHGERPSLRQQAHFNHMRRMHHTHAIAELFTLQYSRLDGPQDQLLDIPVDMEPELAMILYTYRTVFDVPSGLPPSRTHNHSIPLVEGAEPEGIIAPSRSPFSPSIILVKKKDGTWIFCTDYRALNAITIKDSFPIPPVDELIDNLLNKENFHWNDHTSMAFDNLKAAITKAPVLALPDFSKAFTLETDASGIGIRAVLSQEQHPIAFFSKKLTPSMQRQSAYIRESYAFIEAVAKFRHYLLVHRFVIKTDQRSLKSLTE

SEQ ID NO: 211503 - protein, 75 aa, Glycine max
  Coding DNA Sequence Number=SeqID_94725
MSHSGASYIETLAIEPRKLSSNYNGHNFPIGSPNQAHEKSRRLKMNNGTSRETQMVTTFHTEIRFKHITHGDARN

SEQ ID NO: 211504 - protein, 42 aa, Glycine max
  Coding DNA Sequence Number=SeqID_94726
MSRKLRRVRRRLSFEENRVDDHGDDKEGGTGVVGASDGPWRQ

SEQ ID NO: 211505 - protein, 73 aa, Glycine max
  Coding DNA Sequence Number=SeqID_94727
MEKSGGKQNNFGSMKEREWKIFRSDKFSARLSFSTGDIPPHMNKEEKTETPSFLSKNTTLEKILLVRDRTFDL

SEQ ID NO: 211506 - protein, 47 aa, Glycine max
  Coding DNA Sequence Number=SeqID_94728
MATTKRSVMGLGLGGGSLSMSYPKVVKPRDKGRVNMFNLLELIIKQG

SEQ ID NO: 211507 - protein, 105 aa, Glycine max
  Coding DNA Sequence Number=SeqID_94729
  Gene Ontology: Mol. function=nucleic acid binding; Biological process= DNA integration
  Homolog annotation: Hit_ID=Q0ZCC2; Match level="QueryCoverage=92%, HitCoverage=27%, E-value=2e-21, Identity=52%"; Hit description=CCHC -type integrase
YMEIAKASKEVVRLARLVKELGIEQGGVQLHCDSQCAIDLAKNGMYHGKTKHIDVRFHKIRELMTSGQILPRKVHTSENVAYMLTKAIITDKFKPCLDLLNVDEC

SEQ ID NO: 211508 - protein, 63 aa, Glycine max
  Coding DNA Sequence Number=SeqID_94730
MTHQDFQVQAIGQFAQATCAPEFGLPRPFNQRLLVLHVGGERSELSRIGCWTNGLSYLKKKGG

SEQ ID NO: 211509 - protein, 70 aa, Glycine max
  Coding DNA Sequence Number=SeqID_94731
MTEGVGSTRHCQWRQSRREGCIAPGSGDIGHVGVRIAILTGDTQSMGLAITMGGIGLHGVPPALLAGLAV

SEQ ID NO: 211510 - protein, 303 aa, Glycine max
  Coding DNA Sequence Number=SeqID_94732
  Gene Ontology: Mol. function=RNA-directed DNA polymerase activity; Biological process=RNA-dependent DNA replication
MGKTHEIPHHNLADFKPRLGYAIEGQAIGGGPLPNTSEHPPFRPQPQPLHFAVGRVPPAMAGKGKLDHIEERLIAIEGGGDYSFADMEELCLVPYVVIPPKFKVPDFDMYKGTTFPKSHLKLYCRKIGAYAKDEKLLMHFFQESLTGAAVTWYTNLEPSQEYAQRWRELAARVAPSMTEKEMITTIVDTLPVFYYEKMVGYSPSSFANLVFVGKRIEVGLKRGEFDYPALTNKKPGANREDEKEEGTHAVTVALTWPNFPPAQQCHYSANISPSHYPPSNQPQSLPAAHPIPNSTLNTNQNTN

SEQ ID NO: 211511 - protein, 167 aa, Glycine max
  Coding DNA Sequence Number=SeqID_94733
  Subcellular localization annotation: CTP_CleavageSite=95; ConfidenceScore=5.84e-01
MANNKKQAGGSSSSTMKFDHLFGPKDSSSTTSSSTGLFGSIFPPPPSRIKNARSGSTSKLAQFGFALGTQTNKSESSSRISNKNTSTNYQNETVEPSYFSSSIYYGGQENYSPRSRTTQPHHVFKKDKDDGDSNSNDSNSAARGNWWQGRSRIYSLGTVAKGIKNVI

SEQ ID NO: 211512 - protein, 256 aa, Glycine max
  Coding DNA Sequence Number=SeqID_94734
  Gene Ontology: Mol. function=chitin binding; Cellular component =extracellular region; Biological process=chitin metabolic process
  Homolog annotation: Hit_ID=UPI000044A8F0; Match level="QueryCoverage =65%, HitCoverage=99%, E-value=1e-26, Identity=32%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MSSPSEGYMPLPSEGYMPSPSEGYTPSSSKDYTSSPSEDYTSSPSEDYKSSPSEGYMPSPLEDYTGLHVLTFKGLHILTFRGLHALAIRGLYALTIRGLHILTIKGLHALAFRGLHALAFRGLHVLAFRGLHDLTFRGVHVLTFIGLHALALRGLHVLAFRGLHALAFRGLHISGPWGFQLWLRAFVSLTGCPSPQQGIAFARHPVDPEKSNRVLGFPALIMSLCQFYGVHVAPSKVIRPPTNRAFIKKYCVPRQA

SEQ ID NO: 211513 - protein, 68 aa, Glycine max
  Coding DNA Sequence Number=SeqID_94735
MGLRLQSSLWGRIVLDDGQRSRQGQRQKPIKVLMDGRKERLGSRPIGRHPLPSSGQAENTAARQPSIL

SEQ ID NO: 211514 - protein, 263 aa, Glycine max
  Coding DNA Sequence Number=SeqID_94736
  Gene Ontology: Mol. function=carbohydrate binding
  Homolog annotation: Hit_ID=Q10NJ9; Match level="QueryCoverage=76%, HitCoverage=50%, E-value=1e-52, Identity=53%"; Hit description =Lipase, putative, expressed
  Pfam annotation: Domain name=DUF620; Domain location=122-256; Score= -16.2; E_value=8e-14; Accession=PF04788.3; Description=Protein of unknown function (DUF620)
MKKLCPNLTREDGLETVLEVPIPEEIFTIKSGTSRAWHNMKSWMKPNVESSRSSSLFGGQNTDIQLLLGVVGAPLIPLPVTSHNQPITIKSHNIEASMAKYIVKQYVAAVGGESGLNSVESMYAMGEVRVGSEFSEGEECVSSKKTKKVQMKEEVGGFVVWQKKPELWCLELVVSGYKISAGSDGKVAWRQTPWHHSHASRGPPRPLRRLLQFFFHLIKVVKLQRGFGVLCYCGDIGVKERIRATLNFFADFHAKFPAVGFQV

SEQ ID NO: 211515 - protein, 152 aa, Glycine max
  Coding DNA Sequence Number=SeqID_94737
  Gene Ontology: Mol. function=zinc ion binding
  Homolog annotation: Hit_ID=Q1S5F3; Match level="QueryCoverage=94%, HitCoverage=68%, E-value=5e-37, Identity=57%"; Hit description=Zinc finger, C3HC4 type (RING finger), putative
  Pfam annotation: Domain name=zf-C3HC4; Domain location=84-139; Score =19.5; E_value=0.0015; Accession=PF00097.15; Description=Zinc finger, C3HC4 type (RING finger)
MLVTEDKSHVAVAIDNDGCCHRSSAGGEGCSDASDRTDKEQRRSSHVSGTEIVGVCEERGSECSVEVDLVPEVKVHLANEERDCRICHLSMDMTNHESGTPIELGCSCKDDLAAAHKQCAEAWFKIKGNNVSIVECESDSSFANKKILCELN

SEQ ID NO: 211516 - protein, 372 aa, Glycine max
  Coding DNA Sequence Number=SeqID_94738
  Gene Ontology: Mol. function=DNA binding; Cellular component=nucleus; Biological process=regulation of transcription
  Homolog annotation: Hit_ID=A0FK20; Match level="QueryCoverage=82%, HitCoverage=72%, E-value=4e-60, Identity=49%"; Hit description=Myb transcription factor
  Pfam annotation: Domain name=Myb_DNA-binding; Domain location=136 -182; Score=38.2; E_value=2.8e-08; Accession=PF00249.21; Description =Myb-like DNA-binding domain
  Subcellular localization annotation: CTP_CleavageSite=22; ConfidenceScore=5.19e-01
SILPLSLCLASRRPSCYQQSSRATSSRTEKVVYNRLFAQTIFSVWVECLVETHRFGCRKREGTLVTGGGRAVEPIGGAVRGKELGHDRAGSARTLQQVVPAPVGGGSEPKIHMPCTRLAGHYKYLDCQLSISNSNENSISAEEEDNIIVSAHAIHGNKWAIIAKLLPGRTDNAIKNHWNSTLTRKRMEMGRYVPAHADVIEDGTGNFEKTKASSEETMSIGDINSLNPAEVRNVMMNDETKPPTKDDAKVEEHATLHRPVARVSAFSFYNSPGRPTMGSCSKMFPRQSPLIQSPKPDVGPCKQANNGIMFKDVPKAEPFDPIPQTRRDSRESHLHGSLLGPEFVDYLESPFSSHAFLSIATDLNCCPKYHRK

SEQ ID NO: 211517 - protein, 304 aa, Glycine max
  Coding DNA Sequence Number=SeqID_94739
  Gene Ontology: Mol. function=guanyl-nucleotide exchange factor activity
  Homolog annotation: Hit_ID=Q93ZY2; Match level="QueryCoverage=75%, HitCoverage=36%, E-value=3e-40, Identity=44%"; Hit description=Rop guanine nucleotide exchange factor 1
  Pfam annotation: Domain name=DUF315; Domain location=1-191; Score= -156.1; E_value=4e-07; Accession=PF03759.4; Description=Domain of unknown function (DUF315)
MNGRTCLGDFIYHYITSEKFSPECLLDCLDLSSEHVALEIANCVEASIYVWRRRAHSKPPANPNRSSTKSSWEIVKDFMADGDKRELLAERAENVLLSLKQRFPGLTQTTLDTSKIQCNKVPFHASVTLFSSNLQYFLSKPLTLTHFISNIQDIGKSILESYSRVLESMAFNIVARIEDLLYVDDLTKHSDRFPLVPMTVSVSGTPHKAIGTPRSFSPAPPLISPARGERSPFLGNNHNNNNNIKPQRRGFGVRRVLSNYLGAESKETKILSNSTVVNGSNTSNNKEEQPERQKKSHAMHGKTK

SEQ ID NO: 211518 - protein, 202 aa, Glycine max
  Coding DNA Sequence Number=SeqID_94740
  Gene Ontology: Mol. function=guanyl-nucleotide exchange factor activity
  Homolog annotation: Hit_ID=Q93ZY2; Match level="QueryCoverage=58%, HitCoverage=21%, E-value=3e-43, Identity=73%"; Hit description=Rop guanine nucleotide exchange factor 1
  Pfam annotation: Domain name=DUF315; Domain location=2-202; Score= -77.0; E_value=3.4e-10; Accession=PF03759.4; Description=Domain of unknown function (DUF315)
MDALCNKGENFQKKKDGVPSSSSDSTHECSSPSLGWPIRKATLSKCRKSDEKENEPVSHLEDSKFTTVSSKMSGIDAMKERFAKLLLGEDMSGSGKGVCSALAISNAITNLCATVFGQLWRLEPIPCEKKEMWRREMEWLLSVSDHIVELIPSWQTFPDGSKLEVMTCRPRSDLLMNLPTLRKLDSMLLVSVGSYFHCVLVE

SEQ ID NO: 211519 - protein, 72 aa, Glycine max
  Coding DNA Sequence Number=SeqID_94741
MAHSPPTCPKIATVTVFAVTVNELSCMKGPLRLLWAQHPGKDEGMKKNIMAFWEKCGMPHDIPTSLWLSLSE

SEQ ID NO: 211520 - protein, 289 aa, Glycine max
  Coding DNA Sequence Number=SeqID_94742
  Homolog annotation: Hit_ID=Q2XL08; Match level="QueryCoverage=39%, HitCoverage=76%, E-value=2e-51, Identity=90%"; Hit description=Helix- turn-helix, Fis-type
  Subcellular localization annotation: CTP_CleavageSite=77; ConfidenceScore=5.06e-01
PSSQSLGRIRRHPGLSRTLGAQRAGPELRRTGVRHPARGHPPAGSGFRGCGGSDPTDRRSPASVRRPGLPAACGHSRSAGVSEAVRRTAHQHPQCAAAELHLGHEGSAAGSAIAHTKSSTSRTRMCAAAGCRGLTTRLRSSCNTTEGTTRPKWLRAWSQRVPYAMLGLSAGSASQPGGRSCGPGARYRAGSSGSSKQVIFKGNCGRPAACTNVSKVQIAGDSPMYSAGTSTWFQRPPTKAAPLPLRSSAREALATRQASIRRRRPTPRPPAPDALVVHRSRSGTASPAS

SEQ ID NO: 211521 - protein, 74 aa, Glycine max
  Coding DNA Sequence Number=SeqID_94743
MAQLISDVIYCLQGSHPQRHAVDPEKFNRALGFPALVMGLYSPIGCPFPPARDRACKTPSGPEEVQQCLGVVKL

SEQ ID NO: 211522 - protein, 75 aa, Glycine max
  Coding DNA Sequence Number=SeqID_94744
MPLKGSLSKLDWLSEAYPLSEEACSLSKNKTLENVEPESSMLGAQPGLSIGKCLKSLELGRAARSLHFKEYSAVI

SEQ ID NO: 211523 - protein, 172 aa, Glycine max
  Coding DNA Sequence Number=SeqID_94745
MRRKRFCPSRVASSTIISVIKSQFRKLVAWKPEDEYQVKENFKSKGSKHLSQILLEKFSIQAKKNYSSEQGRSMHTRGSISALDWIVHLFHRFGKPPHIVKLFKETRSRKKDNTWVDKRSKKKPMETFERNYKNALVVGHRQLNLHQEENCGMMLLKALGTSLWGRKRVLPL

SEQ ID NO: 211524 - protein, 154 aa, Glycine max
  Coding DNA Sequence Number=SeqID_94746
  Gene Ontology: Mol. function=RNA-directed DNA polymerase activity; Cellular component=intracellular; Biological process=RNA-dependent DNA replication
MDPMKYIFEKPALTERIAYYLAHQPEDYQSMQCEFPDEGIMALFDNEDSSKEKGWIMWFDDAKLIPYQTHIKELVKQFDEIMFKHIPRVDNQLADALATLSSMFALSKEEDMPLIRIQHHDQPAYCHLVEEESDGKPWYFDIKESRLSSKCPRE

SEQ ID NO: 211525 - protein, 755 aa, Glycine max
  Coding DNA Sequence Number=SeqID_94747
  Gene Ontology: Mol. function=RNA-directed DNA polymerase activity; Cellular component=intracellular; Biological process=RNA-dependent DNA replication
  Pfam annotation: Domain name=G-patch; Domain location=659-703; Score =20.0; E_value=0.00069; Accession=PF01585.13; Description=G-patch domain
LHQTRSPGKIMDEFEELRSDVDQLKQQMTSIMEILQALQMKALERTPTREQPITLHLNRHGQHADLAQAYPYGLPPDYTPPIANTTEPTQPRVEVLIPTNQPVHSMPPINHNMIQATEEVPMACSNEQLQMLEERSKAVEGSNYGMAEAADLCLVLDEYAQRWRAVAAQVEPPLSEKETTTLFTNTLREPFYDMMIGCTSSNFFDIVVIGERVENDMKKGRIDSPKAANSKTLPSGGYDAKAKYDYHENNPNIGNNLLPGHREPLVTVIEEGGEQLRRMRMRYNLHPKASQDFKKILQDLMDRQLMKIGYFEIDVSVVDSSSNLPKPLAVHYTKCTTSSTSSGPKLITIQVPIAFPCKDNKVVPWRYEVKVCVDGSDEKQSKNANSEATNVTNIVGLGSMTRSDQIYSPSESRTKPVKETKSKEVVRSPEEQRKEISNEEARKFLKLIKQSDYTVMDQLNRTPAKISLLSLMLNSEPHRKVLLKILNEAHVIHDISEEKFEGIVVDNGPSLNVMPKTISVKLPSDESYMNPSTMVVCTFNGSRREVIGEISLPIQIGPITFEVVFHVMDIAPTYSCLLRRPWINDARAVPSALHQKLKFIVDDKLIIIFVKEDLLVNKPSSIPYIEVFEESLETSFQGLEIANSNCVKEGKAITQPSGASMMVAKVMLENGYQYGHGLGRHRHGPTQVLDLVENKDRFGLGYKPLEANKRQAMLEKKKEDWPDWKTESLELRGSSSAIYKRAFGVLGSYCRERHF

SEQ ID NO: 211526 - protein, 269 aa, Glycine max
  Coding DNA Sequence Number=SeqID_94748
  Homolog annotation: Hit_ID=Q1SAI8; Match level="QueryCoverage=43%, HitCoverage=11%, E-value=3e-19, Identity=45%"; Hit description =Integrase, catalytic region
MYIMQTKTRNIFPLWYQPKFPLLHLAVIPTTSLYFLPLPFFLFVTLNGCPTQVSPNFSNHQHEIPPTIQARVHNRLDHGIPPTDEKAKKAIDDSKAVDPDLWHRLDVAMLQWIVAAIFQDNKHSRVVHLENQFSNTNLEDFPTGKAYCNRLKLLADQLANVDALVSNTRIGVTKITKIWVARTPAEEVVALATMASVVGKVLAVAIADNSSNDKLLGNGHGSKVLLGLCRHVHIPHIVGPSPMQLKGHNSLVSLDPGHCKQHLMLSHPA

SEQ ID NO: 211527 - protein, 183 aa, Glycine max
  Coding DNA Sequence Number=SeqID_94749
  Gene Ontology: Mol. function=transferase activity; Cellular component= mitochondrion; Biological process=DNA integration
  Homolog annotation: Hit_ID=Q1SX87; Match level="QueryCoverage=94%, HitCoverage=26%, E-value=6e-48, Identity=78%"; Hit description =Polynucleotidyl transferase, Ribonuclease H fold
MSFFYGNRFMGSSKLLEPDEIILVASSDTLHKSIMTLLSSEFAMKDLGPLGYFLGDNLLSWSSKHQAALSHSNAKAKYQGVADVVFESCWLCNLLLELHFPIHKATLVYCDNVSAIYLSGNPIQHQHTKHIEMDIHFVREKVAHGQIFSQKDFLWFYFRISGIVSVYENLPLQMWGWAVIEYM

SEQ ID NO: 211528 - protein, 109 aa, Glycine max
  Coding DNA Sequence Number=SeqID_94750
MRGTMHEPQANLGADQKFSPGKTIRSVFIRGLVLKCKLQKDLVKMMTKSLKNDFKIESTSSRSSLISSFMRRNQEDSRIKRSLISRFKNQEKFDFKIQEKMNSRFKRTN

SEQ ID NO: 211529 - protein, 57 aa, Glycine max
  Coding DNA Sequence Number=SeqID_94751
MYDKCNFEIDMRHLENPHFLVNNALGMICPLQCHEEMHDAIKEKARVRLLCAHNSGT

SEQ ID NO: 211530 - protein, 144 aa, Glycine max
  Coding DNA Sequence Number=SeqID_94752
  Gene Ontology: Mol. function=organic anion transporter activity; Cellular component=integral to membrane; Biological process=organic anion transport
  Homolog annotation: Hit_ID=Q6CYW0; Match level="QueryCoverage=98%, HitCoverage=31%, E-value=1e-45, Identity=64%"; Hit description=Na(+)- malate symporter
  Pfam annotation: Domain name=Na_citrate; Domain location=30-144; Score=-288.3; E_value=0.022; Accession=PF03390.6; Description =Bacterial sodium:citrate symporter
MKQINAELACDKNAASSESSGLINQLRQIDIGAVPIALFIAICAIVAISAYANFLPKNMIGGLAVIMTLGYALAQLGKSIPVLRDIGGPAILCLMVPSVLVYFNVFQPNVMGTVHLLMKDANLLYFVIASLVVGSILGMNRVIP

SEQ ID NO: 211531 - protein, 244 aa, Glycine max
  Coding DNA Sequence Number=SeqID_94753
  Gene Ontology: Mol. function=2-oxoglutarate decarboxylase activity; Cellular component=chloroplast; Biological process=menaquinone biosynthetic process
  Homolog annotation: Hit_ID=Q6AHC2; Match level="QueryCoverage=79%, HitCoverage=32%, E-value=4e-42, Identity=51%"; Hit description=2 -succinyl-6-hydroxy-2, 4-cyclohexadiene-1-carboxylate synthase
  Subcellular localization annotation: CTP_CleavageSite=51; ConfidenceScore=5.78e-01
PCSSSSGSPATTDGISPGVTSTTGSVPESGSRVGRFRCTGPATPRTCPAPSCAPIAAVTARRARPVHTPSPGTGASTWSRTKAPKRPGCRVAWFAPTPRSSGGRSAVSSSSGTPEWKASITAGSRLATAVPEVQTTATGSPVSLAMPSAVNPATRSSMRTCTRRCPSAANRTAASASACEREPGDSTTSRTPCSMSSASRDAAAVVAGDEVTGADPWQAARRSPRPGARAPPRGGGCAHPARTC

SEQ ID NO: 211532 - protein, 51 aa, Glycine max
  Coding DNA Sequence Number=SeqID_94754
MDNHQHGNHSDPAQARIKKKGIRQHKVNDQAQNIDSNIPDSSEDKSSESTQ

SEQ ID NO: 211533 - protein, 100 aa, Glycine max
  Coding DNA Sequence Number=SeqID_94755
MSSKVLKCLLAIKGSTQFPFSYERTQWKRVECFGKIFLNGRFHYRRGTHATFCTFIPVLAIQSMPHVFTSSCETMVISRLKTDPLINPSLKSIKGVSPLE

SEQ ID NO: 211534 - protein, 137 aa, Glycine max
  Coding DNA Sequence Number=SeqID_94756
MGAKYLEVVKRGSHPNNGWSPDKIRGYLMVTRIFHQPGANKPVDAQRLTSSPTPFVVLTREVSQVICGITSWLPAPFIKPGANEPVDAKRLTSSSTLFAIQGHQVRWQAEIPYGHRRLSSIEGNDFDGIRMMLAVRC

SEQ ID NO: 211535 - protein, 61 aa, Glycine max
  Coding DNA Sequence Number=SeqID_94757
MCGAPSKAPKEACRGGGAFNICTLIGKGNPSGSATQIQTSCDTRGKCLDLTGLYYTACHSS

SEQ ID NO: 211536 - protein, 96 aa, Glycine max
  Coding DNA Sequence Number=SeqID_94758
PASQAGEEVLIVATLSPGRTGINRFCPDRVKLVGKLRWEPKRGVELGAIHGSVSEQKILTLKLREKQKRKGPGMGPRQGREKRKREVKGELEDNRM

SEQ ID NO: 211537 - protein, 115 aa, Glycine max
  Coding DNA Sequence Number=SeqID_94759
MQQAELEKLDLVKLRKKGFLGIDPFNYPLWETLPKEEVNALSLYGEKEPVLKDFPVKHIVAPNLNNLDHTKIEENFQNEGMPLEVREESPHFQEWKKSNYGYELRMKSLAYKDEI

SEQ ID NO: 211538 - protein, 320 aa, Glycine max
  Coding DNA Sequence Number=SeqID_94760
  Gene Ontology: Mol. function=sequence-specific DNA binding; Cellular component=nucleus; Biological process=regulation of transcription, DNA-dependent
  Homolog annotation: Hit_ID=Q1SIG3; Match level="QueryCoverage=95%, HitCoverage=57%, E-value=1e-106, Identity=64%"; Hit description=POX; Homeodomain-related
  Pfam annotation: Domain name=Homeobox; Domain location=98-156; Score =8.7; E_value=0.00061; Accession=PF00046.19; Description=Homeobox domain
  Pfam annotation: Domain name=POX; Domain location=1-53; Score=14.1; E_ value=2.8e-08; Accession=PF07526.2; Description=Associated with HOX
  Pfam module annotation: Pfam domain module=Homeobox::POX; Domain location=98-156::1-53
MVYRRYRQYYQQMHAVVTSFEYVSGLSNAAPYASLAIKAMSKHFRCLKNAITDQLQFANKAHFHISNNRKDESPWFGNSDKGPYGQRPGFLEHQPVWRPQRGLPERAVTVLRAWLFEHFLHPYPTDTDKLMLAKQTGLSRSQVSNWFINARVRLWKPMVEEIHLLETRQAPKNPQKEEHCRNKLSDHLSSDNSIVSENPSTSTDKFQEAPYKHTINELPNVPIRTQEQLNLPCTSNQPGGGGVGVSMGGGSASNSVSLTLGLYQNHGIGLAEPFPLNAAQRFGVALDTNNEGYVMSGYESQNRHFGRDVIGGQLLHDFVG

SEQ ID NO: 211539 - protein, 420 aa, Glycine max
  Coding DNA Sequence Number=SeqID_94761
  Homolog annotation: Hit_ID=Q1SIG3; Match level="QueryCoverage=32%, HitCoverage=24%, E-value=4e-23, Identity=51%"; Hit description=POX; Homeodomain-related
  Pfam annotation: Domain name=POX; Domain location=228-313; Score= -7.8; E_value=2.5e-06; Accession=PF07526.2; Description=Associated with HOX
MAEGFEAYHVPQQSRRDKLRVVATQNQQHGLIEPSSTLLPLYDPSSFISSDLLLTSFHNGQKHNLGGCGVKEEQRANLMMGFAAAGGGVVMNNGSSSSSCCSSNSSSVSYLDPESSLHLNQATIQVINNNNSNNMFLYQAQNLREFDQGYNNNNNNDDDNNNSEIMVFKPEPLSLSLSSHNNGVNLQRYGSVVYGDKVGGGGVIYGSSGLNEVSRCTVPMGPFTGYASILKGSRFLKPAQQLLEELCDVGGVCAEKIVADASLMEPIPPPQSSSEDPLGDHGGDQGRKKSRLLTMLDELVILSSFVTVFSLVYPEDKWVLAFMDGLLTVHSMCIIKILVFPVMDGLGELNCPFGKVNGREYMHEDEHGIRKVSVNYIKISNVTMTSSLGGIICIKLLKESIGKDLYSEKVCVDMIMGFKG

SEQ ID NO: 211540 - protein, 136 aa, Glycine max
  Coding DNA Sequence Number=SeqID_94762
MSCSRALSSRWTSVNEELEQLLANVPKHGEWKELTNTMQDVVTPSEAFFHTISAKDQIFSEVGKDVSSSMYYFLKDKGWTHLHLEDVAECRLVFNNWRKTLKIGARWKHFCETLSFTADMKITFEFINPNVNRVLY

SEQ ID NO: 211541 - protein, 102 aa, Glycine max
  Coding DNA Sequence Number=SeqID_94763
MGAKHLTRTKEWSHVIEQRFPDEIREQKVQKTVSALACYQAFCLTDSKRMGANNHKGADNRKQRGADNRKGQYDKDYGAADKSKALAPTYPPMRNSDLRSSG

SEQ ID NO: 211542 - protein, 325 aa, Glycine max
  Coding DNA Sequence Number=SeqID_94764
  Gene Ontology: Mol. function=DNA binding
  Homolog annotation: Hit_ID=Q1SDS1; Match level="QueryCoverage=67%, HitCoverage=40%, E-value=4e-27, Identity=35%"; Hit description=IMP dehydrogenase/GMP reductase
MGLSQMPSLKKRFYQVKVKSLGITSLKELGQLMGQLQRQAYRKAYGKIWDLAMAEVSTEAIASLVQYYDQPLRCFTFGDFQLSPMVEEFEEILGCRGEWAPFIDILTLLIFGGVLFPNVDGLVDLAAIDAFLAFHDRKESPVVAILADLYDTFDRRCEKSSTRIVCCTPALYVWLVSHLFCQEVRHACPLESHRSCTEKKKASWDRLLASKEGASINWFPRWKEGRTGVLISCGGFPNVPLMGTRGCISYNLVPSIRQLGYPMRGAPLEEELAPIIARGFNNTNAEALQKVRKAWEMVQKKDKELRGSNNGPIGGYRRWLKAHMQ

SEQ ID NO: 211543 - protein, 333 aa, Glycine max
  Coding DNA Sequence Number=SeqID_94765
  Gene Ontology: Mol. function=transporter activity; Cellular component= mitochondrial inner membrane; Biological process=mitochondrial transport
  Homolog annotation: Hit_ID=Q10NJ7; Match level="QueryCoverage=99%, HitCoverage=99%, E-value=1e-125, Identity=54%"; Hit description =Mitochondrial carrier protein, expressed
  Pfam annotation: Domain name=Mito_carr; Domain location=142-232; Score=113.5; E_value=6.1e-31; Accession=PF00153.17; Description =Mitochondrial carrier protein
  Pfam annotation: Domain name=Mito_carr; Domain location=237-331; Score=107.0; E_value=5.6e-29; Accession=PF00153.17; Description =Mitochondrial carrier protein
  Pfam annotation: Domain name=Mito_carr; Domain location=36-131; Score= 77.8; E_value=3.4e-20; Accession=PF00153.17; Description =Mitochondrial carrier protein
  Pfam module annotation: Pfam domain module=Mito_carr::Mito_carr::Mito_ carr; Domain location=142-232::237-331::36-131
MEARVGMVVEGGQRTLNADSGGAAKFLVAQNNRQLGTVHQLLAGGISGAFSKTCTAPLARLTILFQVQGMHSDVAALSNPSILREASRIINEEGFRAFWKGNMVTIAHRLPYTAVNFYAYERYKNVLHSLMGENVSGNSGANLLVHFVGGGLSGITSASATYPLDLVRTRLAAQRSTMYYRGISHAFSTICRDEGFLGLYKGLGATLLGVGPSIAISFAVYEWLRSVWQSQRPDDSKAVVGLACGSLSGIASSTATFPLDLVRRRMQLEGVGGRARVYNTGLFGAFGRIIQTEGVRGLYRGILPEYYKVVPGVGIVFMTYETLKMLLSSISSY

SEQ ID NO: 211544 - protein, 80 aa, Glycine max
  Coding DNA Sequence Number=SeqID_94766
MKSKGETMSHDEGNSQSGFALAQTHGGVELTMKLEVAKDEAYDNYGGMMVVMTTTMVVWNSGSGNDNDDGGDNNNGSDDD

SEQ ID NO: 211545 - protein, 111 aa, Glycine max
  Coding DNA Sequence Number=SeqID_94767
  Gene Ontology: Mol. function=nucleic acid binding
MTRVCKWSSCFPSCMRGNLFHGLPNEDSYTYLATYIEICNTVKIAEVLEDAIRLNLFPFSLVSEAKRWLHSFKGNNLRTWKEVVEKFLKKYFLESKTAEGEGRDFLISPIP

SEQ ID NO: 211546 - protein, 345 aa, Glycine max
  Coding DNA Sequence Number=SeqID_94768
  Gene Ontology: Mol. function=isochorismate synthase activity; Cellular component=chloroplast; Biological process=biosynthetic process
  Homolog annotation: Hit_ID=Q1SBX7; Match level="QueryCoverage=99%, HitCoverage=62%, E-value=1e-141, Identity=73%"; Hit description =Isochorismate synthases, putative
MATVHKWLTHFYDTKKCSNILVPLGSKGQQSIPHHRCYLSMNGCREGQHQHARTRNNPVGTIETRTLAAVASPAMAMYSLNMAISELKSDALFGTSSGIVRLQVPIEEQVEAIDWLHSQNHLLLPRCFFFGRKQCSSPCCINGEEKLVSVAGVGSAVFFSQPHPFSYWDWISIRRCPLIRAYGAIRFNAKAKVSSEWLAFGSFYFMIPQVEFIELEGGSMLTITIAWDNDLSWSWENAINALQETLCKVSSSIVKFPKQTPPTLISSSQNIPSKVDWDLAVNRALQMIGQNDSLLTKVVLARSTRVVPTVDIDPLAWLSCLKVEGENAYQFLLQPPNAPAFIGNT

SEQ ID NO: 211547 - protein, 272 aa, Glycine max
  Coding DNA Sequence Number=SeqID_94769
MGSEISEPTSPKVTCAGQIKVRPKTTACRSWQSVMEEIEKIHTDKNQKKRLSWAETLGFKKEIMQFLTCLRSIRFDLRCFGSFSGTDIATEEDEDDDEDEVEVELIEEEKHVGVEESDNEASKTVLSKWFMVLQQENQTNNRREETEERGDGNEEESVSVPPPNALLLMRCRSAPAKSWVREREGGDHDDDDEEQQGKEEKENAEREKEKEKGEKKGQSLKSLMEEDKRKKENVVVMRYDSDFYDISSDIAKETWIVGGIRDLMSRSRSSKR

SEQ ID NO: 211548 - protein, 91 aa, Glycine max
  Coding DNA Sequence Number=SeqID_94770
MPISPCESIGWFVPSRHRGHTHKTPSGPREIQQGPGVSSSGYGPLSVLPGARTPPTRSCHRDIGKDRAHKKFRVLPTTHGRPIGDQVQGQR

SEQ ID NO: 211549 - protein, 698 aa, Glycine max
  Coding DNA Sequence Number=SeqID_94771
  Gene Ontology: Mol. function=binding; Cellular component=thylakoid; Biological process=photosynthesis
  Homolog annotation: Hit_ID=Q1T1X0; Match level="QueryCoverage=82%, HitCoverage=98%, E-value=1e-117, Identity=42%"; Hit description=IMP dehydrogenase/GMP reductase
  Pfam annotation: Domain name=TPR_1; Domain location=233-266; Score =32.6; E_value=1.4e-06; Accession=PF00515.18; Description =Tetratricopeptide repeat
  Pfam annotation: Domain name=TPR_1; Domain location=267-300; Score =19.9; E_value=0.0091; Accession=PF00515.18; Description =Tetratricopeptide repeat
  Pfam annotation: Domain name=TPR_1; Domain location=301-334; Score =8.3; E_value=0.55; Accession=PF00515.18; Description=Tetratricopeptid e repeat
  Pfam annotation: Domain name=TPR_1; Domain location=420-453; Score =15.2; E_value=0.082; Accession=PF00515.18; Description =Tetratricopeptide repeat
  Pfam annotation: Domain name=TPR_1; Domain location=466-499; Score =15.3; E_value=0.081; Accession=PF00515.18; Description =Tetratricopeptide repeat
  Pfam annotation: Domain name=TPR_1; Domain location=500-533; Score =32.5; E_value=1.5e-06; Accession=PF00515.18; Description =Tetratricopeptide repeat
  Pfam annotation: Domain name=TPR_1; Domain location=534-567; Score =21.1; E_value=0.004; Accession=PF00515.18; Description =Tetratricopeptide repeat
  Pfam annotation: Domain name=TPR_2; Domain location=233-266; Score =29.2; E_value=1.5e-05; Accession=PF07719.7; Description =Tetratricopeptide repeat
  Pfam annotation: Domain name=TPR_2; Domain location=267-300; Score =23.6; E_value=0.00071; Accession=PF07719.7; Description =Tetratricopeptide repeat
  Pfam annotation: Domain name=TPR_2; Domain location=420-453; Score =21.5; E_value=0.0029; Accession=PF07719.7; Description =Tetratricopeptide repeat
  Pfam annotation: Domain name=TPR_2; Domain location=466-499; Score =16.5; E_value=0.099; Accession=PF07719.7; Description=Tetratricopepti de repeat
  Pfam annotation: Domain name=TPR_2; Domain location=500-533; Score =21.9; E_value=0.0023; Accession=PF07719.7; Description =Tetratricopeptide repeat
  Pfam annotation: Domain name=TPR_2; Domain location=534-567; Score =19.7; E_value=0.01; Accession=PF07719.7; Description=Tetratricopeptid e repeat
  Pfam annotation: Domain name=TPR_4; Domain location=233-258; Score =9.1; E_value=3.1; Accession=PF07721.5; Description=Tetratricopeptide repeat
  Pfam annotation: Domain name=TPR_4; Domain location=267-292; Score =0.6; E_value=32; Accession=PF07721.5; Description=Tetratricopeptide repeat
  Pfam annotation: Domain name=TPR_4; Domain location=301-326; Score =7.5; E_value=4.8; Accession=PF07721.5; Description=Tetratricopeptide repeat
  Pfam annotation: Domain name=TPR_4; Domain location=376-401; Score =2.5; E_value=19; Accession=PF07721.5; Description=Tetratricopeptide repeat
  Pfam annotation: Domain name=TPR_4; Domain location=420-445; Score =12.0; E_value=1.4; Accession=PF07721.5; Description=Tetratricopeptide repeat
  Pfam annotation: Domain name=Thioredoxin; Domain location=618-696; Score=-2.4; E_value=0.00026; Accession=PF00085.10; Description =Thioredoxin
  Pfam module annotation: Pfam domain module=TPR_1::TPR_1::TPR_1::TPR _1::TPR_1::TPR_1::TPR_1::TPR_2::TPR_2::TPR_2::TPR_2::TPR_2::TPR _2::TPR_4::TPR_4::TPR_4::TPR_4::TPR_4::Thioredoxin; Domain location =233-266::267-300::...
  Pfam module annotation: Domain location=301-334::420-453::466 -499::500-533::534-567::233-266::267-300::420-453::466-499::500 -533::534-567::233-258::267-292::301-326::376-401::420-445::618-696
MAEKTKNKVEVQLGCGLMGRIFHLKTNNRTRKSSVHSLPVKVCNNTAQQQRDQAKNEAKPSPNHESNVPRDSSIGTIPTLKVEQNPARKSSSSHRAPSAYQNTQNGRASDAARTSIQRSHDSNEESKQQQKEHAVVNSLELARISTSANHHHHQNNETKSLAKEFVLPITGNLLVNSSPRTSITKSKELNTLSGSCSYNSNNSTNKGMMGNIMRKNSDELAQFRSPRNGRVDPEVLKSMGNEAYKQGRFEEALTLYDRAIAVDSKKATYHCNKSAALIGLGRFLQAIVECEEAIKLEPSYGRAHTRLATIYFRLGEAEKALNCNETSSCVDSVLAFQAQALQNHLSKCTEARKVKDWKVILNETQAAISLGADSAPLVYSLHTEALLKLLRHQEAHATYEKMPKFDLDSSNKLFGPVRSAYLLMTGAQIYLAAGRFEDAVTASEQAAKLDPSNFEMNAVVRRARAVTSARMSGNLLFKASKFTEAYAVYNEGLEHDPHNSVLLCNRAACRSKLGQFEKAIEDCNVALIIQPSYSKARLRRADCNAKLERWEAAIQDYEMLLREKPGDEEVARALFETQLQLKMLRGEDIKDLKFGSNLFFISSNDRFRHYVTSPGMSVVLFCNKATHKQVLLVLEQTCKRFPSVNFLKVEIEDHPYLAKSEGVNCIPAFKIYKNGSRIKEIPGNNHDLLEKLVKLYSS

SEQ ID NO: 211550 - protein, 976 aa, Glycine max
  Coding DNA Sequence Number=SeqID_94772
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=92%, HitCoverage=90%, E-value=1e-115, Identity=47%"; Hit description =Chromo
  Pfam annotation: Domain name=Chromo; Domain location=815-869; Score =30.7; E_value=5.3e-06; Accession=PF00385.14; Description='chromo' (CHRromatin Organisation MOdifier
DELLKNKADSSSSSSMKAEQFFDYYNTPDDQRLTIAAIHLDNELMQTGSVQDYYVQFTALANRVQGVTTEALLDCFIGGLKTEIRRDVVAQRSTGVGTMRFKGSINGIIIQVLLDSESSGNGNSLVVEGLVSKLDVLIQGHALQLSAYLLPVTGVDLVLGTAWLATLGLHISDYSTLTLKFYLDKQFVTLHGEKSTTGSLAQFNHLRRMYCTNAIAELFALQHEIPVCPQDDWLDIPRDMEPELAILLHTYKQVFVVPKGLSPNRSQNHAIPLMHGTGPMKVRPYRYPHSQKLQIEKMILDMLEEDYKALNAITIKDSFPISIVDELLGSGVSMEKEKIKVVLEWPVPINIKQLRGFLGLTGYYRRFIRGYASLATPLTNMLKKDNSQWSNEALTTFDSLKAAMTQAPVLALLDFNKPFTLETDASAYTREFYTITEAIAKFRHYLLGHKFIIKTDQKSLRSLTDQAIQTPEQQTWLHKLLGYDFTIEYKPGKDNIPTDSLSRSFYMAWSQPQFHIVTKIKQALLNNDKLQKVIELCLKNNPHDPHYMVYDGLLYWNGRLVIPDDISLKQQIAMHKFIKDYVQTCLVCQQAKTTITTPIGLLQPLPIPDQVWEDVAMDFITGLPLYHGYIVIMVVVDRLSKYAHFSCLKADYSNKVVAETFMNTVVVYGREPPQLLRYTPNLQDSTSVQDQLMLRDATLAKLKCNLQRAQQVMKKYVDEKRLPKEFAVGDMVMVKLQPYRQHTVALRKNQKLSLRYFGLFSMVERIGVVANKLLLPLSTKIHPVFHASQLKPCHGNHTQHYVPLPFTFNEQLPIIQPRAILQDLVILKGQKQVQQLLIQWEGLDESQATWEDKDVFEVAYPSFNLEDKIVFKGGGIVMDENNVGLELEVDNQRRNPGHMANDPQDVGCRRSTHMKFTSSKLHGFEAEKGYKYFVRGKRKRAHNSLIHSKANPDLLAAFKTGGEVKRGIQLGVGIGQ

SEQ ID NO: 211551 - protein, 111 aa, Glycine max
  Coding DNA Sequence Number=SeqID_94773
  Homolog annotation: Hit_ID=Q1SMF0; Match level="QueryCoverage=70%, HitCoverage=14%, E-value=1e-09, Identity=40%"; Hit description =Tetratricopeptide-like helical
MDKDQWIYDNIMSKEVNMNEENGEEPRVIVIRDDVLHWARFVAYDIGFVLVIMRSDTYTGNRGRTTYVLIGCERSGKYRAYRKDLVRTIIGNRKYGCLFKLRGKPVLGGEG

SEQ ID NO: 211552 - protein, 121 aa, Glycine max
  Coding DNA Sequence Number=SeqID_94774
MGKVKEVQEQMKADMEAMKEQMAKLMEAMMSMKQIMEANAVAVATTRAVAKVNPMHLSDINQMNHPTSNMVGKDLGRYATKGQAVGGIPLRNTLEGPQYHPQPHSLHSTPGKNPHAMAEMG

SEQ ID NO: 211553 - protein, 147 aa, Glycine max
  Coding DNA Sequence Number=SeqID_94775
MVGQKVLLYNSRLGLMSVEIKSDSTNKSFKVNEHRLKSFLINPSLVAAVVEETSLLHHDLWSSYFPISFFAFITLVRFYLMVLQPPLRREGDARAHGCVIQERKMRGVATNIYSRKTSKKLKKRRETLRCWTINDLLFFESSDKVTC

SEQ ID NO: 211554 - protein, 118 aa, Glycine max
  Coding DNA Sequence Number=SeqID_94776
  Subcellular localization annotation: CTP_CleavageSite=29; ConfidenceScore=5.04e-01
MSSVIYAFKDYNVFIYISKTSMSFVFYILQDFNSSGLNVLVFVLLRTQRPLFLCKKGKQGVQIATRSTWAFQDVPPEGTAFWRKQPSSPGRAGWQAPPLFSYKYGEEGRRKTFNPPGI

SEQ ID NO: 211555 - protein, 119 aa, Glycine max
  Coding DNA Sequence Number=SeqID_94777
MAEPSKKRKGSSSRSQRHPEAQETQIPSSISSSSLFSSEEQWIWYTNRFSSRSIIDPKFIDINFFSNESFECIQAFENSNLIPFMSSKLSIYSELVKAFYSNLEIQESTLIYEVFGIKM

SEQ ID NO: 211556 - protein, 238 aa, Glycine max
  Coding DNA Sequence Number=SeqID_94778
RGLVLNAEGHPGKILRKYLTTLAQMDMNVGALISGQITSMAQSNSSRLGFPALITALWAKRARTRPTEAPSTSIAPPLAHTPIAPFAPASTDFQRLEAMLQSIHQGQIILLQSLQMVAPLDSIPSVKEDEGPTAQVPQQMEDDSFKTTTPEPLVRKKKVDETQKVAATSEKSLEATFEPSEPVVDTTSPQQAAYPSTPEDQTTPVLSLNTSPTATPMLHLTDEEDVQTQDTQDQSQDF

SEQ ID NO: 211557 - protein, 166 aa, Glycine max
  Coding DNA Sequence Number=SeqID_94779
  Gene Ontology: Mol. function=protein binding; Biological process=two -component signal transduction system (phosphorelay)
  Homolog annotation: Hit_ID=Q9LU15; Match level="QueryCoverage=55%, HitCoverage=71%, E-value=5e-33, Identity=72%"; Hit description =Histidine-containing phosphotransfer protein 4
  Pfam annotation: Domain name=Hpt; Domain location=98-166; Score=21.6; E_value=0.0027; Accession=PF01627.13; Description=Hpt domain
MDRNQSRRQVAAMKQSLFDQSLHQDHSLAGVKMHSQLVVNENYIFHFIRILITLNHKTQENCAMFIAGMALATMGFLDEQFIQLEELQDDANPNFVEEIVTLHYRDSSRLISSIEQALKERNPLDFNKLDTLMHQFKGSSSSIGAKKVKAECNLFREYCRTGNAEG

SEQ ID NO: 211558 - protein, 50 aa, Glycine max
  Coding DNA Sequence Number=SeqID_94780
MAANQENAETAEQRVAPWSWSEPWHCHATRIIATKKTRTFILLTGSAYYN

SEQ ID NO: 211559 - protein, 446 aa, Glycine max
  Coding DNA Sequence Number=SeqID_94781
  Gene Ontology: Mol. function=protein serine/threonine kinase activity; Cellular component=membrane; Biological process=protein amino acid phosphorylation
  Homolog annotation: Hit_ID=Q5JNK2; Match level="QueryCoverage=87%, HitCoverage=92%, E-value=1e-155, Identity=70%"; Hit description =Putative Nod-factor receptor 1b
  Pfam annotation: Domain name=Pkinase; Domain location=136-418; Score =132.2; E_value=1.5e-36; Accession=PF00069.15; Description=Protein kinase domain
  Pfam annotation: Domain name=Pkinase_Tyr; Domain location=136-418; Score=150.8; E_value=3.7e-42; Accession=PF07714.7; Description =Protein tyrosine kinase
  Pfam module annotation: Pfam domain module=Pkinase::Pkinase_Tyr; Domain location=136-418::136-418
MKETLVWTADQVNHKAHVPYGWIVGGLGVALVLIILTVILCVCLRSSNCFADTRTHEKDAEGKISHKFHILRNPSFFCGSGRYICGKHVDQKQTDGESSNHTIMVPKASTLWPDVFDMDKPVVFTYEEIFSTTDGFSDSSLLGHGTYGSVYYSLLRDQEVAIKRMTATKTKEFMLEMKVLCKVHHANLVELIGYAASHEELFLVYEYAQKGSLKSHLHDPQNKGHSPLSWIMRVQIAIDAARGLEYIHEHTKTHYVHRDIKTSNILLDASFRAKISDFGLAKLVGKANEGEISTTKVVGTYGYLAPEYLSDGLATTKNDVYAFGVVLFEIISGKEAIIRSEGTMSKNADRRSLASIMLGALRNSPDSMSMSSLREYIDPNMMDLYPHDCVFKLAMLAKQCVDEDPILRPDMRQVVISLSQILLSSVEWEATLAGNSQVFSGLVQGR

SEQ ID NO: 211560 - protein, 659 aa, Glycine max
  Coding DNA Sequence Number=SeqID_94782
  Homolog annotation: Hit_ID=Q6ZD92; Match level="QueryCoverage=66%, HitCoverage=98%, E-value=1e-131, Identity=56%"; Hit description =Proline-rich protein-like
  Pfam annotation: Domain name=Paf1; Domain location=263-659; Score =13.8; E_value=3.1e-11; Accession=PF03985.4; Description=Paf1
MASYRPFPPQSSQIPNPIPGGNHQYNNNQNQNWGAYGDPSTSSFPQIPPNSNYHQNQQHHVPYAPPNPHHPHYPYPPPPPPPPPEASYQPPPPPPPAPMYYPSNNQYSNQPPPPPPPLSPPPPPPPVSPPPPPAVTQNNEERHFKEPSTSGRREYEHSNHGIAHKQHKQQPPVPVKKMNNGPPGRAETDEEKRLRKKREFEKQRQEEKHRQQLKESQNTVLQKTHMLSSGKGHGMIAGSRMGERRSTPLLGAERVENRLKKPTTFLCKLKFRNELPDPSAQPKLMASKKDKDQYAKYTITSLEKMYKPKLFVEPDLGIPLDLLDLSVYNPPSVRPPLAPEDKELLRDDEAVTPIKKDGIKRKERPTDKGVAWLVKTQYISPLSMESTKQSLTEKQAKELREMKGGRGILDNLNSRERQIREIEASFEAAKSDPVHATNKDLYPVEVMPLLPDFDRYDDQFVVAAFDNAPTADSEMHAKMDKSVRDAFESKAVMKSYVATSSDPANPEKFLAYMVPAPGELSKDIYDENEDVSYSWIREYHWDVRGDDADDPATFLVAFDESEARYLPLPTKLVLRKKRAKEGRSGDEVEQCPVPARVTVRRRSSVAAIERKDSGVYTSSKGNSSKRGGLEMDDGLEDQHRGAPHQDNYQSSGAEDYMSD

SEQ ID NO: 211561 - protein, 390 aa, Glycine max
  Coding DNA Sequence Number=SeqID_94783
MDLVEDDLHRLRSNLSSLLLQIDEVVVQAIEVNYKNNKTISKEGKTQIESFSRVLSDMLSSLKPWLPKIQNALNPQDIVSDDETRECDRPKPEETTLNLVSPSPLVSWRANCTVKRGRQMFMLTPLPLSSKHHQPKPYFPPPTTSSTTTFKDSDMVKPTPIKQKLPNNQDRSMLVMMTPCLKMSPPRSCLLLEPISEISRLGGDHKVRKGTPYPVGIHCSDSKSSGSDDSSRDLSLMYPELQGIHKSGIGKKTVEVSPDWLTSPPKTCVLLEPPDEKKIDGHLCVQIADNIFNEQVSKFEDDDVSNDHNQAKESCNQDNFVGNLSHVESTPMPESSFQRGKCPGENTLKKELWTKFEVASTWGCQPKVPTVQKSAHKGFLDLLEEASCDE

SEQ ID NO: 211562 - protein, 97 aa, Glycine max
  Coding DNA Sequence Number=SeqID_94784
MHSSKLEGGGHMNENAIHGAPKILRMENCTKQSLGIAPNSKIENEELHQAITTHGSKLEGGGHMNENAIHGAPKRLRMANCTKQSLRIAPNSKVEDT

SEQ ID NO: 211563 - protein, 37 aa, Glycine max
  Coding DNA Sequence Number=SeqID_94785
MSERWRSEIVQNWVANVVLEFHDDPTVNESEIVIFLR

SEQ ID NO: 211564 - protein, 52 aa, Glycine max
  Coding DNA Sequence Number=SeqID_94786
MTKPLDHSKSWISDAILPRRGPITRAMARRLQKDWVRNTREGPRVLMSLRGT

SEQ ID NO: 211565 - protein, 136 aa, Glycine max
  Coding DNA Sequence Number=SeqID_94787
  Gene Ontology: Mol. function=RNA-directed DNA polymerase activity; Cellular component=signal recognition particle, endoplasmic reticulum targeting; Biological process=RNA-dependent DNA replication
MANSRLVSKLNLETKPHSRPYKLQWFSEDGEMTVSQHVEVCLSIGRYNDKKYKDVFPKEVPNGFSPLRGIKHHIDLIHGASLPNQPTCRSNPQETKEIQRQVPMILVPKKDGTWRMSLIVGLSITSRSSIDTLSPY

SEQ ID NO: 211566 - protein, 175 aa, Glycine max
  Coding DNA Sequence Number=SeqID_94788
  Gene Ontology: Mol. function=double-stranded RNA binding; Cellular component=intracellular
  Homolog annotation: Hit_ID=Q8S8F6; Match level="QueryCoverage=83%, HitCoverage=30%, E-value=1e-48, Identity=52%"; Hit description =Putative RNA helicase A
  Pfam annotation: Domain name=dsrm; Domain location=74-136; Score =46.3; E_value=1e-10; Accession=PF00035.15; Description=Double -stranded RNA binding motif
VSDSVVLLFGGSLLKGDADNHLKMLGGYLEFFMEPSVAEMYQSIRRELDDFIQSKYDCRFQMTNVKSGPGGDNPKSQLQTLLTRAGYAAPIYMTKQLKNNQFQATVEFNGMQIMGQPCNNKKSVEKDAAAEALQWLMGGKQTGREYINHGIVTSPGSLSQFAHENSQAPIPHQTD

SEQ ID NO: 211567 - protein, 48 aa, Glycine max
  Coding DNA Sequence Number=SeqID_94789
MMILCFKEGGAANLILPHQKRIIDQVEMVKICYSEATPCHNESPSWRP

SEQ ID NO: 211568 - protein, 73 aa, Glycine max
  Coding DNA Sequence Number=SeqID_94790
MVNLTPTQRDIKEWEGPLIDKCSTSGYFVSIRGNVVSWKSKKQSVVACSSVEAEFRPWPWLPANLSGLNNFKS

SEQ ID NO: 211569 - protein, 70 aa, Glycine max
  Coding DNA Sequence Number=SeqID_94791
  Subcellular localization annotation: CTP_CleavageSite=63; ConfidenceScore=5.06e-01
MRHYFRIYPRPRPSLTTPQFNKNKQQFEDKSLTFLSKHMQFRAPKYINGKLESPRMRGGSPRRAQLAQAS

SEQ ID NO: 211570 - protein, 69 aa, Glycine max
  Coding DNA Sequence Number=SeqID_94792
  Homolog annotation: Hit_ID=Q1SB60; Match level="QueryCoverage=68%, HitCoverage=3%, E-value=1e-10, Identity=62%"; Hit description=Double- stranded RNA binding; Fungal hydrophobin
MAPSDVCPTEDAVQAFIEHLVDPLLPTKATVQGNPTPSQQKLVAKQIYLHYFYVLPAWSVESIDNSFPE

SEQ ID NO: 211571 - protein, 343 aa, Glycine max
  Coding DNA Sequence Number=SeqID_94793
  Gene Ontology: Mol. function=protein dimerization activity; Cellular component=nucleus; Biological process=regulation of transcription, DNA-dependent
  Homolog annotation: Hit_ID=Q8LAL2; Match level="QueryCoverage=57%, HitCoverage=66%, E-value=2e-48, Identity=54%"; Hit description=Auxin- responsive protein IAA26
  Pfam annotation: Domain name=AUX_IAA; Domain location=15-308; Score =60.2; E_value=6.9e-15; Accession=PF02309.7; Description=AUXIAA family
MWQRSHKSSEERKLELRLGPPGEESLNESIRKCNRERRRNESPLTLGCFSTQKIFTSDTPGPGGAMLPSAWPSTSYHHQDQAKAKASSFLQLQSSPQNMILMGKDVSQFSCVEKKSFSPSCANPAVSKRTASGPVVGWPPIRSFRKNIASGSTSNSKLPSGSQQQHQNVVPGKVASQKPTDNSGKGLFVKINMDGVAIGRKVDINAYDSYEKLSSAVDELFRGLLAEMKLSHIASSQCCSGQRDSCAGGIQNKEQEEKSNTGLLVGSGEYTLVYEDNEGDRMLVGDVPWHMFVSTVKRLRVLKSSDLPAFTHKEKDAEATCYNISNACPNMRKIDFALKNTFN

SEQ ID NO: 211572 - protein, 262 aa, Glycine max
  Coding DNA Sequence Number=SeqID_94794
  Gene Ontology: Mol. function=transferase activity; Cellular component= integral to membrane; Biological process=glycolysis
  Homolog annotation: Hit_ID=Q9SEK2; Match level="QueryCoverage=80%, HitCoverage=42%, E-value=2e-53, Identity=56%"; Hit description =Hexokinase-1
  Pfam annotation: Domain name=Hexokinase_2; Domain location=11-214; Score=65.5; E_value=1.4e-18; Accession=PF03727.6; Description =Hexokinase
MARSFARFWRYGEQFLSYFPLIESLVLTKAINMEWGNFRSSHLPLTEYDCALDAESLNPSDQIFEKMTSGLYLGEIVRIVFQYKCEKYPFGYCPLSKETKWLEKRKTKNLTADKISDTSLEVRKVVVEICNIIATRGARLSAAGILGILKKLGKDTISEVVGQKNVIAMDGGLFEHYTEYTECLENTLKELVGEDISESIIIEHSNDGSGIDVKKGGRAQRARRRGAKRTTRAEREVALSARLRAQRDYDDPKPNFAPINKR

SEQ ID NO: 211573 - protein, 64 aa, Glycine max
  Coding DNA Sequence Number=SeqID_94795
MGLTVPSMLKPFVHLIRFPEARDVCMTGKEKGILQQRDKDVVFFCLQEAKTNLLLLNTDIHSRN

SEQ ID NO: 211574 - protein, 396 aa, Glycine max
  Coding DNA Sequence Number=SeqID_94796
  Homolog annotation: Hit_ID=Q9LK76; Match level="QueryCoverage=96%, HitCoverage=91%, E-value=2e-68, Identity=42%"; Hit description =Arabidopsis thaliana genomic DNA, chromosome 3, P1 clone: MDC8
  Pfam annotation: Domain name=IQ; Domain location=115-135; Score=32.1; E_value=1.9e-06; Accession=PF00612.17; Description=IQ calmodulin -binding motif
  Pfam annotation: Domain name=IQ; Domain location=137-157; Score=20.5; E_value=0.0059; Accession=PF00612.17; Description=IQ calmodulin -binding motif
  Pfam annotation: Domain name=IQ; Domain location=163-183; Score=3.9; E_value=16; Accession=PF00612.17; Description=IQ calmodulin-binding motif
  Pfam module annotation: Pfam domain module=IQ::IQ::IQ; Domain location=115-135::137-157::163-183
MGKASRWLKGLLGMKKEKDHSDNSGSLAPDKKEKKRWSFAKPGKDVPPSVPATDNTWLRSYISETENEQNKHAIAVAAATAAAADAAVAAAQAAVAVVRLTSQGRGALFSGSREKWAAVKIQTFFRGYLARKALRALKGLVKIQALVRGYLVRKRAAATLHSMQALIRAQTAVRTQRARRSMSKENRFLPEVLARKSVERFDETRSEFHSKRLPTSYETSLNGFDESPKIVEIDTYKTRSRSRRFTSTMSECGEDMSCHAISSPLPCPVPGRISVPDCRYIQDFDWYYNVDECRFSTAHSTPRFTNYVRPNVPATPAKSVCGDTFFRPYSNFPNYMANTQSFNAKLRSHSAPKQRPEPKKRLSLNEMMAARNSISGVRMQRPSSNFFQTQEDSWNF

SEQ ID NO: 211575 - protein, 788 aa, Glycine max
  Coding DNA Sequence Number=SeqID_94797
  Gene Ontology: Mol. function=polynucleotide adenylyltransferase activity; Cellular component=nucleus; Biological process=RNA polyadenylation
  Homolog annotation: Hit_ID=Q5Z7G3; Match level="QueryCoverage=83%, HitCoverage=97%, E-value=0.0, Identity=55%"; Hit description =Putative poly(A) polymerase
  Pfam annotation: Domain name=NTP_transf_2; Domain location=73-170; Score=30.6; E_value=5.4e-06; Accession=PF01909.13; Description =Nucleotidyltransferase domain
  Pfam annotation: Domain name=PAP_RNA-bind; Domain location=330-466; Score=187.6; E_value=3e-53; Accession=PF04926.5; Description=Poly(A) polymerase predicted RNA binding domain
  Pfam annotation: Domain name=PAP_central; Domain location=11-329; Score=412.5; E_value=5.9e-121; Accession=PF04928.8; Description =Poly(A) polymerase central domain
  Pfam module annotation: Pfam domain module=NTP_transf_2::PAP_RNA -bind::PAP_central; Domain location=73-170::330-466::11-329
MGGSEGVGASSKQFGVTKPISMAGPSATDLQRTRELEKFLAASGLYESKDEAAKREEVLHRLGEIVKSWVKQLTRLRGYTGQMVEDANAIILTFGSYRLGVHGPGADLDTLCIGPSYVTREEDFFYTLHDILANVEEVTELQPIPDAHVPVMKFKFDGISIDLLYASISRLVLPEDLDISDVSVLHNVDEPTVRSLNGCRVADQILKLVPNIEVTGFLGGVNLALLVARVCQFYPNAVPSMLVSRFFRVYTQWRWPTPVMLCPIEENELGFPVWHPGKNPRDRSHHMPIITPAYPCMNSSYNVSTSTLRVMMDQFQYGNKICGALFEQYSFFESYKNYLQVDVVAADADDLRSWKGWVESRLRQLTLMIERDTFGKLQCHPYHHEFVDTSRLCAHCAFFMGLQRKQGEVVQEGQQFDIRGTVEEFRHSVNMYMFWKPGMEIYVSHVRRRQIPFYVVPDGYKRSRLSRPTSQVENCKSFHNEVSGTEHVERIRKRKNNDGVDVRGDAIVKRQSASPSEDRLARHSSLGTGGLSVEAVSDRQELRNVECNHLSNSGQDELDRTESPEAASNSSVITSVGSSEDTGSVTVAGCVEESTGGVEMMNNGWFEDSTYGNDSVTLVKNIVASGNEVFQHELQEQFQPNATLGMVLDSAEKVISEVVQEPEIETIIDSLLDHSSLQIGTDPNQAEELELRFSEKAKLRKVVVCATVIGACTEAAAAAVHRNVRKCQRWGRAVEILKELEEKIAKPTWKLKLKLVVHAMNVEMHAGLASEGGSKLKMLITYVAKLPT

SEQ ID NO: 211576 - protein, 125 aa, Glycine max
  Coding DNA Sequence Number=SeqID_94798
  Gene Ontology: Cellular component=chloroplast
  Homolog annotation: Hit_ID=P03938; Match level="QueryCoverage=48%, HitCoverage=45%, E-value=4e-10, Identity=86%"; Hit description =Hypothetical 14 kDa protein ycf68
MSPHGGDMDGGEKKEREGWGFSCFWHSGPRREAPHDGLLAQWRIDGAIQVRSNVDPTFSSLVGSGRSGGDHHGSSLLENSYIPYQYMDSYLSSTGLGLASMEKNGAPNNVSSQTKNYEIAPFILG

SEQ ID NO: 211577 - protein, 378 aa, Glycine max
  Coding DNA Sequence Number=SeqID_94799
  Homolog annotation: Hit_ID=Q1SB60; Match level="QueryCoverage=82%, HitCoverage=56%, E-value=1e-60, Identity=39%"; Hit description =Double-stranded RNA binding; Fungal hydrophobin
MQHYMHHAVLPRVDLYLLELNMILVLWYSSLMTQVPRVLMTGKWGFFLSANQAESSIFLPAAKEAFSISLQDSRVTEKNVKVDTPEATDFYVNKDTFTSLGSKPNSDNIDSQKQKENNGSCTPALSYYINEPMEMDVNENSIFKSQNKEKCQDIIASTVQVGVDQENNNPYLKYNSNGSASAVKALKVDSTRMLIAEGGVNNLASLHKNYAHRPNTSSEKGKLVSFTPTANHSNSDLEKLQILSDSKKILSQTALAALIRKRNELALQQRKIEDEIAVCDKKIQRMLTDGEDDFKLKIESIVEGCNDTWELDNTCHENNWVLPTYHLSHADGGFKANVTVKGVDFQCSFEGNVGSNPSEARESAAALMLTNLKEKIVQ

SEQ ID NO: 211578 - protein, 65 aa, Glycine max
  Coding DNA Sequence Number=SeqID_94800
MAVAVRGGGDVTVRQRWCNKIGEEEVGKKYLAFWFGAKCEWGEEKKAENNNGKGFLVLDSERNSK

SEQ ID NO: 211579 - protein, 833 aa, Glycine max
  Coding DNA Sequence Number=SeqID_94801
  Gene Ontology: Mol. function=nucleoside-triphosphatase activity; Cellular component=nucleus; Biological process=proteolysis
  Homolog annotation: Hit_ID=Q69IM3; Match level="QueryCoverage=97%, HitCoverage=66%, E-value=0.0, Identity=64%"; Hit description =Bromodomain protein 103-like
  Pfam annotation: Domain name=AAA; Domain location=419-609; Score =267.6; E_value=2.6e-77; Accession=PF00004.19; Description=ATPase family associated with various cellular activities (AAA)
  Pfam annotation: Domain name=AAA_2; Domain location=415-549; Score= -43.3; E_value=0.018; Accession=PF07724.4; Description=ATPase family associated with various
  Pfam annotation: Domain name=AAA_5; Domain location=419-555; Score =9.7; E_value=0.00032; Accession=PF07728.4; Description=ATPase family associated with various
  Pfam module annotation: Pfam domain module=AAA::AAA_2::AAA_5; Domain location=419-609::415-549::419-555
MYPKQSGQDGPDSRQVRSSDRIKTRPNVYGRPYLYYNQNHRHTRKSKIKTRTAASQIAKMLRPGNRKSKDSNTNSGSANLRRSTRKRRLNVNLEDFTDSSGAQDEDLMVRYVAMFQRPPTYSSLRNRMKNSVRRDGLMSNKRKRAAETKQTPRREGLRPRRSKGAAIERLILESDDEQDLSEEKVDEDETENGNDADDGQNEIEGDAEEEDEDEDEGDEDGDDEEGEEEQDGRRRYDLRNRSDVRRFSMEEGKARPRSPRRVLHQGMGTKVNRDVRKGGSRVHKRHRLARPEDSDDSLLVDELDQGQAIPWGRGGNRSGPPWLFGGLEMHGTTAFGLNLAASGWGHQGDAVATLTSGIQTAGPSSKGGADIQPLQVDESVSFDDIGGLSEYIDALKEMVFFPLLYPDFFASYHITPPRGVLLCGPPGTGKTLIARALACAASKAGQKVSFYMRKGADVLSKWVGEAERQLKLLFEEAQRNQPSIIFFDEIDGLAPVRSSKQEQIHNSIVSTLLALMDGLDSRGQVVLIGATNRIDAIDGALRRPGRFDREFNFPLPGCEARGEILDIHTRKWKHPPPNELKKELAASCVGYCGADLKALCTEAAIRAFRQKYPQVYTSDDKFVIDVDSVKVEKTHFIEAMSTITPAAHRGAIVYSRPLSLVVQPCLQRHLEKAMCSISDIFPPASITSELTKLSMLSYGSAIPLVYRPRLLLCGGEGTGLDHLGPAVLHELEKFPVHSLGLPSLLSDPSAKTPEEALVHIFGESRRTTPSILYLPQFDVWWETAHEQLRAVLLTLLEELPSDLPILLLGTSSVALSEVEEVPTSIFPHRSVYA

SEQ ID NO: 211580 - protein, 536 aa, Glycine max
  Coding DNA Sequence Number=SeqID_94802
  Gene Ontology: Mol. function=RNA-directed DNA polymerase activity; Cellular component=exocyst; Biological process=RNA-dependent DNA replication
  Homolog annotation: Hit_ID=Q1SRI1; Match level="QueryCoverage=87%, HitCoverage=73%, E-value=1e-102, Identity=41%"; Hit description=RNA -directed DNA polymerase
MINEAVDLAKRRKDECLLFKVDFEKAYDSVSWSFLTYMLNRMGFDKRWIGWIQACVFSSSMSVLVNGSPTDEFTAHKGLRQGDPLSPFLFLIVAQGLSGLVQKAIQVGNFDGYQVADGLNLSLLQFADDTILLDKGSWKNLWSIKTIFRSFELVFGLRVNFHKSKLIGLNINEGFLESASIFLSCCMTLIPFKFLGVPVGANPRRRSTWKPMVDSMRAKLSCWRGRNLSIGGKVTLINSVLSSLPLYLFSFFKAPKVVIKELTQIQRDFLWGSHEEERKICWVSWEDICKPKKEGGLGVKNLEVFNISFLAKWKWRCIHDHNALWRDLLAFRYGNLIAKQTCSLDRSWGTKDSIWWRDLMLLEKDLSQNQNFFQRAVSCDVGDGQSILFWYNKWLGSEPLKDAFPELFAISSQQLVSVGNAGSWRRDQWTWGLTWKRQLNPNEEESLHSLETILVDVHLAAESHDRWKWSLHNSKLFTVSNNSIFKEEEKDIPKTINQIKHICWAWFMGKVGGKINSNTMSRCTLIITQWIQKPFR

SEQ ID NO: 211581 - protein, 173 aa, Glycine max
  Coding DNA Sequence Number=SeqID_94803
  Gene Ontology: Cellular component=nucleus; Biological process =regulation of progression through cell cycle
  Homolog annotation: Hit_ID=Q6ZIX9; Match level="QueryCoverage=82%, HitCoverage=13%, E-value=4e-50, Identity=64%"; Hit description =Cyclin-like protein
MGVMSRQVVPVCGNLCCVCPALRASSRQPVKRYKKLLADIFPRNQEAELNDRKIGKLCDYASKNPLRIPKITDNLEQICYKDLRYETFGSVKVVLCIYRKFLSSCKEQMPLFAGSLLEIIRTLLEQTRTDEIRILGCNALFEFLDCQFMKAVKMDTTEGQKSYFPFVVVAWWC

SEQ ID NO: 211582 - protein, 463 aa, Glycine max
  Coding DNA Sequence Number=SeqID_94804
  Gene Ontology: Cellular component=nucleus; Biological process =regulation of progression through cell cycle
  Homolog annotation: Hit_ID=Q5N857; Match level="QueryCoverage=94%, HitCoverage=47%, E-value=6e-75, Identity=37%"; Hit description =Cyclin-like
MDLDEIISVTLENYPSLQSNSKRVMEDKLNLESLDLLVQGFPKLEDPSTDITKKDPLLLKAVTGTEIDYVLNTAKDPTYWSKVCLYHMVKLAREATTLRRVLEPLFHYFDTENQWSSEKGVADHVLMYLQSLLAESGDNSCLLLSILVKHLDHKNVAKQPILQINIINTTTKLAQNLKQQASVAILGAISDLIKHLRKCLQNSAEASSTGNDGLKLNTELQFALEMCILHLSKKVGDVGPILDLMAVVLENISSTAIIAGTTISAVYQTAKLIMSIPNAFPDALFHQLLLAMAHPDHETRVGAHSIFSLKVPSESFSIQHESFLGAEQINGKSMEGKAVFSVSGKYAVHPYHGHILSGALTDGQHELSSFRLSSHQVSLLLSSIWVQATSLDSGPANFEAMAHTYSIALLFTRSKTSSYMALVRCFQLAFSLMSLSLDQEASWGCLHCAGFERGLFGPVFVVI

SEQ ID NO: 211583 - protein, 372 aa, Glycine max
  Coding DNA Sequence Number=SeqID_94805
  Homolog annotation: Hit_ID=Q9LXF9; Match level="QueryCoverage=39%, HitCoverage=91%, E-value=4e-54, Identity=67%"; Hit description =Ribosomal protein L27-like
  Pfam annotation: Domain name=Ribosomal_L27; Domain location=268-349; Score=162.3; E_value=1.2e-45; Accession=PF01016.9; Description =Ribosomal L27 protein
MVILELPLWNGYSKMLVPEWRKGTKEESWEEHHAVEGVRNVGGGGAPLGKEEPSRRREVLGLGEKMLIHMVNAYWAGHREPDEIRFVRIRVAHYRNIWRFGLELSVNEEKRRRLRTTTKKGFWFWTLKETQSDAFHRSFAQTLTSSSCIHSPRSAISLLQGRQRLKGRGTLRNKFPSTRMRGLEDIFGIIPFWIFYRLPGARGIEVPKENSKAMSEQCVFLSIANSMNFAASLCRRLNIKELVTYVPVYRSTSGVSGEGLNLAFRRWASKKTAGSTKNGRDSKPKNLGVKKFGGERVIPGNIIVRQRGTRFHPGNYVGLGKDHSLFALKEGWVKFERNKLTGRKWVHIEPKEGHVLHPLYAADGSASELKVA

SEQ ID NO: 211584 - protein, 67 aa, Glycine max
  Coding DNA Sequence Number=SeqID_94806
MGMLTNETHLSAENGGKAKGMNKQFPKDITDKPEKGTVPYMIELVVQLNVAAEFVRLPPLLEPVDIV

SEQ ID NO: 211585 - protein, 325 aa, Glycine max
  Coding DNA Sequence Number=SeqID_94807
  Homolog annotation: Hit_ID=Q2R7H6; Match level="QueryCoverage=80%, HitCoverage=87%, E-value=4e-71, Identity=48%"; Hit description =Expressed protein
MEVSASASRRRNNSICIKISLLILVIFHFSSTITAIRKDVGFQIIHPCKTTVQGRYLLSDDNGYVCNAASVNSRSRCCPQRGEKFSCHGCNLLSQCCNSYEYCVSCCLNPALISKEQVLKMKVAKPTTASNSFIWSLGLTSLDILPISYIFASTMNAFLIRIVAYTHHLIFWPGTYSSVFDYCAGRCRHSSESVVHENAYISDFHHCFSLSSNSSGKNSTLTEARLSGINVVVGRQGESCNSVCKSRGQSCVPNKLVVLNSCDIIQKYMSCKGSCLASVGADQPAEVVYDAPVHLNPGSCLYTETQSILSCDGLHQHTRRLCPCA

SEQ ID NO: 211586 - protein, 567 aa, Glycine max
  Coding DNA Sequence Number=SeqID_94808
  Gene Ontology: Mol. function=carbohydrate binding; Biological process= carbohydrate metabolic process
  Homolog annotation: Hit_ID=Q1SPM1; Match level="QueryCoverage=99%, HitCoverage=99%, E-value=1e-84, Identity=37%"; Hit description =Glycoside hydrolase, starch-binding
  Pfam annotation: Domain name=CBM_20; Domain location=92-183; Score =25.5; E_value=3.5e-07; Accession=PF00686.10; Description=Starch binding domain
MMKALTSSCSKAMVETLGPFSPRVPLCVSDRPEFCFTLRSKNEKKGWNLLLLKLVRNNDLYPVHAVPPKDQVDLETVEPQAQQSEQTNESKFVHVSFQLEKSCNFGEQFLIVGGDPVLGSWDPLEALPMTWSEGHVWAVELDMPAGQTFQYKFILEGEGGDIIWQPGSDRLIHTWETKNRIVVLEDWENVELQKITEEDQLAEPNEEPQVDFEVPTLAEFLNNPQEELDSKASEISSVEDTQIQSVEEPLAETVRQQITENISSSGDLISSISHKSNKKSILQPSEESADSPGNDIRTLKEDQLAEPNEEPQVDFEVPTLAEFLNNPQEELDSKALEISSVEDTQIHAVEEPLAETVRQQITGNSISSSMEKPMSIVVENISSSGDLISSISHKSNKKSILQPSEESADSPGNDDIIHDLGQNGNPASLENQEKTIVESSLFDLEEGPVLVPGLPIPPTEPTDEADQGEVQETTKKDTSVEAFETQDQNIAKFSKEEETDDAIPQEINATINNGPELLYNKQHEESHLSPEMEDWPNYEPDDDNTVQNDIKWGQDTVNKFLTKLGFF

SEQ ID NO: 211587 - protein, 236 aa, Glycine max
  Coding DNA Sequence Number=SeqID_94809
  Gene Ontology: Mol. function=protein dimerization activity; Cellular component=nucleus; Biological process=regulation of transcription, DNA-dependent
  Homolog annotation: Hit_ID=Q9ZPY6; Match level="QueryCoverage=99%, HitCoverage=32%, E-value=1e-77, Identity=63%"; Hit description=Auxin response factor 11
  Pfam annotation: Domain name=B3; Domain location=147-236; Score=77.7; E_value=3.6e-20; Accession=PF02362.12; Description=B3 DNA binding domain
MYEPLWKGCAGPLVDVPRVGQRVFYFPQGHMEQLEASTNQELNQRIPLLKLPTKILCRVVNVHLLMVEGGILVFLEFLLSCKVLNCGCSGNYDTTLVVTCEKLWTNEAEQETDEVYAQITLVPESNQDEPMNPDPCTAEPPRAPVHSFSKVLTASDTSTHGGFSVLRKHAMECLPALDMSQPTPTQELVAKDLHGYEWRFKHIFRGQPRRHLLTTGWSTFVTSKRLVAGDTFVFLR

SEQ ID NO: 211588 - protein, 124 aa, Glycine max
  Coding DNA Sequence Number=SeqID_94810
  Subcellular localization annotation: CTP_CleavageSite=50; ConfidenceScore=5.00e-01
MKPYSSPTTRIFTRHYIRPKSRHLHHFSFIFRSISKPKTLFFLAPTSEIVTESDSAENMAQLEEEKARRRRERSPEQGKNTVQRSRFSIRRRRLRSALRRYYRIMRNFRRRLQGSSRIASSCSY

SEQ ID NO: 211589 - protein, 115 aa, Glycine max
  Coding DNA Sequence Number=SeqID_94811
  Gene Ontology: Cellular component=chloroplast envelope
  Homolog annotation: Hit_ID=Q9SJX7; Match level="QueryCoverage=76%, HitCoverage=20%, E-value=1e-36, Identity=84%"; Hit description =Expressed protein
METIKFAFGLVFFFTAFFSCFTFVAIDALYDIGTGLEVLSPWCPHLFLEMAGLGNFAKGMAVVAARATRLPIYSSFSKEGNLSDLFAKEEEFSTLFNVIGIGVGIQLASTICASM

SEQ ID NO: 211590 - protein, 190 aa, Glycine max
  Coding DNA Sequence Number=SeqID_94812
  Gene Ontology: Mol. function=chromatin binding; Cellular component =chromatin; Biological process=chromatin assembly or disassembly
  Homolog annotation: Hit_ID=Q1SAV4; Match level="QueryCoverage=57%, HitCoverage=33%, E-value=6e-20, Identity=41%"; Hit description =Integrase, catalytic region
AHENPRAFSCIFGPIFLESSIQCPWGVGLHQTPPFRPFEVTANGAQAITRKLAKRFYGFFQVLECIGPVAYKLQLPEGEQIHPVFHCSKLKPFRRSTENVEGTPLPAEEVLVQWDGLSLDDTTWEDWEQLCNNYHLEDKVVFQGSKDDTNELAEAQTGTQAGGISDEREVQVATKTKRRIIKPAYLNDYV

SEQ ID NO: 211591 - protein, 133 aa, Glycine max
  Coding DNA Sequence Number=SeqID_94813
MLKDFDPIDKVMRILKLAKYRLKAQVEKDEGPSGEGQSPRVEKDEGPSSLLNQSQTYQGNPCGVYPDLSSFTGSGVYPDLSSLSRGGVIQKNSITCIKRSVPSHTLTYLPSPEVASTLTYLPSPEVASSKRTP

SEQ ID NO: 211592 - protein, 96 aa, Glycine max
  Coding DNA Sequence Number=SeqID_94814
MKQTLESVFNRHRYIVCLPIPEPARSFVYYWANFARFTCFQLPEENNFRSLLPPLILVLLVTVIALFIHFLLSPKELAIEVKRNEDGSFTRNDGVA

SEQ ID NO: 211593 - protein, 121 aa, Glycine max
  Coding DNA Sequence Number=SeqID_94815
  Gene Ontology: Cellular component=membrane
  Homolog annotation: Hit_ID=O98447; Match level="QueryCoverage=29%, HitCoverage=4%, E-value=8e-10, Identity=75%"; Hit description=ClpC protease
MAVLIRMESISIKRVHGLAKILGSVLSLVGAITFALVKGPHLGFMKWYLENQNHTSYPLTIVHSKGDTIRGSLLMLSANTAWSLWCIGASTMDEYRKHIEKDPALERRFQPDETIQILKRT

SEQ ID NO: 211594 - protein, 671 aa, Glycine max
  Coding DNA Sequence Number=SeqID_94816
  Gene Ontology: Mol. function=protein serine/threonine kinase activity; Cellular component=integral to membrane; Biological process=protein amino acid phosphorylation
  Homolog annotation: Hit_ID=Q948R7; Match level="QueryCoverage=85%, HitCoverage=63%, E-value=0.0, Identity=65%"; Hit description=CR4
  Pfam annotation: Domain name=Pkinase; Domain location=218-504; Score =128.1; E_value=2.5e-35; Accession=PF00069.15; Description=Protein kinase domain
  Pfam annotation: Domain name=Pkinase_Tyr; Domain location=218-491; Score=105.3; E_value=1.7e-28; Accession=PF07714.7; Description =Protein tyrosine kinase
  Pfam annotation: Domain name=TNFR_c6; Domain location=49-96; Score =9.9; E_value=0.075; Accession=PF00020.9; Description=TNFRNGFR cysteine-rich region
  Pfam module annotation: Pfam domain module=Pkinase::Pkinase_Tyr::TNFR_ c6; Domain location=218-504::218-491::49-96
IKVFEVAAGDYFTCAVLADKSLMPLCWGVGFPTSLPLAVSPGMCQPSPCAPGSYAIDKHKSLCKSPDSRVCMRCSGACPPEMYLKSACNLAYDRVCEYNCSSCSSSECFLNCSSSYSNAAASTEKKSEKIWALQLPVLIAEIAFAVFVVSIMSITTVLYVRYRLRDCECSKGSGVKKLGGNSSFQNENKVRPDLEELNKIRRAQIFTYEELETATGGFKEESIVGKGSFSCVFKGVFKDGTVVAVKRAIVSPNMQKNSKEFNTELDLLSRLNHAHLLNLLGYCEEGEERLLVYEFMAHGSLHQHLHGTNQVLREQLDWIRRVTIAVQAARGIEYLHGYACPPVIHRDIKSSNILIDEEHNARVADFGLSLLGPADSGSPLAELPAGTLGYLDPEYYRLHYLTTKSDVYSFGVLLLEILSGRKAIDMQYEECNIVEWAVPLIKSGDITAISDPVLKPPPDLEALKRIANVACKCVRMRGKERPSMDKVTTALERGLAQLMGSPCIEQPILPTEVVLGSNRLHKKSSQRSSNRSVSETDVAETEDQRFEFRAPSWITFPSVASSQRRKSSVSEEDVDGKNNNAEGKTWAMLMLAIAPSLSSQHRHWITGVASGRVAASSSHHRPHGFKKLWWFTTSRLSVCRVVELANEFGIAGEVRCISTMSQKNESNFVAE

SEQ ID NO: 211595 - protein, 104 aa, Glycine max
  Coding DNA Sequence Number=SeqID_94817
MANEELKLQDPRCRIQCPDILPENTGVAIFRKEDRSPPAQAVAAQKRRVLYNHERCTSSVPSPGLKRLISLVQKLISGCKQGLLDLELTLLRVDFLPGLVAPRC

SEQ ID NO: 211596 - protein, 560 aa, Glycine max
  Coding DNA Sequence Number=SeqID_94818
  Gene Ontology: Mol. function=protein binding; Cellular component =nucleus; Biological process=cytoskeleton organization and biogenesis
  Homolog annotation: Hit_ID=Q1RXV5; Match level="QueryCoverage=98%, HitCoverage=96%, E-value=1e-106, Identity=43%"; Hit description =Cyclin-like F-box
  Pfam annotation: Domain name=F-box; Domain location=2-50; Score=18.9; E_value=0.019; Accession=PF00646.23; Description=F-box domain
  Pfam annotation: Domain name=LRR_1; Domain location=171-195; Score =7.5; E_value=11; Accession=PF00560.23; Description=Leucine Rich Repeat
  Pfam annotation: Domain name=LRR_1; Domain location=259-284; Score =1.5; E_value=1.5e+02; Accession=PF00560.23; Description=Leucine Rich Repeat
  Pfam annotation: Domain name=LRR_1; Domain location=337-360; Score =6.4; E_value=18; Accession=PF00560.23; Description=Leucine Rich Repeat
  Pfam annotation: Domain name=LRR_1; Domain location=363-393; Score =1.9; E_value=1.3e+02; Accession=PF00560.23; Description=Leucine Rich Repeat
  Pfam annotation: Domain name=LRR_1; Domain location=394-414; Score =1.4; E_value=1.6e+02; Accession=PF00560.23; Description=Leucine Rich Repeat
  Pfam annotation: Domain name=LRR_1; Domain location=420-444; Score =7.5; E_value=11; Accession=PF00560.23; Description=Leucine Rich Repeat
  Pfam annotation: Domain name=LRR_1; Domain location=469-495; Score =9.1; E_value=5.5; Accession=PF00560.23; Description=Leucine Rich Repeat
  Pfam annotation: Domain name=LRR_1; Domain location=520-545; Score =4.1; E_value=48; Accession=PF00560.23; Description=Leucine Rich Repeat
  Pfam module annotation: Pfam domain module=F-box::LRR_1::LRR_1::LRR _1::LRR_1::LRR_1::LRR_1::LRR_1::LRR_1; Domain location=2-50::171 -195::259-284::337-360::363-393::394-414::420-444::469-495::520-545
MMSVKNFPEECWELVFRFIGHGRHLESLSLVCKQFLSITNRLQFSLTIHDPTIPVLPRLLLRFPRLRILDLSHLNSHHEGLLRQISQSGLELDLLNLSNQRTLPVDGLRELGSKMKNLRVLICSNIGSLRDSHLVVMAYCFPFLEELDISFPLDSQASDFGVLRLSSMLENLRKINISGNYLITDKSLFSLCQNCLSLQEISFFTCFKITQLGIASAIRLRPGLNSISFNIEKKRIHGPGLTLAPIDLDLIDSFSSLKRLTAIDLSNSVISDEFLFAVAEGGGLLLKKLILQNCCNCTFSGISYVLSKCQSVQCLDLRKADFLTDQCIRKLSLFLLNLTSINLSGCCQLTNSTFFILTRNCSSLSEIKMERTYLGVEGEEEEEDSMPDSFVNLEVKKLYLGDNVLLSDASLIKFVSICPSLQLLDLTGCEGVSGECIGDVLKRCCEIRHLNLAYTGMKVFEMMDFEVSQLEVLNLSGSRIEDEALSIISKRCSGLLLLDIQSCWHVTPKGVGEIVEKCRTLKELNLKNCRLVSDDFVAWVEISRPSLRTITTPSDVGVYC

SEQ ID NO: 211597 - protein, 253 aa, Glycine max
  Coding DNA Sequence Number=SeqID_94819
  Gene Ontology: Mol. function=catalytic activity; Biological process =cellular metabolic process
  Homolog annotation: Hit_ID=O22810; Match level="QueryCoverage=98%, HitCoverage=90%, E-value=6e-55, Identity=46%"; Hit description =Putative cinnamoyl-CoA reductase
  Pfam annotation: Domain name=3Beta_HSD; Domain location=6-237; Score=- 151.7; E_value=0.089; Accession=PF01073.9; Description=3-beta hydroxysteroid dehydrogenaseisomerase family
  Pfam annotation: Domain name=Epimerase; Domain location=7-183; Score=- 65.4; E_value=0.073; Accession=PF01370.11; Description=NAD dependent epimerasedehydratase family
  Pfam module annotation: Pfam domain module=3Beta_HSD::Epimerase; Domain location=6-237::7-183
LHFPWNCQRTCYSEISTLAQTPRSTLFKADFLNYESLCSAISGCTAVFHLACPVETIEPAVKGTTNVLEAKVQRLVFVSSIVAISINPNLPKDKVIDESYSSDKDYCKRTRTEAEEQALDFAKRTGLDLSTTVNTSSLVLLKLLKGVDSLEKKIRWIVDVRYVVYAILLTYEKLEAKGRYVFHSHNIKTRDMLEKLKSIYPSYKYPANYTEVDDYISFSSEKLQRLGWKYRSLEEALIDSVESYREAGLLQSE

SEQ ID NO: 211598 - protein, 944 aa, Glycine max
  Coding DNA Sequence Number=SeqID_94820
  Gene Ontology: Mol. function=hydrolase activity, acting on acid anhydrides, catalyzing transmembrane movement of substances; Cellular component=integral to membrane; Biological process =metabolic process
  Homolog annotation: Hit_ID=O22613; Match level="QueryCoverage=99%, HitCoverage=98%, E-value=0.0, Identity=78%"; Hit description=Plasma membrane proton ATPase
  Pfam annotation: Domain name=Cation_ATPase_N; Domain location=2-65; Score=46.4; E_value=9.5e-11; Accession=PF00690.16; Description =Cation transporterATPase, N-terminus
  Pfam annotation: Domain name=E1-E2_ATPase; Domain location=78-299; Score=307.8; E_value=2e-89; Accession=PF00122.10; Description=E1-E2 ATPase
  Pfam annotation: Domain name=Hydrolase; Domain location=303-589; Score=54.8; E_value=2.8e-13; Accession=PF00702.16; Description =haloacid dehalogenase-like hydrolase
  Pfam module annotation: Pfam domain module=Cation_ATPase_N::E1-E2 _ATPase::Hydrolase; Domain location=2-65::78-299::303-589
MIVFKEKIPLEQVFAQLNCSEEGLTTEEGLKRLQESKVLKFLGFMWNPLSWVMEAAAVMAIAMANGGGKPPDWQDFVGILALLVINSTISFIEENNAGNAAAALMAGLAPKTKVLRDGKWTEEDAAILVPGDIISIKLGDIIPADARLLDGDPIKIDQSALTGESLPVSKNPGDEVFSGSTVKQGELEAVVIATGVHTFFGKAAHLVDSTNQVGHFQKVLTAIGNFCICSIAVGMVIEIIVMYPIQHRPYRSGIDNLLVLLIGGIPIAMPTVLSVTMAIGSHRLSQQGAITKRMTAIEEMAGMDVLCSDKTGTLTLNKLTVDKTLIEVFAKDADKDIVILLGARASRVENQDAIDACIVGMLGDPKEARDGIKEVHFLPFNPVDKRTAITYIDINGNWHRASKGAPEQIIHLCNVREDVKKEAHAIIGKFADRGLRSLAVAKQEVPEKTKESPGGPWQFVGLLPLFDPPRHDSAETIRRALHLGVNVKMITGDQLAIGKETARRLGMGSNMYPSSSLLGDHKDESIAALPVDELIEKADGFAGVFPEHKYEIVKILQDRKHICGMTRDGVNDAPALKKADIGIAVADATDAARGASDIVLTEPGLSVIVSAVLTSRAIFQRMKNYTIYAVSITIRIVLGFLLLALIWKFDFSPFMVLIIAILNDGTIMTISKDRVKPSPRPDSWKLNEIFVTGIVLGTYLAIMTVVFFWAAHASDFFTEKFGVRPIRNNQDELTAAVYLQVSIVSQALIFVTRSRNFSFLERPGLLLVTAFVIAQLIATIIAVYANWGFARMKGIGWGWAGVIWLYSIIFYIPLDFLKFGIRYFLSGRAWNNITENKFAYTYACLFVRYDMQTAFTTKKDYGKEEREAQWVTAQRTLHGLNPPETEQIFSEKNKYRELSDIADQARKRAEVARLRELYTLKGHVESVVKLKGLDIGTIQQHYTV

SEQ ID NO: 211599 - protein, 232 aa, Glycine max
  Coding DNA Sequence Number=SeqID_94821
  Subcellular localization annotation: CTP_CleavageSite=34; ConfidenceScore=5.78e-01
MVNGDGGSSGSGTKFSRGSSGNSGGAKKTSGVPSGSSGVSGTVKTGGVERNGVGSSGGGKEMSGSVGVERKGGEGENGTCGGALLMKGFGGGRTRGGKRVGAGGAGGRGGGEGDGGGGGNGQQGEAGGGEHSGGGGDSDGQAGGGGGGGGGAEYCTGGGILGLNAACTCIQTRSNNYTEIRTRDTAEKKHGELMEGIEEMPSCTCQYNAVVSEVFIGRWHSSLTEGLHFAKK

SEQ ID NO: 211600 - protein, 116 aa, Glycine max
  Coding DNA Sequence Number=SeqID_94822
  Subcellular localization annotation: CTP_CleavageSite=58; ConfidenceScore=5.36e-01
MGVQIATRPTWALQKIPPEDGCFWRRSPCSPGRARKSETRRFRKVSVTFPWGFSRIFSAVLQRSSVVLHRSSVFNGKDKDNLTKHFVHKELRRSDFLIAIKEYIGARETPSSTAKR

SEQ ID NO: 211601 - protein, 57 aa, Glycine max
  Coding DNA Sequence Number=SeqID_94823
MVSKVWSFDGGFNGEEEEGNSNMRLCHMSPFEWSKKGPTFSLDVTHTQPQEEKNLTF

SEQ ID NO: 211602 - protein, 344 aa, Glycine max
  Coding DNA Sequence Number=SeqID_94824
  Gene Ontology: Mol. function=protein binding; Cellular component =integral to membrane; Biological process=positive regulation of enzyme activity
  Homolog annotation: Hit_ID=Q8L9G7; Match level="QueryCoverage=76%, HitCoverage=96%, E-value=2e-77, Identity=55%"; Hit description=Gamma- secretase subunit APH1-like
  Pfam annotation: Domain name=Aph-1; Domain location=1-266; Score =319.7; E_value=5.2e-93; Accession=PF06105.3; Description=Aph-1 protein
  Subcellular localization annotation: CTP_CleavageSite=48; ConfidenceScore=5.21e-01
MTVAAGIGYALVALGPSLSLFVSVISKKPFLILTVLSSTLLWLISLIVLSGIWRGVLPLSTTASWPFGILIFSSVAFQEALRLFFWKIYKRLEDMLDAFADRVSKPHLHLTDKMLIALAGGLGHGVAHAVFFCISLLTPAFGPATYFVDRCSRVPFFLLSAIIALAFVIIHTFSMVIAFNGYTEGNKVDQYFVPIVHVVAGMVICEVGKMINSNMLGCRERISPNKTLVNLAPGGCAVGIPLLYLVAILTLIHCGRMVWRKLTENPIRPVHSYFLVLAIPVGIHKDTESYNAQKFFLDVMFSSYNGLLCGQVNFLHLSVSLIVTAIRFTEVLVADAGLLKVLIV

SEQ ID NO: 211603 - protein, 35 aa, Glycine max
  Coding DNA Sequence Number=SeqID_94825
MWFSEWKQGCLLALFGKGYMWNLIHFNILMYGFLN

SEQ ID NO: 211604 - protein, 270 aa, Glycine max
  Coding DNA Sequence Number=SeqID_94826
  Gene Ontology: Mol. function=4 iron, 4 sulfur cluster binding; Cellular component=intracellular; Biological process=base-excision repair
  Homolog annotation: Hit_ID=Q9FT83; Match level="QueryCoverage=88%, HitCoverage=67%, E-value=1e-102, Identity=73%"; Hit description =Endonuclease III homologue
  Pfam annotation: Domain name=HHH; Domain location=132-161; Score =30.1; E_value=8e-06; Accession=PF00633.13; Description=Helix-hairpin- helix motif
  Pfam annotation: Domain name=HhH-GPD; Domain location=66-210; Score =71.7; E_value=2.3e-18; Accession=PF00730.15; Description=HhH-GPD superfamily base excision DNA repair protein
  Pfam module annotation: Pfam domain module=HHH::HhH-GPD; Domain location=132-161::66-210
MGSDAIPVASEVASTRSSGESPAQWEKVLEGIRKMRCSADAPVDTMGCEKAGETLPPKERRFAVLVSSLLSSQTKDPVTHGAIQRLLQNDLLTADAINDADEETIKKLIYPVGFYTRKASNLKKIANICLMKYDGDIPSSIEQLLLLPGIGPKMAHLVMNVGWNNVQGICVDTHVHRICNRLGWVSRLGTKQKTSTPEETREELQRWLPKEEWVPINPLLVGFGQTICTPLRPRCGECSISELCPSAFKETSNSSPSSSKSKKSGLNKRV

SEQ ID NO: 211605 - protein, 289 aa, Glycine max
  Coding DNA Sequence Number=SeqID_94827
  Homolog annotation: Hit_ID=Q1RZ08; Match level="QueryCoverage=77%, HitCoverage=31%, E-value=1e-17, Identity=32%"; Hit description =Peptidase aspartic, active site
MSLTGTVNDDATATNSPCCSEVSGSVSYCGCSSYNSSTHLCVKCDFNCDSLLTLENEDSKWMISDSKPYYGCCSSEKPSSPLSTNGIIHFDRSEDNNISVEHLLEIEGMQEFNADEPLFWPFEGKFNWNYSEESRSPFCISPRKKVVFGSRSMTSRIEESKRKDDGSECSVTSEPSRIVMPSKGSALVVNSELNDEKVVLKSRDGNKLIFVDNLNEDHGPNYELLPLARGDFSLDQEPEIPIEALVGLKEFDGHEGLDSEFNGDDVFMLEESLLITHASECVVSKKDEY

SEQ ID NO: 211606 - protein, 56 aa, Glycine max
  Coding DNA Sequence Number=SeqID_94828
MPRKNRAQCLNSKEEKKFNPKQSMGQKLEFCKLSGHTDVSELSSIGKFDGPLIVVH

SEQ ID NO: 211607 - protein, 134 aa, Glycine max
  Coding DNA Sequence Number=SeqID_94829
  Gene Ontology: Mol. function=transcription factor activity; Cellular component=nucleus; Biological process=regulation of transcription, DNA-dependent
  Pfam annotation: Domain name=AP2; Domain location=1-53; Score=69.4; E_ value=1.2e-17; Accession=PF00847.10; Description=AP2 domain
GRWSAEIRDRIGRCRHWLGTFDTAEEAARAYDAAARRLRGAKARTNFQIPSVLPLSPEGVHGGAVKPKTARNNARKCSSVEQLFSGVPQLRKDDGIGENGNVEVSCRIYKCTTEIQFLLDLQLAVAVAVGEKLP

SEQ ID NO: 211608 - protein, 250 aa, Glycine max
  Coding DNA Sequence Number=SeqID_94830
  Gene Ontology: Biological process=protein modification process
  Homolog annotation: Hit_ID=Q1S0J6; Match level="QueryCoverage=48%, HitCoverage=33%, E-value=1e-20, Identity=49%"; Hit description =Ubiquitin; Apoptosis regulator Bcl-2 protein, BAG
MCWEDGARRPQRLLRRLRERVELQEFSQGSCPPSLALQGMLWSTIGDQLLASPILDGKALLYSFISTPEVRIGVAFGSNGSQSLPATEWPGISSWLLVPGGAGELKKMLTEPTGLHVQDRKLIYKKKERDSKSYLDVERVKDGSKLVLLVDIESRKRRLLEMLKIAKKEKTLKSLTEIKVEVDKLAKKRREQGMTIVGGCRYRRAIPVGLRGLLDIDADYGIRKAFLPQMRQRLLLEINQQLIKQLARTA

SEQ ID NO: 211609 - protein, 115 aa, Glycine max
  Coding DNA Sequence Number=SeqID_94831
  Homolog annotation: Hit_ID=Q9FGJ3; Match level="QueryCoverage=43%, HitCoverage=26%, E-value=3e-12, Identity=70%"; Hit description =Nuclear transcription factor Y subunit B-2
MYELFYDGYRNRRCKGKNFRRIHLHSRAHKELCQEQHQYAAPAIELSPERCESFWEGSHGLLSFHSLEALEVAFEKLHVVLEAQSGHRPEQVVAVDRLALLALETCFANFEKNCN

SEQ ID NO: 211610 - protein, 86 aa, Glycine max
  Coding DNA Sequence Number=SeqID_94832
MEKNLLANLMQKPMRLFFLVFRIKDTALEDETKVEELEQSKEITVTLLLRCPFQQLQKYLILLDLLEQHVRVVSSVLCNLHWVHLL

SEQ ID NO: 211611 - protein, 124 aa, Glycine max
  Coding DNA Sequence Number=SeqID_94833
  Gene Ontology: Mol. function=binding; Biological process=thiamin biosynthetic process
  Homolog annotation: Hit_ID=Q1S1R8; Match level="QueryCoverage=92%, HitCoverage=37%, E-value=8e-39, Identity=52%"; Hit description =Tetratricopeptide-like helical
MDVKHDATVWKALLAACRVHGITKEPGCSWIKMNYRVHTFISEDRGHPREAEICSKIDEIVRRTKEVGYVPDMNFLLHDMDTEGKEVGLAYHSKKSDVALGLLASQTGAPIRMLKNEFVEIVLL

SEQ ID NO: 211612 - protein, 112 aa, Glycine max
  Coding DNA Sequence Number=SeqID_94834
MTLYGFYNFSNDQDLDKVYTFGLCRGNQPSGRDVLDGTKNEMGLMDQFNEALNSLVRNPFVDLSPLPSLCWKPPKPMPALARGPGFDRREQESPRREGPSTTMGIGLENFES

SEQ ID NO: 211613 - protein, 107 aa, Glycine max
  Coding DNA Sequence Number=SeqID_94835
MFRQAGMSSRKRKNVGSRPTAQYDTRRFHSFEAWTRYTDNVLGRHILAERKVEIYHTKLDEFKGELERRNFHKRLTNLADSSIDLALVKEFYANLYSLWKQRLPRLF

SEQ ID NO: 211614 - protein, 114 aa, Glycine max
  Coding DNA Sequence Number=SeqID_94836
  Subcellular localization annotation: CTP_CleavageSite=47; ConfidenceScore=5.27e-01
MGRLVGFTKNNTGLSDTGVPLSRNCYGPAALSGTKLSKNFTKLWRLSEQERSAQQMPQGFSLGVGDSGLACGQSVRKNFTKLPELRKSASLSAQCALSKCSYKHLYSGKNSLRA

SEQ ID NO: 211615 - protein, 46 aa, Glycine max
  Coding DNA Sequence Number=SeqID_94837
MLSILDDFCRGLRWGGYGVEGGAARRRGCRQPWPWQPTGRRRSWTS

SEQ ID NO: 211616 - protein, 177 aa, Glycine max
  Coding DNA Sequence Number=SeqID_94838
MVKRRRRLLKYLKRTDWDSYCFVISKLELRDNPDHGYKTRSIWCGSIGSHIWWSDERKPKIRKMEKDNQPVDGKPAGLCRFHSGQSGCSAESPVFQKNNLNNIQAVNQTAAHLIPILITCSSHKWRMNEHWVKGSAAAREAQGWRARCKWGGYDNVCCGCINMEWNRKGRIAGQFLI

SEQ ID NO: 211617 - protein, 59 aa, Glycine max
  Coding DNA Sequence Number=SeqID_94839
EVLVWGHPIWFLLFSDHNFLNIYGRSLERLLDDSLEVSDLLGAGQLGEQVCSGIAFPGD

SEQ ID NO: 211618 - protein, 50 aa, Glycine max
  Coding DNA Sequence Number=SeqID_94840
MEEDYKLVAQPQRRHNPTMKEVVRKEVVKLLEKGMIYPISNSQWEAQQSH

SEQ ID NO: 211619 - protein, 144 aa, Glycine max
  Coding DNA Sequence Number=SeqID_94841
  Gene Ontology: Mol. function=ribonuclease H activity; Cellular component=mitochondrion; Biological process=DNA integration
  Pfam annotation: Domain name=rve; Domain location=2-143; Score=73.0; E_value=9.6e-19; Accession=PF00665.16; Description=Integrase core domain
MAGPWPFSMWGIDVIEAIEPKASNRHRFILVAIDYFTKWVEAASYSSIMRNVVVRFTKREIICRYGLPRKIITDNATNLNNKIMKEMCEDFKIQHSNSTPYRPKMNEAVEAANKNVKKIIQKMTVSYKDWHEMLPFTLHDYWTS

SEQ ID NO: 211620 - protein, 257 aa, Glycine max
  Coding DNA Sequence Number=SeqID_94842
  Gene Ontology: Mol. function=RNA-directed DNA polymerase activity; Cellular component=intracellular; Biological process=RNA-dependent DNA replication
MHLSGWSTCEMNYSLLERICYALVWASHRLRKYMLSHTTWLVSKMDPVKYIFEKPALTGQIEEKLEDKDKEKWVMWFDGASNPLGHRVGAALVSPDNQCIPFTAILGFDCSKNMAEYEACTLEIQASIDINIKLLKLTLHGDLPYIEFRCCGKLAHCCLIEEEQDGKPWYFDFKRYVERKEYPPEASDNDKRMLRTLVTGFFLSGSVSYKRNHDMVLLRCVDVKEAERRIVEVHEGSFGSHANGHAIARKILRAGYY

SEQ ID NO: 211621 - protein, 263 aa, Glycine max
  Coding DNA Sequence Number=SeqID_94843
  Gene Ontology: Mol. function=helicase activity; Biological process =viral genome replication
  Homolog annotation: Hit_ID=Q2QP74; Match level="QueryCoverage=63%, HitCoverage=19%, E-value=1e-24, Identity=36%"; Hit description=AT hook motif-containing protein, putative, expressed
MMDFFGGATQCLIKDLAGKEKHEHLVNGHTINASSIQTNLLSKFGKENITSSNLKPPSTSKVHTTTGAVPIQNGTTSQHIHSGRYTIHKSKLIEHISDDSEEEFNITQGNIHIGPTYNDIGDLFWQCNHCKAMMWYDERINKCKQTKNLRFALCCGDGKIQLPLLQHAPQPLRQLLFDTNSSQAKNFQQNIRSYNLMFAFTSPGVKVNTTYNTGRGPSTFRIHGQGHHLIGSLLSMPNNSSKFTQLYIYDTDNKVNNRLSQSP

SEQ ID NO: 211622 - protein, 232 aa, Glycine max
  Coding DNA Sequence Number=SeqID_94844
MKDSTRLDIKSGFPILINCYSSYINFVIHLHVCHSVWHHIEHNLIEVPTTYHRKWAPHYPLYVLFNYNGDKHYIKVRKYYNKCYFADGLKELRRIMGIHEGVMITFAAPEKNWIFHLRFMPPLDIQTCGRPPTISRTHVFTIDVTNVLQLDALNFVDVTTKYMIVLHIHGRRHLWKLIMHNGLQSIAETWYQYLTENDLHVEDEVAFYYRPNQHVWEFIFKKELTWNEEESI

SEQ ID NO: 211623 - protein, 50 aa, Glycine max
  Coding DNA Sequence Number=SeqID_94845
MLSARLALSQISLTRAKHENGAKRAFKRTEEKLSKEAKVLRGGGDIPTAL

SEQ ID NO: 211624 - protein, 337 aa, Glycine max
  Coding DNA Sequence Number=SeqID_94846
  Gene Ontology: Mol. function=peptide deformylase activity; Cellular component=soluble fraction; Biological process=translation
  Homolog annotation: Hit_ID=UPI00005460C3; Match level="QueryCoverage =59%, HitCoverage=44%, E-value=1e-23, Identity=34%"; Hit description =PREDICTED: similar to amplified in osteosarcoma
  Pfam annotation: Domain name=PRKCSH; Domain location=164-238; Score =57.0; E_value=6.1e-14; Accession=PF07915.3; Description=Glucosidase II beta subunit-like prote
MVDWCIDVEAVTFGAVVGTRKWVCVVVRFNETMRALFLFFVLFSFSYATEQIFPAHIGLHHFLLSSFLGFQFQFFTSSSIFGGGGGGRSREPKYKIEFHPEDSPFHPDDDQESIVMPDKTGQKYICYLPKVEKEKSGKPVIQHNISSMIVETEKRIKQKTPDELLEQEGWWSYEFCYQKKLRQLHLEDDKVVQEFVLGVYDPEATAAFNENLSDISTLKDPRSKDASQRYHAHQYTNGTVCDLTNKPRETEVRFVCSEPRAMISSITEISTCKYALTVQCPQLCKHPLFQEERPVWHTIDCNVLPKDHVDAKVRRQNENTEIVIVKDFENSDLESEQ

SEQ ID NO: 211625 - protein, 76 aa, Glycine max
  Coding DNA Sequence Number=SeqID_94847
MEGGGKTLSRFGHVRPCRMKRDRDEDNMSFEKYDILVMLDVKASFREVVWGALSVLCVIFVKDGFSTIDRGAHTNM

SEQ ID NO: 211626 - protein, 60 aa, Glycine max
  Coding DNA Sequence Number=SeqID_94848
MEYWKKHRHGGRGLGRGIKWASIRNLVGKLKVDLLCLQETKRDSLDKAACQALWGHPEID

SEQ ID NO: 211627 - protein, 93 aa, Glycine max
  Coding DNA Sequence Number=SeqID_94849
MDTRLHIHIHISMKPPKTRNHILSICSHACQIQDRHRHGPHVQQHKALHKDSINIHHCHHQPINHQVPKYLHDQGYQYRESTQTRENFVESTR

SEQ ID NO: 211628 - protein, 165 aa, Glycine max
  Coding DNA Sequence Number=SeqID_94850
  Subcellular localization annotation: CTP_CleavageSite=61; ConfidenceScore=5.18e-01
NDVLLDESWTWLSSSRVNSYTLTSLRVYFGPASRLGSKLVFGQTRRGLGGSFAKHDTQWLSARKNPEEDELSDPRGGGDILTTCIFAIFHLVLLYVVKEVSGLWKAKSSVGSSLGNWSDSKVLDSTGLSCCTVTRNRGLIRIRLGYHEESGSSSPGDNIGIHEHC

SEQ ID NO: 211629 - protein, 83 aa, Glycine max
  Coding DNA Sequence Number=SeqID_94851
MVHAGKTLQDKINLQQVASKTTFVWPLNERRYTTERTSCILDVPYWILDLLAGLRTQAEGGEEFHLEFTKCIIVPIFYKDLEP

SEQ ID NO: 211630 - protein, 121 aa, Glycine max
  Coding DNA Sequence Number=SeqID_94852
  Gene Ontology: Mol. function=nucleic acid binding; Cellular component= nucleus; Biological process=DNA integration
MELEQLDVQVAFLHGSLEEDIIMQQPKGFEVQGKENSICRLKKFLYGLRQSPSRHPYDLCVYHIKVKNGSHIYFLLYEDDMLIASQDKSEIQNLKSLLSSEFEMKEIGATEKILCMEIKRD

SEQ ID NO: 211631 - protein, 79 aa, Glycine max
  Coding DNA Sequence Number=SeqID_94853
GLVRARALSADLDRLARISGFWLSALVSLSGRLEDIWMWMLTFKDAVFGIVVEGTFVEGIKEEVVLSPMHALSLIVAGE

SEQ ID NO: 211632 - protein, 465 aa, Glycine max
  Coding DNA Sequence Number=SeqID_94854
  Gene Ontology: Mol. function=transferase activity, transferring nitrogenous groups; Cellular component=cytoplasm; Biological process= ethylene biosynthetic process
  Homolog annotation: Hit_ID=Q9SEJ9; Match level="QueryCoverage=99%, HitCoverage=97%, E-value=0.0, Identity=80%"; Hit description=1 -aminocyclopropane-1-carboxylate synthase 1
  Pfam annotation: Domain name=Aminotran_1_2; Domain location=34-415; Score=471.0; E_value=1.5e-138; Accession=PF00155.11; Description =Aminotransferase class I and II
IANNDKHGENSPYFDGLKAYDRNPFHPKKNPQGVIQMGLAENQLCFDLIEEWIRNNPKTSICTPEGVHQFRNIANFQDYHGLREFTNAMANFMSKVRGGRVKFDADRILMSGGATGANELIMFCLADPGDAFMIPTPFYPGFVRDLCWRTGVQLIPVHCDSSNNFKITREALEVAYKKAKEDNINVKGLIITNPSNPLGTTLDKDTLKSLVSFINEKNIHLVCDEIYAATVFSSPSYVSVAEVIQEMKHCKRDLIHVIYSLSKDMGYPGFRVGIVYSFNDEVVNCGRKMSSFGLVSTQTQHMLASMLSDEKFVTRFLSENSRRLEQRHDKFMKGLEEVNITRFPSNAGLFCWMNLKCLLEEPTFEAELKLWRVIIHEVKLNVSPGSSFNCSEPGWFRVCFANMDDETVDVALNRIRAFVGKETKKPVGFKRWQPNLRLSFSSRMFEESVMSPHSPIPTSPLIGAT

SEQ ID NO: 211633 - protein, 114 aa, Glycine max
  Coding DNA Sequence Number=SeqID_94855
MVLEKYGIEDLDRFIHEIVVSEGSQWWNDLILTCGVGGESRAIGVRALTRDEENGWKWNQGEEEKYVVKEMYLQPHAGNISNEEESSCQLWKLKVPSNIKGFVWKLSYIVCKQS

SEQ ID NO: 211634 - protein, 114 aa, Glycine max
  Coding DNA Sequence Number=SeqID_94856
LITGLCQSFGVPVTPSRVIRPPITRAFIEKYCTPRQAQGDALQAADAPPPPHQADPAGSFGMEWYLQHLVRQQAANHRGQAGEVPAEAPGNAKEARMDEKMTDLLGFLGGSGAT

SEQ ID NO: 211635 - protein, 90 aa, Glycine max
  Coding DNA Sequence Number=SeqID_94857
THLLLEVASLLSLPFSIPLPFIFQEAKESIDEEDPRPTSSNGACITSFPTFKLLFMVSYGEANDSIDEEDPRPTSSTWSYIMWYQEHLHL

SEQ ID NO: 211636 - protein, 92 aa, Glycine max
  Coding DNA Sequence Number=SeqID_94858
MTELKTLSVDYVGNSSSVTSFCDDRKLKVHFPCRNTNTNRIRHLHLRVSCGAVELHLYNVYYTNTKMRVHNTSKTNIYIKTLGSLPKQRQKL

SEQ ID NO: 211637 - protein, 117 aa, Glycine max
  Coding DNA Sequence Number=SeqID_94859
MKVDQENCIKPKVILDFINHRTLENRPRSKAVKNLSYFWRPNSWICFQRFIIKAVNNLSYFMKTLPQQSRGTVEGKRRSRGEVERGGSGSARCSGRIGAVHREREREGNLGRATQQQ

SEQ ID NO: 211638 - protein, 75 aa, Glycine max
  Coding DNA Sequence Number=SeqID_94860
MAKKELVAQRVKEPVESYFEASLSHGLKSQHLEDKVFFYWLGNDRNEEIQQEHNICLNGRPKRKIIPPRHLEDFV

SEQ ID NO: 211639 - protein, 141 aa, Glycine max
  Coding DNA Sequence Number=SeqID_94861
MGKKGRRKEGMRKGKRKERKRGWWEGVCFGINLAKDPWWVLGFTVVVGFLLPLASALVSSPCTQQSPFVLLLPRYWPSSSAPSFPSSEPSCPPLKLLFVSSAIKTKVLPRIGKGLLGTPAEELWKVLPRIPAEEASAGSSA

SEQ ID NO: 211640 - protein, 53 aa, Glycine max
  Coding DNA Sequence Number=SeqID_94862
MEYEHRELRMSWLEHAVLWGVNGCMGSPTVWEVMLSDGVGSVRLERVQCAIGL

SEQ ID NO: 211641 - protein, 100 aa, Glycine max
  Coding DNA Sequence Number=SeqID_94863
  Homolog annotation: Hit_ID=Q9AVI1; Match level="QueryCoverage=82%, HitCoverage=34%, E-value=2e-18, Identity=56%"; Hit description =Putative senescence-associated protein
MVMLQKNNKNKGSYDDEKPRSKRFLVNINIMGSAGPIRFVVNEKELVSGVIDTALKSYSREGRLPVLGFDATNFLLYCANAGFDVYLELYVSFYYVDNHG

SEQ ID NO: 211642 - protein, 214 aa, Glycine max
  Coding DNA Sequence Number=SeqID_94864
  Homolog annotation: Hit_ID=Q1M2Z4; Match level="QueryCoverage=58%, HitCoverage=88%, E-value=3e-09, Identity=31%"; Hit description=Ampk protein
  Subcellular localization annotation: CTP_CleavageSite=67; ConfidenceScore=5.09e-01
SHLETQGIFFSNVSRTIGWESTKKLPCNVASQSSRWDFHRLASSHQAFTAVYPRRPFICRANSMPISLQESASYGDNSIEDEDPSTDLEEETLAKPPTSEQALARLAEEIAQCGIPEGSRKINGKYIHSHLVARLEGIVLLSNGLFLPTLPHLCPYQCKCVVFAYIAVNEQLKEQIKDVDAAQSKEVSVFWVGMAEVNTSRLDFQMFNKNQLDQ

SEQ ID NO: 211643 - protein, 121 aa, Glycine max
  Coding DNA Sequence Number=SeqID_94865
  Gene Ontology: Mol. function=sequence-specific DNA binding; Cellular component=nucleus; Biological process=regulation of transcription, DNA-dependent
  Homolog annotation: Hit_ID=Q43454; Match level="QueryCoverage=56%, HitCoverage=35%, E-value=2e-18, Identity=60%"; Hit description=Heat shock transcription factor 21
  Pfam annotation: Domain name=HSF_DNA-bind; Domain location=39-121; Score=-90.7; E_value=0.028; Accession=PF00447.8; Description=HSF -type DNA-binding
MTTKEVMMTTHVMKEEMDDYIVNRSLSLKPMEGLHEVGPLLFLKKTFGIAEDPHTNPIVSWSQTHDIFIVWDSHKFFKSLLPKYFKHNNFSNFFASSTPIFMDFCTFSPFPLQNCERNIWV

SEQ ID NO: 211644 - protein, 237 aa, Glycine max
  Coding DNA Sequence Number=SeqID_94866
  Gene Ontology: Mol. function=nucleoside-triphosphatase activity; Cellular component=intracellular; Biological process=viral genome replication
  Homolog annotation: Hit_ID=UPI000068CBB0; Match level="QueryCoverage =100%, HitCoverage=30%, E-value=1e-58, Identity=46%"; Hit description= putative helicase
MLFIGDLYQLPPLVRDEHILKMYYQSPFFFDSLAIKEIPLITIELTKVYRQSDQEFLEILNAIRDGDIANIDFEHLNERYDPDFETGQDSYVYLCSHNKMADEINQKKLAEIKVDPSIYEAKLFGEFKENQFPNDQFLELKIGAQIMFIRNDISPEKKYFNGKLGEIVGLDENEIRVALEGSEKEIVVKREVWEQKKYFLDTDKNIKEEVLGSFEQFPIKLAWAVTIHKSQGLTFDK

SEQ ID NO: 211645 - protein, 167 aa, Glycine max
  Coding DNA Sequence Number=SeqID_94867
DEPTTSPSSSESVDAKGEESSEEIYPLEDGQPLVVKEKCKEVSVSSKRLAKKETHFTIKTNTKETFLLRQPPHFLFCKNTLASIATPLGLEFIPQVKKLLDEGLVRKSLNPCALLVPKIGIIRHQVPKIGGMMNVLSGATLFCKITRTPNIFMVLREGALSMKNLGI

SEQ ID NO: 211646 - protein, 54 aa, Glycine max
  Coding DNA Sequence Number=SeqID_94868
MEYPLYGISMRKVAKQMLRCRQRIAPSKVRPTIWNFPTLLPHMFAKTSECYSNR

SEQ ID NO: 211647 - protein, 106 aa, Glycine max
  Coding DNA Sequence Number=SeqID_94869
MVQLLLENEFFMSLAQPYKIGFYYPYETVISLFTFITQILEESDERFGDEGVTEIVELVKKTLPLPLNMKKEEITKGDEETATLKNEKGNKIRQDQNEDGEEMDTS

SEQ ID NO: 211648 - protein, 139 aa, Glycine max
  Coding DNA Sequence Number=SeqID_94870
  Homolog annotation: Hit_ID=Q1SPB9; Match level="QueryCoverage=92%, HitCoverage=24%, E-value=2e-14, Identity=37%"; Hit description =Transposase
MKTKGAQKKLMTKQQRSTKRDLSYWKYVDALHFVQKRSASSSEQLIQRRSMPMLDQFHPCIHDFIVNIVDVKTDGNCGYRAIAALLGMGEDSWSLMHNHLHKELTKWSDKYINLVGGIDKFKELKLSLLMDYPWYITLM

SEQ ID NO: 211649 - protein, 110 aa, Glycine max
  Coding DNA Sequence Number=SeqID_94871
MQQLMKLLEWDQYIHWHRLKDEDVVCDIFCSHLDAVKLTNVCNLVFLIDDTYKTNSKSVFPEATNLLYRFHIDKNVKAKCKTLVGLSLLIEPLRDYYKIALETYVVFRKP

SEQ ID NO: 211650 - protein, 489 aa, Glycine max
  Coding DNA Sequence Number=SeqID_94872
  Gene Ontology: Mol. function=protein serine/threonine kinase activity; Cellular component=membrane; Biological process=protein amino acid phosphorylation
  Homolog annotation: Hit_ID=Q8LGB4; Match level="QueryCoverage=96%, HitCoverage=95%, E-value=1e-171, Identity=61%"; Hit description =Protein kinase-like protein
  Pfam annotation: Domain name=APH; Domain location=155-330; Score=2.6; E_value=0.0036; Accession=PF01636.13; Description=Phosphotransferase enzyme family
  Pfam annotation: Domain name=Pkinase; Domain location=153-430; Score =118.9; E_value=1.4e-32; Accession=PF00069.15; Description=Protein kinase domain
  Pfam annotation: Domain name=Pkinase_Tyr; Domain location=153-430; Score=85.5; E_value=1.6e-22; Accession=PF07714.7; Description =Protein tyrosine kinase
  Pfam module annotation: Pfam domain module=APH::Pkinase::Pkinase_Tyr; Domain location=155-330::153-430::153-430
MGFSQDPCTDSNAPTSTSSTLVVDHYCDYDKLKFKTFLRKMFWEFGLACVANPSQRRRSSGSGQKDEHGEQQGVAACGVWFSFCSQVELESLNMSSSAAATVLMVNLDNGVSESRANEMKWRRMESLEKSISPVAHTLIRFSYGEIMSATRNFSKGRVLGRGALSCVFRGRVGILRTAVAIKRLDKEDKESAKAFCRELMIASSLHSSNVVPLLGFCIDPEEGLFLVYKYVSGGSLERHLHGRKKGSSPLPWPVRYKVAIGIAEAVAYLHSGTERCVVHRDIKPSNILLSSRKTPKLCDFGLATWTSAPSVPFLCKTVKGTFGYLAPEYFQHGKVSDKTDVYAFGVVLLELITGRKPIEATRPSGDENLVLWAKPFLQKGKGAIEELLDPQLKCSLKFSNQMGRMIEAAAACVTNEESRRPGIREIIAILKGEEEPLLSKRKKSSFLGNGCVIDCYSQLQQTNNEMKSHLALAMLGVAEFEDDDYLYGR

SEQ ID NO: 211651 - protein, 52 aa, Glycine max
  Coding DNA Sequence Number=SeqID_94873
MLADAECRVGEGYGIGLVRKGNLVVLRAEEDWEPTGGQHPLVVRDQGLMKLE

SEQ ID NO: 211652 - protein, 102 aa, Glycine max
  Coding DNA Sequence Number=SeqID_94874
  Gene Ontology: Mol. function=calcium ion binding; Cellular component =flagellin-based flagellum; Biological process=ciliary or flagellar motility
  Homolog annotation: Hit_ID=Q84V36; Match level="QueryCoverage=91%, HitCoverage=97%, E-value=1e-30, Identity=71%"; Hit description =Polcalcin Che a 3
  Pfam annotation: Domain name=efhand; Domain location=11-39; Score =33.1; E_value=9.6e-07; Accession=PF00036.22; Description=EF hand
  Pfam annotation: Domain name=efhand; Domain location=46-74; Score =17.6; E_value=0.045; Accession=PF00036.22; Description=EF hand
  Pfam module annotation: Pfam domain module=efhand::efhand; Domain location=11-39::46-74
MADDDPQDVADRERIFKHFDSDGDGQVSSQELGDALKALGSVTPEEVQRMMAEIDTDGDGFISHDTDGDGFISHEEFINFARANRGLVRDVAKIFGFLSSCS

SEQ ID NO: 211653 - protein, 129 aa, Glycine max
  Coding DNA Sequence Number=SeqID_94875
  Gene Ontology: Mol. function=DNA binding; Biological process=DNA integration
EKDSTLEDDIKAEEHEQSKEISTTMPKEFLRKWRTQKDLSLDNIIGEISKGVSTRSRLRILCNNMAFVSTVEPRNIDEALCDEHWLMPMHEELNRFKRNEVLDLVPKPTSHKSIGTKWVFRNKLDDLAS

SEQ ID NO: 211654 - protein, 130 aa, Glycine max
  Coding DNA Sequence Number=SeqID_94876
MGAKHLTRTKERSHVIKQRFPDEIRQKNVYTDNHSGISAYHRARRLWMIQGCRMTKLGLCLSSGPPPLDDKKGADNRKGADNRKGADNRKVSPRIMGISAYHGCRMTKLGLCLSSGPPPLDDKRGADNRK

SEQ ID NO: 211655 - protein, 75 aa, Glycine max
  Coding DNA Sequence Number=SeqID_94877
MRGIVHEPQVNIGAYQKFSPVDVFPLSSLQNGQVTKSNRTYTLREFPERFAKDRIGLHELSPFSKGQSICVFQKD

SEQ ID NO: 211656 - protein, 68 aa, Glycine max
  Coding DNA Sequence Number=SeqID_94878
  Gene Ontology: Mol. function=nucleic acid binding; Biological process= DNA integration
MTGDTSKFTHISPKKSGHVTYGDNNKGRILGVGKIGTNSSTSIENVLLVEGLKHSLLSVSQLCDKGYL

SEQ ID NO: 211657 - protein, 110 aa, Glycine max
  Coding DNA Sequence Number=SeqID_94879
ALEESRATLFVLLRRRCGAERQKGSQKGGHTGAKKAKITSSTKETQVKGPEQARDSDEAQTQRAQANKQRAIAALPRGNLSLSFLLPGVIVLMERIENEVRGYQTQEARA

SEQ ID NO: 211658 - protein, 79 aa, Glycine max
  Coding DNA Sequence Number=SeqID_94880
MVRDKSHQTLIPHFFSCCIELMLNVTSHSKLHYGPLAIVHSLVIASMALCTYAAMRHLIRTHVCASSSVNQALGFDFEE

SEQ ID NO: 211659 - protein, 108 aa, Glycine max
  Coding DNA Sequence Number=SeqID_94881
  Gene Ontology: Mol. function=ribonuclease H activity; Biological process=RNA-dependent DNA replication
  Homolog annotation: Hit_ID=Q1S700; Match level="QueryCoverage=90%, HitCoverage=39%, E-value=5e-15, Identity=32%"; Hit description =Ribonuclease H
IKCHLYHPPKAPSIKEVRWLNPPVGWVKGNSDGAAKGFSGHAGCGVISAMEVAHEKDWARFGLECDSSMVIQAYSNANIVPWKLRTYWDNFLYHMNTLHFRLNNIGNK

SEQ ID NO: 211660 - protein, 335 aa, Glycine max
  Coding DNA Sequence Number=SeqID_94882
  Gene Ontology: Mol. function=triacylglycerol lipase activity; Biological process=lipid metabolic process
  Homolog annotation: Hit_ID=Q41251; Match level="QueryCoverage=91%, HitCoverage=88%, E-value=3e-91, Identity=72%"; Hit description =Calmodulin-binding heat-shock protein
  Pfam annotation: Domain name=Lipase3_N; Domain location=7-75; Score =64.1; E_value=4.7e-16; Accession=PF03893.7; Description=Lipase 3 N -terminal region
  Pfam annotation: Domain name=Lipase_3; Domain location=101-224; Score= 63.7; E_value=5.9e-16; Accession=PF01764.16; Description=Lipase (class 3)
  Pfam module annotation: Pfam domain module=Lipase3_N::Lipase_3; Domain location=7-75::101-224
MSASCGVVECVFVLGCARWLWKRCTYVGSYDSATWPSATADEFDPVPRVCRLILANYEPDLRTPNHRLNPDCIIKRVTYEDTLGHAPPYVIYLDHDHKEIVLAVRGLNLAKESDYKVLLDNRLGQQMFDGGYVHRGLLKSAVWLLNRESETLKRLWVENGLEYEMVFAGHSLGSGVVSLLTILVVNHRDRLGGIPKEKIRCYALAPARCGRFPPEVRTAIPVDGRFEHIVLSCNATSDHGIIWIEREAEKALQAQSSETVTDPPTVQKFQRLKTIEKEHRDALERAVSLNVPHAVDTAENEPSENNEGDDASGNGRNNVSSNQSKSSGGRSNWDD

SEQ ID NO: 211661 - protein, 465 aa, Glycine max
  Coding DNA Sequence Number=SeqID_94883
  Gene Ontology: Mol. function=hydrolase activity, hydrolyzing O -glycosyl compounds; Cellular component=anchored to membrane; Biological process=carbohydrate metabolic process
  Homolog annotation: Hit_ID=Q94EN5; Match level="QueryCoverage=90%, HitCoverage=85%, E-value=0.0, Identity=82%"; Hit description=Beta-1 ,3-glucanase
  Pfam annotation: Domain name=Glyco_hydro_17; Domain location=1-311; Score=300.2; E_value=3.8e-87; Accession=PF00332.9; Description =Glycosyl hydrolases family 17
  Pfam annotation: Domain name=X8; Domain location=326-411; Score =168.7; E_value=1.5e-47; Accession=PF07983.3; Description=X8 domain
  Pfam module annotation: Pfam domain module=Glyco_hydro_17::X8; Domain location=1-311::326-411
MPHPTQVVALLKAQQIRHVRLYDADQAMLIALANTRIQVAVSVPNQEILAIGQSNTTAAKWVSHNVIAHYPATNITTICVGSEVLTTLPYAAKVLVSALKFLHSALVASNLDHQIKVSTPLSSSMILDSFPPSQAFFNRSLNPVLVPMLDFLQTTDSYLMLNIYPYYDYMQSNGVIPLDYALFKPLPPNKEAIDSNTLLHYSNVFDAVIDAAYFAMAFLNYTNIPVVVTETGWPSKGDSNEPDATVENANTYNSNLIKHVLNITGTPKHPGIGVSTFIYELYNEDAKAGPLSEKNWGLFDANGKPVYVLHLTESGGVLANDTTNQTYCVAKDGADPKMLQAGIDWACGPGKVDCSPLLQGQPCYEPDNVVAHANYAFDTYYHQMGKSTQSCDFNDMATISTTNPSHGSCVFPGSLGINGSFPNVTLSSLNSTNSVSSASNLHSGELGIRSLLMVIVLLLWGVVLL

SEQ ID NO: 211662 - protein, 303 aa, Glycine max
  Coding DNA Sequence Number=SeqID_94884
  Gene Ontology: Mol. function=nucleic acid binding; Cellular component= spliceosome; Biological process=protein folding
  Homolog annotation: Hit_ID=Q9LF76; Match level="QueryCoverage=76%, HitCoverage=83%, E-value=6e-58, Identity=53%"; Hit description=DIP2 protein
  Pfam annotation: Domain name=RRM_1; Domain location=123-193; Score =61.3; E_value=3.1e-15; Accession=PF00076.12; Description=RNA recognition motif. (a.k.a. RRM, R
  Subcellular localization annotation: CTP_CleavageSite=52; ConfidenceScore=5.43e-01
MASSLDMSLDDRIKNRSNNRGRGRGGRGRAHSGRGPSGTLNGRRMVGAVNSRRMAGAGNGGRTTGAVRRGPLMVNTRPSSYAIAKASSKNSIRRARPFPWQHDLFEDSLRAAGIQGVEVGTKLYVSNLDHGVTNEDIRELFSELGELKRFAVHYDKNGHPSGSAEVVYTRRSDAFAALKRYNNVLLDGKPMKIEIVGSNSELPISARVNVTGVNGRRKRTVVMTSRGGQAGGGPAMPTRGAGWGRRGGPRSGSGRGGAGGRGRGRGRGGAGGRGRGRKDAVEKSAEELDKELETYHAEAMNIS

SEQ ID NO: 211663 - protein, 108 aa, Glycine max
  Coding DNA Sequence Number=SeqID_94885
MDLLWVVLQICAAQAACHTLVVASAAEEPFAQEALSLFDRHRPPRFPVWPTAVCGVFADTINTSLRMAGDFPAEAARRRTGFCGVRQVVSHSSIKLKATASLNVALSS

SEQ ID NO: 211664 - protein, 170 aa, Glycine max
  Coding DNA Sequence Number=SeqID_94886
  Pfam annotation: Domain name=AT_hook; Domain location=4-16; Score =16.6; E_value=0.031; Accession=PF02178.9; Description=AT hook motif
  Pfam annotation: Domain name=AT_hook; Domain location=49-61; Score =7.1; E_value=1.4; Accession=PF02178.9; Description=AT hook motif
  Pfam module annotation: Pfam domain module=AT_hook::AT_hook; Domain location=4-16::49-61
  Subcellular localization annotation: CTP_CleavageSite=37; ConfidenceScore=5.82e-01
MSSPKPRGRPPKDPNAPQNSTSVKVSSGSSGTMFRKNNNMKSNLRVPPKRGCGRPPKPKVPLPPSTILFSPRPRDHPPKDPNTPQKSISVKVLSGSSEIMFKKNNYLKSNTNASLKKVHPSLKFHFPQVLVCPHQGLGVALQRTLMFHKCQQMPKCQDQGGDLGRLLGLG

SEQ ID NO: 211665 - protein, 81 aa, Glycine max
  Coding DNA Sequence Number=SeqID_94887
MADGGRSKFHHINMPLRLMEPPWQVSLHKLPIVIGKKITTPFHHGGTLIWNFFRTQNSNISLKMQKMFLLLHTLNVLQVVV

SEQ ID NO: 211666 - protein, 126 aa, Glycine max
  Coding DNA Sequence Number=SeqID_94888
  Gene Ontology: Mol. function=glutathione dehydrogenase (ascorbate) activity
  Homolog annotation: Hit_ID=Q4JR86; Match level="QueryCoverage=74%, HitCoverage=36%, E-value=3e-48, Identity=100%"; Hit description =Dehydroascorbate reductase
  Subcellular localization annotation: CTP_CleavageSite=84; ConfidenceScore=5.76e-01
MMLWKRCIVPRKHRGNQKHNNATSSSASAMSTVRVQVSACVFSATVNNLCLRQNAVVSFRKKKLLRLVSMSSVPPSQPFEIAVKASVTTPNRLGDCPFCQRVLLTLEEKHLPYDPKLVDLTNKPEW

SEQ ID NO: 211667 - protein, 114 aa, Glycine max
  Coding DNA Sequence Number=SeqID_94889
MFVKFLIFFCKASICSLKSATTIVSLETEDELEIRIAARLPWWHCRMKLPENAQQLPLADMDKSSEQAAGTEPQSRRRRSNSAWEEEEEEATSSFVNPNFFGEEEATLHVRENL

SEQ ID NO: 211668 - protein, 62 aa, Glycine max
  Coding DNA Sequence Number=SeqID_94890
  Gene Ontology: Mol. function=intramolecular transferase activity, phosphotransferases; Biological process=carbohydrate metabolic process
  Homolog annotation: Hit_ID=Q83ZZ0; Match level="QueryCoverage=99%, HitCoverage=13%, E-value=3e-27, Identity=98%"; Hit description =Phosphoglucomutase
MPLPAFKAYDIRGRVPEELNDDLARRIGVALAAQLAPGPVVLGHDVRLTSPALQDALAAGLR

SEQ ID NO: 211669 - protein, 174 aa, Glycine max
  Coding DNA Sequence Number=SeqID_94891
  Gene Ontology: Mol. function=nucleic acid binding; Cellular component= signal recognition particle, endoplasmic reticulum targeting; Biological process=intein-mediated protein splicing
  Homolog annotation: Hit_ID=Q13NN7; Match level="QueryCoverage=93%, HitCoverage=14%, E-value=7e-63, Identity=71%"; Hit description =Putative helicase
  Pfam annotation: Domain name=Helicase_C; Domain location=24-99; Score= 79.1; E_value=1.4e-20; Accession=PF00271.21; Description=Helicase conserved C-terminal domain
MVEEGRRVLVFSQFTGMLALIAHALEELGLAYVTLTGYTQDRATPVQRFMQGEVPVFLINLKAGGVGLNLTAADTVIHFDPWWNPAAENQASDRAHRIGQQQPVFVYRLIAAGSIEERIAELQERKATLADSILEGGGAAGPRFSEEDVQALLAPLPGVPGKRSRKAGKRSTRA

SEQ ID NO: 211670 - protein, 44 aa, Glycine max
  Coding DNA Sequence Number=SeqID_94892
MAEVGVSDNLKGLILAMGSSAFIGSSFILKKKGLKRAAARGTRA

SEQ ID NO: 211671 - protein, 354 aa, Glycine max
  Coding DNA Sequence Number=SeqID_94893
  Gene Ontology: Mol. function=nucleoside-triphosphatase activity; Cellular component=membrane; Biological process=defense response
  Homolog annotation: Hit_ID=Q1SVC8; Match level="QueryCoverage=69%, HitCoverage=24%, E-value=5e-40, Identity=34%"; Hit description=TIR; Disease resistance protein; AAA ATPase
  Pfam annotation: Domain name=LRR_1; Domain location=161-186; Score =5.9; E_value=23; Accession=PF00560.23; Description=Leucine Rich Repeat
  Pfam annotation: Domain name=LRR_1; Domain location=228-247; Score =1.5; E_value=1.5e+02; Accession=PF00560.23; Description=Leucine Rich Repeat
  Pfam annotation: Domain name=LRR_1; Domain location=273-295; Score =9.5; E_value=4.7; Accession=PF00560.23; Description=Leucine Rich Repeat
  Pfam annotation: Domain name=LRR_1; Domain location=297-318; Score =12.0; E_value=1.6; Accession=PF00560.23; Description=Leucine Rich Repeat
  Pfam annotation: Domain name=LRR_1; Domain location=320-342; Score =3.9; E_value=54; Accession=PF00560.23; Description=Leucine Rich Repeat
  Pfam module annotation: Pfam domain module=LRR_1::LRR_1::LRR_1::LRR _1::LRR_1; Domain location=161-186::228-247::273-295::297-318::320-342
EYMKRLYDKVKVQIAKKNESYTKQANKKRKEVVLEPGDDPGHLRANVFQEGGNDENPEIGQIQAKGPSNPCGVYPDLSSFTGSGVIQNLRSLYQMIRSYSGSHQAGSPSEPRKRSRLWLYENIVDVLENDKGTDTIEVIMLHLPKNKEVRWNGSELKKMTNLKLLSIENAHFSRGPEHLPSSLRVPKWWGYPSPSLPPEFDPRRLDMLDLSKTCNILSKQLKIMNFESLSEMVLRGCTFIKQAPDMLLDKITWFSAIGCINLRILPHNFKLTSLEYLSLTKCSSLQCLPNILEEMKHVKNLDLSGTAIEEFPLSFRKLTGLKYLVLDKCKMLNKISTSILMLPKLKRLMAVQCG

SEQ ID NO: 211672 - protein, 89 aa, Glycine max
  Coding DNA Sequence Number=SeqID_94894
  Gene Ontology: Mol. function=transmembrane receptor activity; Cellular component=membrane; Biological process=regulation of transcription, DNA-dependent
  Homolog annotation: Hit_ID=Q5NRP6; Match level="QueryCoverage=71%, HitCoverage=9%, E-value=4e-10, Identity=50%"; Hit description=TMV resistance protein N, putative
MEKLKVSYEGLKGNEKGIFLDITCFFRGYDLKDVVSFLLQGRGFSLEYVIRVVIDKSLIKIDQYGFAKGPSGEGRRPKWRRIKPPSGEG

SEQ ID NO: 211673 - protein, 166 aa, Glycine max
  Coding DNA Sequence Number=SeqID_94895
MAIVVFRHCYWRKSQWFCCSCWRRRSRAAGLGSRSQAKAGFATGPSEIEKEAQHEEAVSQTLLAKTACTSAHLHLSSLPPAHPLAHLHLLYPSRKLIRQSNWRDQVDGDITKTSSETTGFFASGSGEKPCVAQTAILLVAMAFCMAFHVKNEPPLEIVSKQIHSRK

SEQ ID NO: 211674 - protein, 118 aa, Glycine max
  Coding DNA Sequence Number=SeqID_94896
  Gene Ontology: Mol. function=transmembrane receptor activity; Cellular component=membrane; Biological process=regulation of transcription, DNA-dependent
  Homolog annotation: Hit_ID=Q9FPK8; Match level="QueryCoverage=64%, HitCoverage=20%, E-value=3e-12, Identity=40%"; Hit description =Putative resistance protein
MVKKFGIIVLLEQVWMYAGKREGFDRGIRENEFERKIKYEHELIQTIGLESRVQEGNSLLDVGSNQGVSMVGIYGIGVIGQCFLGDIREKSMKHGLVQLQETILSEMVGGEEYQVWEY

SEQ ID NO: 211675 - protein, 42 aa, Glycine max
  Coding DNA Sequence Number=SeqID_94897
MECDDSLPVCCLCLDPMMISNLEFMGADGLMDYFREPRAGRC

SEQ ID NO: 211676 - protein, 79 aa, Glycine max
  Coding DNA Sequence Number=SeqID_94898
MSRAVSGSENESARVRAIVQRQSGMWRVHSDTVSNTVGTSRCEELSDCERARVRVTEGEWELQRLKAESESETTRERYE

SEQ ID NO: 211677 - protein, 104 aa, Glycine max
  Coding DNA Sequence Number=SeqID_94899
MANPILLARWTELKHFYGLIRNHQMIMTHFGQSVLFLTIFKSSSKPRAYLKWHYLYHQVSNSDTFEVLLSEYKVTCNSLDVPSIMYSFMKAARFTHLNLEEITK

SEQ ID NO: 211678 - protein, 139 aa, Glycine max
  Coding DNA Sequence Number=SeqID_94900
  Subcellular localization annotation: CTP_CleavageSite=90; ConfidenceScore=5.28e-01
MPPKLAVVIADDDLPSSLGQLAASLCDSNFALTSSGKPLSSVANHSSTVASKVKKAFGLESPGLASRKRPGSASSQGKPKLPLIVGKLMRNQMKVSEAMDSHVRRVLLRISAGQVVNTLRLNHSSHFFARAAMHVARDT

SEQ ID NO: 211679 - protein, 177 aa, Glycine max
  Coding DNA Sequence Number=SeqID_94901
  Gene Ontology: Mol. function=transmembrane receptor activity; Cellular component=membrane; Biological process=defense response
  Homolog annotation: Hit_ID=Q8W2C0; Match level="QueryCoverage=69%, HitCoverage=11%, E-value=6e-23, Identity=46%"; Hit description =Functional candidate resistance protein KR1
  Pfam annotation: Domain name=TIR; Domain location=32-155; Score=22.3; E_value=4.3e-07; Accession=PF01582.10; Description=TIR domain
MSYCCEREKEESTTTRWFQKNCRKITIVKTLISNSRTDNLYKALCDRGIHTFIDDQQPRKGHHITSAFEKAIEESIIFIFLLLLKLDYILKFIKGKGLLILPTFYMVDPSDLRHHTSSFGEALANHDKKFNTNEETFRCNVNMDKLETWKMALHQVANLLATISNMGTLPRQSFILF

SEQ ID NO: 211680 - protein, 388 aa, Glycine max
  Coding DNA Sequence Number=SeqID_94902
MSNVITHSWKNSRTSPGEPVMPDPVVMIKDDGHILIIADADTDADGSPDAEEIDPTGNWKKITGVAVNMGDMAKINYRDSHIYAICADVGGKESIGEASIAAVEALGVNPWSKNKKKIIRGIGYGVTYEIIAGSASLGATVSFETIQAYGRELFKENLPFSLPMKIEDISGVMLGSNGKGTPTVVISSKSGESHVKEYSDTQELALILQLLPKTKVTIDAPFVAQLADAVVWDDHFYSSAERFVGMFKEDYRSIREAVEDWFVPEYSPTATSNACVAHQVSCLKLCGLPYPKLGSMQSINVDYFVEWALEQGWQKITHRASLAPGDICVSGPIGHPKEFDHVYCFVSFSTEQVGYAVIFDNQYFGIHTRSLDGIGSKIGEWRYAIRMP

SEQ ID NO: 211681 - protein, 360 aa, Glycine max
  Coding DNA Sequence Number=SeqID_94903
EGIDQTVDMRIEGGGSSFTWQIRRYKYSLEYDRERQLLLANSVSNRTGQIPSPVIMLLSEPERKAILLVSRTSEGVPVGEFELSSTIQNNGPWLVVPKQGDEASFRPCYIAGEPVIQSDTTTIQSLQKATQLFNPRSDVNTITLVLEQMASDPAHSGWQFLRNLYNQFGYLPLATFEVWRALVQHPQALAMSLFKFEMSIDYLSRIESEFPVFWEFLPITEVKRASMRFRAFLTHKGAPEEMQIKSLGRMFQRLGTVFPTYASEVQTWLDQGKLPPTFPAQTIEGIIHEWYQELLREHGESRWPEFGGPGLFRWYASQKDPIIEVSPDTSYRYSVTLLPIFAAAVTCGKTTFDSVFENKP

SEQ ID NO: 211682 - protein, 222 aa, Glycine max
  Coding DNA Sequence Number=SeqID_94904
  Homolog annotation: Hit_ID=Q1S0F5; Match level="QueryCoverage=17%, HitCoverage=8%, E-value=8e-07, Identity=62%"; Hit description=IMP dehydrogenase/GMP reductase
VRHACPLESHRSCTEKGGPNWDQLLASKEGASVNLFPRWKEGRTGVLISCGGFPNVPLMGTRGCISYNLVLAIRQLGYPMRGAPLEDELAPVISRGFNKTNMETLQKEVEAPEEDKEVQALRAELEQAQTVKEKFKSAALKIRKENTELRDGSKSKLKLRREERDQSRVDSLILKDELKACTRSKRSLSQRLCETETNMLAIITKYQEELNLAATHEHRVAD

SEQ ID NO: 211683 - protein, 221 aa, Glycine max
  Coding DNA Sequence Number=SeqID_94905
  Gene Ontology: Mol. function=helicase activity; Biological process =viral genome replication
  Homolog annotation: Hit_ID=Q9ZQ61; Match level="QueryCoverage=97%, HitCoverage=21%, E-value=1e-44, Identity=36%"; Hit description =Putative helicase
MFQPHTILDADGYPVYRRRNNGHTIEKNGVIIDNRYIVPYNPRLLRKYQAHINVEWFNQSTSIKYLFKYINKGYDRVTVVLIHDDNDPIHNGSTHNDEIKEYLDCSKKKRCCHLMKKGYTIGRLLWVPPITSKLFYLRMMLTIGKGPTSFEDLRIVGNVQYPTYREACFTMGFLQNDKEFIEAIKEAKDWSSAHYIRKLFVLLLLTTTMNKPEQVWDQTWH

SEQ ID NO: 211684 - protein, 233 aa, Glycine max
  Coding DNA Sequence Number=SeqID_94906
  Gene Ontology: Mol. function=chitin binding; Cellular component =extracellular region; Biological process=chitin metabolic process
  Homolog annotation: Hit_ID=UPI000044A8F0; Match level="QueryCoverage =98%, HitCoverage=99%, E-value=2e-29, Identity=31%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MTTRPRLQRATCPHHLRTTRPHLHRATRPRHQRIARPGLQRARRLRLAFRGQHTLAISGLHILTVRGLHALAFKGLHGHAFRGLRVLAFRGLLALALRGLNVLAFRGLHAFAFRRLHTLAFIGLHVLAIKGLHTLDFRGLHALTFKALHILRFRGLHALAYRGLHILAFRRLHALAVRGMHVLPFRGLHALANRGLHILAFRGLHALAFRRLHILSFKGLHPLNFRGLHVLAF

SEQ ID NO: 211685 - protein, 137 aa, Glycine max
  Coding DNA Sequence Number=SeqID_94907
MIMRGQDIYSSQDKATTSPSSSECEEAKGEESSEEIYPQEEGQPLMVKEECKKIGVSSKRLAKKESHFEIKTNIRETSPLRKPPHLLLCKKILVSTVTPLRLKVIPQVKKLLNEGLVRKSLNPCALLVSKIVIKGFP

SEQ ID NO: 211686 - protein, 124 aa, Glycine max
  Coding DNA Sequence Number=SeqID_94908
  Subcellular localization annotation: CTP_CleavageSite=84; ConfidenceScore=5.11e-01
MLVRMIRTRLFTAARMKSCPGMHSSCVIASLSGCARTVGPPPISGGGPGTVWIWSPPKVRTRSPLKARACSLLKARTCSPLKVRACSPTKVKAHDPLTARTCSPLKLKVHDPLKARTCSPLKVK

SEQ ID NO: 211687 - protein, 95 aa, Glycine max
  Coding DNA Sequence Number=SeqID_94909
MRKLIKERMENKVVNFVGLNKVVSGIKWMNGMKYRNGNNGSYRAPNEVILKREVDFLELWFERTRVEMIGRKESLFPARATHKGCESPLIQPGCS

SEQ ID NO: 211688 - protein, 80 aa, Glycine max
  Coding DNA Sequence Number=SeqID_94910
MAPTRHPLDPEKSNRALGFLALITGLYQFYGVHVTPNKYCTPRQAQGDAHQAAGAPSPPRQADSAAPLSVEQYLQHLVRH

SEQ ID NO: 211689 - protein, 48 aa, Glycine max
  Coding DNA Sequence Number=SeqID_94911
MGELLQAQEKKVDSPLEIVDQLALEQPRWISPMEVKLQARLLAQENAP

SEQ ID NO: 211690 - protein, 320 aa, Glycine max
  Coding DNA Sequence Number=SeqID_94912
  Gene Ontology: Mol. function=RNA-directed DNA polymerase activity; Biological process=RNA-dependent DNA replication
MHHSHTSMIFIGCIAHGILALKTNLIIVIKRKEHASRSPYRTRARARVMGEVEEVQEQIKADMEAVKEKMAIMMEAMISMKKIMEVNAVAIAATSAIAKVNITPQSGLNQMNHPTSNMVGKDLGSTGNPHFVQVQNKHAFLPYGLPPNYTPPNENVNNSTPILIESQKPQSDHAHVSQPMGGTHEMPHHNLVNFEPCLKYATEGQIVGGEPLPNTSEGPHFRPQPQPLHFVVGRAPPAMAENRKLDRIEERLRVVEGSRDYAFANMAELCLVHDVIIPSKFKVSEFDKYKGTTCPKNHLKLYCWKMEAYAKDEKLLMHFF

SEQ ID NO: 211691 - protein, 306 aa, Glycine max
  Coding DNA Sequence Number=SeqID_94913
  Homolog annotation: Hit_ID=Q06308; Match level="QueryCoverage=48%, HitCoverage=33%, E-value=3e-74, Identity=95%"; Hit description =Bacteriocin 28b
  Pfam annotation: Domain name=Colicin; Domain location=1-160; Score =218.0; E_value=2.1e-62; Accession=PF01024.9; Description=Colicin pore forming domain
GVSLAAGINKDIAEKLGAKYAKLAKDLEAGIQGRYIRNVQDAEKTYEQLTKGLNKKLKAQDKAAIVAWLKKIDAEQYARNARVLGKAFTGVDWAIKGADLTNAAIEGFSTGSWKAFRNQLEALGLSIGAGYTLSAIAAFFAPTLVSSTGGSPLFLSYRHVPFSPPRRHRQQQVGEAALFAGGDHQQRSIRFDRRIKILTRQVLYRALRRQQLSVFGFDGVGEIRRAGHQRRAFHVDAGQQFFQDRRGGERAGRQVQIDHGGVFRRVRHAGVVAVGDQYLGFMPASRQRGEQRRVGDGGFDHKAIPE

SEQ ID NO: 211692 - protein, 68 aa, Glycine max
  Coding DNA Sequence Number=SeqID_94914
MKMKANETRNELKVSDSKTYRLKNEERTKNGRRTTENLHEIAHGNVSEALRKHFGLDFLHGNTLFHQK

SEQ ID NO: 211693 - protein, 89 aa, Glycine max; identical to SEQ ID NO: 157672
  Coding DNA Sequence Number=SeqID_94915
  Subcellular localization annotation: CTP_CleavageSite=53; ConfidenceScore=5.71e-01

SEQ ID NO: 211694 - protein, 56 aa, Glycine max; identical to SEQ ID NO: 156316
  Coding DNA Sequence Number=SeqID_94916
  Subcellular localization annotation: CTP_CleavageSite=35; ConfidenceScore=5.13e-01

SEQ ID NO: 211695 - protein, 87 aa, Glycine max
  Coding DNA Sequence Number=SeqID_94917
MSPSIIRIMKIYQLERSTYYITIRSEETALLLVSFIVLTLIITLTAYVCSNNIPRTVPSVPGGATHSNNNHTTITVEPPEPRLDHTN

SEQ ID NO: 211696 - protein, 153 aa, Glycine max
  Coding DNA Sequence Number=SeqID_94918
  Pfam annotation: Domain name=Cu_bind_like; Domain location=3-60; Score=-4.5; E_value=0.00019; Accession=PF02298.8; Description =Plastocyanin-like domain
MCILYLINDDNIQVSQKEYEHCTSLEPLRIFNTSPVILPLRERGVMFFICNIPNYCCLGQKIVISVHEGSIEKPPSPSPSPSQVPINISPQPSPNASAPQPHGSSGMSSPPSPTTNTSGGNGGNSPVPSSTQEGKSNAVALKYKMQGWVNKLK

SEQ ID NO: 211697 - protein, 325 aa, Glycine max
  Coding DNA Sequence Number=SeqID_94919
  Pfam annotation: Domain name=DUF688; Domain location=1-325; Score= -187.8; E_value=7.6e-05; Accession=PF05097.3; Description=Protein of unknown function (DUF688)
MRSFSSTLASETDHKGKSDNSLARLPLPPAYKLELNSVPERNAGNVPFEWEKAPRRPKDESKLQTQDFEKPPFTSNFLLGRVSKTKQQSLAETRTGSTLSNSQSVASLDKKATKHSKAETREKESSGSNDGDEAYEDARDSLSRTESFFMSCSVSGLSGWDEQEVQPFGSFSSDHQKGRNFMIDRFLLAAKAMTSESPQYASKKAHIGQEQQKQRKKEVNTESPCPINQHRPKALPYYTQDIDGEESDDCSEYENYTTTTCGLCPRFCLLNPMPGLRMVERVPTNAAHGMQAKSAASHIGSSKEEQRENFSKEMINAEKKEKESY

SEQ ID NO: 211698 - protein, 290 aa, Glycine max
  Coding DNA Sequence Number=SeqID_94920
  Homolog annotation: Hit_ID=Q60DI7; Match level="QueryCoverage=45%, HitCoverage=46%, E-value=6e-25, Identity=43%"; Hit description =Glutaredoxin domain containing protein
  Pfam annotation: Domain name=Glutaredoxin; Domain location=228-288; Score=33.8; E_value=6e-07; Accession=PF00462.14; Description =Glutaredoxin
MKGVKGKFLKKLKSIKPILKQDLILQIKASDGYVHFLPKIPSFNLHSPFVSRENKPEKVVQSCEKMQDEPEVIDVAELMKDLEEEDDYNDNKENIGPCSQKPQQHHKGVLQNGNRAKTDSKQRGVLEEKKSSPENADNNNNRNSNRKIPLLDTDVPSFRRPDLNSGSLFDPNLLAAFEQAVKEHSRITEEQRRSRVEEESSQKVEDDDPDPLMFFEEKCPPGGDGMVIFYTTTLRGILKTFEDCNKIRFLLQSFKVLYFERDISMHKEFRDELWSSLEGKLVPPRLFVKG

SEQ ID NO: 211699 - protein, 73 aa, Glycine max
  Coding DNA Sequence Number=SeqID_94921
MLKMGDLAKVVIKQDMKRGTSNNLKVVHSGTKEFKIASNKRDLFLGFSEHQERLCKKLAVEEGRIFAANEQVS

SEQ ID NO: 211700 - protein, 68 aa, Glycine max
  Coding DNA Sequence Number=SeqID_94922
  Homolog annotation: Hit_ID=Q60DI6; Match level="QueryCoverage=69%, HitCoverage=13%, E-value=6e-08, Identity=58%"; Hit description =Pyrimidine 5'-nucleotidase-related
MSMLLTWLLLFMRDWVIWMVGPTDGNASLKKRTNVSFSVITPETWECLMIFSSMVMPVSFPFLDMAGD

SEQ ID NO: 211701 - protein, 348 aa, Glycine max
  Coding DNA Sequence Number=SeqID_94923
  Gene Ontology: Cellular component=mitochondrion
  Homolog annotation: Hit_ID=Q10G00; Match level="QueryCoverage=86%, HitCoverage=38%, E-value=2e-99, Identity=60%"; Hit description =Expressed protein
KKHEEESGDDIDYDRRLLSSSDDYTSGKWHKIENITTSPSFVPEFEENSFTVGSWEQKEVISRDGQMKLHTQIFFASIDQRSECAAGESACAVLVALIADWLKANQVVMPIKCEFDSLIRDGSSEWRTLCENKDFIKKFPDKHFDLETVLQAKICAVSVVSEKSFVGFFIPEEPEGEGFDFLHGAMSFDSIWEEISHSASELHMFREPLVYIVSWNDHFFVLKVEKDAYYIIDTLGERLHEGCNQAYILKFDTSTKVEKLSKKGNKTVEVNGSQENVVDKSFIITPNESNDRREGIICSGKESCKEYIKKFLAAIPIRELQVDVKKGLKASMPLHHRLQIEFHYTHLK

SEQ ID NO: 211702 - protein, 107 aa, Glycine max
  Coding DNA Sequence Number=SeqID_94924
  Homolog annotation: Hit_ID=Q1SKD7; Match level="QueryCoverage=91%, HitCoverage=26%, E-value=6e-11, Identity=34%"; Hit description =Ankyrin
MAPRKLPAKRSRKDKAAEGTSAAPEYDSHRFRSAEHQQRFEAIKGWSFHRERRVQLRDDEYTDFQEEIVRRQWASLVTPMAKFDPDIVLEFYANAWPTQEGVRDMRS

SEQ ID NO: 211703 - protein, 64 aa, Glycine max
  Coding DNA Sequence Number=SeqID_94925
MEQVSIGHHNWGEFYRLFAAKLPPWLVGFVVDLGMAFVDNWVVGKEKGCYWLSNDIVGLLGNLA

SEQ ID NO: 211704 - protein, 134 aa, Glycine max
  Coding DNA Sequence Number=SeqID_94926
  Gene Ontology: Mol. function=protein binding; Cellular component =nucleus; Biological process=ceramide metabolic process
  Homolog annotation: Hit_ID=Q6EUI5; Match level="QueryCoverage=99%, HitCoverage=5%, E-value=6e-41, Identity=68%"; Hit description =Putative lysosomal trafficking regulator 2
  Pfam annotation: Domain name=Beach; Domain location=1-119; Score= -113.9; E_value=1.7e-09; Accession=PF02138.8; Description=BeigeBEACH domain
MVLYHLVRVEPFTTLAIKLQGGKFDHSDLMFSNISATWNGVLKGMSDVKELVPNLFYLPEVLTNENSVDFGTTQLGEKLGILIKIFCTSIGWLWRVSMYMLIYMSGLTSYLGISNRAKRPLQQIMFSFILHMKG

SEQ ID NO: 211705 - protein, 115 aa, Glycine max
  Coding DNA Sequence Number=SeqID_94927
  Gene Ontology: Mol. function=protein dimerization activity; Cellular component=nucleus; Biological process=regulation of transcription, DNA-dependent
  Homolog annotation: Hit_ID=P14232; Match level="QueryCoverage=87%, HitCoverage=30%, E-value=3e-16, Identity=43%"; Hit description=TGACG- sequence-specific DNA-binding protein TGA-1A
MEGIIMVILPQVQHSCSQQQLSDIFNFVQSCQQAEDALAQGMEKLHQILDKASAAGDKGLKLTCVSQQMSFLKQADHVRQQFLIQLSRLLTICRYAEFLIAFGERLYKPQPWSSL

SEQ ID NO: 211706 - protein, 80 aa, Glycine max
  Coding DNA Sequence Number=SeqID_94928
  Subcellular localization annotation: CTP_CleavageSite=74; ConfidenceScore=5.15e-01
MGVQIATRPTWALLSGGSNPARLGELGGKLLPQFSINRGRSEVEKGKSKPRRFCNVSVSNFAKVFDHSSTFFIRSSVFNG

SEQ ID NO: 211707 - protein, 1406 aa, Glycine max
  Coding DNA Sequence Number=SeqID_94929
  Gene Ontology: Mol. function=ubiquitin-protein ligase activity; Cellular component=ubiquitin ligase complex; Biological process =protein ubiquitination
  Homolog annotation: Hit_ID=Q6H6D6; Match level="QueryCoverage=82%, HitCoverage=89%, E-value=4e-58, Identity=28%"; Hit description =Transducin-like
  Pfam annotation: Domain name=U-box; Domain location=530-603; Score =55.1; E_value=2.3e-13; Accession=PF04564.6; Description=U-box domain
  Pfam annotation: Domain name=WD40; Domain location=1225-1261; Score =18.9; E_value=0.018; Accession=PF00400.22; Description=WD domain, G -beta repeat
  Pfam annotation: Domain name=WD40; Domain location=1267-1303; Score =34.1; E_value=4.8e-07; Accession=PF00400.22; Description=WD domain, G-beta repeat
  Pfam module annotation: Pfam domain module=U-box::WD40::WD40; Domain location=530-603::1225-1261::1267-1303
MAGNFRFTMDQKDIVRFLTTTIDSFIQDRLINKEQRTQHKEQCAERLAAEDGSCDKDTEVEYSDQAVLANLDWGIEALEEAINTYNMETKLARLDYAEKMLQVCAMLNPKQKTAGVPNYYLSAWAHLNLSYLWKLRNNVQNCVFHALEMFIVDPFFSRIDFAPELWKNLFLPHMSSIVGWYSEERHRLMMEVIPDSSDLSFTADFDQFFNESLVFSMRPHQLDKLQKMEQLYGESLDENTRLYAKYYKDCMNSDSTSGKKVAPMLPIAEPPMTPMHELSRSVPDFVKFGPILPKSAGFSLTPRSKDGVNETIRDNSTSSHSKVEKSSIWGAKFEVHEFGVALCIGLMINYHMQESIVKENENEEDLDSELDDASMDSDNKNNIFSPEMKMVKDEDIEAMAPLSNQKNQFHSPDIFSPLGSPRTGPNNSSTNPDTNSKREPKYLRLLSTRLRDSTISDHLSLDMSKDHILNSDNEVMALKNTQRKNNNQTLSMNDDNENSQGLNDSSLCESDEGNQSCISLPKLMIGSKPPKDFVCPITGQIFCDPVTLETGQTYERKAIQEWLRTGNTTCPITRQPLSANTLPKTNYVLKRLITSWKEQNPELAQEFSNANTPRGSSCSPSAKDFSMLSTTQRITDSPSLKGKENYIRQRSNRFMRVATSPTSVLTQAAVETIMNSLKPYISSLCTSENLHECEEAVLEIARLWKDSKTDPQIHAYLSKPTIISGLMEILSASLNREVLRTSIYILSELIFIDERVGETLNSVDSDFDCLATLLKNGLAEAALLIYQLRPVFAQLSAHELIPSLVEVIRNKNEGSDDFQLVLDPRDAAIAILEQILIGGDEYSRSLNALSVVSENGIPALVKYLERMEGRRSVVSILLCCMQAEKGCKSLIANKIELSPVLELFHAGNDSVRGICVEFLSELVQLNRRTVCNQILQTIKDEGAFSTMHTFLVYLQMAPMEHQLAVASLLLQIDLLVEPRKMSIYREEAVETLIEALWQKDFSNTQMKAFDALIFLIGHVTLSGKSYTEAWLLKIAGFEQPYNALIKAEQLGQYDNDSMETMEDEKNAMNSWQRRVAFVLCNHENGSIFQALEECLRSNSLKMAKSCLVLVTWLTHMLSTFPDTGIKDVARKSLLDELINVLQSSKNLEEKILATLALKNFINDPSRSTKLEIVNGSVAQEALRAYAKSIYRIMRKLKKYSTVAADIMKTLLNLNSVDVTELWSCKEVVELDLSSNGEVLCLLYMNGQVLSGHSDGTIKVWDARKRIPRVIQETHEHTKAVTSLCSSDDRLYSGSLDKTIRVWTVKPDEIKCIDVHDVKEPVYELTVNAKLACYVSQGSGVKASLICCLNISNTNVFNWSEAPKLINFNKYVKCLAGAGDKLYCGCSGYSIQFLYLINQPTKSAKAF

SEQ ID NO: 211708 - protein, 92 aa, Glycine max
  Coding DNA Sequence Number=SeqID_94930
MIIIMRFIRHLKENPQASISRYKTTTKKDGKITVLTCKAACDATMTEGTNDSDCRVDGGGHNRHWLTESTMEYVLRMRYIGICLRTWWQLRN

SEQ ID NO: 211709 - protein, 70 aa, Glycine max
  Coding DNA Sequence Number=SeqID_94931
MDVLAGDGGAQREALTSVLIKEEAFYGHNEWANMLKPYRGEFFHQKQEENSEEDYDARLEVAMPALDQGT

SEQ ID NO: 211710 - protein, 491 aa, Glycine max
  Coding DNA Sequence Number=SeqID_94932
  Gene Ontology: Mol. function=ligase activity; Cellular component =cytoplasm; Biological process=response to auxin stimulus
  Homolog annotation: Hit_ID=Q05680; Match level="QueryCoverage=98%, HitCoverage=82%, E-value=0.0, Identity=83%"; Hit description=Auxin -responsive GH3 product
  Pfam annotation: Domain name=GH3; Domain location=12-491; Score =997.5; E_value=4.9e-297; Accession=PF03321.4; Description=GH3 auxin -responsive promoter
MAIANCDDKNAKALQFIEDMTQNTDSVQKRVLAEILSQNAKTEYLKRFELNAATDRDTFKSKVPVVSYDDLKHDIQRIANGDRSPILCAHPISEFLTSSGTSAGERKLMPTIRQEMDRRQLLYSLLMPVMNQYVPDLDKGKALLFLFIKAETKTPSGLVARPVLTSLYKSDQFKNRPYDPFNVYTSPDEAILCPDSFQSMYTQMLCGLIMRHQVLRVGAVFASGLLRAIRFLQLNWAELAHDISTGTLNPKISDLAIKQRMTQILTPNPELADFIVKECSGENWDRIITRIWPNTKYLDVIVTGAMAQYIPTLDYYSGGLPKACTMYASSECYFGLNLNPICTPSDVSYTIMPNMGYFEFLPHEEDLSSSSSSSTLSRDSLDLADLELGKSYELIVTTYSGLCRYRVGDILQVTGFHNTAPHFSFVRRKNVLLSIDSDKTDEAELQNAVENASVLLREFKTSVAEYTSFADTKSIPGHYVIYWEHLSLFFL

SEQ ID NO: 211711 - protein, 80 aa, Glycine max
  Coding DNA Sequence Number=SeqID_94933
MDFVPNFVFMNTTKNPTKFGGGKRRLKPSKKYLILLFPHKILRIDAIIIKIQFGEKSRRNLRSNHEVMKDRRVISPYSGG

SEQ ID NO: 211712 - protein, 80 aa, Glycine max
  Coding DNA Sequence Number=SeqID_94934
  Homolog annotation: Hit_ID=Q9FG10; Match level="QueryCoverage=98%, HitCoverage=5%, E-value=1e-21, Identity=58%"; Hit description =Ubiquitin carboxyl-terminal hydrolase
WRFAFVLHGPPEYLQDSDIVFDRFQRRDIYGVWEQYLGLEHDDSAPKKSYAVNQVSEVYNDYFSILQNRHTFEKPVKIYN

SEQ ID NO: 211713 - protein, 539 aa, Glycine max
  Coding DNA Sequence Number=SeqID_94935
  Gene Ontology: Mol. function=dipeptidyl-peptidase IV activity; Cellular component=membrane; Biological process=proteolysis
  Homolog annotation: Hit_ID=Q0WVR9; Match level="QueryCoverage=91%, HitCoverage=98%, E-value=0.0, Identity=74%"; Hit description=WD -repeat protein-like
  Pfam annotation: Domain name=WD40; Domain location=252-290; Score =15.3; E_value=0.22; Accession=PF00400.22; Description=WD domain, G -beta repeat
  Pfam annotation: Domain name=WD40; Domain location=406-444; Score =9.4; E_value=2.9; Accession=PF00400.22; Description=WD domain, G -beta repeat
  Pfam module annotation: Pfam domain module=WD40::WD40; Domain location=252-290::406-444
MEFTESYKQTGPCCFSPDARFIAVAVDYRLVIRETVSFKIIIDAILPRKGPITRTMSKRLQEDWARAAEEGPRILMNLRVVQLFSCLDKISYIEWALDSEYILCGLYKKPMIQAWSLTQPEWTCKIDEGPAGIAYARWSPDSRHILTTSDFQLRLIVWSLLNTACVHLQWPKHASKGVSFTRDGKFAAICSRRDCKDYINLLSCHTWEIMGNFAVDTLDLADIEWSPDDSAIVIWDSPLDYKVLIYSPDGRCLFKYQAYESGLGIKSVSWSPCGQFLAVGSYDQMLRVLNHLTWKTFAELMHPSTVRGPCYAAVFKEVDEPLQLDMSELCLSDDFSQGHDDSPEEPFRVRYEVMEVPINLPFQKPPAEKPNPKQGIGILSWSTDSQYICTRNDSMPTVLWIWDIRHLELAAILVHKDPIRVAAWDPTCTRLVLCTGSTHLYMWTPSGAYCVHVPLSQFTITDLKWNSDGSCLLLKDKESFCCAAVPLLPESNKTPRFKIIQSPVGVRGNYGDQAFSGGAMEQSYVVAFGKIQWPSRPLL

SEQ ID NO: 211714 - protein, 415 aa, Glycine max
  Coding DNA Sequence Number=SeqID_94936
  Gene Ontology: Mol. function=6-phosphofructokinase activity; Cellular component=6-phosphofructokinase complex; Biological process=glycolysis
  Homolog annotation: Hit_ID=Q9FKG3; Match level="QueryCoverage=83%, HitCoverage=48%, E-value=1e-95, Identity=83%"; Hit description =Pyrophosphate-fructose-6-phosphate 1-phosphotransferase-like protein
  Pfam annotation: Domain name=AT_hook; Domain location=342-354; Score =14.9; E_value=0.061; Accession=PF02178.9; Description=AT hook motif
  Pfam annotation: Domain name=PFK; Domain location=144-403; Score= -100.2; E_value=1.2e-06; Accession=PF00365.10; Description =Phosphofructokinase
  Pfam module annotation: Pfam domain module=AT_hook::PFK; Domain location=342-354::144-403
  Subcellular localization annotation: CTP_CleavageSite=59; ConfidenceScore=5.74e-01
MDISVSFSKTRPPPFSPSLCRQLSLRPNAPQLLRFSRNNGTFRRKPPPTISRPNKLAVTAIQISNLSENEDDFVLEDVPHLTDFLPNLPSYPNPLQKSQGYSIVKKTFVSPEDVVAENVVIQKGSPRGVHFRRTGPREKPEEVRACIVTCGGLCPGINTVIREIVCGLNNMYNVEDILGIEGGYKGFYSKNTMMLTPKVVNHIHKCGGTFLRTSRGGHDTHKIVDNIEDRGINQVYIIGGDGTHKGAALIYEEVKKRGLQVAVAGIPKTIDNDIALSDIACDALSLNTCQDLSESSYHKRVGVAPIVEKMVKNRLRWFGHVERRPVDSVVRRVDQMERRQTIRGRGRPKKTIREVIKKDLELNDLDRSMVIDKSFGFDTAVEEAQRAINAAHVEVESVENGVGIVKLMGRYSGKQ

SEQ ID NO: 211715 - protein, 105 aa, Glycine max
  Coding DNA Sequence Number=SeqID_94937
  Gene Ontology: Mol. function=6-phosphofructokinase activity; Cellular component=6-phosphofructokinase complex; Biological process=glycolysis
  Homolog annotation: Hit_ID=Q7X9K2; Match level="QueryCoverage=87%, HitCoverage=73%, E-value=2e-35, Identity=73%"; Hit description =Pyrophosphate-dependent phosphofructo-1-kinase
MTLTRYALFIYPTYMIRAIPSNASDNIYCTLLAHGAVHGAMAGYTGFTVGPVNSKHAYIPIARVTEKQNKVKLTDRMWARLLASTNQPSFVASDQERVEKEIMNI

SEQ ID NO: 211716 - protein, 371 aa, Glycine max
  Coding DNA Sequence Number=SeqID_94938
  Gene Ontology: Mol. function=transferase activity, transferring hexosyl groups; Biological process=metabolic process
  Homolog annotation: Hit_ID=Q6VAA3; Match level="QueryCoverage=95%, HitCoverage=96%, E-value=1e-75, Identity=40%"; Hit description=UDP -glycosyltransferase 79A2
  Subcellular localization annotation: CTP_CleavageSite=35; ConfidenceScore=5.21e-01
LHVVMFPFLAFGHFNAGVQLSNKLFYHGVSITFLSAASNIPRIKSTLNLNPAITVIPLHLPNGITSTAELPPHLAGKLILAIDLTQSHVKSLLLELKPHYVFLDFAQNWLPKLASELEIKSVRFVSFSAISDSCINVPSRLAGVEGRNITFDDLKKPPPGYPKKSNISLKAFEAMDLMFLFKRFGEKNLTDSFPAKSVILCSFGNEKFLNDDQIKEVASGLELTGLPFVLVLNFPSNLSAKAELERALPKEFLERVKNRGLVHTALTSDCELVLLPFKADQFFNAKLIAKDLEAGIEGNRSEDGNFKKEDILKAVKTIMVEDDKEPGKHIKENHMKWKEFLSNKGIQNKFITDLLLLYEFSKQTCWLHNPP

SEQ ID NO: 211717 - protein, 83 aa, Glycine max
  Coding DNA Sequence Number=SeqID_94939
MGLGEIENKDGSAKGGRSAPDYGHGGLKAGPKSKFRPHLLLIMSGLFRDSASWWIAGFAKVCRIHVCINMHGQIWLAIKSSIQ

SEQ ID NO: 211718 - protein, 204 aa, Glycine max
  Coding DNA Sequence Number=SeqID_94940
  Gene Ontology: Mol. function=nucleic acid binding; Cellular component= intracellular; Biological process=regulation of transcription, DNA -dependent
  Homolog annotation: Hit_ID=Q8L6Y4; Match level="QueryCoverage=85%, HitCoverage=27%, E-value=3e-22, Identity=38%"; Hit description =Polycomb protein EMBRYONIC FLOWER 2
MPDIPGTSSARMAASETNSRRTGQRNNRVVWENLSEEEKLAAIESLTVYCRPIELYNIIKSRTKKKPLYLRRCMDYHIKAKRKKRLVLTASLSWKDDDNRALFPLCVCLGRLDPNTEARSAQRYHVGKISSFKGLSGVDGKGNTQLEVNFMLPEFDKLAGEVSTAKYWFLVFASAGNPISLSRANSSPWPVEVSSNECEICFNY

SEQ ID NO: 211719 - protein, 138 aa, Glycine max
  Coding DNA Sequence Number=SeqID_94941
  Gene Ontology: Mol. function=nucleic acid binding; Cellular component= intracellular; Biological process=regulation of transcription, DNA -dependent
  Homolog annotation: Hit_ID=Q8W5B1; Match level="QueryCoverage=75%, HitCoverage=23%, E-value=2e-19, Identity=42%"; Hit description =Polycomb group protein VERNALIZATION 2
MALEEALLDEDSEDEMNEGAQEIEDRREALTHTDMQRLAILDAPDHVKEFLSLWNAFIKKHRVLADGHINWACEAFTKYHSAEFAQSNSLAWNWRMFMIKLINQGLLKTSTFVACNNILEQCRKQNQDPQRQNQDPQS

SEQ ID NO: 211720 - protein, 122 aa, Glycine max
  Coding DNA Sequence Number=SeqID_94942
MVGAFSQNGVTLTSHLMILLSESDPTYLLCEGVTISFHSRVENNLEEGCKHFLGKTGEDRLPRLELDLRFKNIINLQQREDLMHALDLTQAKIETHPEKNDLWDVVEEDYKVLSLPTNLTMA

SEQ ID NO: 211721 - protein, 241 aa, Glycine max
  Coding DNA Sequence Number=SeqID_94943
MFKCKKCITYCYDNAESKAIILHPGPRCVPSIFDHDNGTHAMLQYDPEGVSDEILLPGPDCVLSVSDHDDVTHAMILDDHEGVSNATLHHEGVSNRDDGTRAMLLDDHEGSNATLHPGPDCVPSDDDGTHAMLEDDSEGVTNAILLPRPDYVPSLSDHHGGTRAVPQVDHEGVSNVIVLNPSQDCVASTSKHDHGAPKVRKARKKDKLPIEQYDPRISLSHLASSSYVAGRLLICLSFVNF

SEQ ID NO: 211722 - protein, 115 aa, Glycine max
  Coding DNA Sequence Number=SeqID_94944
MMAHQNPPYLAFCTPGQNETKNKIQGYQREANENIHIFVNEHQGMKGMVSFKTRKGKQGSKGISKELSQGKSIWLEAYKNKIASIISKYACELGSINKNQAKAIVHAINGAKHTK

SEQ ID NO: 211723 - protein, 318 aa, Glycine max
  Coding DNA Sequence Number=SeqID_94945
  Homolog annotation: Hit_ID=Q8AAA7; Match level="QueryCoverage=38%, HitCoverage=31%, E-value=2e-17, Identity=37%"; Hit description =Mannose-1-phosphate guanylyltransferase
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGIRSSNIWVVTSERYADIVREQLPDVPADNVLLEPCMRGTAPCICYASWKIKKRDPRATIVDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 211724 - protein, 257 aa, Glycine max
  Coding DNA Sequence Number=SeqID_94946
  Gene Ontology: Mol. function=oxidoreductase activity; Cellular component=mitochondrion; Biological process=electron transport
  Homolog annotation: Hit_ID=Q6AH96; Match level="QueryCoverage=99%, HitCoverage=56%, E-value=1e-121, Identity=83%"; Hit description =Ferredoxin/ferredoxin-NADP reductase
  Pfam annotation: Domain name=Pyr_redox_2; Domain location=5-223; Score=-21.6; E_value=0.0058; Accession=PF07992.4; Description =Pyridine nucleotide-disulphide oxidor
MTKLRLAIVGAGPAGIYAADILLKAERKFDVSIDLFEQLPAPYGLVRYGVAPDHPRIKGIVNALRDVLDRGDIRLFGNVRFGEDITLDDLKRHYNAVIFATGAIRDTSLDIPGIDAVASYGAADYVSWFDGHPDVPREWPLDAASVGVLGNGNVALDVARMLAKHAEDLLVTEVPQNVYEGLKASEVTDVHVFGRRGPAQVKFTPLELRELGELRDVDMVVYDEDFDYDEAAKDAVASNKQVMVIDRILQSWRKRES

SEQ ID NO: 211725 - protein, 96 aa, Glycine max
  Coding DNA Sequence Number=SeqID_94947
  Gene Ontology: Mol. function=protein binding; Biological process =cysteine metabolic process
  Homolog annotation: Hit_ID=P0AGF2; Match level="QueryCoverage=97%, HitCoverage=64%, E-value=6e-34, Identity=76%"; Hit description=SufE -like protein ygdK
  Pfam annotation: Domain name=SufE; Domain location=1-94; Score=95.8; E_value=1.3e-25; Accession=PF02657.6; Description=Fe-S metabolism associated domain
RAQAKEIAGCENRVWLGDQVDAEGKMHFFGDSEGRIVRGLLAVLLAACEGKSAAEILANDPLALFNELGLRGQLSASRSQGLQALSDAVLAAAREN

SEQ ID NO: 211726 - protein, 53 aa, Glycine max
  Coding DNA Sequence Number=SeqID_94948
MMIWKQRAKLVVATARWALKHPVYGIVILRTMFLNEKLYTAPEFQQTLLTTTK

SEQ ID NO: 211727 - protein, 142 aa, Glycine max
  Coding DNA Sequence Number=SeqID_94949
  Subcellular localization annotation: CTP_CleavageSite=24; ConfidenceScore=5.04e-01
MHRSASWNRFSDDYFKHATTSSPSSGHRSSYSMFDGNNLPTYDPIAELAKRERARVKFAENAVHVIPLVLIICAIILWLFSNPDVGIIGDPIGARIEGLSLEGEIENDSDGTQMGFLPIVTSEEISTTEIGADKDSIIPKNF

SEQ ID NO: 211728 - protein, 208 aa, Glycine max
  Coding DNA Sequence Number=SeqID_94950
MDPKTDEGEGGYGESGNPMDQFHRNEAISVVANEGVGGSGEGVGGGGGSEVMESRVLGRVNGFQNQGFRGNKVGVIGGIGVELGNQFGNLSEIEDEGGNDGVMGFVIQGQGGVGGGGGGGNVNRVGGNGVGNNASVVSSINAKGVEGVGGGGVVGSDATILFLQTEFSKYGSVKKVKFFNEKASGKSKGCPFEFFYHFVTIACKVGME

SEQ ID NO: 211729 - protein, 262 aa, Glycine max
  Coding DNA Sequence Number=SeqID_94951
  Gene Ontology: Mol. function=electron carrier activity; Cellular component=membrane; Biological process=electron transport
  Homolog annotation: Hit_ID=Q6V5G1; Match level="QueryCoverage=57%, HitCoverage=75%, E-value=3e-35, Identity=51%"; Hit description=Cu2+ plastocyanin-like
  Pfam annotation: Domain name=Cu_bind_like; Domain location=109-189; Score=91.9; E_value=1.9e-24; Accession=PF02298.8; Description =Plastocyanin-like domain
MARHKRVSQEVNALRVVWPTSLRNREKDQAVTVLSGFVLSENNVSWVWRISLSAFGEEIMMVVAWPILMRILVQFNGVSDDSEKGRSWWKVLIITCSATTYTVGDSSGWDISTNLDAWIADKNFRVGDALVFQYSSGQSVEEVTKENFNTCNTTNVLATHGNGNTTVPLTRAGDRYFVSGNKLYCLGGMKLHAHVQGDDKSLAPTLAPKAVAGSDQNTATLPQSPSSKKNTHLSAGAANPARDALHLVYIAPMAAIYGMMKI

SEQ ID NO: 211730 - protein, 387 aa, Glycine max
  Coding DNA Sequence Number=SeqID_94952
  Gene Ontology: Mol. function=transcription factor activity; Cellular component=nucleus; Biological process=regulation of transcription, DNA-dependent
  Homolog annotation: Hit_ID=Q6J9Q4; Match level="QueryCoverage=78%, HitCoverage=77%, E-value=3e-46, Identity=38%"; Hit description =Putative AP2/EREBP transcription factor
  Pfam annotation: Domain name=AP2; Domain location=219-283; Score =132.5; E_value=1.1e-36; Accession=PF00847.10; Description=AP2 domain
  Subcellular localization annotation: CTP_CleavageSite=51; ConfidenceScore=5.24e-01
MATGSKFLDNAIIRGHSHFLTASNHLHVLKSGANSSIASSPENLFSCSNPTSMKEEAPLATWISHIPAKFNVHQDIKNGKEKNQSNSIFPASDTKNSSIPLNLLETLPPLTIAPCFDEPVTSLASSSAIPKFPNLTLFLQEPSMVYSSISSSNIKGGEVMSATSDPSYHVSQFVQNQHQAGSGDAHKMNKSLSNSQSKSFDENWLSATRTQPMKNGGRGKLFKGVRQRHWGKWVAEIRLPRNRTRVWLGTFDTAEDAAIAYDTAAYILRGEYAQLNFPDLKHVIQANSLNGTTAALVEAKLQAISKGGSSHRKPTDSPPGSSNKHNDENGKLKSISGKDSSIRLGAEITERSKSTHHETSDVEGVQLSRMPSLDMDIIWDELFVSNS

SEQ ID NO: 211731 - protein, 83 aa, Glycine max
  Coding DNA Sequence Number=SeqID_94953
MTSPPLIFEDDIDEYTMEGSCKNKVKFGNFGMAEEDAKEVTGSSKHGAMVNGWEDRIGLVFLFAILDVLMDIELCRDMTNPSG

SEQ ID NO: 211732 - protein, 243 aa, Glycine max
  Coding DNA Sequence Number=SeqID_94954
  Gene Ontology: Mol. function=superoxide dismutase activity; Cellular component=chloroplast; Biological process=superoxide metabolic process
  Homolog annotation: Hit_ID=P28759; Match level="QueryCoverage=89%, HitCoverage=89%, E-value=1e-120, Identity=92%"; Hit description =Superoxide dismutase [Fe], chloroplast precursor
  Pfam annotation: Domain name=Sod_Fe_C; Domain location=123-238; Score= 156.7; E_value=6.1e-44; Accession=PF02777.8; Description =Ironmanganese superoxide dismutases, C-term
  Pfam annotation: Domain name=Sod_Fe_N; Domain location=30-119; Score =130.5; E_value=4.5e-36; Accession=PF00081.12; Description =Ironmanganese superoxide dismutases,
  Pfam module annotation: Pfam domain module=Sod_Fe_C::Sod_Fe_N; Domain location=123-238::30-119
MGRPLSKILTPATRLSRPWPHWVGPKVNAKFELKPPPYPLNGLEPVMSQQTLEFHWGKHHKTYVENLKKQIVGTELDGKSLEEIIVTSYNKGDILPAFNNAAQACMLVWNHDFFWECMKPGGGGKPSGELLELIERDFGSFEKFLDEFKAAAATQFGSGWAWLAYRASKFDGENAANPPSPDEDNKLVVLKSPNAVNPLVWGGYYPLLTIDVWENRRPDYISVFMDKLVSWDAVSSRLEQARL

SEQ ID NO: 211733 - protein, 86 aa, Glycine max
  Coding DNA Sequence Number=SeqID_94955
MSSSRQRTKGISYFRRGQLSSLSLKKAILSSCYPDYPPVLFWLNPNCPYFQCSLSPTSNGQCFQISVVGHDAGVARPQVKTQVIHW

SEQ ID NO: 211734 - protein, 813 aa, Glycine max
  Coding DNA Sequence Number=SeqID_94956
  Gene Ontology: Mol. function=binding; Cellular component =mitochondrion; Biological process=cell cycle
  Homolog annotation: Hit_ID=Q1RSH5; Match level="QueryCoverage=99%, HitCoverage=99%, E-value=0.0, Identity=71%"; Hit description =Tetratricopeptide-like helical
  Pfam annotation: Domain name=PPR; Domain location=152-186; Score =29.9; E_value=8.8e-06; Accession=PF01535.11; Description=PPR repeat
  Pfam annotation: Domain name=PPR; Domain location=187-221; Score =36.4; E_value=1e-07; Accession=PF01535.11; Description=PPR repeat
  Pfam annotation: Domain name=PPR; Domain location=222-256; Score=2.8; E_value=3.4; Accession=PF01535.11; Description=PPR repeat
  Pfam annotation: Domain name=PPR; Domain location=274-308; Score =41.9; E_value=2.2e-09; Accession=PF01535.11; Description=PPR repeat
  Pfam annotation: Domain name=PPR; Domain location=309-343; Score =40.9; E_value=4.3e-09; Accession=PF01535.11; Description=PPR repeat
  Pfam annotation: Domain name=PPR; Domain location=344-378; Score =37.1; E_value=5.9e-08; Accession=PF01535.11; Description=PPR repeat
  Pfam annotation: Domain name=PPR; Domain location=379-413; Score =29.0; E_value=1.7e-05; Accession=PF01535.11; Description=PPR repeat
  Pfam annotation: Domain name=PPR; Domain location=482-516; Score =25.4; E_value=0.0002; Accession=PF01535.11; Description=PPR repeat
  Pfam annotation: Domain name=PPR; Domain location=517-551; Score =13.9; E_value=0.17; Accession=PF01535.11; Description=PPR repeat
  Pfam annotation: Domain name=PPR; Domain location=552-586; Score =36.9; E_value=6.9e-08; Accession=PF01535.11; Description=PPR repeat
  Pfam annotation: Domain name=PPR; Domain location=587-621; Score =34.2; E_value=4.5e-07; Accession=PF01535.11; Description=PPR repeat
  Pfam annotation: Domain name=PPR; Domain location=622-656; Score =23.6; E_value=0.00069; Accession=PF01535.11; Description=PPR repeat
  Pfam annotation: Domain name=PPR; Domain location=657-690; Score =15.4; E_value=0.11; Accession=PF01535.11; Description=PPR repeat
  Pfam annotation: Domain name=PPR; Domain location=691-724; Score=4.4; E_value=2.2; Accession=PF01535.11; Description=PPR repeat
  Pfam annotation: Domain name=PPR; Domain location=725-759; Score =33.9; E_value=5.6e-07; Accession=PF01535.11; Description=PPR repeat
  Pfam module annotation: Pfam domain module=PPR::PPR::PPR::PPR::PPR::PP R::PPR::PPR::PPR::PPR::PPR::PPR::PPR::PPR::PPR; Domain location=152 -186::187-221::222-256::274-308::309-343::344-378::379-413::482 -516::517-551::...
  Pfam module annotation: Domain location=552-586::587-621::622 -656::657-690::691-724::725-759
MFVKLQLLYPHTPLLANANANANAFLLPEKTEQVSPTRRKQRLPLHNGTVKQETHSKKRRPEKNPEEGVPRKSKPEKSHTKCSTKRVSYGGCIPAILEALDAVLGVDEALGPWEERLSNKERSIILKEQLRWDRALEIFEWFNKKGHELNTIHYNIMLRSLGRARQWRRVESLWNEMNARGIAATCSTYGTLIDVYSKGGRRDDALSWLDMMLGQGVQPDEVTMVIVVQLYKKAGEFQKAEEFFKKWSLGNDNAMATLELDERVVCANASFGSHTYNTLIDTYGKAGQLKEASETFAKMLKQGVAPTTVTFNTMINICGNHGQLEEVSLLVRKMEELRCSPNTRTYNILISLYAKHDDIGMATKYFEIMKEACLEPDLVSYRTLLYAYSIRKMVGEAEELVKEMDERRLEIDQYTQSALTRMYIKAGMLDQSLLWFLRFHVAGNMTSECYAASIDAYGEHGHTLEAEKVFIWSQKQKNLSVLEFNVMIKAYGIGKCYEKACQLFDSMEQHGVVADRCSYTSLIQILTTSDQPHMAKPYLKKMQEAGLVSDCIPYCVVICSFAKLGQLEMAEDIYWEMIRHGVQPDVIVYSILINVFSDAGRVKEAISYVDEMKKAGLPGNTVIYNSLIKLYAKIDNLEKAQEAYKLLQLSEEGPNVYSSNCMIDLYVKQSMVGQAKQIFDTLKKNGGANEFTFAMMLCLYKKIERFDEAIQIAKQIRKLGPLTELSYNNVLDLYAIAGRPKEAIETFKEMVRASIQVNDCSLRSLGNLLLRYGVSRLAVGKLEALVKKDASNGLQAWMLALSSVLEVDDYDHD

SEQ ID NO: 211735 - protein, 88 aa, Glycine max
  Coding DNA Sequence Number=SeqID_94957
  Subcellular localization annotation: CTP_CleavageSite=36; ConfidenceScore=5.05e-01
MPRKHALSAPLARLASHLYLLAPSVPDSLSQKSLTRAKRAFENRKPLKAEVDVKKGESLAFGRREIYVRDAVGQGSTKNLSFPEDSRF

SEQ ID NO: 211736 - protein, 156 aa, Glycine max
  Coding DNA Sequence Number=SeqID_94958
  Gene Ontology: Mol. function=protein binding
  Homolog annotation: Hit_ID=Q1RSH6; Match level="QueryCoverage=99%, HitCoverage=73%, E-value=1e-53, Identity=68%"; Hit description=BSD
  Pfam annotation: Domain name=BSD; Domain location=102-156; Score=6.9; E_value=0.042; Accession=PF03909.7; Description=BSD domain
MSSRQVVKRAKYKTTVKDPGTPGVLKLTQDRFVFKPNDPTSKTKLDVEFRFIQGHKVTKEGSKQPPLLNLIRAQGSCIFELESFADLHVCRELVGFALNRNVPGEATKVISEEQLSPAEMALRIKLLQEDSKLQRLHKELVASGKLTESEFWATKK

SEQ ID NO: 211737 - protein, 70 aa, Glycine max
  Coding DNA Sequence Number=SeqID_94959
  Gene Ontology: Mol. function=hydrolase activity, acting on ester bonds; Biological process=lipid metabolic process
  Homolog annotation: Hit_ID=Q9SZ19; Match level="QueryCoverage=88%, HitCoverage=17%, E-value=6e-18, Identity=61%"; Hit description =Putative APG protein
MANPVHRFEVVEKACCSTGTFEMSYLCSDKNPLTCTDAEKYVFWDAFHPTEKTNRIVSNYLIPKLLATFR

SEQ ID NO: 211738 - protein, 272 aa, Glycine max
  Coding DNA Sequence Number=SeqID_94960
  Homolog annotation: Hit_ID=Q1RSH7; Match level="QueryCoverage=99%, HitCoverage=49%, E-value=4e-53, Identity=77%"; Hit description=IMP dehydrogenase/GMP reductase
MEMEHPRTVAEILARRKQDEERRNRISKMTPIEDLQAQDNHPYAPLCIKLITRFMKCVLVGTCNNINIGKRKRHSLVGKGEVHVQQLRREKNMHCSVWQWYRRITSNRGKRKRGIVKSEHADRHRGGLNQGTGSRVNELTRSDPRDYFDSQQANAVKTLDDSQAGMEQMKCSLGSEEAYDSLRASISKIKTTGLRDPLFSPDVALKVLNGLTKNITSTKYHLGKSSQESVLDILPNSTKEKLLDHWVCSQELLRHFWSSYPVSTQNLVSKAK

SEQ ID NO: 211739 - protein, 264 aa, Glycine max
  Coding DNA Sequence Number=SeqID_94961
  Gene Ontology: Mol. function=protein tyrosine/serine/threonine phosphatase activity; Biological process=protein amino acid dephosphorylation
  Homolog annotation: Hit_ID=Q6Z648; Match level="QueryCoverage=24%, HitCoverage=22%, E-value=1e-17, Identity=68%"; Hit description =Protein phosphatase-like
  Pfam annotation: Domain name=DSPc; Domain location=1-103; Score=-2.5; E_value=0.00026; Accession=PF00782.11; Description=Dual specificity phosphatase, catalytic domain
MTATRNVIQRLHKEWDLPMTHCDVAVDQRSGRVDNDPLFSNSVGNCEQCEKDKERVLVHCMSGKSRSPAIVIAYLMKSKGWRLVHSYQWVKERRPSVELTQVKPSDCSVGQLKTLIWPSYLFEDHYGNFIKLKGKHLHFQSVHLFDHLFAIVFPLLSPLFSGDPLMPEFEEKIYGRIDSGSSLVPGFLPAAPPSISFGFPKINDPAQLPSFSAGTPSIFARAPLDIAPTEFTFGAGQTQKNVAGNPFNANPANPNGTDIQMDGS

SEQ ID NO: 211740 - protein, 114 aa, Glycine max
  Coding DNA Sequence Number=SeqID_94962
MAKYTKGMLVFGLGVLIVSMWCMKGTEAGDDDDDDDDEPIIHAVRREDPREGCGSSHPEGGVEECTDEDDSLGLYGDIDDTFKAAVKKVASHFHHDDGNDSPNIANNNVNVLGH

SEQ ID NO: 211741 - protein, 52 aa, Glycine max
  Coding DNA Sequence Number=SeqID_94963
  Homolog annotation: Hit_ID=Q1RSH7; Match level="QueryCoverage=75%, HitCoverage=10%, E-value=2e-11, Identity=85%"; Hit description=IMP dehydrogenase/GMP reductase
MQTRRLKDSISQIYSKLEDIKVSAESDLRHHVSLVVHPMQQIGFDKHKPLPT

SEQ ID NO: 211742 - protein, 314 aa, Glycine max
  Coding DNA Sequence Number=SeqID_94964
  Gene Ontology: Mol. function=zinc ion binding; Cellular component =intracellular; Biological process=regulation of transcription, DNA -dependent
  Homolog annotation: Hit_ID=Q52ZI8; Match level="QueryCoverage=99%, HitCoverage=86%, E-value=3e-55, Identity=44%"; Hit description =CONSTANS-LIKE a
  Pfam annotation: Domain name=CCT; Domain location=251-289; Score =79.2; E_value=1.3e-20; Accession=PF06203.4; Description=CCT motif
  Pfam annotation: Domain name=zf-B_box; Domain location=8-55; Score =63.9; E_value=5e-16; Accession=PF00643.14; Description=B-box zinc finger
  Pfam module annotation: Pfam domain module=CCT::zf-B_box; Domain location=251-289::8-55
NRVASRHKRVWVCEACERAPAAFLCKADAASLCSSCDADIHSANPLASRHNRVPILPISGSLFREPEHNHKRVEHAFVNEVEEEEEGVFDEYEDEVEAASWLLPHPMKNNDEIEENDCGDEGFLFVDEYLDNLVDCCNSCGHNDNQFSNVYQHQQNYNTVPQNYVVVPVQVPQHFQPGLDFDSSKAGFSYDGSLSQSVSVSSMDVGVVPESTVSGISMSHSKSPIGTNDLFPPLLMPSHLTPMDREARVLRYREKKKTRKFEKKIRYASRKAYAETRPRIKGRFAKRTDVEAEVDQMFSTKLFNEVGGSIFPTF

SEQ ID NO: 211743 - protein, 316 aa, Glycine max
  Coding DNA Sequence Number=SeqID_94965
  Gene Ontology: Mol. function=kinase activity; Biological process =metabolic process
  Homolog annotation: Hit_ID=Q4V0G0; Match level="QueryCoverage=72%, HitCoverage=67%, E-value=6e-66, Identity=56%"; Hit description=2 -keto-3-deoxygluconate kinase
MGLYFLAPGAVHRASEVVYDRAGSAFANSSAEDHAWPALLSGAQLLHVSGISPALGDNVAGSVLGAVRAARAARVQVSFDGNYRPSLWRRWGGDAGAILREVFAEADIVFADHRDIELVLGLHFPQDDAVARTEAAAAAAFAAFPHLQWLACTQRDVVSADHHILGALLLGRDGSRAQAPPRPLPGIVDRIGGGDAFAAGILHGMLSGLDAESTVRFGLAAGALKHAIPALNAERAWSPRRGGDEATVGTQIDAAGTGIQQDIELLQDFAAKRPVVRGAIVIDGDRVLSAPSVAGSRCWPRARARPPRGSSGPRCR

SEQ ID NO: 211744 - protein, 68 aa, Glycine max
  Coding DNA Sequence Number=SeqID_94966
  Gene Ontology: Mol. function=glutathione transferase activity; Cellular component=cytoplasm; Biological process=metabolic process
  Homolog annotation: Hit_ID=Q9FQE3; Match level="QueryCoverage=91%, HitCoverage=28%, E-value=4e-21, Identity=74%"; Hit description =Glutathione S-transferase GST 15
MLFGSIVKFLEVVEDTLEVKILDDEKFPHLHSWYNNFKNAPVIKENLPDHEKMVGFFKFFREKLLVSS

SEQ ID NO: 211745 - protein, 115 aa, Glycine max
  Coding DNA Sequence Number=SeqID_94967
  Subcellular localization annotation: CTP_CleavageSite=45; ConfidenceScore=5.29e-01
MQVCEVLIFIYSLSQSANSTSYLLSATLSTRKWRRDFRHFSKTKRASTNKATYYVSSVCFFLDHVDACFVRIIQQRKLVYFLELDRAGLVYRIITRDRGTFWSSLVQQEESEDDA

SEQ ID NO: 211746 - protein, 243 aa, Glycine max
  Coding DNA Sequence Number=SeqID_94968
MAQSNSSRLGFPVLITSLCRSRGVVFDSLAFERLSLIINLAYIRKNCWNPDDSTVIIRGFKRPRARPTEVPSTSAAPYPASTSAAPPPAHMAVALSTLPPADFQHFETMLQSIHQGQIILLQSLQLVAPPDSIPMVEQFIEWVAWPGTQPPLHREHEDPATQVPHQSEDESSDSSTPEPLIRKRRVVVTHEAASTFEKSLEASPELPALVADTTSPQQAAEPSTPKDQTTPVLSPNTSPVATP

SEQ ID NO: 211747 - protein, 43 aa, Glycine max
  Coding DNA Sequence Number=SeqID_94969
VGSFLPCLANENMLVSVETQVRLSSDMNPHGTRADLGSSRIKP

SEQ ID NO: 211748 - protein, 977 aa, Glycine max
  Coding DNA Sequence Number=SeqID_94970
  Homolog annotation: Hit_ID=Q10RW2; Match level="QueryCoverage=83%, HitCoverage=85%, E-value=1e-104, Identity=31%"; Hit description =Expressed protein
  Subcellular localization annotation: CTP_CleavageSite=68; ConfidenceScore=5.35e-01
MAEGSSSTDIQRVLAAIKSSEASFFFFSLSFLFLFVNFTSSMWSQILGFYVQIVEDRVELFNDLRRIELKNVSESDYGSVINCLVACVWCDKHLKMSLLSSEDSQEDEHSSVFYQLLVEILRFSASTFSTLLKFTDFGDKELMDTVEIFILEALNLTKDSISEAKKIQSFGSEILKVAHVVIDAVVKLCKVRSELINQEVGDEKWLRLDKPAIVDHVINITKCAIEKLSQIGVLAANDGGNSVNILNVSWKGIVSLLQIGGGHFTEVDVANIVLTLLALITEPLKCAAQAWSSSLNEAISVTEAKRIFVPVKFYLINAVKICSLYPHQAYTVYKEITECVLKITCFWIFVSNENLLKCASVVITELLEETTLNLLLSLLNSYKLKLEQKLEVLEWLFTNKGDSHSGLDCPTLSDCNLAWVNDIFCNSYESMSRAKILILGRVVLFINFFRYSLGLDGDMKIAITQKLYWFLDVLVEEDVYSHILVLQFPLLYGSGKTAELVRQPMFTSLLQAFKTFMIVICSSTAWEELESFLLENFFHPHFLCWEIVMECWCFMLRYAETQMANNILSKLCSLLKLLASSYSVFVPYSSFRKLARSICMLLTNGAQSMVNEVYMSLVGDGKSQLSSIFCLALFMEGFPFDLLTDELRKTSIQRIISDYFDFIDNFDEASLVACSSGLFGVPVFILSASLQSLQDGLSHIDERARKFLVAISSNYKSTVDKVIKDRYLQLFSETLGIISYFKKLYTSNDIEQVIMEIQNIFLSEPPALLDKCKPHLAQFLAGLVHMEISESDDDAKSCAVWELYHLLLKERHWALSHLAITAFGYFASRTRCNKLWRFVPEDAALSYDIVSGVESDQQRFMVEFGKFLKKEIALLTLAPIPEQLELLGREGFVLKQMVQKISAIAEEREKCEVMEVDHKSQSHKKRKLPDGINRGVELLKNGLKIIGDGLSQWQLNDFDTTELHEAKSEIKRKEKKK

SEQ ID NO: 211749 - protein, 319 aa, Glycine max
  Coding DNA Sequence Number=SeqID_94971
  Gene Ontology: Mol. function=protein-tyrosine kinase activity; Cellular component=membrane; Biological process=protein amino acid phosphorylation
  Homolog annotation: Hit_ID=Q1RSI5; Match level="QueryCoverage=99%, HitCoverage=24%, E-value=1e-137, Identity=76%"; Hit description =Octicosapeptide/Phox/Bem1p; Protein kinase
  Pfam annotation: Domain name=Pkinase; Domain location=9-302; Score =189.5; E_value=8.2e-54; Accession=PF00069.15; Description=Protein kinase domain
  Pfam annotation: Domain name=Pkinase_Tyr; Domain location=9-302; Score=238.3; E_value=1.6e-68; Accession=PF07714.7; Description =Protein tyrosine kinase
  Pfam module annotation: Pfam domain module=Pkinase::Pkinase_Tyr; Domain location=9-302::9-302
MQNIENDDLEELQELGSGTFGTVYHGKWRGTDVAIKRIKSSCFSGRLSEQERLTKDFWREAQILSTLHHPNVVAFYGVVPDDPGGTLATVTEYMLHGSLRNVLMKKDKVLDRRKRLLIAIDAAFGMEYLHLKNIVHFDLKCDNLLVNLGDPERPVCKVGDFGLSRIKRNTLVSGGVRGTLPWMAPELLDGNSCRVSEKVRNFICLSVLFTLIFTRHSHVDRASTVLENVDIFSFGIAMWEMLTGEEPYANMHCGAIIGGIVNNTLRPPIPKRCDSEWKKLMEECWSPDPAARPTFTDIKNRLRNMSDSVPKKRHNIARR

SEQ ID NO: 211750 - protein, 902 aa, Glycine max
  Coding DNA Sequence Number=SeqID_94972
  Gene Ontology: Mol. function=protein-tyrosine kinase activity; Biological process=protein amino acid phosphorylation
  Homolog annotation: Hit_ID=Q1RSI5; Match level="QueryCoverage=98%, HitCoverage=75%, E-value=0.0, Identity=62%"; Hit description =Octicosapeptide/Phox/Bem1p; Protein kinase
  Pfam annotation: Domain name=PB1; Domain location=206-293; Score =95.3; E_value=1.9e-25; Accession=PF00564.15; Description=PB1 domain
MSNEDPGISGKQYIDTVSVGLSDRISSDDDSDNICLQTGEEFSAEFLRDRVALRRFPVVTNADQHMPNRLDFNIKENNYQLVYEDLKHVLGLRRTESDSNSDLSEIASVRGYAVEVDGRAYPNNLSRYQCEHGGFRQASGKFSRQLSGKFSEGNGCDQVNSGPNAPSVYVVESPHCHPYGSVFSEGSFYKKIKFLCSFGGRILPRPNDGKLRYVGGETRIISIRKNITWEELMRKTSAICSQTHIIKYQLPGEDLDALISVCSNEDLHHMIEECEELERAGGSQRLRNFLIPSNECESPSSNEARVNQPSDADYHYVVAVNGLLDPSPRKNSNGLSLASHANQFGNTSDYNSPHFYRDSSTSAFASEMKDCTPNSPNLVGILSKPGTQFFPVLAGKSFSQMSPLSPTCVQPKDPKISNVQLFKDKPYHAINESITPFVMEKVPCNNSLFVENANYVDPVAHHNNLAQGPTCVNYHPNNQYIVEPDLIRKPGENLHLHRRNNSSNEFVSSAACSLTDMIFERPLVNNEGSYHFNKVVSRPHESSSLFSDSDVREGSWYRMLHAHSDSTLKENDENYKVHLQFPLSVERDNLPSLKNSSSLEECSIQPGEMIDRKEHLAKYQNLPIFGKTDSFNVSEIGKDILQLADKSNDFFDENAGAMSQDNAIDLKHLQYIYSSHGVCSSSPDFQSSECNLSTASFISLESTRNLRGKPLDRTASEFSRRSQYSSMVHQYAMPETKDGQPLLPCSFESQTDRGSILPISYMDMCSSLREVVIPVEDPAYYLHQKEHNTVIKNQCSEYINEFCVHKPVAEPVAVVKGPRDYNSSGIQSCLKVVSNVDEEADVEPTSPEKEGIECDNPESESKHAESDSGNFNKPNGDRATAETEAEIYGLQYYHECLEWFAE

SEQ ID NO: 211751 - protein, 166 aa, Glycine max
  Coding DNA Sequence Number=SeqID_94973
  Subcellular localization annotation: CTP_CleavageSite=38; ConfidenceScore=5.24e-01
MNSKNQTPIRVFGQRTIASTFRNLPPRNPPSEGNERNQASRKSETAHHSLSHFLTLKPQKSPQTVPGKSTPFLSPLGLKGEEGGAVKEVEKEKNGGSDDKVIFKSFKHTEEDKRDFVDQIEVGELENSVAEDIQESNKRKTPFEVLLPDPFLNSCCTLASLPKRIY

SEQ ID NO: 211752 - protein, 102 aa, Glycine max
  Coding DNA Sequence Number=SeqID_94974
  Homolog annotation: Hit_ID=Q8W5N5; Match level="QueryCoverage=39%, HitCoverage=2%, E-value=2e-09, Identity=60%"; Hit description =Putative disease resistant protein
MDVIACLKIYPEAIYYGGANESQTARNNVVVLGGASKLKPKKGQIGNDTSNKRPRPHYNHYANGRGWWDYDMEGVDNEELGFSDEVWEGVGSTTLGGIVDWH

SEQ ID NO: 211753 - protein, 307 aa, Glycine max
  Coding DNA Sequence Number=SeqID_94975
  Gene Ontology: Mol. function=beta-glucosidase activity; Cellular component=smooth endoplasmic reticulum; Biological process=bile acid metabolic process
  Homolog annotation: Hit_ID=Q2R859; Match level="QueryCoverage=85%, HitCoverage=26%, E-value=6e-61, Identity=44%"; Hit description =Expressed protein
MVSGNIFHCRKNSWPPQEYISKSTLQLFDYDSSAPPEQAWRRRLNSHANLLKEFRVRLGIRIWSYVREEASHGRSNMLKLRIPDFILLACFLQKAPIDPFTRESCKPSASQGVPLGGMGSGSISRGFRGEFRQWQIIPSLCEASPVMSNQFSIFISREGGKKKFASVLAPGQHEGLGSSRKPDDQGISSWGWNLSGQHSTYHALFPRAWTVYDGEPDPELKISCRQISPFIPHNYRESSLPAAVFVYTLVNTGKERAKVSLLFTWANSIGGSSHSSGDHVNEPFKAEDGVSGVLLYHKQVIEPYSYI

SEQ ID NO: 211754 - protein, 134 aa, Glycine max
  Coding DNA Sequence Number=SeqID_94976
  Subcellular localization annotation: CTP_CleavageSite=21; ConfidenceScore=5.63e-01
MGHMSYNKVSTSTSSGKASSRCSRGFRLNPRKFYVLRLRKRFNFFLRLFDSWKLSYGEAIQLLKKMVCRKSGLKRNNSNNSTRSLVRSREEKIKDHEDCKMRSCVLGLHEKIAIAHAVNISSLASFSSVMGHSL

SEQ ID NO: 211755 - protein, 839 aa, Glycine max
  Coding DNA Sequence Number=SeqID_94977
  Homolog annotation: Hit_ID=Q53QK3; Match level="QueryCoverage=75%, HitCoverage=93%, E-value=1e-20, Identity=26%"; Hit description=PWWP domain, putative
  Pfam annotation: Domain name=PWWP; Domain location=236-315; Score =11.8; E_value=0.0008; Accession=PF00855.8; Description=PWWP domain
MDDERETLDEPVEKEGSLVGDGKDLKVGVLGSDLCTEDGVCTREGDAELNGDVGFDGSKEEGKGVNPSGGEAAEALGEGSQVVRSLEGKSENEIAELDGNDATLKTLDEKKNINDRKVKKLVEKEAISDVIRVKSDVSQSIEEHAKALGEGSQVVKFLEGKSENDTVESDISQSIEGKAGFPEQVGSQGELEIEGENFDDAKWRKPTHGRVTKHVSNKSSGNILHASYQLPKERGEFSVYDMVWGKVKSHPWWPGQIFDLSDSSVEAKKHLKKDRHLSNSDAFQNAVDCALDEVRQCAEFGLACSCIPKDTYDKIKLQTVESTGIREELSFTRRVDESLNASSFSPDNLLEYLKTLSEFPTGGFDRLELLIAKAQLLAFYRLKGYSCLPELQYCGVVDNDTDAFLIKDLLKGTDKSLSKVNKHATHASKKGQTGAGNLKTTNGSCRKSKHNLKDDLYPEKKKRILSESVGRTPDSSHGYYRSGDATDNLISPASSKKRKTIDHCAAVSGVKDRRKTISLAKVSNSIKQSFKIGERILRVANQLTGPPSVLKCSGDRSQMEDGSADGFSGNGSGFFSPNLEKTQKSSLTVPTEYSSLDDLLHLLQWVAQEPLGDYSSLNVIVSFFSDFRNSIIVANDSGKEISPTKKVGKKKKRPVGGSPETIEFDDLSDTHWTDKGIQSGSEKKLPRRSNRRDYQHAPAEPEKPIIVYTRRSYSRKQCSDSNLVVVPEKPFVCADENSPAELVLNFAELDSVPSEMHLNKIFRRFGPLNESETEVDRGSSRARVVFKKCTDAEVAFSNAKNFNIFGSVLVNYKLNHTPSTLFKASSLATTQDQENGDAC

SEQ ID NO: 211756 - protein, 607 aa, Glycine max
  Coding DNA Sequence Number=SeqID_94978
  Gene Ontology: Mol. function=protein binding; Cellular component =spliceosome; Biological process=cell division
  Homolog annotation: Hit_ID=Q84MU4; Match level="QueryCoverage=90%, HitCoverage=94%, E-value=0.0, Identity=67%"; Hit description =Putative pre-mRNA splicing factor
  Pfam annotation: Domain name=WD40; Domain location=279-318; Score =44.3; E_value=4.1e-10; Accession=PF00400.22; Description=WD domain, G-beta repeat
  Pfam annotation: Domain name=WD40; Domain location=323-361; Score =47.3; E_value=5.1e-11; Accession=PF00400.22; Description=WD domain, G-beta repeat
  Pfam annotation: Domain name=WD40; Domain location=365-405; Score =9.7; E_value=2.7; Accession=PF00400.22; Description=WD domain, G -beta repeat
  Pfam annotation: Domain name=WD40; Domain location=409-447; Score =34.2; E_value=4.4e-07; Accession=PF00400.22; Description=WD domain, G-beta repeat
  Pfam annotation: Domain name=WD40; Domain location=452-490; Score =10.7; E_value=2; Accession=PF00400.22; Description=WD domain, G-beta repeat
  Pfam annotation: Domain name=WD40; Domain location=497-537; Score =12.7; E_value=1.2; Accession=PF00400.22; Description=WD domain, G -beta repeat
  Pfam annotation: Domain name=WD40; Domain location=541-580; Score =29.8; E_value=9.9e-06; Accession=PF00400.22; Description=WD domain, G-beta repeat
  Pfam module annotation: Pfam domain module=WD40::WD40::WD40::WD40::WD4 0::WD40::WD40; Domain location=279-318::323-361::365-405::409 -447::452-490::497-537::541-580
  Subcellular localization annotation: CTP_CleavageSite=46; ConfidenceScore=5.23e-01
MDLLHQYSDGDDPDSPSQNPSSPPRLLAGRSAAPKVDDTMLALTVTSSSSAALSRPIDPTQHLVGFNPSYDQLWAPIQGPAHPFAKDGIAQGMRNHKLGFVEDASIEPFLFDEQYNTFHKFGYAADPAANNFVGDLDALRDNNAVSVYNIPRHEHKKRRIEAKEKKKSDENTGDDDDNNDEEENQNPASEAWITKNKKSPWAGKKEGLQGELTEEQQKYAEEYAKKKGEEKSGFGGEKVEVVKDKSTFHGKEEKDYQGRSWIAPPKDAKASNDHCYMPKRLIHTWSGHTKGVSAIRFFPKYGHLILSAGMDTKIKIWDVFNSGKCMRTYMGHSKAVRDICFSNDGTKFLSAGYDKNIKYWDTETGQVISTFATGKIPYVVKLNPDEDKQNVLLAGMSDKKIVQWDMNTGQITQEYDQHLGAVNTITFVDNNRRFVTSSDDKSLRVWEFGIPVVIKYISEPHMHSMPSISLHPNANWLAAQSLDNQILIYSTREKFQLNKKKRFGGHIVAGYACQVNFSPDGRFVMSGDGEGKCWFWDWKTCKVYRTLKCHEGVCIGCEWHPLEQSKVATCGWDGMIKYWYVNSRAMQQLITESYMVFVQICFCYHSC

SEQ ID NO: 211757 - protein, 103 aa, Glycine max
  Coding DNA Sequence Number=SeqID_94979
MWDLIQVTCEGTPKVRRARNNSFIQEYETFRMKQVIKISESEDLTSITNAELFGKLRKYEVDITRIAKEEEKEKKMIKLALKTTTSLGDESEEQNVDGSDAEL

SEQ ID NO: 211758 - protein, 590 aa, Glycine max
  Coding DNA Sequence Number=SeqID_94980
  Gene Ontology: Mol. function=nucleic acid binding; Cellular component= intracellular; Biological process=regulation of transcription
  Homolog annotation: Hit_ID=Q9FJS0; Match level="QueryCoverage=79%, HitCoverage=66%, E-value=1e-160, Identity=57%"; Hit description =Arabidopsis thaliana genomic DNA, chromosome 5, P1 clone:MQD22
  Pfam annotation: Domain name=JmjC; Domain location=213-336; Score =166.8; E_value=5.6e-47; Accession=PF02373.13; Description=JmjC domain
  Pfam annotation: Domain name=JmjN; Domain location=37-76; Score=33.6; E_value=6.9e-07; Accession=PF02375.7; Description=jmjN domain
  Pfam module annotation: Pfam domain module=JmjC::JmjN; Domain location=213-336::37-76
MTGKSPITQRTARHGSHKLCKFDLADLEWTNMIPECPTYHPSEYEFEHPLVYLQKIAPEASKYGICKIVSPIAASNPAAFVLMKEKKDFKFETNVQPLRLSKWNEKDIITFSMRGRKYTYHDFEVLANKAFFSRFHNSRDLPSSYVEKEFWHEMAHGEKGTVEYGVNVEGSAFSCDPNDRLGTSKWNLKNFSRLPQSLLRLVDRKIPGITDPMLYIGMLFSMFAWHVEDHYLYSINFHHSGANKTWYGVPGHAASQFEKTVLQHVYCNKIITKHGEDGAFKFLAQKTTMFPPNVILQHDVAVYKAVQKPGEFIITFPRAYHAGFSHGFNCGEAVNFANGDWFSLGAAASMRYTHLKMMPLIPYEELLCKEAMLVFKSSRVRSSKNKPEDKTSYQAIMLPFVHLVQSYKTSLLRLNSSRKLPSSSNTTGSQICSLCYRDCYVAYFLCKYCFSHPICLFHDIAPQTCLCGRDYTIFKRNDIFALEEAAKSSQQGKECVDKFSLSSIFSCSRNDCIKDPENNPWQREKSVRGTASSLGAASKPKTKVADSTKHSVERNKSTMKHWRNNGLPSVRGTERPGIIYNLRKSKSKLI

SEQ ID NO: 211759 - protein, 117 aa, Glycine max
  Coding DNA Sequence Number=SeqID_94981
MDSVTSGCNTDIRACFAEQLALPVGVTDTTSAHFRLQRGGGSNGSVNMITDKTRQDNERFQNNLPRECSLPSFRLYVIIVKKSRVKVGDVAERGFLKLTTAGNVNLNAGHIVEVPGT

SEQ ID NO: 211760 - protein, 180 aa, Glycine max
  Coding DNA Sequence Number=SeqID_94982
  Gene Ontology: Mol. function=sequence-specific DNA binding; Cellular component=intracellular; Biological process=regulation of transcription, DNA-dependent
  Homolog annotation: Hit_ID=Q2XTB9; Match level="QueryCoverage=79%, HitCoverage=88%, E-value=6e-55, Identity=76%"; Hit description =Transcription factor NF-Y CCAAT-binding-like protein-like
  Pfam annotation: Domain name=CBFD_NFYB_HMF; Domain location=42-107; Score=134.4; E_value=3.1e-37; Accession=PF00808.13; Description =Histone-like transcription factor (CBFNF-Y) and archaeal histone
MKGDKNVKVCEMSDAPASPSHESGGEQSPRGSLSGAAREQDRYLPIANISRIMKKALPPNGKIAKDAKDTMQECVSEFISFITSEASEKCQKEKRKTINGDDLLWAMATLGFEDYIEPLKVYLARYREAEGDTKGSARSGDGSARPDQVGLAVNTYFVCTVGLCFWQLVHQGSLNYIGLQ

SEQ ID NO: 211761 - protein, 71 aa, Glycine max
  Coding DNA Sequence Number=SeqID_94983
MPEKLPEMVKAEEDEPDSSSSFSTITKSFDSKGKGPTVSEGTPMVEAGGGADGAFTGEGVGIEEDLSHWIV

SEQ ID NO: 211762 - protein, 659 aa, Glycine max
  Coding DNA Sequence Number=SeqID_94984
  Homolog annotation: Hit_ID=Q1RUM5; Match level="QueryCoverage=43%, HitCoverage=87%, E-value=1e-108, Identity=69%"; Hit description=Haem peroxidase, plant/fungal/bacterial
  Pfam annotation: Domain name=peroxidase; Domain location=43-292; Score=460.3; E_value=2.5e-135; Accession=PF00141.13; Description =Peroxidase
  Subcellular localization annotation: CTP_CleavageSite=24; ConfidenceScore=5.28e-01
MDNTSMLQMVSSLVLILSVSSLASASLKVGFYSSTCPSAEEIVRSTVNKAISDNAGIAAGLIRMHFHDCFVRGCDGSVLLASTPGNPVAERDHFANNPSLRGFEVIEEAKTQLEAACPQTVSCADILAFAARDSALKVGGINYDVPSGRRDGRISIADEVPRNLPAPTSSAHELVSNFSRKGLSADEMVTLSGAHSIGVSHCSAFSKRLYSFNDTVTQDPSMDSSYAETLKSNCPAPPSTIDSTVSLDPSTPIRLDNKYYEGLINHRGLLTSDQTLYTSQTTREMVQSNANNGASWAEKFAKAMVQMGSIEVLTGSDVTPISNVQTLSFAPEPTAILYGANYPLWSQVVEMFVAGRVKLVGAYRMGLSVLKICITNELTEGKEPKRENSKEMATLAMSTLLFERYILCDCLLTFIGEYAEAIEKLEGVQELTNSYLGVRVAALETQAGLHLLMRQDDLAAAVADKCMKTVENQEKPLEYESRFIDYEAQFVCAKALKGLIGNGNADSAEDFFDKSLREKYCDDRELSMAKEVYQNVVQGAIEVKNAGRPYLGAEHHLTQALSRAEEAYGDSKHPRVGVALTSIALMYRRKAIHEHSSSLLVQEGLYRKVIDILKVPTTETESEDAAPLVDRSDTAALATGVSLLYSAEGGRTRRREEGK

SEQ ID NO: 211763 - protein, 173 aa, Glycine max
  Coding DNA Sequence Number=SeqID_94985
  Homolog annotation: Hit_ID=Q9AYT5; Match level="QueryCoverage=40%, HitCoverage=8%, E-value=7e-13, Identity=58%"; Hit description =Chloroplast RelA homologue 1
MVTNFFLHWLNINLIKNATRREKQSQPKKYRYGIKIITTKKKRAENREKLQGVDEALIVLHGGFVVGRGGVERLCRYSISISCQNGPRRWQLCCSSTLNSTTEFFTESLWEDLKPTILHLSPKELKLVYNAFMLMMVRKDAVVNPSSFTKSRLHAFWENFRVMKKCFPFAKFT

SEQ ID NO: 211764 - protein, 302 aa, Glycine max
  Coding DNA Sequence Number=SeqID_94986
  Gene Ontology: Mol. function=nucleic acid binding; Cellular component= intracellular; Biological process=DNA integration
MDMVRSMLSNSKLPHSLWNEALKTATYILNQAPAKVVPKIPFELLKSWKPSLKHVCVWGCPAEVRIYNPNEKKLDARTISVYFIGYAKRSKEYRFYFPTHSTRIIESRNAKFLENDVASESDLTQGIDLKKNQCEGVVPTSSYKLVVFGDTHQNRVTQAPHQVDLILEDPVEQHQTQNVEQLVKQHQTQDVEQPVEQQPKGVDVTLRRSARIKKPAIPSDYQVYLESQYDFGVENDPESFLQAINNCNSKLWYDAMKDELESMENNKVWDLVECPNGIKPIGCKWIFKTKKDSLGNIERHKT

SEQ ID NO: 211765 - protein, 235 aa, Glycine max
  Coding DNA Sequence Number=SeqID_94987
  Pfam annotation: Domain name=Tim17; Domain location=61-196; Score= -16.6; E_value=0.061; Accession=PF02466.9; Description=Tim17Tim22Tim23 family
MAPPSSPPLVDNSDSDAEGRLREAEERFRDAIEELQRRQRRAAAHAQQHCRVDSPPCDHGPDESCVAHAIGNLCQTFLLSYGVRVGIGILLRAFKLVRGQSYSSLLDLKQLVSEKDLIVREEACRIGLLFGGFTGSYHALRCLLRKLRKKETPANAILAGLIAGFSIMALNDSNRRRTLALYLLARLAQCAYNSAKSKNKFHLWGSHWRHGDSLLFALACAQGNSHKTGGKHFYE

SEQ ID NO: 211766 - protein, 77 aa, Glycine max
  Coding DNA Sequence Number=SeqID_94988
MEENMQCPMIVYSQRQPWGLSSQGRIPPRVRALLKEKGDGEDQVWLELLQACLLAPRTMKTGASSSFLQSLSHHLQR

SEQ ID NO: 211767 - protein, 123 aa, Glycine max
  Coding DNA Sequence Number=SeqID_94989
MALETVENMCAWNIFGAESTTGKLQVHVLGEEVAEAQAATFGDIEGEEGVQDAKKGTALEEEKLLIGVRERQEKKTAAQNERKRQSGEKSAEGGVELVEEGFANAAKVFVFEDYWILSGGVGE

SEQ ID NO: 211768 - protein, 113 aa, Glycine max
  Coding DNA Sequence Number=SeqID_94990
MVGKEFMLHLEVKCSWGSMIRGVNHFIRYLCYALMPVDDAEEQPQIFEYYLLWMQHTPSYYRQTLPVHVMDILMSTSSSSSNGCNTLHRRAHYDCLLLSVIYGTSGDDLFSMH

SEQ ID NO: 211769 - protein, 336 aa, Glycine max
  Coding DNA Sequence Number=SeqID_94991
MSSKTKADLLAEYIAFMKERQYIFIDSCRDVTTSILDCIIRQAFSQDTTGDAVYHIKENTSAQDICLLAAILKLMSVSLLQAIKYLSNGSDSDCLKTMGSASVREKYDFLISIIDLFQQFKFCLPIQTLFNNVMKTQKSNYKVSKSMLVHFIGLLSISFGNGLDLLAKGCILVLMALMCLFVFEEGDLVGLGSFRGLPLQPCSSEIPSDKSGKGARDKRSVYTVAAEFRRIRECNLRAEPSVSFTSYNLEVGTEKSCNGGMFLNCIIEDPKKLSDYDELADFLECKTGKNYSKWLNDREIYRNRRYQKKIDLRKNKKKTFWNFTKHKKIGKSLKRP

SEQ ID NO: 211770 - protein, 157 aa, Glycine max
  Coding DNA Sequence Number=SeqID_94992
  Homolog annotation: Hit_ID=P49692; Match level="QueryCoverage=32%, HitCoverage=18%, E-value=2e-08, Identity=53%"; Hit description=60S ribosomal protein L7a-1
MEVERSSKEVVVFPFSGMTRLMKEVVLMHKRGSFKEEPQDLFFGNSTPSSSPSPLVTVSTNLFMVQDLTEKMALNWIVELIHRALPPKRDLTRFVKWPKNVQIQRIKRILKYRLKVPNAILPRKGPVTRVISKRLQEDWARAAKEGPRVLMNLRVDL

SEQ ID NO: 211771 - protein, 89 aa, Glycine max
  Coding DNA Sequence Number=SeqID_94993
MAPTRHPLDPEKSNRALGFPALITSLCQSYGVPVTPSKGDAHQDAGAPPPPRQADSARPLGVEQYLHLKGECCEKFSRTPQMDSNECVN

SEQ ID NO: 211772 - protein, 362 aa, Glycine max
  Coding DNA Sequence Number=SeqID_94994
  Gene Ontology: Mol. function=protein binding; Cellular component =membrane; Biological process=defense response
  Homolog annotation: Hit_ID=Q8GZF0; Match level="QueryCoverage=99%, HitCoverage=30%, E-value=1e-147, Identity=74%"; Hit description =Resistance protein KR4
  Pfam annotation: Domain name=LRR_1; Domain location=106-127; Score =6.6; E_value=17; Accession=PF00560.23; Description=Leucine Rich Repeat
  Pfam annotation: Domain name=LRR_1; Domain location=129-151; Score =3.0; E_value=77; Accession=PF00560.23; Description=Leucine Rich Repeat
  Pfam annotation: Domain name=LRR_1; Domain location=184-204; Score =8.1; E_value=8.8; Accession=PF00560.23; Description=Leucine Rich Repeat
  Pfam annotation: Domain name=LRR_1; Domain location=206-233; Score =2.2; E_value=1.1e+02; Accession=PF00560.23; Description=Leucine Rich Repeat
  Pfam annotation: Domain name=LRR_1; Domain location=324-343; Score =7.0; E_value=14; Accession=PF00560.23; Description=Leucine Rich Repeat
  Pfam annotation: Domain name=LRR_1; Domain location=344-359; Score =2.6; E_value=92; Accession=PF00560.23; Description=Leucine Rich Repeat
  Pfam module annotation: Pfam domain module=LRR_1::LRR_1::LRR_1::LRR _1::LRR_1::LRR_1; Domain location=106-127::129-151::184-204::206 -233::324-343::344-359
FDVGKSSEFTIQQLGELNLHGRLSIRELRNIENPSHALSADLKNQTRLGELEFRWNSHGKHDDHAKERDVVVIENLQPSKNLEKLSIRKYGGKQFPNWLSDNSLSNVVSLELDNCQSCQHLPSLGLLPFLKNLEISSLDGIVSIGADFHGNSSSSFPSLETLKFSSMKAWEKWECEAVIGAFPCLQYLSISKCPKLKGDLPEQLLPLKKLQISECKQLEASAPRALELSLKDFGKLQLDWATLKRLRMAGPSMEASMLEKSDTLKELFIHCCPKYEMFCDCEMSDDGCDSLKTFPLDFFPALWILDLVGFRNLQMITQDHIHNHLEYLIIRECPQLESLPGSTSLKELRIYDCPRVESFPEG

SEQ ID NO: 211773 - protein, 60 aa, Glycine max
  Coding DNA Sequence Number=SeqID_94995
MMSRAKLRCPFGMIVTEMMPWFAKEGANGKAKALLENKSSFRDKWCKGTEQQPTVSFFED

SEQ ID NO: 211774 - protein, 227 aa, Glycine max
  Coding DNA Sequence Number=SeqID_94996
  Gene Ontology: Mol. function=serine-type endopeptidase activity; Biological process=proteolysis
  Homolog annotation: Hit_ID=Q8S3I6; Match level="QueryCoverage=42%, HitCoverage=21%, E-value=3e-31, Identity=69%"; Hit description=D1 protease precursor
  Pfam annotation: Domain name=PDZ; Domain location=131-219; Score=8.9; E_value=0.069; Accession=PF00595.14; Description=PDZ domain (Also known as DHR or GLGF)
MSQWKCFSLRVIESRFPLAHRRKKGVGSRNRDSWKEYSIGLVPRISSISYPHCGYFPSSGGFIAKRRKRNSLLRLNDCSDNIRQHASILFVRLVSGVMLVMSVSLASTEPSYKVIRKMLATLDDPFTRFLEPEKQSGTEGALTGVGLSIGYPTKAEMQPGGLVVISASPGGPAYRVGVLSGDVILAIDCTSTENMGLYDAAERLQWVFSPAFHLCFQVNIFLHKLGE

SEQ ID NO: 211775 - protein, 209 aa, Glycine max
  Coding DNA Sequence Number=SeqID_94997
  Homolog annotation: Hit_ID=Q6ZGD1; Match level="QueryCoverage=92%, HitCoverage=23%, E-value=2e-39, Identity=47%"; Hit description=DENN (AEX-3) domain-containing protein-like
MAGVTKEEERGSPSWGASFFTQTTEDVARAVATAMNSQRPSVVYSLKNDHGGSQLQRLQYQVTKMIKGFSSPPEVKYTNYNPEILTTQKRQWAANFQLQYTDHKSWKEPTKLFESMVVAGLHPNCDIQALQRQCFLRKSEGPGKLRSALGYQNQSRVEVEPNLEPQVLFVYPPEKQLPLKGKDLLSFCFPGGLEVRCMHNELLIFSLSI

SEQ ID NO: 211776 - protein, 275 aa, Glycine max
  Coding DNA Sequence Number=SeqID_94998
  Gene Ontology: Mol. function=phosphoglycolate phosphatase activity; Cellular component=cytoplasm; Biological process=metabolic process
  Homolog annotation: Hit_ID=Q014M1; Match level="QueryCoverage=89%, HitCoverage=95%, E-value=3e-35, Identity=38%"; Hit description =Homology to unknown gene
  Pfam annotation: Domain name=Hydrolase; Domain location=35-238; Score= 44.2; E_value=4.3e-10; Accession=PF00702.16; Description=haloacid dehalogenase-like hydrolase
  Subcellular localization annotation: CTP_CleavageSite=54; ConfidenceScore=5.45e-01
MPLLVSNCAKSFILSTLPKSKQMSRQAPGVVKTRLRGVVFDMDGTLTVPVIDFPAMYRAVLGDEEYLRLKAENPSGIDILGHIDGWPPHKQRKAFDAIAEVERQGLERLQIMPGCAELCAMLDSKKISYCPNNNDIIILVVVKCEQITHVIYQFFRRGLITRNTKSAVDLFHERFGITFSPALSREFRPYKPDPGPLLHICSLWEVQPNEVIMIGDSLKDDVPCGRQAGAFTCLLDQTGVYDSPEYADVEFKPDFKVTSLDEVHSVLKENFDLSP

SEQ ID NO: 211777 - protein, 630 aa, Glycine max
  Coding DNA Sequence Number=SeqID_94999
  Gene Ontology: Mol. function=binding; Cellular component =intracellular; Biological process=protein amino acid phosphorylation
  Homolog annotation: Hit_ID=Q7XHM3; Match level="QueryCoverage=86%, HitCoverage=64%, E-value=1e-104, Identity=36%"; Hit description =Selenium-binding protein-like
  Pfam annotation: Domain name=PPR; Domain location=165-199; Score =10.3; E_value=0.45; Accession=PF01535.11; Description=PPR repeat
  Pfam annotation: Domain name=PPR; Domain location=307-341; Score =27.3; E_value=5.4e-05; Accession=PF01535.11; Description=PPR repeat
  Pfam annotation: Domain name=PPR; Domain location=410-444; Score =41.4; E_value=3.1e-09; Accession=PF01535.11; Description=PPR repeat
  Pfam annotation: Domain name=PPR; Domain location=445-479; Score=3.4; E_value=3; Accession=PF01535.11; Description=PPR repeat
  Pfam annotation: Domain name=PPR; Domain location=481-514; Score=9.6; E_value=0.54; Accession=PF01535.11; Description=PPR repeat
  Pfam annotation: Domain name=PPR; Domain location=547-581; Score=1.3; E_value=5.3; Accession=PF01535.11; Description=PPR repeat
  Pfam annotation: Domain name=PPR; Domain location=95-129; Score=43.7; E_value=6.2e-10; Accession=PF01535.11; Description=PPR repeat
  Pfam module annotation: Pfam domain module=PPR::PPR::PPR::PPR::PPR::PP R::PPR; Domain location=165-199::307-341::410-444::445-479::481 -514::547-581::95-129
MVLRRTFSFTLTTSRYYTSATVSLAHTPQSLLHLLQLCIDLRSQKLAQQSHAQILANGFAQNAFLATRLVSAYATCGELATSRFVFESVEAKSVYLWNSLINGYVKNHDFRQALALFREMGRNGMLPDDYTLATVFKVFGELEDLVSGKLIHGKGIRIGFVSDVVVGNSLMSMYCRCGEFGDAVKVFDETPHRNVGSFNVVISGCAALENCNFTSHDDLSNFFLRMQCEGFKADAFTVASLLPVCCGDTGKWDYGRELHCYVVKNGLDLKMDSDVHLGSSLIDMYSRSKKVVLGRRVFDQMKNRNVYVWTAMINGYVQNGAPDDALVLLRAMQMKDGIRPNKVSLISALPACGLLAGLIGGKQIHGFSIKMELNDDVSLCNALIDMYSKCGSLDYARRAFETSSYFKDAITWSSMISAYGLHGRGEEAIIAYYKMLQQGFKPDMITVVGVLSACSKSGLVDEGISIYKSLMTKYEIKPTVEICACVVDMLGRSGQLDQALEFIKEMPLDPGPSVWGSLLTASVIHGNSRTRDLAYRHLLELEPENPSNYISLSNTYASDRRWDVVTEVRTIMKERGLKKVPGCSWITISGKTHSFSVADKAHPSSSLIYEMLGDLVSIMTDGCADIDILT

SEQ ID NO: 211778 - protein, 80 aa, Glycine max
  Coding DNA Sequence Number=SeqID_95000
  Subcellular localization annotation: CTP_CleavageSite=14; ConfidenceScore=5.08e-01
MVLHGGVDSAASPRFAALSPDSRGRVASPTSDGLVVDVVLWMNWRGAVAVLVYATALWYFFERVGYNFLSFVIKVFANKL

SEQ ID NO: 211779 - protein, 301 aa, Glycine max
  Coding DNA Sequence Number=SeqID_95001
  Gene Ontology: Mol. function=binding; Cellular component =intracellular; Biological process=RNA processing
  Homolog annotation: Hit_ID=Q1SXC6; Match level="QueryCoverage=51%, HitCoverage=46%, E-value=9e-32, Identity=46%"; Hit description =Tetratricopeptide-like helical
  Pfam annotation: Domain name=TPR_2; Domain location=149-182; Score =19.3; E_value=0.014; Accession=PF07719.7; Description=Tetratricopepti de repeat
  Pfam annotation: Domain name=TPR_2; Domain location=183-217; Score =6.7; E_value=5.5; Accession=PF07719.7; Description=Tetratricopeptide repeat
  Pfam module annotation: Pfam domain module=TPR_2::TPR_2; Domain location=149-182::183-217
MSMDSSSNSVMEDEFESTTLHSAPSFAIYNNLHGDDEITPAEVFKRAIGKSLEATGSGEFSFGSNKMDLIEEEENENNDWSTGIQNLSIEEEDVQPASPPMYLAAGLGVDGDVGFDKFISDDVFNPSLEESEDLVGYYKRMADEYPCHPLVLKKYALLLQSNGDLRGAEEYFLRATMADPNEGEILMQYAKLVWENHHDKDRAMVYFERAVQAAPQDSNVLAAYTTFLWNIEDDENEDGKHEIQSEMETQKAEPVKPSKDESGQEIDGAHTTTANCGEENNVEDYFKKMLDENPNNPLFLK

SEQ ID NO: 211780 - protein, 220 aa, Glycine max
  Coding DNA Sequence Number=SeqID_95002
  Gene Ontology: Mol. function=binding; Cellular component=thylakoid; Biological process=photosynthesis
  Homolog annotation: Hit_ID=Q8VYL2; Match level="QueryCoverage=87%, HitCoverage=22%, E-value=3e-75, Identity=77%"; Hit description =Putative TPR repeat nuclear phosphoprotein
MASVYIPVQNSEEEVRVALDQLPRDASDILDILKAEQAPLDLWLVIAEDTTLDLSFFLKPANQTYISQGCREYFKQGKIDQFRQILEEGSSPEIDDYYADVRYERIAILNALGAYYSYLGKIETKQREKEEHFILATQYYNKASRIDMHEPSTWVGKGQLLLAKGEVEQASAAFKIVLDGDRDNVPALLGQISAFVIETHNFKSCEMVTSWFLFNQLFFI

SEQ ID NO: 211781 - protein, 235 aa, Glycine max
  Coding DNA Sequence Number=SeqID_95003
  Gene Ontology: Mol. function=oxidoreductase activity; Cellular component=integral to membrane; Biological process=protein amino acid phosphorylation
  Homolog annotation: Hit_ID=Q1H3H3; Match level="QueryCoverage=93%, HitCoverage=42%, E-value=9e-73, Identity=59%"; Hit description=2 -polyprenylphenol 6-hydroxylase
MHPGNIQVVTEGPDKGKFIALDFGIMGSLTPTDQYYLARNFLAFFNRDYRDVAVAHIESGWVPADTNVEALETAVRAICEPIFEKPLKDISFGRTLLSLFQMSRRFGVNIQPQLIMLQKTLLNIEGLGRELDPNIDLWHSAKPFLKRWMSEQIGWRSLLKSAKRELPYILTHAAEMPRLFEQYLRNQTELSKQQSRIDALLISQHRQATWQKWATTAIIVLALLQFASLFLLFSH

SEQ ID NO: 211782 - protein, 284 aa, Glycine max
  Coding DNA Sequence Number=SeqID_95004
  Gene Ontology: Mol. function=transporter activity; Biological process= transport
  Homolog annotation: Hit_ID=UPI00005F82D5; Match level="QueryCoverage =58%, HitCoverage=29%, E-value=2e-41, Identity=49%"; Hit description =COG4533: ABC-type uncharacterized transport system, periplasmic component
  Pfam annotation: Domain name=PTS_EIIB; Domain location=24-57; Score =54.9; E_value=2.6e-13; Accession=PF00367.11; Description =phosphotransferase system, EIIB
LKTPGREEEDTITGGSDDQSEAIARYIVALGGKENLKSVDACITRLRLTLVDNSVLDEPTLKALGAKDSGTDRSLTLSVPVPSPHRRGNKTGTLHLSRPYLFRKTPYTLNIPYRHRNVAMRQLQKIRQYQRLYQHYGAAPKPTTIAEVAEVAVCSERHARTLLRQLAQSGWLSWNAQPGRGHRAILHCLATTSELSAPLMHACLEKGDYQSALQLADGDPASLHHIITPFLGGKWLKHQPTLRIPWYRALTSLDPSLQRRRAEQHIICAVHAGLTRYAPGHPQP

SEQ ID NO: 211783 - protein, 123 aa, Glycine max
  Coding DNA Sequence Number=SeqID_95005
  Subcellular localization annotation: CTP_CleavageSite=27; ConfidenceScore=5.34e-01
MHALLGSFNNGNWSDSKVLDSVGLSCRAFTRNRGTGPRGEGNFCKTKQLHPFLRRRLISMTYYHLIHHHQGNLPLNYLKPLPWQKSMTRGLPLRIIQVVQYHNFSPTLHILKYKLTTSTIHIP

SEQ ID NO: 211784 - protein, 103 aa, Glycine max
  Coding DNA Sequence Number=SeqID_95006
  Subcellular localization annotation: CTP_CleavageSite=39; ConfidenceScore=5.40e-01
MMRCCTLIDWPNSLKTVPSGVANCRDLPFSRRATRKLMGASSKGGRRVESPPMFIRGKRQKNQDACGQRTLGVKGSGVVFTYGEGCFPRSYVFLSCNEKIRLT

SEQ ID NO: 211785 - protein, 100 aa, Glycine max
  Coding DNA Sequence Number=SeqID_95007
MEVPDIHLGETERSCLQESNDSSYVQTPPLVGLESLKVCDIIDQSTGNWNVNAINEIFNNRDAQQQILSMATYLNNDEDTLIWKACLAGMANFQSTVIII

SEQ ID NO: 211786 - protein, 101 aa, Glycine max
  Coding DNA Sequence Number=SeqID_95008
MWRHFRRSRKAWEMVQKKDKELRGSNNGPIGGYQEEVEAPEEDEEVQALRAGLEQAQIVKERFKSAAFKFRKENADLRDVNIATTKALEQETKRARREEHG

SEQ ID NO: 211787 - protein, 96 aa, Glycine max
  Coding DNA Sequence Number=SeqID_95009
MEAMNDQMTTMMEAMMSMRKMVEVNAAAITITSAATEVDPTHPSGGNQGGEVLGSTGIPHFVQVQSKHPAEASSNYFDCGRNPSMKMFSCIGSEKP

SEQ ID NO: 211788 - protein, 49 aa, Glycine max
  Coding DNA Sequence Number=SeqID_95010
MDTSEPYTGEMRGTMHEPQQKQNRNPKWEPPLNRREEQCKEHMHEVGQQ

SEQ ID NO: 211789 - protein, 73 aa, Glycine max
  Coding DNA Sequence Number=SeqID_95011
MEVFHSKFGEALVASNPMVLLGCLTSKTQKYSFKQRTNFLFQSLLIPHDVAPWDLTIEDIHGQEDEEQGIKVN

SEQ ID NO: 211790 - protein, 105 aa, Glycine max
  Coding DNA Sequence Number=SeqID_95012
  Subcellular localization annotation: CTP_CleavageSite=67; ConfidenceScore=5.07e-01
MRMRVTKALGLSSWSCGSLLFPMLVFVSDRTISKGAGKSQSHSPGAYLILGLELQSASNPLFSRGPPAKRKEASICPISPEKECRFWILFLLALPSCSCIPSVWV

SEQ ID NO: 211791 - protein, 75 aa, Glycine max
  Coding DNA Sequence Number=SeqID_95013
  Gene Ontology: Mol. function=binding; Cellular component=thylakoid; Biological process=photosynthesis
  Homolog annotation: Hit_ID=Q69SU8; Match level="QueryCoverage=77%, HitCoverage=23%, E-value=2e-16, Identity=70%"; Hit description =Putative tetratricopeptide repeat (TPR)-containing protein
MDIAAVVAFSYTLLVFSDGKYREALGKWEATLVLAPDVPVVHEQKAQVLLEIGDAWNALLKAATRATELDPSWAE

SEQ ID NO: 211792 - protein, 160 aa, Glycine max
  Coding DNA Sequence Number=SeqID_95014
MSIVHTAEMQLIIQFFLSPPFPSPKINKQQNLKQTTWGREHARRLQRQCWSVGRVVVVNDYPQREVATCTQHYCWGTQQSGENDLPRRLFPEEPSSEIIPEDTFFRNFPEKPSSGRKFRDSGRTQEHFLEERHPECFRKKVLPEDNLLLPEEGFFGNFFF

SEQ ID NO: 211793 - protein, 101 aa, Glycine max
  Coding DNA Sequence Number=SeqID_95015
  Gene Ontology: Mol. function=shikimate kinase activity
  Homolog annotation: Hit_ID=Q9LW20; Match level="QueryCoverage=64%, HitCoverage=27%, E-value=5e-10, Identity=46%"; Hit description =Similarity to shikimate kinase
MTSWHGVVVPWFNPFSRALLRHGISLWIDVPLDFVAGDVQDKLGALYDKYKVGYATADAIISVQKVVSRLGCDNLDEITREDMTCNFYASNLKHAMLTASC

SEQ ID NO: 211794 - protein, 137 aa, Glycine max
  Coding DNA Sequence Number=SeqID_95016
MSGTSGEGGIAVFLGTNQRDSAQKTCMAWPLGLQSMVGCWDPIDSATELSSPFRMSLDHVDVSFAQVLQVQVDQLDLTAVLPHGSRMGWADGRGGKRKKECARHQHVADHVGIDPRWGCARRIWIWLNVLVLVLTAH

SEQ ID NO: 211795 - protein, 129 aa, Glycine max
  Coding DNA Sequence Number=SeqID_95017
MKSACFGHPHHAQTQWQKLSPMVSICSHFISGKGKGDYLTSTADPPSKSNPNPTRNWKLVDQHHELENRSKLYVLFNCKGNLGQHQGNLLNLVNTSEFFKIKASLHPPASTDINLIHFETDSWNCQDDQ

SEQ ID NO: 211796 - protein, 132 aa, Glycine max
  Coding DNA Sequence Number=SeqID_95018
MPDGGNVQGCELGRLAVLYRMKHVEGDRHFVKEEIEKVRFAFLYSNQRSNLSTLRSKPWENHITKASCCSWRVQGLIKPTLESHNVGLKSHALQLDPNIPPCSATLVAMPCNLVHNPATTWVQYQELKLCKE

SEQ ID NO: 211797 - protein, 271 aa, Glycine max
  Coding DNA Sequence Number=SeqID_95019
MGPKSTLRLIRTLGPSLAYLAQSTWSFLSNALAGNDVILNDYINNGNTTFKVKEKMTLIAVKKPFDLAVGNTSKDHSHDHWGNVVLKHLYHSLGNDNGGMKWCIREALMSCPKISCAPTMKETLKIVKDGQECSPQLESLFYRLQSEANGHENVVHNGFSSESNGRDTTEGCQRVFRDILASEKFSSLCKVLLENFQGTKPETVFDFSLINSRMKGQAYEQSPTLFLSDVQQESIIIIPINLMSLSEFRTVHNLHCLTITIPNLHVPSSWK

SEQ ID NO: 211798 - protein, 34 aa, Glycine max
  Coding DNA Sequence Number=SeqID_95020
MGGEEAFFAYERTFFRMRDCLKMLRTEEGSSNYT

SEQ ID NO: 211799 - protein, 89 aa, Glycine max
  Coding DNA Sequence Number=SeqID_95021
MKNKKVAAAGVSLSEAYALSEQHLLSETSTRLKSEENLPRMHALSTPSARPASHLSLWAPIAGRRGIYVRDAAGPGSTKNLSFQEDSRF

SEQ ID NO: 211800 - protein, 116 aa, Glycine max
  Coding DNA Sequence Number=SeqID_95022
  Subcellular localization annotation: CTP_CleavageSite=57; ConfidenceScore=5.41e-01
MASRCLSGSIVPSYCSSGSIVLSYYSRLSGFHPKGISASIMRLTKGCRRTTHVGRCTCERLRSSTTLPMSRGCDSSWVHSGKVWVDYSSSWGLYMSVITVGRGWESVRGVLHPRLD

SEQ ID NO: 211801 - protein, 141 aa, Glycine max
  Coding DNA Sequence Number=SeqID_95023
MANHTTILKEAFNLEILIWLPQMKPPRSGSDTIKYCRYERGIGHNIEDCQTQKDKIEELIQAGYIAQFVKRTKNHQVGPRPRGHQEDQCGNQEADRRRAEDQGKQRHQQHQHKREPPPEQEPAQHIRGVINTIACDFSYGG

SEQ ID NO: 211802 - protein, 74 aa, Glycine max
  Coding DNA Sequence Number=SeqID_95024
  Homolog annotation: Hit_ID=Q2PMM5; Match level="QueryCoverage=97%, HitCoverage=3%, E-value=3e-36, Identity=98%"; Hit description =Protein ycf2
MVFIRYLTTRIALFSYPVPPPPRTPVRFRHDILFSYWENPSTLFRIQEIALRDLFFFWKIQERNNQPIDIGRLR

SEQ ID NO: 211803 - protein, 332 aa, Glycine max
  Coding DNA Sequence Number=SeqID_95025
  Gene Ontology: Mol. function=protein binding; Cellular component =integral to membrane; Biological process=defense response to fungus
  Homolog annotation: Hit_ID=Q949G9; Match level="QueryCoverage=95%, HitCoverage=30%, E-value=9e-50, Identity=40%"; Hit description =HcrVf1 protein
  Pfam annotation: Domain name=LRRNT_2; Domain location=23-63; Score =51.1; E_value=3.8e-12; Accession=PF08263.3; Description=Leucine rich repeat N-terminal domain
  Pfam annotation: Domain name=LRR_1; Domain location=106-131; Score =10.8; E_value=2.7; Accession=PF00560.23; Description=Leucine Rich Repeat
  Pfam annotation: Domain name=LRR_1; Domain location=133-155; Score =11.6; E_value=2; Accession=PF00560.23; Description=Leucine Rich Repeat
  Pfam annotation: Domain name=LRR_1; Domain location=182-203; Score =11.7; E_value=1.8; Accession=PF00560.23; Description=Leucine Rich Repeat
  Pfam annotation: Domain name=LRR_1; Domain location=208-236; Score =8.3; E_value=8.1; Accession=PF00560.23; Description=Leucine Rich Repeat
  Pfam annotation: Domain name=LRR_1; Domain location=259-281; Score =12.7; E_value=1.2; Accession=PF00560.23; Description=Leucine Rich Repeat
  Pfam annotation: Domain name=LRR_1; Domain location=283-305; Score =9.4; E_value=5.1; Accession=PF00560.23; Description=Leucine Rich Repeat
  Pfam annotation: Domain name=LRR_1; Domain location=307-329; Score =11.8; E_value=1.8; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1; Domain location=23-63::106-131::133 -155::182-203::208-236::259-281::283-305::307-329
MEEYFSIWHKNKKSLPCRESVCIPSERETLLKFKNNLNDPSNRLWSWNHNHTNCCHWYGVLCHNVTSHLLQLHLNSSDSLINDDWEAYRRWSFGGEISPCLADLKHLNYLDLSGNRFLGEGMSIPSFLGTMTSLTHLDLSLTGFYGKIPPQIGNLSNLVYLDLGGYSDLFAENVEWVSSMWKLEYLYLSNANLSKAFHWLHTLQSLPSLTHLSLSHCTLPHYNEPSLLNFSPLQTLHLSFTSYSPAISFVPKWIFKLKKLVSLQLPGNEIQGPIPGGIRNLSLLQNLDLSFNSFSSFIPNCLYGLHRLKFLNLMDNNLHGTISDALGNLTSL

SEQ ID NO: 211804 - protein, 115 aa, Glycine max
  Coding DNA Sequence Number=SeqID_95026
MTCGDTQVVIHTNQLLLISTREVRWQAEIPQVVIRTNTLLLFLTREVRWHAEIPQVVIRTHTVLLPRPVRSQVACGDALYGLTLIAVESVKFRDISERKRPKTQKCGGELIKIWV

SEQ ID NO: 211805 - protein, 678 aa, Glycine max
  Coding DNA Sequence Number=SeqID_95027
  Gene Ontology: Mol. function=zinc ion binding; Cellular component =cellulose and pectin-containing cell wall; Biological process =metabolic process
  Homolog annotation: Hit_ID=O22285; Match level="QueryCoverage=86%, HitCoverage=82%, E-value=0.0, Identity=64%"; Hit description =Expressed protein
  Pfam annotation: Domain name=DUF248; Domain location=155-676; Score =1061.4; E_value=0; Accession=PF03141.7; Description=Putative methyltransferase
  Pfam annotation: Domain name=Methyltransf_11; Domain location=274 -387; Score=15.1; E_value=0.0018; Accession=PF08241.2; Description =Methyltransferase domain
  Pfam module annotation: Pfam domain module=DUF248::Methyltransf_11; Domain location=155-676::274-387
  Subcellular localization annotation: CTP_CleavageSite=53; ConfidenceScore=5.69e-01
MKSLTTLWPMDILKTSSFVRITALSLFSFTLFLFLFMRFSPTSYSDLTFFSSTAEAPSPEQSPPNSPPPPPPPPPSPPLPTPPGVKIFRVPPLPPVERMGVLDGSGVMTEDFKVGELDPGFEEDSLNDTFSSVSGGGGVREKVEKYKMCDVRMVDYVPCLDNVKTMKKYMESLRGEKYERHCKGMGLKCLVPPPKGYRRPIPWPKSRDEVWFSNVPHTRLVEDKGGQNWISIKKDKFVFPGGGTQFIHGADKYLDQISEMVPEIAFGRNTRVALDVGCGVASFGAFLMQRNVTTLSVAPKDFHENQIQFALERGVPAMVAVFATHRLLFPSQAFDLIHCSRCRINWTRDERQLNATQAHGYTTVAIEDGILLLEANRLLRAGGYFVWAAQPVYKHEETLQEQWKEMENLTASICWELVRKEGYIAIWRKPMDNSCYLSRDIDAHPPLCESNDDPDNVWYVGLKACITPLPNNGYGGNVTEWPLRLHQPPDRLHSIQLDAIISRDELLRADTKYWFEIIESYVRAFRWQDYNLRNVMDMRAGFGGVAAALHDLQIDCWVMNVVPVSGFNTLPVIYDRGLIGVMHDWCEPFDTYPRTYDLLHAAGLFSVEKKRQKCNISTIMLEMDRMLRPGGRVYIRDTTHVIGELEEIATALGWSNTINDVGEGPYSSWKILRSDKGF

SEQ ID NO: 211806 - protein, 86 aa, Glycine max
  Coding DNA Sequence Number=SeqID_95028
  Gene Ontology: Mol. function=RNA-directed DNA polymerase activity; Biological process=RNA-dependent DNA replication
  Homolog annotation: Hit_ID=Q1SLQ0; Match level="QueryCoverage=93%, HitCoverage=8%, E-value=2e-17, Identity=46%"; Hit description=AAA ATPase, central region
MEEIFEALHQMHATKAPGVDRTSTLFYQHFWDLVDPNVCTTIMNILNEGGDPAKLNKTLIALIPKVKRPSHAGELRPISLCNAGRA

SEQ ID NO: 211807 - protein, 106 aa, Glycine max
  Coding DNA Sequence Number=SeqID_95029
MEGKFPVLFSLKYQTQLSLRYGLDHRLSVSLVLSKSSLTRAKHENGAKRNVEFLSDCEILGGGGNILMQSYPARALHRRLQEDWAKDAREGPRVLMSLKVDFGPMG

SEQ ID NO: 211808 - protein, 57 aa, Glycine max
  Coding DNA Sequence Number=SeqID_95030
MEENTSPINKGQWQLHSPNLATVEDTFADLVISDATALAYPCQSSLDEISNHPLTSL

SEQ ID NO: 211809 - protein, 117 aa, Glycine max
  Coding DNA Sequence Number=SeqID_95031
MPHPIRPLRPDILQHMSLSLSKIIGRPVRVTIFCENAPSIWDQHRLKGALKPNDEDMTKSKGKDPLEGLGGPMTRARARKAKEALQQVLSILFEYKPKFQGEKSKVVSCIMAQMEED

SEQ ID NO: 211810 - protein, 64 aa, Glycine max
  Coding DNA Sequence Number=SeqID_95032
MKLHRKVKQVLEGTSENNGVCHDPLVAQGRGPGKMTDPGLKRKKHRMTPIEHFLIEIVQILSGD

SEQ ID NO: 211811 - protein, 76 aa, Glycine max
  Coding DNA Sequence Number=SeqID_95033
  Gene Ontology: Mol. function=oxidoreductase activity, acting on single donors with incorporation of molecular oxygen, incorporation of two atoms of oxygen
  Homolog annotation: Hit_ID=Q6L4C1; Match level="QueryCoverage=98%, HitCoverage=21%, E-value=2e-10, Identity=44%"; Hit description =Hyoscyamine 6-dioxygenase , putative
IITNGRLVGAEHRAVTNSSSARTSVAYFVYPSFESIIEPAQALINESTPAIYKSMTFGEFRRNFFQKGPKIEEELQ

SEQ ID NO: 211812 - protein, 105 aa, Glycine max
  Coding DNA Sequence Number=SeqID_95034
MGNRASNQLGPMILDFAKGAKSSMKVVKLKKGPRKAWEELFMVKGNNTHECQILRLSSSSVGTCTNFLHSTYSSIAIKMGKSGGRAMEGCRRKRLNLDEKNHNDC

SEQ ID NO: 211813 - protein, 72 aa, Glycine max
  Coding DNA Sequence Number=SeqID_95035
  Homolog annotation: Hit_ID=Q575Z6; Match level="QueryCoverage=87%, HitCoverage=8%, E-value=4e-15, Identity=62%"; Hit description =Alkaline alpha galactosidase 3
MTVGAGISVADGNLMVLGNKVLSHVHDKVLVTPACGGALLNGAFIGVQSHHKGSRTVFPIGKLQITAILILG

SEQ ID NO: 211814 - protein, 72 aa, Glycine max
  Coding DNA Sequence Number=SeqID_95036
  Homolog annotation: Hit_ID=Q75IY5; Match level="QueryCoverage=57%, HitCoverage=38%, E-value=1e-07, Identity=62%"; Hit description =Expressed protein
MDNITASEVAGFGVGAVLLCATVAATKVDAFFSSSQRSLAACIYYTQQVINIGKLLQYLILCHGDIEPFTDP

SEQ ID NO: 211815 - protein, 123 aa, Glycine max
  Coding DNA Sequence Number=SeqID_95037
  Gene Ontology: Mol. function=oxidoreductase activity; Biological process=flavonoid biosynthetic process
  Homolog annotation: Hit_ID=Q8LKP6; Match level="QueryCoverage=94%, HitCoverage=43%, E-value=2e-19, Identity=37%"; Hit description =Putative flavanone 3-hydroxylase
METLDQMLVSSWYNVHSSVPPSFVQLPENRPGRVVSSLHKAIPVIDFGGHDLGDTTKQVLEASEEYGFFQVINHGVSKDLMDETMNIFKEFHAMPPKEKDSLTHPCPPSGEYMEYWPQKPSKY

SEQ ID NO: 211816 - protein, 99 aa, Glycine max
  Coding DNA Sequence Number=SeqID_95038
MEETTTEAARTGFSCESETKESGDAQERQEKGTVSGGVRGETERDRVDVKRTKVMKFDPMSDPIQVISSQMHNQSNNQTNPIMSQDPLDWSNSFEQYAK

SEQ ID NO: 211817 - protein, 123 aa, Glycine max
  Coding DNA Sequence Number=SeqID_95039
MIETIQKYNKIKNYSLAARPKGNHHRGWRAAPDIASTRPDNTRPPQGQQRRDGGRDRVGLAAGHGGVPKEGGTVGQKRKEEEDDEEEEEEGGGEEERKREEGKREDEGVRNEGLPDDPSSSTV

SEQ ID NO: 211818 - protein, 107 aa, Glycine max
  Coding DNA Sequence Number=SeqID_95040
MKGCREGEAATGGRGAAVVSVPSKKGCCRGLRERRKEAFGLGNESSSQVKLPSVSSIVVVIRRKASSSRFCFFLEVSFSFAFLLLPPLLPAMAETAIRKLLGCLRIT

SEQ ID NO: 211819 - protein, 54 aa, Glycine max
  Coding DNA Sequence Number=SeqID_95041
MRMTGQRRSILNKLFSSVLAFDSHSPAKETKVATDLVIQQQQEPRKRQTTLQHK

SEQ ID NO: 211820 - protein, 164 aa, Glycine max
  Coding DNA Sequence Number=SeqID_95042
  Homolog annotation: Hit_ID=Q9ZU92; Match level="QueryCoverage=65%, HitCoverage=67%, E-value=6e-13, Identity=42%"; Hit description =Expressed protein
MGKKKLMLFLFPFFPFPKFENQFLITVLTCVEVKDAVTSLSAQKSITKKKKKSKQQRRQKKLKAYNLSSLLESLPEVKASKKPGCANDSKLTCKSRQMLVLTERDRISAVLNDPNFQADPLSAIHQYIQNKQPVVEEQPKKKVNKNGSRKKKSKASTGLQSMEM

SEQ ID NO: 211821 - protein, 124 aa, Glycine max
  Coding DNA Sequence Number=SeqID_95043
MSEMLRRERVDIVWRITRLTLPNHASTDSAPQSSASTLSSAALTLFKVSIELSTSKIVSLSKRGWHRIIVSVQRQKVQEGCCGEDGGRDKCMHTYGTLSHISKTTISNAPPYLCMVRASSPFPC

SEQ ID NO: 211822 - protein, 128 aa, Glycine max
  Coding DNA Sequence Number=SeqID_95044
MEKRDRSSPSKSCKFDNQCLSRETQLDASNGSNVTKPLTKMLLDLCFVQEFDPKHCHYQKMTCFGGLSSIALSFPFESFFGDGISMTFQVHDRLTIFEVKSSMDTLNRVSAADDGVDAEDHGAESVDA

SEQ ID NO: 211823 - protein, 267 aa, Glycine max
  Coding DNA Sequence Number=SeqID_95045
  Gene Ontology: Mol. function=alpha-1,4-glucan-protein synthase (UDP -forming) activity; Cellular component=cellulose and pectin -containing cell wall; Biological process=cellulose biosynthetic process
  Homolog annotation: Hit_ID=Q69F96; Match level="QueryCoverage=90%, HitCoverage=68%, E-value=1e-139, Identity=93%"; Hit description =Reversibly glycosylated protein
  Pfam annotation: Domain name=RGP; Domain location=7-267; Score=522.4; E_value=4.9e-154; Accession=PF03214.4; Description=Reversibly glycosylated polypeptide
MADASVAPPPPLKDELDIVIPTIRNLDFLEMWRPFFQPYHLIIVQDGDPTKTIKVPPGFDYELYNRNDINKLLGPRASCISFKDSACRCFGYMVSKKKYIYTIDDDCFVANDPSGKAINALEQHIKNLLCPSTPLFFNTLYDPFREGADYVRGYPFSLREGVPTAISHGLWLNIPDYDAPTQLVKPLERNTRYVDAVLSIPKGTLFPMCGMNLAFDRDLIGPAMYFGLMGDGQPIGRYDDMWAGWCCKVHFFVLFFTITSTQSYRNS

SEQ ID NO: 211824 - protein, 218 aa, Glycine max
  Coding DNA Sequence Number=SeqID_95046
  Homolog annotation: Hit_ID=Q2QTF1; Match level="QueryCoverage=60%, HitCoverage=89%, E-value=7e-21, Identity=42%"; Hit description =Expressed protein
MAKEEEQQQPTSPMHPPYAYTIILNIFSKRRTWACLFLLVYGTLLTSSWNFLKSTLSWYNLQVESSTTSAWPALYASVLLGTVFGVLSMVAALVVMVPALVVTWITIVVLLAFFGKPKRTLVVEGRKITREIFGFVMRTLLKEGNFVAAVCAVLGYFALVRRNGTQGGVVVVGESYVIVLLKFLYSILLIVYQMFLNLECSTLDYLIEQAFVPFRFYA

SEQ ID NO: 211825 - protein, 75 aa, Glycine max
  Coding DNA Sequence Number=SeqID_95047
MAKTKTGSHAGLDMDSQLCKVSILKHDHAESLKLWEICQRSGAKCKAGCRLKWRKVRKLLPDEDVDKAFFQETKL

SEQ ID NO: 211826 - protein, 52 aa, Glycine max
  Coding DNA Sequence Number=SeqID_95048
MILYLLHTLCNIEPEKFNKFVRSSDTLLDSYPKGHFLLMKWGMAMLQPCRRK

SEQ ID NO: 211827 - protein, 294 aa, Glycine max
  Coding DNA Sequence Number=SeqID_95049
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=Q8S1X0; Match level="QueryCoverage=98%, HitCoverage=16%, E-value=1e-122, Identity=68%"; Hit description =Putative callose synthase 1 catalytic subunit
LFARSHFVKAIELGLILVIYASHSPVATDTFVYIALTITSWFLVASWIMAPFVFNPSGFDWLKTVYDFDDFMNWIWYSGSVFAKAEQSWERWWFEEQDHLKVTGLWGKLLEIILDLRFFFFQYGIVYQLGISDHNTSIAVYLLSWIYVFVVSGIYAVVVYARNKYAAKEHIYYRLVQFLVIILAILVIVGLLEFTKFKFMDIFTSLLAFIPTGWGLISIAQVFRPFLQSTIIWDGVVSVARIYDIMFGVIIMAPVALLSWLPGFQNMQTRILFNEAFSRGLRIFQIVTGKKSQS

SEQ ID NO: 211828 - protein, 212 aa, Glycine max
  Coding DNA Sequence Number=SeqID_95050
MGFAWKILNINNNFFNRCGKPSSLGHHYHRHSPLFFAGLFLLLSLKKNHEPPTRRRTRKKKQRACECETEDEEVEEQEAEDKEEEEATRGRKPKMLGVQSNTLVGKYEYGFLWGERIVLGDFKITSRERWVIEEMYAFGKLNGWNLTWRRPWIQWEIQLVNKLWDIIGVHGLKQNMSDGWVWKLNGGSEYVTSEVYEALYGEGGDVDEELYK

SEQ ID NO: 211829 - protein, 284 aa, Glycine max
  Coding DNA Sequence Number=SeqID_95051
  Gene Ontology: Mol. function=DNA binding; Biological process=DNA integration
  Homolog annotation: Hit_ID=Q2HRM8; Match level="QueryCoverage=68%, HitCoverage=19%, E-value=1e-13, Identity=27%"; Hit description =Polynucleotidyl transferase, Ribonuclease H fold
  Pfam annotation: Domain name=zf-CCHC; Domain location=100-117; Score =17.1; E_value=0.0015; Accession=PF00098.13; Description=Zinc knuckle
  Pfam annotation: Domain name=zf-CCHC; Domain location=62-79; Score =9.4; E_value=0.027; Accession=PF00098.13; Description=Zinc knuckle
  Pfam module annotation: Pfam domain module=zf-CCHC::zf-CCHC; Domain location=100-117::62-79
MSERDSQTPGVDSFLYLHPSENPAVSLVSPVLDSSNYHSWSRSMMTALSAKNKLEFIDGVKMACNYYGKTGHTEKVCYKKHGVPSNNSERNKSSSHRSGKVCTYCGKMGHIIDVCYKKHGFPPGYRFSNPRSSANNLVARDDVVTNDQTQLLESKEIRFSPEQYKALLALIQQPTDGNLANISSNLKQIASYSVDTTPAHASLDLFKSYTQLNPPTVVRLPNGHHDVITQAKIGTIEVINGLYYLTPNYTAISNIETNIVHPHCTITPIDLWHFRMGHLSFERL

SEQ ID NO: 211830 - protein, 420 aa, Glycine max
  Coding DNA Sequence Number=SeqID_95052
  Gene Ontology: Mol. function=DNA binding; Cellular component=beta -galactosidase complex; Biological process=DNA integration
  Homolog annotation: Hit_ID=Q1SS72; Match level="QueryCoverage=99%, HitCoverage=34%, E-value=1e-107, Identity=46%"; Hit description =Integrase, catalytic region
MLKHLNMIVGLKRCKPSYKLYKRITLGPLQTYQLIRKLLGAVGFIRLSIILMAPLNDIRLDFCEAHNSPIIVSIGYYSWLAPSSARCNNAFLHGELNEEVNMQLPPGMQVSHPNQASRQWFHHLSSFLLTHGFSQASSDHSLFLCFNDNSFTALLVKYVLDILSDSGMLACHPTSKPMDCTTHLQAGIGDPLSAEDSSSYCRLVGSLIYLTNTRLDISYTVQQLSQFMANPTTDHSKVASRVLRYLKSSSGCGIFFPTIGSTRLQAFSDSDWAGCRDTHRSITGFSIFLGNSLISWCSKKQSTVSRSSSEAEYRALATTTCELQWLKYLFQEFRIPFTQPANVFCDNQSAILIASNQVFHERTKHIELDCHIVREKSLNGLLKLLPVRSSMQLADVFIKPLSPTQFKTLVSKLGMMNIYS

SEQ ID NO: 211831 - protein, 105 aa, Glycine max
  Coding DNA Sequence Number=SeqID_95053
MDNLKKRNIISNSTSIECISCLNASLHIEFGHKCYTRFGDLRVMLVDCIFHFWQHKGAVFGKQTCLVWWSMWVAVLWTIWKRRNNIKFNAAQGDYVGVLDEANFW

SEQ ID NO: 211832 - protein, 84 aa, Glycine max
  Coding DNA Sequence Number=SeqID_95054
MEGGVGSEGIIPKLLHCGGAREVVQTEPFENVAPLIGLADAKAYEGAPSEHVSLSASKWLCAKRAWMREAQEETTSSLGRLAAH

SEQ ID NO: 211833 - protein, 634 aa, Glycine max
  Coding DNA Sequence Number=SeqID_95055
  Gene Ontology: Mol. function=protein binding; Cellular component =membrane; Biological process=defense response
  Homolog annotation: Hit_ID=Q6SQJ2; Match level="QueryCoverage=99%, HitCoverage=53%, E-value=0.0, Identity=82%"; Hit description=NBS-LRR type disease resistance protein RPG1-B
  Pfam annotation: Domain name=NACHT; Domain location=211-363; Score= -29.9; E_value=0.012; Accession=PF05729.3; Description=NACHT domain
  Pfam annotation: Domain name=NB-ARC; Domain location=170-474; Score =336.6; E_value=4.4e-98; Accession=PF00931.13; Description=NB-ARC domain
  Pfam module annotation: Pfam domain module=NACHT::NB-ARC; Domain location=211-363::170-474
MAVELIAGALLSSFLQVAFEKLASPQVLDFFHGKKLDETLLRKLKIKLQSIDALADDAERKQFADPRVRNWLLEVKDMVFDAEDLLDEIQYEFSKWELEAESESESQTCTGCTCKVPNFFKSSPASSFNREIKSRMEKILDSLEFLSSQKDDLGLKNASGVGVGSELGSEVPQISQSTSLVVESDIYGRDEDKKMIFDWLTSDNGNPNQPSILSIVGMGGMGKTTLAQHVFNDPRIQETKFAVKAWVCVSDDFDVFRVTRTILEAITKSTDDSRDLEMVHGRLKEKLTGKKFLLVLDDVWNENRLKWEAVLKPLVFGAQGSRIIATTRSKEVASTMRSKEHLLEQLQEDHCWKLFAKHAFQDDNIQPNPDCKEIGTKIVEKCKGLPLALKTMGSLLHNKSSVREWESILQSEIWEFSTECSGIVPALALSYHHLPSHLKRCFAYCALFPKDYEFDKECLIQLWMAENFLQCPQQGKSPEEVAEQYFNDLLSRCFFQQSSNIEGTHFVMHDLLNDLAKYICGDICFRSDDDQAKDTPKATRHFSVAINHIRDFDGFGTLCDTKKLRTYMPTSGRMKPDSRYRWQSWHCKMPIHELLSKFNYLHILSLSDCHDLREVPDSIAELLWKFEGAALKFA

SEQ ID NO: 211834 - protein, 423 aa, Glycine max
  Coding DNA Sequence Number=SeqID_95056
  Gene Ontology: Mol. function=RNA-directed DNA polymerase activity; Cellular component=chromatin; Biological process=chromatin assembly or disassembly
MATDFGTFMHQLPTRRDAVMNENPTTEQCAQNKNNTNDEDDVTGTEHAIESRKEGEERPKQEVSPFSTAFPISSKENEKLDALIHRIEALEHTVHHSPTPSSSSVTPVVNPPNNHPPRMKLDIPRFDGSAPSDWIFKITQFFEYHFTPEANRLTITSFYMEGSALAWFQWMMRNHQLTTWPCLLQTIEARFSHSLYEDPTGLLCKLTQKGTVKDYLNNFEALANRIVGLPPSFLLSCFISGLDPDICHEVQALQPFSIVHAAGLACLMEDKLHENRKGFRGRQSPGPTFTSPPPGPTFTLLPPGPTFASAPSSPSFAPPSSPTPFVQPLPALVPTNNPNLPLLPSPTKPLPLPVWRLTAKELANRRECNLCFNCHEKFTRGHRCAPRFFLLAADEDSEDTNPNILSPHNPILEDPTLMTRTDP

SEQ ID NO: 211835 - protein, 1013 aa, Glycine max
  Coding DNA Sequence Number=SeqID_95057
  Gene Ontology: Mol. function=protein binding; Cellular component =membrane; Biological process=defense response
  Homolog annotation: Hit_ID=Q6R271; Match level="QueryCoverage=99%, HitCoverage=82%, E-value=0.0, Identity=71%"; Hit description=Disease resistance protein
  Pfam annotation: Domain name=LRR_1; Domain location=403-425; Score =5.0; E_value=34; Accession=PF00560.23; Description=Leucine Rich Repeat
  Pfam annotation: Domain name=LRR_1; Domain location=427-448; Score =9.8; E_value=4.1; Accession=PF00560.23; Description=Leucine Rich Repeat
  Pfam annotation: Domain name=LRR_1; Domain location=450-472; Score =11.3; E_value=2.2; Accession=PF00560.23; Description=Leucine Rich Repeat
  Pfam annotation: Domain name=LRR_1; Domain location=474-495; Score =8.1; E_value=8.7; Accession=PF00560.23; Description=Leucine Rich Repeat
  Pfam annotation: Domain name=LRR_1; Domain location=610-631; Score =5.6; E_value=26; Accession=PF00560.23; Description=Leucine Rich Repeat
  Pfam annotation: Domain name=LRR_1; Domain location=633-656; Score =0.8; E_value=2e+02; Accession=PF00560.23; Description=Leucine Rich Repeat
  Pfam annotation: Domain name=LRR_1; Domain location=688-709; Score =9.7; E_value=4.3; Accession=PF00560.23; Description=Leucine Rich Repeat
  Pfam annotation: Domain name=LRR_1; Domain location=766-789; Score =12.0; E_value=1.6; Accession=PF00560.23; Description=Leucine Rich Repeat
  Pfam annotation: Domain name=LRR_1; Domain location=833-855; Score =9.2; E_value=5.4; Accession=PF00560.23; Description=Leucine Rich Repeat
  Pfam annotation: Domain name=LRR_1; Domain location=858-881; Score =8.8; E_value=6.4; Accession=PF00560.23; Description=Leucine Rich Repeat
  Pfam annotation: Domain name=LRR_1; Domain location=906-926; Score =2.1; E_value=1.2e+02; Accession=PF00560.23; Description=Leucine Rich Repeat
  Pfam annotation: Domain name=LRR_1; Domain location=929-952; Score =3.1; E_value=76; Accession=PF00560.23; Description=Leucine Rich Repeat
  Pfam annotation: Domain name=LRR_1; Domain location=954-977; Score =10.9; E_value=2.6; Accession=PF00560.23; Description=Leucine Rich Repeat
  Pfam annotation: Domain name=NB-ARC; Domain location=1-280; Score =294.7; E_value=1.8e-85; Accession=PF00931.13; Description=NB-ARC domain
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR_1::NB- ARC; Domain location=403-425::427-448::450-472::474-495::610-631::633- 656::688-709:...
  Pfam module annotation: Domain location=:766-789::833-855::858 -881::906-926::929-952::954-977::1-280
MIVNWLTSDIDNCSELSILSIVGMGGLGKTKLAQHVFNDPRIENKFDIKAWVCVSDEFDVFNVTRTILVEVTKSTDDSRNREMVQERLRLKLTGKRFFLVLDDVWNRNQEKWKDLLTPLNDGAPGSKIVVTTRDKKVASIVGSNKIHSLELLQDDHCWRLFAKHAFQDDSHQPNPDFKEIGAKIVEKCKGLPLALTTIGSLLHQKSSISEWEGILRSEIWEFSEEDSSIVPALALSYHHLPSHLKRCFAYFALFPKDYRFHKEGLIQLWMAENFLQCHQQSRSPEEVGEQYFNDLLSRSFFQQSSNIKGTPFVMHDLLNDLAKYVCGDICFRLEDDQVTNIPKTTRHFSVASNYVKCFDGFRTLYNAERLRTFMSSSEEMSFHYYNRWQCKMSTDELFSKFKFLRVLSLSGYSNLTEAPDSVGNLKYLHSLDLSNTDIEKLPESTCSLYNLLILKLNGCKHLKELPSNLHKLTNLHSLELINTGVRKVPAHLGKLKYLQVSMSPFKVGKSREFSIQQLGELNLHGSLSIQNLQNVENPSDALAVDLKNKTHLVEVELEWDFFWNPDDSTKERDEIVIENLQPSKHLEKLRMRNYGGKQFPRWLLNNSLLNVVSLTLENCQSCQRLPPLGLLPLLKELSIEGLDGIVSINADFFGSSSCSFTSLESLMFHSMKEWEEWECKGVTGAFPRLQRLSIVRCPKLKGLPPLGLLPFLKELLIERLDGIVSINADFFGSSSCSFTSLESLKFFDMKEWEEWECKGVTGAFPRLQRLSIEDCPKLKGHLPEQLCHLNYLKISGWDSLTTIPLDMFPILKELDLWKCPNLQRISQGQAHNHLQTLNVIECPQLESLPEGMHVLLPSLHHLVIYDCPKVEMFPEGGLPSNLKEMGLHGSYKLIYLLKSALGGNHSLETLDIGRVDVECLPEEGVLPHSLVNLWIRECGDLKRLDYKGLCHLSSLKTLLLWDCPRLQCLPEEGLPKSISTLTIRRCRLLKQRCREPEGEDWPKIAHIEDVYCE

SEQ ID NO: 211836 - protein, 66 aa, Glycine max
  Coding DNA Sequence Number=SeqID_95058
  Subcellular localization annotation: CTP_CleavageSite=44; ConfidenceScore=5.63e-01
MPRPTQSVTQAQRHKDPLSATSPQPTHKHSSPSRPRATAFPRPYAAANAHPPSFLTLFLDLRIVSW

SEQ ID NO: 211837 - protein, 118 aa, Glycine max
  Coding DNA Sequence Number=SeqID_95059
  Pfam annotation: Domain name=DUF784; Domain location=22-118; Score= -36.8; E_value=0.024; Accession=PF05617.2; Description=Arabidopsis thaliana protein of unknown function (DUF784)
MSSLNNLYVALAFALSLNLLINMSLSSETPQPSQGPSNSKPLSAYEKYLSDCASKLKPHCGEQIFFSVFVGNQTVTNRCCLSLLNDMGKACHTDVTKYAVTLPLFKQNLTQILKRSEK

SEQ ID NO: 211838 - protein, 310 aa, Glycine max
  Coding DNA Sequence Number=SeqID_95060
  Gene Ontology: Mol. function=protein dimerization activity; Cellular component=nucleus; Biological process=regulation of transcription, DNA-dependent
  Homolog annotation: Hit_ID=Q8LNK9; Match level="QueryCoverage=87%, HitCoverage=35%, E-value=7e-65, Identity=45%"; Hit description =Putative transposable element
  Pfam annotation: Domain name=zf-BED; Domain location=51-96; Score =20.8; E_value=0.0031; Accession=PF02892.5; Description=BED zinc finger
MAHQESAHEETTHGLGYTPSYSPPATPNESITTPKLEETTNNLEGTSRLKSEISKHFKNIKANGEDKAQCNYFFKLLGRKSKNGTKHLWGHTNICIQYKSAMRRNKGQTYLVPKVVQGKQELGTGTYDADNARKELAKTIIMHEYPLLIVDHVGFKRYLVALQPVFQVPCGNTIKREIFMIYQEERSTPLKLLDSLQGRVAITSDMWTGSNQKREYMVLTAHYIDSSWTLKSQILKFIYVPAPYSSEKLCNVLVECLMDWNIDTKLSTITLDNSSTNDKMVDKIKDKLHLGSLLRDETLLHMCCCAHVKT

SEQ ID NO: 211839 - protein, 56 aa, Glycine max
  Coding DNA Sequence Number=SeqID_95061
MVVLPESYVPLVVDLVDLVSKDEEEDLEEDTSIEEDPSMNKDDLAIELELMEEDSS

SEQ ID NO: 211840 - protein, 61 aa, Glycine max
  Coding DNA Sequence Number=SeqID_95062
MSMKNLIEHLGVHDKTNHTLGDQSGSPCFARMLQPCEIDTDLKEQSNQVYLPPRPTLRRVC

SEQ ID NO: 211841 - protein, 143 aa, Glycine max
  Coding DNA Sequence Number=SeqID_95063
MAPCKIKATVTLSQASYDSSRFVSRDAWDRYTDNIIDQNILLKRNVKLYINEFDDFKREVERRNWHRELTNFSDGSIDVAIVKEFYANLYVPKDKEQKQVRVQRHLIKFDADSLNTFLKTPMVEARPSRAGRPVVYPRKGICS

SEQ ID NO: 211842 - protein, 136 aa, Glycine max
  Coding DNA Sequence Number=SeqID_95064
  Gene Ontology: Cellular component=integral to membrane
  Homolog annotation: Hit_ID=Q1MBC1; Match level="QueryCoverage=99%, HitCoverage=55%, E-value=3e-35, Identity=54%"; Hit description =Putative transmembrane protein
KRLDRAWNAERADELSNGALPEFKDIEDIQDSLRALNPKDAAQGSLQTRALEVSGMIAEGLPVPFLIVLISWLALLFATFGLQAPLNSTVILIIIVCSLSVAGAIFVISDMASPYAGLIHISETPLRTALDRLGAP

SEQ ID NO: 211843 - protein, 313 aa, Glycine max
  Coding DNA Sequence Number=SeqID_95065
  Gene Ontology: Mol. function=nucleoside-triphosphatase activity; Cellular component=membrane; Biological process=peptide transport
  Homolog annotation: Hit_ID=Q1MAH5; Match level="QueryCoverage=99%, HitCoverage=99%, E-value=1e-123, Identity=55%"; Hit description =Putative ATP-binding component of ABC transporter
  Pfam annotation: Domain name=ABC_tran; Domain location=50-240; Score =195.2; E_value=1.6e-55; Accession=PF00005.17; Description=ABC transporter
  Pfam annotation: Domain name=oligo_HPY; Domain location=243-301; Score=39.6; E_value=1.1e-08; Accession=PF08352.2; Description =Oligopeptidedipeptide transporter, C-
  Pfam module annotation: Pfam domain module=ABC_tran::oligo_HPY; Domain location=50-240::243-301
  Subcellular localization annotation: CTP_CleavageSite=38; ConfidenceScore=5.04e-01
EVAETVASGQTPVLSVKNLVTRFPIRSGLLARQTGAVHAVENVSFDLFQGETLSLVGESGCGKSTTGRSIMRLVEPSSGDVSLDGYDVMRLDTVGLRNMRKSVQMIFQDPFSSLNPRMTVGTAISEPFIKHKLGTTKQAKEKTADLLEKVGLSADMANRYPHEFSGGQRQRIAIARALALDPKVIVADESVSALDVSIKAQVINLMLDLQQSLDLAFLFISHDMAVVERVSHRVAVMYLGEIVEIGPRSAVFENPQHDYTRKLMAAVPVPDPDRRRVKLSSETGELKSPIRPADFVVPLREYREVSPQHFVAL

SEQ ID NO: 211844 - protein, 125 aa, Glycine max
  Coding DNA Sequence Number=SeqID_95066
  Pfam annotation: Domain name=Response_reg; Domain location=16-125; Score=-15.2; E_value=0.052; Accession=PF00072.14; Description =Response regulator receiver domain
MGMDILFNTGDDNKPKKIIIALSCNFAQTGLQELCRSLPGCEVQTILGAPEAISDELMFSYADLVITDLPRDAAGLAELLLIPEWFKGSTLILLDEEAKAMRRTLLDADFSDVVMKKEKLTTLHQ

SEQ ID NO: 211845 - protein, 86 aa, Glycine max
  Coding DNA Sequence Number=SeqID_95067
MSDNNDAPQIKTHRCRHQLRSYKNAFNGHGRTNKTKVKDIVTIFGKTQKKDHADKNIWKKMQDKRWSEMSSGFGGDGYTTTVASVG

SEQ ID NO: 211846 - protein, 116 aa, Glycine max
  Coding DNA Sequence Number=SeqID_95068
MASHKRKAIASMSQASYDRSRFISQKTWDHYSDNVLARNILLERNVKLFSRLRPDPQELAARLCILGGDLFLMPRVCRGSSCGKILPLWPKPGVFYLILTWPRHPILLILILIGPS

SEQ ID NO: 211847 - protein, 85 aa, Glycine max
  Coding DNA Sequence Number=SeqID_95069
MFMKRKDMHWQFGTLNLSHTSSYFPPSCAEGMAILSFALSLFLIRERGSWRKYHFCSGNCFWDIKDVCSEECHAEPGEAQDSDTG

SEQ ID NO: 211848 - protein, 141 aa, Glycine max
  Coding DNA Sequence Number=SeqID_95070
MHLHGGKSPLKDLIEAQRSSLHRSSTSKLPSKGGKSSEEIYPQEEGQPLMVKEECKEVSVSSKRLAKKERHFEIKKNIKEISPLRQPPHFLLCKNTLVSIVTPLGLKYIPQVKELLDEGLVRKSLNPCALLVAKIVIKGFP

SEQ ID NO: 211849 - protein, 99 aa, Glycine max
  Coding DNA Sequence Number=SeqID_95071
  Gene Ontology: Mol. function=protein phosphatase type 2C activity
KLQLISGVRAFLSEQQGLIIKWKKRGSVSLIVRCWKPFGHGDDSGNAAATKRECKDDLLWFRDIEKFAADDFSMAVVQTNQGMVDPKQVPLDYVLFQPN

SEQ ID NO: 211850 - protein, 118 aa, Glycine max
  Coding DNA Sequence Number=SeqID_95072
MSEEVDMDVEKEDEPGVKSEHVDCSDVFNTSKILKLIFVVKARAVTYEIGFVAVIMRSNTNTGMRGRVPFVLIGCERSSQYRTRKKDFVRTVTDSRKYGCPFKLCGKPVVGGEGWMVK

SEQ ID NO: 211851 - protein, 149 aa, Glycine max
  Coding DNA Sequence Number=SeqID_95073
MEKSGGKQNNFGSMKEREWKIFRPDKFSARLPFSTGDIPPHLNKEEKTETPSFLSKNTTLEKILLKLKVDILPFILGYKEDYPWHKYIVSLRYGALANDLFFFTKSMFAFQVEKPSGPFGPANHFYSETHECHCLALFMCPPPFESGAP

SEQ ID NO: 211852 - protein, 152 aa, Glycine max
  Coding DNA Sequence Number=SeqID_95074
  Pfam annotation: Domain name=zf-CCHC; Domain location=80-97; Score =13.8; E_value=0.0051; Accession=PF00098.13; Description=Zinc knuckle
MTLATLFGKLQEHEIELMRLNQHEENDKKKKGTALQASSSIQEESDKEDLNEIEEDEKQRKLKEIKLQSKKKGEDSSLVLKCNECDQPGHLRFNCLVFKRRMEKSDKKNFKDKKENKAYITWEDNDMDSSSDSENEIINLGLMTKDYESEEE

SEQ ID NO: 211853 - protein, 256 aa, Glycine max
  Coding DNA Sequence Number=SeqID_95075
  Homolog annotation: Hit_ID=Q8H6Q8; Match level="QueryCoverage=47%, HitCoverage=4%, E-value=1e-09, Identity=30%"; Hit description=CTV.20
  Subcellular localization annotation: CTP_CleavageSite=26; ConfidenceScore=5.02e-01
MASESDDDSETNLQKQIQKAKQTKTVCNQKPSQQLTQQESTPQPSNSYISKNKFFNVLQMEPEYWDKNPFKATAKNNTMYNFPNWFLQWWNYFGPIPQIFPEEVQQGFQQFSKLFNSKESRIPADLKYGKTENSKQYPPLQRHAFVKWWSQFDTPKAAPEQVKNWFQSNSEFLKPADPETSLFLNQKSQLAAFLASSKSKESLAQNLKEVLQLLQQEEEEELPKKEAESSENNDDQEDDPFYQNEDDCFGISLDDD

SEQ ID NO: 211854 - protein, 81 aa, Glycine max
  Coding DNA Sequence Number=SeqID_95076
MASSTCFQQISSQITIMKEKEVYPNLKFRGPTRRDALHDSENAFLSRFGAEMMTKGWSFVGASMVEEEEENGNVRERGKGF

SEQ ID NO: 211855 - protein, 218 aa, Glycine max
  Coding DNA Sequence Number=SeqID_95077
ADTVVSDGKQRPSLVILHPRYAEIPYGYPHPFARQTQLCPMASRDQRPSLVILHPRYAEIPYGYLHPFARQTQLCPMASRDQRPSLVILHPRYAEIPYGYLHPFARQTQLCPMASRDQVWSFCTQDTRRYLTVIRTLLSSRGGGPDDKQRPNRTLDSMQRLTQSSAPFVPPGTTKSFTCGNFMVTRDSRQPRGAKLVSYTDFWGPLLDDMRPFFGPCG

SEQ ID NO: 211856 - protein, 42 aa, Glycine max
  Coding DNA Sequence Number=SeqID_95078
LARVGGAGLWPRVKFRIGGPPPPPRDQFCTQDFANFGLRPVG

SEQ ID NO: 211857 - protein, 53 aa, Glycine max
  Coding DNA Sequence Number=SeqID_95079
  Gene Ontology: Mol. function=unspecific monooxygenase activity
  Homolog annotation: Hit_ID=O04892; Match level="QueryCoverage=98%, HitCoverage=15%, E-value=2e-10, Identity=90%"; Hit description =Cytochrome P450 like_TBP
ALNVKVKKFNQARVIGGCNYDSLKAKGTGLAESAGKEDPVELDSSPTWGNDLR

SEQ ID NO: 211858 - protein, 105 aa, Glycine max
  Coding DNA Sequence Number=SeqID_95080
  Homolog annotation: Hit_ID=Q09JM0; Match level="QueryCoverage=47%, HitCoverage=91%, E-value=6e-07, Identity=58%"; Hit description=10 kDa putative secreted protein
MNRKLGYGAQLRANLDPTKGVGRLRQQDGGHGSRNPLRRRGGRCKTQGASPGGAVVGADLGGTGEARLIALCARTPKGNRPAHPGNGSAGGRVQRLEEHRTSRGV

SEQ ID NO: 211859 - protein, 152 aa, Glycine max
  Coding DNA Sequence Number=SeqID_95081
MPLIIWLYPDRTRPRAPAILRENFGGNQLLDGIVHHLSGPDRYALTRTLHRRSGSVGGATHRGIPPISFLAPYGPTPGARRCRGTPRARAAIHNRDDDVSTSISTARAWATIAIRVGQCPESIGGPALTVPHPTGTHRRPPSASLPTISSTL

SEQ ID NO: 211860 - protein, 85 aa, Glycine max
  Coding DNA Sequence Number=SeqID_95082
MLQLQCIIKAKGRLGTPTSNGNGVQPKEAAPGLAVKEKARGRAILLGAPSISPVFERATLVHSTKEISLKVYKLHMELHHVLVGH

SEQ ID NO: 211861 - protein, 105 aa, Glycine max
  Coding DNA Sequence Number=SeqID_95083
  Gene Ontology: Mol. function=RNA-directed DNA polymerase activity; Cellular component=chromatin; Biological process=RNA-dependent DNA replication
MAPEDMEKTNFITLWGIFCYKVMLFGLKNARATYQRAMVALFHDMMHKEIEVYVDDMIEKSRTEEDYLVNLRKLFEQLCKYKLRLNPMKCTFGVKSGKLLDFVVR

SEQ ID NO: 211862 - protein, 76 aa, Glycine max
  Coding DNA Sequence Number=SeqID_95084
MGENFLIGPYVHLRLMHGAPHGPSEGTYWVRTSNFPLGSLEAHARCPSLPQCKALRYQFVIFRDDLVAGNLLGENF

SEQ ID NO: 211863 - protein, 44 aa, Glycine max
  Coding DNA Sequence Number=SeqID_95085
MTYRIHNCTGDRRQDPAYLQVLSVPQLPVYPTQLINIKRMTVKT

SEQ ID NO: 211864 - protein, 93 aa, Glycine max
  Coding DNA Sequence Number=SeqID_95086
MGFRGFRDTPGLTSPGRAGRQPPPPFSYKKAEGGCSKDPSAPWLCISAVLGEKNCFREENPSRGASVTLPRCFRKQIREGFRPFFIRSSFFNG

SEQ ID NO: 211865 - protein, 79 aa, Glycine max; identical to SEQ ID NO: 183825
  Coding DNA Sequence Number=SeqID_95087

SEQ ID NO: 211866 - protein, 365 aa, Glycine max
  Coding DNA Sequence Number=SeqID_95088
  Gene Ontology: Mol. function=DNA binding; Cellular component=nucleus; Biological process=regulation of transcription, DNA-dependent
  Homolog annotation: Hit_ID=Q6R0A6; Match level="QueryCoverage=92%, HitCoverage=98%, E-value=2e-71, Identity=46%"; Hit description=MYB transcription factor
  Pfam annotation: Domain name=Myb_DNA-binding; Domain location=16-63; Score=49.9; E_value=8.5e-12; Accession=PF00249.21; Description=Myb -like DNA-binding domain
  Pfam annotation: Domain name=Myb_DNA-binding; Domain location=69-114; Score=42.9; E_value=1.1e-09; Accession=PF00249.21; Description=Myb -like DNA-binding domain
  Pfam module annotation: Pfam domain module=Myb_DNA-binding::Myb_DNA -binding; Domain location=16-63::69-114
MGKGRAPCCDKTQVKRGPWSPAEDLKLIAFIQKYGHENWRALPKQAGLLRCGKSCRLRWINYLRPDVKRGNFTLEEEENIIRLHKALGNKWSKIASRLPGRTDNEIKNVWNTHLKKRLAPKKGSESSADESKPESSITSASSSSSESFFSYERPNSPKTTTPCNNDQFNDQAEKLSIEDKMEQDSEKQVSNELANITEDPKGSSVSLSSDESNIVNTSQIVEHKPEEEQLASPLPYLGHYDVGSMLEEVDKPNQLIEIPWEPDYDFWKLLDDDNSLESFQSNEVQLGEFPAIQNIILGEESVHDAEAKKWSQDFENEFGVVGEMKESNKDHFLPKNYAVEPEMDHTQAFDFDDIDMARPESELDL

SEQ ID NO: 211867 - protein, 125 aa, Glycine max
  Coding DNA Sequence Number=SeqID_95089
MTKTRQKGVRKVNEMKIKVRETSGDHQGPKNNGEGTKDGGKSSRNHLRKCLGCVTEAPRLGFSSRKRFFSLISSDPQIPGGLNVFVLPSSPYLLGKKGEACHPACPGEIGCFLQKAPPFGGTSWK

SEQ ID NO: 211868 - protein, 181 aa, Glycine max
  Coding DNA Sequence Number=SeqID_95090
  Gene Ontology: Mol. function=protein binding; Cellular component =intracellular; Biological process=protein modification process
  Homolog annotation: Hit_ID=A0DBT3; Match level="QueryCoverage=90%, HitCoverage=88%, E-value=3e-41, Identity=58%"; Hit description =Chromosome undetermined scaffold_445, whole genome shotgun sequence
  Pfam annotation: Domain name=ubiquitin; Domain location=1-53; Score =56.4; E_value=9.1e-14; Accession=PF00240.13; Description=Ubiquitin family
  Pfam annotation: Domain name=ubiquitin; Domain location=61-129; Score= 117.4; E_value=4e-32; Accession=PF00240.13; Description=Ubiquitin family
  Pfam module annotation: Pfam domain module=ubiquitin::ubiquitin; Domain location=1-53::61-129
MARPAELELDDKEGIPPDQQRLIFAGKQLEDGRTLADYNIQKESTLHLVLRLRGGTMIKVKTLTGKEIEIDIEPTDTIDRIKERVEEKEGIPPVQQRLIYAGKQLADDKTAKEYNIEGGSVLHLVLALRGDIIVLMCLVVIEAAIGGSTNVNLQTLLSVSEKFIFCSLVCGCLPLEKREME

SEQ ID NO: 211869 - protein, 75 aa, Glycine max
  Coding DNA Sequence Number=SeqID_95091
MGVEGAQGQWNWSGGRRVRRRRKWRFRCEEKEEGTSKWEVGSGKGKGCGIIAYAGTRGFLGRAQTGILASGVGSS

SEQ ID NO: 211870 - protein, 229 aa, Glycine max
  Coding DNA Sequence Number=SeqID_95092
MTTIAQSNTSRLVFPTLIVALCRARGVVSDSLTFERLSPVINLAYIKKNCWNPKDLTVSIRGARRARVRPAELPSTFAAPTPASTSAAPSVPAQTDSQHFAAMLQSIHQGHIILLQSLQVVAPPGSIPSTEQFREMVAWPRTQPSLHKEDEGPTTQPFVIGEEAEETQVRQVVAATPERSLKATSEPSAQGEDIPSPQPTVDPSTPLLEMPKDPTTPILAMDTSPPATP

SEQ ID NO: 211871 - protein, 440 aa, Glycine max
  Coding DNA Sequence Number=SeqID_95093
  Gene Ontology: Mol. function=pepsin A activity; Cellular component =anchored to membrane; Biological process=proteolysis
  Homolog annotation: Hit_ID=Q9C864; Match level="QueryCoverage=98%, HitCoverage=98%, E-value=4e-73, Identity=37%"; Hit description =Chloroplast nucleoid DNA binding protein, putative
  Pfam annotation: Domain name=Asp; Domain location=91-435; Score= -87.7; E_value=2e-08; Accession=PF00026.14; Description=Eukaryotic aspartyl protease
  Subcellular localization annotation: CTP_CleavageSite=60; ConfidenceScore=5.09e-01
MHAFVFCFLLLCSHSIASFAEASKTLSGFSINLIHRESPLSPFYNPSLTPSERIKNTVLRSFARSKRRLRLSQNDDRSPGTITIPDEPITEYLMRFYIGTPPVERFAIADTGSDLIWVQCAPCEKCVPQNAPLFDPRKSSTFKTVPCDSQPCTLLPPSQRACVGKSGQCYYQYIYGDHTLVSGILGFESINFGSKNNAIKFPKLTFGCTFSNNDTVDESKRNMGLVGLGVGPLSLISQLGYQIGRKFSYCFPPLSSNSTSKMRFGNDAIVKQIKGVVSTPLIIKSIGPSYYYLNLEGVSIGNKKVKTSESQTDGNILIDSGTSFTILKQSFYNKFVALVKEVYGVEAVKIPPLVYNFCFENKGKRKRFPDVVFLFTGAKVRVDASNLFEAEDNNLLCMVALPTSDEDDSIFGNHAQIGYQVEYDLQGGMVSFAPADCAKD

SEQ ID NO: 211872 - protein, 50 aa, Glycine max
  Coding DNA Sequence Number=SeqID_95094
MGVSGNVIVLGDSSLSSLLDPNALDPRRLDQEMEHMAAFLRRSDGPLIFA

SEQ ID NO: 211873 - protein, 298 aa, Glycine max
  Coding DNA Sequence Number=SeqID_95095
  Gene Ontology: Mol. function=peptidase activity; Cellular component =cellulose and pectin-containing cell wall; Biological process =proteolysis
  Homolog annotation: Hit_ID=Q6XBF8; Match level="QueryCoverage=80%, HitCoverage=64%, E-value=3e-37, Identity=33%"; Hit description=CDR1
MFATADTGSDLIWMQCSPCECQYSYAYGDKTFTVGTLGVDKINFGSKGVVQFPKFTVGCAYYNQDTPNSKGLGEGPLSLVSQLGDQIGYKFSYCLIPYGLNYTSKLKFGDIALATIKGKRVVSTPLILKSSEPSFYYVNFEGISIGKRKVEMSKSESDGNMFIGSGATYTMLQQDFYNKFVTLVKEVAGAEVEKNPPAPFDFCLRDKGTKHLWFKDSSDDDDDGVPDVVFHFTATEMDLTSSGMCNKWDFRWSMILEGERFRLLLLIVPNISLRNLCSVNNDYTCACIPRKYEKVVCL

SEQ ID NO: 211874 - protein, 72 aa, Glycine max
  Coding DNA Sequence Number=SeqID_95096
MERKAAFVMRSDGPLRLSLASPEDIEESEYKAKDKNKSGCMLMKCKFKEVKAKDKNLNARVEHVEVALFIDF

SEQ ID NO: 211875 - protein, 395 aa, Glycine max
  Coding DNA Sequence Number=SeqID_95097
  Gene Ontology: Mol. function=peptidase activity; Cellular component =cellulose and pectin-containing cell wall; Biological process =proteolysis
  Homolog annotation: Hit_ID=Q6XBF8; Match level="QueryCoverage=92%, HitCoverage=93%, E-value=5e-67, Identity=38%"; Hit description=CDR1
  Pfam annotation: Domain name=Asp; Domain location=89-390; Score= -107.2; E_value=2.8e-07; Accession=PF00026.14; Description=Eukaryotic aspartyl protease
MHPLVFLSLALYLLSTVSSREVSEGQRGFSIDLIHRDSPLSPFYKPSLTPSDRIINTALRSIYQLNRASHSDLNEKKTLERVRIPNHGEYLMRFYIGTPPVERLAIADTASDLIWVQCSPCNLCLYTNTYGDGSSTKGVLCTESIHFGSQTVTFPKTIFGCGSNNDFMHQISNKVTGIVGLGAGPLSLVSQLGDQIGHKFSYCLLPFTSTSTIKLKFGNDTTITGNGVVSTPLIIDPHYPSYYFLHLVGITIGQKMLQVRTTDHTNGNIIIDLGTVLTYLEVNFYHNFVTLLREALGISETKDDIPYPFDFCFPNQANITFPKIVFQFTGAKVFLSPKNLFFRFDDLNMICLAVLPDFYAKGFSVFGNLAQVDFQVEYDRKGKKVSFAPADCSKN

SEQ ID NO: 211876 - protein, 41 aa, Glycine max
  Coding DNA Sequence Number=SeqID_95098
MTFFTTAPHGTSSGEVIPQHFKCKRKRGLQKVGKGKFPRTT

SEQ ID NO: 211877 - protein, 345 aa, Glycine max
  Coding DNA Sequence Number=SeqID_95099
  Gene Ontology: Mol. function=peptidase activity; Cellular component =cellulose and pectin-containing cell wall; Biological process =proteolysis
  Homolog annotation: Hit_ID=Q6XBF8; Match level="QueryCoverage=99%, HitCoverage=78%, E-value=9e-66, Identity=41%"; Hit description=CDR1
  Pfam annotation: Domain name=Asp; Domain location=3-340; Score= -173.1; E_value=0.0022; Accession=PF00026.14; Description=Eukaryotic aspartyl protease
MRFYIGTPPVERLAVANTASDLIWVQCSPCLSCFPQDTPLFEPLKSSTFKGATCDSQPCTLLHPNNRHCGKVGQCIYSYEYGGKFAESFTVGLVGTETLSFGSTGGAQNVSFPNSIFGCGMSNEIKFRFSNKVTGVVGLGAGPLSLVSQLGAQIGHKFSYCLVPYDSTSSSKLKFGSEAIITTNGVVSTPLIIKPNLPTFYFLNLETVTIGQKVLQTGRTDGNIIIDCGTPLVHLEETFYNNFMALVQEALDTALVTHHSIPLKCFGRTGREVLPDIELQFTGASGAVRSKNLFLPITNLFCLAVVPSQVSGISIFGNIAQVDFQVGYDLEGRKVSFAPTDCSKF

SEQ ID NO: 211878 - protein, 232 aa, Glycine max
  Coding DNA Sequence Number=SeqID_95100
  Gene Ontology: Mol. function=transcription regulator activity; Cellular component=nucleus; Biological process=regulation of transcription
  Homolog annotation: Hit_ID=Q2QQD4; Match level="QueryCoverage=24%, HitCoverage=19%, E-value=7e-11, Identity=62%"; Hit description=Helix- loop-helix DNA-binding domain containing protein
  Pfam annotation: Domain name=HLH; Domain location=172-219; Score =11.8; E_value=0.008; Accession=PF00010.16; Description=Helix-loop -helix DNA-binding domain
MALSTYFNFETLQIPNLETNTFHEAMPEEVAAPNLQQLFPYSDESFFLSDALFENYIDPTGGFLYPPDVNPPYDGDIFPTHKDYKLLPCSKRQKCCYEEQQRQQEHVYSSSLQEFTTPTLPSSFLDGFVIPYDNCCSLQAEELQQKLFSETQYGDTCVDLPCEKKGNERTISPQSVAARERRRKITKKTQELGKLVPGGPKMNTAEMLHAAGKYVMYLQAQVGMLELMNTLE

SEQ ID NO: 211879 - protein, 337 aa, Glycine max
  Coding DNA Sequence Number=SeqID_95101
  Gene Ontology: Mol. function=transcription regulator activity; Cellular component=nucleus; Biological process=regulation of transcription
  Homolog annotation: Hit_ID=Q2QQD4; Match level="QueryCoverage=40%, HitCoverage=40%, E-value=3e-12, Identity=37%"; Hit description=Helix- loop-helix DNA-binding domain containing protein
  Pfam annotation: Domain name=HLH; Domain location=177-224; Score =22.5; E_value=0.00058; Accession=PF00010.16; Description=Helix-loop -helix DNA-binding domain
MALSTYSNCDTLQISNLETNTFHEAMPEEEVAAPNLQHFFSYLDESFFLSNTLLENYIDPTFGFLYPPGINHPYDPFTSLTSRDDIFPTHEDYNLLPCPKRKKCCYEEKQQHQEHVYSSLQEITTPTLLSNLIDGFVVPYENCSSFQAEELQQPVFYEVTQYGDPCVDLQCEKRGTKRPISPPRERRRKITEKTQELGKLVPGGPKMNTAEMLHAAAKYVKFLQAQVGMLELMNILEFICDDASIFALTIRMHVLGHCIFGHLEDKAEPPPENIHALVVSPLVQEKLYTEERCFVPNGIVTTLTNHEDVHSRPTILEDLKQLIGTDIEKKQSKTKSS

SEQ ID NO: 211880 - protein, 134 aa, Glycine max
  Coding DNA Sequence Number=SeqID_95102
MTRRLCTWFISVPQRQHFWSLNGNGYLKRENVWGRKKKKKIGGHCALQTGASTVHVTRGTAGSTLTRAPLVAPRGQALLVAPLLQALRLAQAARRLPPSLFFSHPPVSSHTPSLSSSHTPHPKILYFLYCLSKI

SEQ ID NO: 211881 - protein, 83 aa, Glycine max
  Coding DNA Sequence Number=SeqID_95103
MKLVTDSKIIWKEDKAEPPPENLHALVASPFVQEKLYTEERCFVPKEVVTTLTNHKDVQSRPTILKDLKQLIGTDIEKKAKQE

SEQ ID NO: 211882 - protein, 260 aa, Glycine max
  Coding DNA Sequence Number=SeqID_95104
  Gene Ontology: Mol. function=thiosulfate sulfurtransferase activity; Cellular component=mitochondrion; Biological process=sulfate transport
  Homolog annotation: Hit_ID=Q9ZPK0; Match level="QueryCoverage=98%, HitCoverage=70%, E-value=1e-123, Identity=80%"; Hit description =Thiosulfate sulfurtransferase
  Pfam annotation: Domain name=Rhodanese; Domain location=1-87; Score =23.3; E_value=0.00087; Accession=PF00581.10; Description=Rhodanese -like domain
  Pfam annotation: Domain name=Rhodanese; Domain location=135-252; Score=82.7; E_value=1.1e-21; Accession=PF00581.10; Description =Rhodanese-like domain
  Pfam module annotation: Pfam domain module=Rhodanese::Rhodanese; Domain location=1-87::135-252
MAHLFQWRIGHISGFSSFYRCRLPHMLPSEEAFAAAVSALGIENKDDLVVYDGKGLFSAARVWWMFRVFGHDRVWVLDGGLPRWRASGYDVESSASSDAILKASAASEAIEKVYKGQTVGPLTFQTKFQPHLVWNIDQVKKNIEDKTHQHIDARSKPRFDGAVQEPRKGIRSGHVPGSKCIPFAQLLDSSQTLLPADELKKRFEQEGISVESPAVTSCGTGVTACILALGLHRLGKSDVAVYDGSWTEWGAQSDTLVDTS

SEQ ID NO: 211883 - protein, 108 aa, Glycine max
  Coding DNA Sequence Number=SeqID_95105
MEHPFASTHASSRYRLDDSSNTALPLSDTCAFQGLSSKYAASENHEECEKMISVTQQKHERTSVFLRLPGASDAVVQPGHCMTELLEEASQWKKGKEKRHFQNGNITA

SEQ ID NO: 211884 - protein, 211 aa, Glycine max
  Coding DNA Sequence Number=SeqID_95106
  Homolog annotation: Hit_ID=Q9LW83; Match level="QueryCoverage=16%, HitCoverage=4%, E-value=5e-07, Identity=67%"; Hit description =Receptor kinase 1
MMFYEDDVKIAIVVILPWLCLQISTYALSSNSLLRQGETFDHSSTLFSPMHQFCLKFAPLQFDPTHTYLVIRNTRTPTGYADWIGNRNDYWQQFWGASDIEKFSGSMKHAMWQSFDHPSDVLLPGMKLGVNHKTNRSWSVASSFSTNNPSSGSFALEWEPRKGELLMYEYKIVSNKDEESFSYASHNDYSQLVLFSNGNLQDTQIGDIAQA

SEQ ID NO: 211885 - protein, 678 aa, Glycine max
  Coding DNA Sequence Number=SeqID_95107
  Gene Ontology: Mol. function=protein serine/threonine kinase activity; Cellular component=membrane; Biological process=protein amino acid phosphorylation
  Homolog annotation: Hit_ID=Q17U57; Match level="QueryCoverage=96%, HitCoverage=97%, E-value=1e-148, Identity=44%"; Hit description =Receptor protein kinase, putative
  Pfam annotation: Domain name=B_lectin; Domain location=43-157; Score =54.2; E_value=4.5e-13; Accession=PF01453.15; Description=D-mannose binding lectin
  Pfam annotation: Domain name=Pkinase; Domain location=360-631; Score =151.9; E_value=1.7e-42; Accession=PF00069.15; Description=Protein kinase domain
  Pfam annotation: Domain name=Pkinase_Tyr; Domain location=360-631; Score=133.1; E_value=7.6e-37; Accession=PF07714.7; Description =Protein tyrosine kinase
  Pfam annotation: Domain name=S_locus_glycop; Domain location=168-273; Score=-18.3; E_value=0.00082; Accession=PF00954.11; Description=S -locus glycoprotein family
  Pfam module annotation: Pfam domain module=B_lectin::Pkinase::Pkinase_ Tyr::S_locus_glycop; Domain location=43-157::360-631::360-631::168-273
MLNNSSILTSAQKKFSLKFATIEIPNTSLNTYLVIDRANTTGNVDWIGNRNDPLAYNSCALTLNHSGALIITRHNGDSIVLYSPAEATNRTIATLLDSGNFVLKEIDGNGSTKNVLWQSFDHPEFVLLPGMKLGVNKKSGMSWLVKASISRAKPASGSFTLEWEPREGQLVIKRQGQVYWASGLLRNKRFEHIPEEVQLMYEYNIVSNEEEESFSYTTPNGVSQWVLFHNGQLKDTTRGSEIARADTCYGYNTDGGCQRWEQPTCRKKSDQRDMKKSIRVHFAAAVASLVIVITSIGIFYIILRRRKSALKDNTTRTENKMLKLVALDRYAVSKHHCEVKKRSDSRVFSYASIIAMTNRFSVENKLGEGGFGLVYKGKLPTGEDVAIKRLSKGSRQGVIEFKNELNLISQLQHMNVIQILGCCIHGEERMLIYEYMANKSLDFFLFDRTRKMLLDWKRRFNIIEGIAQGLLYLHKYSRLKVVHRDLKASNILLDENMNPKISDFGTARIFSPQESEINTERIVGTYGYMSPEYVTRGIFSIKSDVYSFGVLILEIVSGGRTNSFYSGERQCNLIGHAWELWQQGKGLELVDPTIRDSCIEDQALRCIHVGLLCAEDNAVDRPTISDIINMLTSEYAPFPLPRRPAFYSRRMPNEECRCTKGSECYSVNGLSISNVVAR

SEQ ID NO: 211886 - protein, 261 aa, Glycine max
  Coding DNA Sequence Number=SeqID_95108
  Homolog annotation: Hit_ID=Q2L8W8; Match level="QueryCoverage=81%, HitCoverage=72%, E-value=1e-44, Identity=41%"; Hit description=MTERF- like protein
  Pfam annotation: Domain name=mTERF; Domain location=3-261; Score =112.8; E_value=1e-30; Accession=PF02536.5; Description=mTERF
MEKQILTCAVFSLGVCMVIKWRCPKQTIPPDDTGFQKKLLYLESIGIDSFSLIENHPTVITTSLADIKSTVEYITSLDFTAIEFRRMVGMCPDILTTQVSDLIPVFTFLHREVHVPGSHIKRVINRRPRLLVCSVSKRLRPTLYFLQSIGIEEVNKHTDLLSCSVEEKFMPRIDYFENIGFSRRDATSMFRRFPQLFCYSIKNNLEPKYSYFVVEMGRDLKELKEFPQYFSFSLENRIEPRHKQCVEMGPLGAFGLSLWKS

SEQ ID NO: 211887 - protein, 103 aa, Glycine max
  Coding DNA Sequence Number=SeqID_95109
MGSDRKSKRASPSQREDEKRSKRRRTVEDEERKQRKREKKEKRKDKKSHEHSKENSEKGLSMLGFQGRIREIKKDMIHAYLGAIVWIGQPSSTLVGLLVLNLE

SEQ ID NO: 211888 - protein, 307 aa, Glycine max
  Coding DNA Sequence Number=SeqID_95110
  Gene Ontology: Mol. function=threonine endopeptidase activity; Cellular component=proteasome core complex (sensu Eukaryota); Biological process=ubiquitin-dependent protein catabolic process
  Homolog annotation: Hit_ID=O23708; Match level="QueryCoverage=99%, HitCoverage=100%, E-value=1e-106, Identity=70%"; Hit description =Proteasome subunit alpha type 2-A
  Pfam annotation: Domain name=Proteasome; Domain location=56-285; Score=159.4; E_value=9e-45; Accession=PF00227.16; Description =Proteasome A-type and B-type
  Subcellular localization annotation: CTP_CleavageSite=66; ConfidenceScore=5.01e-01
MGDSQYSFSLTTFSPSGKLVQIEHALTAVGSGQTSLGIKVYSSVLGFPIKFSGIEVAEGAAANGVVIATEKKLPSILVDEASVQKIQLLTPNIGVVYSGMGPDFRVLVRKSRKQAEQYHRLYKEPIPVTQLVREVAAVMQEFTQSGGVRPFGVSLLVAGFDDNGPQLYQVDPSGSYFSWKASAMGKNVSNAKTFLEKRASLGAVVKLCLSDWLVMFLFRKQPLCIYKSKVVYNDPPPYRCIVRSLPALGYTDDMELDDAVHTAILTLKEGFEGQISGKNIEIGIIGADKKFRVLTPAEIDDYLAEVE

SEQ ID NO: 211889 - protein, 96 aa, Glycine max
  Coding DNA Sequence Number=SeqID_95111
  Gene Ontology: Mol. function=protein serine/threonine kinase activity; Cellular component=mitochondrion; Biological process =protein amino acid phosphorylation
  Homolog annotation: Hit_ID=Q5NJB1; Match level="QueryCoverage=93%, HitCoverage=14%, E-value=3e-19, Identity=54%"; Hit description=S -receptor kinase-like protein 1
MGNDTLNLVVSDTFNNLVELQNEVNNGNALRIFSYASIIAATNKFSIDNKLGEGGFGPVYKGLLPQGEEIAIKRLSEGSEQGDIEFKNELTLISEL

SEQ ID NO: 211890 - protein, 408 aa, Glycine max
  Coding DNA Sequence Number=SeqID_95112
  Gene Ontology: Mol. function=carboxylic ester hydrolase activity; Cellular component=mitochondrion; Biological process=lipid metabolic process
  Homolog annotation: Hit_ID=Q1XBG1; Match level="QueryCoverage=88%, HitCoverage=87%, E-value=1e-116, Identity=53%"; Hit description =Lipase
  Pfam annotation: Domain name=Abhydro_lipase; Domain location=40-107; Score=84.7; E_value=2.8e-22; Accession=PF04083.6; Description=ab -hydrolase associated lipase region
  Pfam annotation: Domain name=Abhydrolase_1; Domain location=121-399; Score=2.6; E_value=0.005; Accession=PF00561.10; Description =alphabeta hydrolase fold
  Pfam module annotation: Pfam domain module=Abhydro_lipase::Abhydrolase _1; Domain location=40-107::121-399
MASTVVSLSSIVLLCTITAVQGRKTLHHLNNEWLTSYSVINDIDGICKTMVETQGYTCEEHQVTTEDGYILSLQRIPVGRSSNNTDKPPVLLQHGIFCDALTWLVNSPDESLGFILADNGYDVWLANTRGTKYSNRHISLDPDDMAYWDWSWDELASYDLPAFVQYVYNHTGQRIHYAGHSLGTLMALASFCQGQVVNMLRSAALLSPIAHMNQITSLLTKIAADAFLANDIYWLGLREFVPNGDVAAKFAKDLCHILNFDCSNLMSLFAGPNCCINSSTIDVFLDHEPPPTATKNLVHLSQMIRTGTIAQYDYGNQEQNMQHYGQPLPPLYDMTGILNEFPLFISYGGQDTLSDVKDVQVLLNDLKDHDWNKLVVLLNEDYAHVDFVMGVNANQMIYDPMMDFFKVN

SEQ ID NO: 211891 - protein, 113 aa, Glycine max
  Coding DNA Sequence Number=SeqID_95113
  Gene Ontology: Mol. function=transition metal ion binding; Biological process=aromatic compound metabolic process
MLFCTINEFPAYGNLSGYNVKGHRACLICEEHISYIQLKHKKNVCDSVIGMLLNIQGKMKDGLNTRQDLAEMACHTLSGKEKMSFCQCLRRVKVPQGYSSNIKSLVQLKDLNL

SEQ ID NO: 211892 - protein, 383 aa, Glycine max
  Coding DNA Sequence Number=SeqID_95114
  Gene Ontology: Mol. function=RNA-directed DNA polymerase activity; Biological process=RNA-dependent DNA replication
  Homolog annotation: Hit_ID=Q8H6Q8; Match level="QueryCoverage=96%, HitCoverage=10%, E-value=2e-32, Identity=28%"; Hit description=CTV.20
MLSDNFSIDKETLRKNFYSPENEPQRRWFFQHYKGTNRKQIQDKFYEFVERVKINVLFFDWFHAYAIRKDIDYPWKQDIIGNPTTNVITNWQVKDGELIQSELPPTTQYQLPNIKDSNNKPVMAIPFKTKDVNEEVTSRDIKSLMEQANYTNKYLQALGETIKTKVVPKQKSIEEASPSVPIEKPLFKPFKVSDKAKRKIRELRKTKSLIEGVGDNHSELLNKISSLLKVIPDTPQASENTSKMVTRSTSKLINVINEDSDQNLDNTTEIGSVSEKNINPLNSKHWKTPSKLYYQRPTAPDLLLEERGENNFKSFSANNIYEWNIDAQTEYNIMNTLQHMTMVATAYQTSHECSEETIIDILVAGFSGQLKGWWDNYLTNEEK

SEQ ID NO: 211893 - protein, 67 aa, Glycine max
  Coding DNA Sequence Number=SeqID_95115
MVIGSRTQGAPAFSGRYSAEVIHAILPGKARTTFNKWVPVPETDTGLRKVVRPCMGADACPVPEGQG

SEQ ID NO: 211894 - protein, 118 aa, Glycine max
  Coding DNA Sequence Number=SeqID_95116
MRIKRSFKVVMGPRTRYGEIWNKWLNPKGIEEQWGISFGGGRFHSACPTFNQYTMYIKYGPKYIMKHSQQNKLSNETKTPHTYSQNNSKAPKFLKDMWGFKTRKGKQGSKGLSKELIQ

SEQ ID NO: 211895 - protein, 206 aa, Glycine max
  Coding DNA Sequence Number=SeqID_95117
  Gene Ontology: Mol. function=hydrolase activity; Biological process =peptidoglycan biosynthetic process
  Homolog annotation: Hit_ID=Q1GXA5; Match level="QueryCoverage=98%, HitCoverage=98%, E-value=1e-66, Identity=64%"; Hit description=Ham1 -like protein
  Pfam annotation: Domain name=Ham1p_like; Domain location=8-202; Score= 225.9; E_value=8.6e-65; Accession=PF01725.7; Description=Ham1 family
MALPFDNLVIASGNKGKIREIAHVLAPLNIQIVSQSEFNVPECPEPYGTFIENALAKARHASEHTGLPALADDSGLCVNALHGAPGVISARYAGPQPASSLLTQDERNNDKLLTVMSRESDRRAYFYSVLVLVRSPQDPQPIIADGMWRGEILREFRGSEGFGYDPLFMDLATRKTVAELPLEIKSQMSHRGQALVKLLQALEQNQ

SEQ ID NO: 211896 - protein, 399 aa, Glycine max
  Coding DNA Sequence Number=SeqID_95118
  Gene Ontology: Mol. function=oxidoreductase activity; Cellular component=vacuole; Biological process=response to oxidative stress
  Homolog annotation: Hit_ID=Q5U1S5; Match level="QueryCoverage=87%, HitCoverage=87%, E-value=6e-77, Identity=46%"; Hit description=Class III peroxidase 18 precursor
  Pfam annotation: Domain name=peroxidase; Domain location=86-360; Score=335.1; E_value=1.2e-97; Accession=PF00141.13; Description =Peroxidase
  Subcellular localization annotation: CTP_CleavageSite=81; ConfidenceScore=5.43e-01
MRSCIINLWIVAALVVPVLLSLRSPRGETQTQTTSSFSDSSTFSLKLANGFGFYAVSFPFNQRIRDGSNLEYDFYRDTCPQAEGVVRSALTRIYFDHRDVAPALLRLFFHDCFIEGCDASLLLDENNGDRNRSVEKQAVPNQTLRGFDKIELIKEEVEQACPGIVSCADILALAARDSILLAGGPFYPVLTGRRDSHQSFFEEATDQIPRPDDNVTRTLNLFNLRGFNARETVSLLGGHNIGKIGCDFIQQRLYNFQGTGQPDPSIPLDFLRQMRLNCPDSKNSSTSIDEFTISKPVSSDFHSKMGMSYMQALSSSVSSGASFDTHYYQSLLRGRGLLFADQQLMAEQKTARLVSAYASDDGSTFRMDFARVMLKMSNLDVLTGLQGQVRVNCSLPVSS

SEQ ID NO: 211897 - protein, 88 aa, Glycine max
  Coding DNA Sequence Number=SeqID_95119
MVYLRHKIIDYNLSAVVTDACRLEESGKLSLGSDKLPSKTVNHPGPFGPSRRFLQKAVASGGSNPARLGELSSPGRAGRQPPPLFCYK

SEQ ID NO: 211898 - protein, 127 aa, Glycine max
  Coding DNA Sequence Number=SeqID_95120
  Gene Ontology: Mol. function=nucleotide binding; Cellular component =cytoplasm; Biological process=small GTPase mediated signal transduction
  Homolog annotation: Hit_ID=Q8VY57; Match level="QueryCoverage=96%, HitCoverage=96%, E-value=6e-38, Identity=52%"; Hit description=ADP -ribosylation factor-like protein
  Pfam annotation: Domain name=Arf; Domain location=6-126; Score=-30.8; E_value=2.1e-07; Accession=PF00025.11; Description=ADP-ribosylation factor family
MGLWEAFGNWLRSLFFKQEMELSLVGLQDAGKTSLINVGFIMKKLIMTIYLSLNELHDLLSKPSLSGIPMLILGNKIDKPGALSKQDLTEQMGLKCINGRDVCCFMISCKNSINIDTVIDWLMNLAD

SEQ ID NO: 211899 - protein, 52 aa, Glycine max
  Coding DNA Sequence Number=SeqID_95121
MGGVWLFEATLLSWVMENSSLTVNHLIQPYFNLLSENQLRVFNTCLGTTYTS

SEQ ID NO: 211900 - protein, 84 aa, Glycine max
  Coding DNA Sequence Number=SeqID_95122
  Homolog annotation: Hit_ID=UPI0000162B84; Match level="QueryCoverage =99%, HitCoverage=29%, E-value=1e-07, Identity=34%"; Hit description =hydrolase, hydrolyzing O-glycosyl compounds
DNPKQQPEWVKTLSSEKSGEAAAESMKSVVSRYKGELIAWDASCPAKYIKILKEILSFPGVSGMSAAIGLQGHFASGQPNLAYM

SEQ ID NO: 211901 - protein, 896 aa, Glycine max
  Coding DNA Sequence Number=SeqID_95123
  Homolog annotation: Hit_ID=Q6K2T0; Match level="QueryCoverage=99%, HitCoverage=95%, E-value=1e-101, Identity=31%"; Hit description =Extra-large G-protein-like
MSDSANKLRLVRCPKCQNLLPELADYSVYQCGGCGAVLRAKHKGYVSGSLSDEGKVGLGGDSGKSESSLEKGLVDRSDASDVDAKSSSVPSRDDNQRAVDKVDNIDEGFQNQPEDAGEKGVIDDDVDVGRNKDELGKTIGREQEEPPKSQIGRENGSKFSNWPNGERNEMEGFWRKPRADMENVRFSTSKYPDEGPSNGFSSNYMESWRSRKESDGPNMVQHLEQDRAELLRKLDELKVHISKSSEMVHNPKGKILPEERMIPPDPHPYGGGSDPWFSDGSSGLNRTSRQFFGTDKHVAGSNHFNYHHDPYSYASGHDMAMPNFPLSMHNPNRYGDPLASQMPRRGPHQFPQQPLHPYYPGRYVDTNPDSYELYSHNAMLHPPTCSCFHCYDSKQRGSVPALPASFINSRFPDTPNDPMLYHHEIPGAFGPHVHNSRTTIPPVTYRQKQLHARWASDFNSEMSGFVRSRPRKVMLASSSQRCYPAAGGSPFISCHNCFELLLLPKKALVLVKNHQQKVQCGACSSEISFAVINKKLVISPNLETKGVPSRGDNSSNEVVSSRMSHSRGHVSRTGANFSSDDYSGYDFHSVDREPISLVALNSNKSREMPSFHSSSLSTSEDENSPEAMIAPREATKSIQRPTTDSLSPPAGSPLQEYFDYSSNNHAVNRFGKGNQSSRSEQEKTKVDKMSARQNSLKETALATEMDVHDYSNTGVSQDSGDASREHDHPRSNRGGESFFANIIKKSFRDFSRSNHTDERSKISVTVNGQPLSDRVVKKAEKLAGTIQPGNYCELTDFPPYRYDFRAGFWGVMGGPCLGIIPPFIEEFNHPLPDKCSGGSTGVLVNGRELHQKDLDLLSGRGLPTDIDRSYIIEISGRVLDEDTGEELDSLGKLAPT

SEQ ID NO: 211902 - protein, 581 aa, Glycine max
  Coding DNA Sequence Number=SeqID_95124
  Gene Ontology: Mol. function=hydrolase activity, hydrolyzing O -glycosyl compounds; Biological process=carbohydrate metabolic process
  Homolog annotation: Hit_ID=Q8GTJ2; Match level="QueryCoverage=88%, HitCoverage=88%, E-value=1e-156, Identity=51%"; Hit description =Endoxylanase precursor
  Pfam annotation: Domain name=CBM_4_9; Domain location=51-187; Score =35.5; E_value=1.8e-07; Accession=PF02018.8; Description=Carbohydrate binding domain
  Pfam annotation: Domain name=Glyco_hydro_10; Domain location=225-520; Score=88.9; E_value=1.5e-23; Accession=PF00331.11; Description =Glycosyl hydrolase family 10
  Pfam module annotation: Pfam domain module=CBM_4_9::Glyco_hydro_10; Domain location=51-187::225-520
MKVAAEGCNLLLFITSYLLLISAVNTQTYLCCHCFENKQCLAEPRRAQYGGGIIVNPGFDHNIEGWTAFGNGAIKEVMSNGGNRFIVAHNRTQPLDSFSQKVQLKKGMLYTFSAWLQVSEGSDTVSVMFKTKRNEMVRGGQVIAKHGCWTLLKGGIAANFSSPVEILFESKNSAEEIWADNISLQPFTKKQWRSLQDASIERVRKRRVRFQITHVNETALKGAKVITRPIKLNFPFGCGMNHYILTNEDYQSWFVSRFKFTTFTNEMKWYSTEKKQGEENYTIADAMLKFTQENGISVRGHNIFWDDPKYQPDWVRTLSPADLTKAAAKRMKSVLSRYKGELIAWDVMNENLHFHFYEDKFGENASAVAYATAYELDPEPKLFLNEFNTIEYSGDEASNPAKYIKKLKEILSFPGVSGMSAAIGLQGHFASGQPNLAYMRSGLDLLATTGLPIWLTEASVDPQPSQAEYLEEVLREAYSHPAVEGIIMFSGPAQAGFNATTLADETFKNTAAGDVVDKLIQEWGTGPNIATADSRGIVDISLHHGDYDVTVTHPLIHSPITLNLSVKKDFSLETIHVKMHA

SEQ ID NO: 211903 - protein, 259 aa, Glycine max
  Coding DNA Sequence Number=SeqID_95125
  Homolog annotation: Hit_ID=Q10QA8; Match level="QueryCoverage=80%, HitCoverage=61%, E-value=8e-15, Identity=27%"; Hit description =Somatic embryogenesis related protein, putative, expressed
MVYVVFGREGGLGEKHDKPIFSLCFVPLAVSICKLFFWADVADSCSIPCLEHDERGSTGQVGRSNGQREAGGKVFTQSKENNESQSREQRDEKSPVKLDDSLQKRDGFTARKDDPPTMRKRRAFREKKIPADSADANPASIVEVKPSHTDHPPERNERKDERSSNPHHLDRPEKQNAEGRAPNKIEARRDGFSSRARYGGSGGNNNYRGRDKFNGKQGYRPIKTRMEKWKHDLYQEVNKDPIPKNEDDQIAKLEALLAS

SEQ ID NO: 211904 - protein, 116 aa, Glycine max
  Coding DNA Sequence Number=SeqID_95126
MKADMLALKDQMASMTEAMLSIVATCPFAGERGEAHGCTFQRRKDARSRHQRLFVENVGKTKGNRSTNAGLLLLRTLHQRGNQTYVVLFKGESSDSFYLEGDHFKALDLKNDPFTW

SEQ ID NO: 211905 - protein, 118 aa, Glycine max
  Coding DNA Sequence Number=SeqID_95127
  Pfam annotation: Domain name=efhand; Domain location=5-33; Score =34.3; E_value=4.2e-07; Accession=PF00036.22; Description=EF hand
MAKWSLTEMIKEADTDGDGVISFTEFATIMACSDFDFLGLSSPRKNTFFRYTTQRPVLHARKKNTNLDGGRNAHRKPMAKTGTKMETESRREQRPVEENKGTKMEKQSLHGGRTEEDQ

SEQ ID NO: 211906 - protein, 226 aa, Glycine max
  Coding DNA Sequence Number=SeqID_95128
  Homolog annotation: Hit_ID=Q1STP5; Match level="QueryCoverage=60%, HitCoverage=24%, E-value=2e-12, Identity=31%"; Hit description=IMP dehydrogenase/GMP reductase
  Subcellular localization annotation: CTP_CleavageSite=73; ConfidenceScore=5.28e-01
MLYGKHNERPKKSKSEQAMIVANSVKLITPSPSVSASLIISNTRSTSCVRQGRGRDISQDVPEADVPRRRRPTASARRQRVTQRVEDVPQLPEDVPHVSNGSPEMTGAADGVETDRVASDGSLGALADDEGFPGGPRDPSVLIEFVDHVAHNIWSGQERPDLKLVSHGRKVDKFGRPDAEIEGVIVATGLDPLIRCSVITIDPGLIFAFVERWHRETSSFHLPVEE

SEQ ID NO: 211907 - protein, 91 aa, Glycine max
  Coding DNA Sequence Number=SeqID_95129
  Gene Ontology: Mol. function=chitinase activity; Cellular component =lysosome; Biological process=carbohydrate metabolic process
  Homolog annotation: Hit_ID=Q8NBM9; Match level="QueryCoverage=78%, HitCoverage=17%, E-value=2e-19, Identity=57%"; Hit description=CDNA PSEC0104 fis, clone NT2RP2004795
KVKNADADAGGGAIIGRDYLALLEKHWPELQWDKNSGEHFFFYTDDKDIRHVVFYPSLKSISLRLEEARSWGCGISIWEIGQGLDYFFDLL

SEQ ID NO: 211908 - protein, 362 aa, Glycine max
  Coding DNA Sequence Number=SeqID_95130
  Gene Ontology: Mol. function=sequence-specific DNA binding; Cellular component=nucleus; Biological process=regulation of transcription
  Homolog annotation: Hit_ID=Q6R7N3; Match level="QueryCoverage=99%, HitCoverage=99%, E-value=2e-76, Identity=47%"; Hit description =Putative WRKY transcription factor 30
  Pfam annotation: Domain name=WRKY; Domain location=128-190; Score =130.5; E_value=4.7e-36; Accession=PF03106.6; Description=WRKY DNA -binding domain
MEESTKRKYTNLIHELIQGKELTKQLSDHLVSSSPSSHETNELLVEKILLSYEKALTMLNWGSIVGEAKTTSLNIMDSRCSFTNSESPRSEVVDREFEHKAVFKKRKTMPRWTEQVKICSRTGLEGSLDDGYSWRKYGQKDILGAKFPRGYYRCTQRNVQGCLATKQVQRSDEDPTTIEVTYRGRHTCTQAKHLNKAFSSNIKIGLGENQFQKNQPLLEKTQQQNPEGIFTFETELKVKTEELETKEDIFPWFSFSSSSIGSENEDNMLPDTMIENHFMESFSPVFISPATSESNPFCLSAYDLDSTGLLCRNIQTSESDITEIVSALTSVTNSPILDLDILLDKGDFDTDFPFNIPEFFSS

SEQ ID NO: 211909 - protein, 343 aa, Glycine max
  Coding DNA Sequence Number=SeqID_95131
  Gene Ontology: Mol. function=transcription regulator activity; Cellular component=nucleus; Biological process=regulation of transcription
  Homolog annotation: Hit_ID=Q7XHI9; Match level="QueryCoverage=95%, HitCoverage=96%, E-value=4e-32, Identity=33%"; Hit description =Putative bHLH084 transcription factor
  Pfam annotation: Domain name=HLH; Domain location=260-307; Score =32.7; E_value=1.3e-06; Accession=PF00010.16; Description=Helix-loop -helix DNA-binding domain
MDPVEQISEEWSSLSGFYTAEEADFMSQLLGNCSLPENLCGNFNLGIPSAIWPGHESTIVSVTGINESPYFHANADNRSSFTADSSNIFPTTSGNKCDPVANIGYMSVGFPLGDAKFSPYNVQGSDSQQINENTDEELGLEVIADKKLQDHQECEVLVSEAAQEDINTNLEKSGKRSRGSMQVRKSKKNVKSMKKPKSDSISNSEEGRSPDLQGFCSEDDDSNASQELNGGGSSSLSLEDSTSLKLKGKKSTANRGSATDPQSVYARRRRERINERLRILQHLVPNGTKVDISTMLEEAVKYVKFLQLQIKLLSSDDLWMYAPIAYNGMNIGLDLNITPTKQP

SEQ ID NO: 211910 - protein, 249 aa, Glycine max
  Coding DNA Sequence Number=SeqID_95132
  Gene Ontology: Mol. function=chitinase activity; Cellular component =lysosome; Biological process=carbohydrate metabolic process
  Homolog annotation: Hit_ID=Q7TP14; Match level="QueryCoverage=73%, HitCoverage=36%, E-value=1e-14, Identity=31%"; Hit description=Cc1-9
MYKKLDGSFNVKLSYRLILPRVVLEASPAVLLGKEKQRNKAINLIVTECKEMGYDGIVLESWSRWAAYGILHDPSMRNLVTVKTMNSISENSTNLSQALQFVKQLGDALHSISSEKISGQQLQLVYVIGSPSEKLQEHDFGPKDLETLSEAVDGFSLMTYDFSNPHNPGPNAPLKWIQIVLQLLLGTSGNRAQSLAPKILLGINFYGNDFSLSRGNSFVSCLRNPLHVWLEGNEGGWVPGQSLLLHPLN

SEQ ID NO: 211911 - protein, 246 aa, Glycine max
  Coding DNA Sequence Number=SeqID_95133
MEPVQLVSEEWGSLCGFHTTEEADFMVQLFGGNTSVTEKHSGNTTFGFWPGHESTIVAITDTNSNSYLPPNFTDTNFLCFSQGSSSSTDNSGNNIFSTTSSGTYSCDPETNFDSVPMVLCLGDAKFSPHSFQCDDYLSQQINENTDEESSLDPWKLAIADNNLQAKREYEMMVSEPVEEDRSRNLENLPKRLKSSIEGKTLLVEGICNPCLACETIQAMTEFKFGGVLSDIWENEKQHLLDQDTAY

SEQ ID NO: 211912 - protein, 135 aa, Glycine max
  Coding DNA Sequence Number=SeqID_95134
  Gene Ontology: Mol. function=transition metal ion binding; Biological process=cytoskeleton organization and biogenesis
  Pfam annotation: Domain name=Transposase_21; Domain location=2-135; Score=26.0; E_value=8e-17; Accession=PF02992.5; Description =Transposase family tnp2
GGLLRHPANSPQWKTIDHLYPNFVDEPRNLRLGLASDRMNHFGNLSTNHISWPILLMIYNLSHWLCIKQKYTKLCMMITGPRQLRNDIDVYLSLLIEDFRKLWEDGVDRLKKAFNGSQENESASKPLARKEVYDQ

SEQ ID NO: 211913 - protein, 289 aa, Glycine max
  Coding DNA Sequence Number=SeqID_95135
  Homolog annotation: Hit_ID=Q7PC91; Match level="QueryCoverage=33%, HitCoverage=20%, E-value=8e-27, Identity=60%"; Hit description =Putative transposase
MDPNIDLDEVLDQMIDEELEDNTNEEIIRLILESQQQLHGNTTGCSQRRIVVHHNHEEDALNNHDEYFQMRVDALRQKGLSPLQKCTTAIHILAYGSPADNVDEYVRIGETIAVECLERFVSGIYTIFGNEYLRRPNNEDTERLLQMGAARGFPGGRNLRPRTAGPERTNSHEHQNRGDNLLDLNSNLLQLQLRLLWLNKTDGLDHLVFALQTKKLVSVSAAEGEGGVSYKRAHGCKKWRFTHTDTKLNSNTGKFIIIHAYPSINQQTPWNTVICKVKTNANTDTAFDL

SEQ ID NO: 211914 - protein, 153 aa, Glycine max
  Coding DNA Sequence Number=SeqID_95136
  Homolog annotation: Hit_ID=Q2HUH8; Match level="QueryCoverage=35%, HitCoverage=14%, E-value=3e-07, Identity=43%"; Hit description =Histidine triad (HIT) protein; Homeodomain-like
MMMRQSGQFCERSWTQLKSQWNKIHHLVQKFNGCYKQVDKYKRSGISEKDVLTDAHMIYSQKRTKVSTSGNYSSSSNPETPVEVEKYVMPSPMSRPIGQIGAKRKSKGKECSNPLDLSSIESVMKDKNMNTSKLIQLKEAQERRMQEQEWCLE

SEQ ID NO: 211915 - protein, 293 aa, Glycine max
  Coding DNA Sequence Number=SeqID_95137
MCAFRVLCDEFFIIPITSKFLHHYNVKQNRKGGWVSLIGILNKAVIGPSTSSYKDFKGYFFRVHPGIESKFLRGLYCSRLKGLWLPRHKLRRPRAKKYDHFKDNWVLPPPSIIMGVAKRVNSSQDEGSSKRQKVELVLIATLFVVESHLIFLSMKEAVSSLWDKDFNPCALIVRLEYAMEASLLALMDCILTTTKDLAKALQDEIECLNKEFALFKVNAKETEVKLNSDLNKAEAEILKTHEVSFFKATNQAKYLFKEADLYLSNSDKEMNHQGELVLEAEALAKGAIEEPIT

SEQ ID NO: 211916 - protein, 547 aa, Glycine max
  Coding DNA Sequence Number=SeqID_95138
  Gene Ontology: Mol. function=RNA-directed DNA polymerase activity; Biological process=RNA-dependent DNA replication
MVENDNNTNIVKGIPIVGASGKRNPTNVVSPLRQELDGTREEGIQENQNANSVVIAKTHQTYLAKIDTTDTMWREGTHSVTKPVHKATSTNTRLHPFIDRIMEAQLPPGWKLLSISCYDRLSDSNEHGVTLYFYTQLLKNSIDSFATLIVCFRAEYAMSIPHHLTVVALASFKQEQDESLHKFILCKKPPTTLGKLRARVVEFIQMEEITRFKEKMCEETSRKLVDPEEACNTRLIQSLAKNRLPPIVEKSKYYQYHQVTNHNIEDCTILKDKRDRSQERSSTCKAKETHHQGENPLPETQLRGVINIIAGRFVRRGSSNLARKHYVCSLESLNSVAVEKKPTRSLPLITFIDEDFEGIDRCHNDPMVVKIQTMSTIGYVHLLTTFKDEKGSKSIMIKYFLVDTLTFYNILIRCPSHNELGAIISTPHLAMKFPSEDGKIITIRVDQMSGMECYIVSLKIAKGKRVAKPKVQSVACTSLNSNLGETELDLRKAKSRVKPTKEVKSFQLDKDPSQCTKLICQMSKEMEESITQARLVTQSKRKLDPKR

SEQ ID NO: 211917 - protein, 105 aa, Glycine max
  Coding DNA Sequence Number=SeqID_95139
MAHKRNATFNGSLGVCVNHLDIFKLSQVTFPVLASPGFLDLEDCREGAKGDQEVLEQKSLREVKGDLMICGSGGIFSSSTTKVKLLKIAEVTAIVVTIPYTVVSL

SEQ ID NO: 211918 - protein, 103 aa, Glycine max
  Coding DNA Sequence Number=SeqID_95140
MWSREHLAEKELKRRGATLREKGKSFVPWRKEESWMEGAESDKEREEDMGARNWKQRYDTRNVVLVPTARKIGVQEATIQFLVVSGFGYGMVLELIEFICTTN

SEQ ID NO: 211919 - protein, 210 aa, Glycine max
  Coding DNA Sequence Number=SeqID_95141
  Gene Ontology: Mol. function=metal ion binding; Cellular component =integral to membrane; Biological process=regulation of transcription
  Homolog annotation: Hit_ID=Q339K7; Match level="QueryCoverage=58%, HitCoverage=33%, E-value=4e-53, Identity=72%"; Hit description=Zinc finger, C3HC4 type family protein, expressed
  Pfam annotation: Domain name=zf-C3HC4; Domain location=98-148; Score =19.9; E_value=0.0014; Accession=PF00097.15; Description=Zinc finger, C3HC4 type (RING finger)
MSQGSALFSFLSYSSRLFLFLSKTLIFVCPITLDLLTGYVDRIGFVYSDQPWATKLYCFVHKVPVCGECICFPEHQICVVRTYSEWVIDGEYDWPPKCCQCQSVLEEGDGSQTTRLGCLHVIHTNCLVSHIKSFPPHTAPAGYVCPSCSTTIWPPKSVKDSGSRLHSKLKEAIMQRLHGHCGRDDAKGYELPSGKLIQDIMSDSLLNGQY

SEQ ID NO: 211920 - protein, 34 aa, Glycine max
  Coding DNA Sequence Number=SeqID_95142
MLVVENLLMNEVELSAVGSERFGYTWQVMCLELT

SEQ ID NO: 211921 - protein, 115 aa, Glycine max
  Coding DNA Sequence Number=SeqID_95143
  Gene Ontology: Mol. function=oxidoreductase activity, acting on NADH or NADPH, quinone or similar compound as acceptor; Cellular component=integral to membrane; Biological process=ATP synthesis coupled electron transport
  Homolog annotation: Hit_ID=A0A380; Match level="QueryCoverage=99%, HitCoverage=24%, E-value=2e-52, Identity=96%"; Hit description=NADH -plastoquinone oxidoreductase subunit 2
MAITEFLLFILTATLGGMFLCGANDLITIFVALECFSLCSYLLSGYTKKDVRSNEATTKYLLMGGASSSILVHGFSWLYGSSGGEIELQEIVNGLINTQMNWVQAFPSPFSSMDS

SEQ ID NO: 211922 - protein, 148 aa, Glycine max
  Coding DNA Sequence Number=SeqID_95144
MGYIQTVPPPPFRDSLTDHVVPTGELCVVLGQVAPDYMEWFFQILHPFVTLTEDTAEPRPAPPPPPTHDDEFVEPPVPEVPVASDLPTHFVVDCTGCVRIAEHLERAINLRMVTKGTDLYDIMDICQRIARGNDPDDSLMPRQRHRIY

SEQ ID NO: 211923 - protein, 76 aa, Glycine max
  Coding DNA Sequence Number=SeqID_95145
MANKAKGKGKEVAGKGSAGKRKGAFDNDKTDGGCKRNKPCSNEPVSHVIFLDSLTCRHEAGHLWRATFRESQAIPR

SEQ ID NO: 211924 - protein, 175 aa, Glycine max
  Coding DNA Sequence Number=SeqID_95146
  Subcellular localization annotation: CTP_CleavageSite=72; ConfidenceScore=5.75e-01
MTFHLPFFFPFFLPCHSTFFFLLLPPSPFAPLHALSSSPSPQHSRSPSPLPSAASRLPPPLPLPLRGLKAPSSFHLRDPPPRSPPTNSNISKIFRVLIEEPIIHPGDLWCSFFGRSTQGQILSSRSGAKVALKHRAHVVHFSKPSPHTNISDDEDMEEFLCRKHLVKGEGRGKRK

SEQ ID NO: 211925 - protein, 65 aa, Glycine max
  Coding DNA Sequence Number=SeqID_95147
MGFIHSQGWIFVDSGNEMEHETFLATWLAEIDFSPNGLRFSNLQPHPRLINHEKPMLCRWHRLNP

SEQ ID NO: 211926 - protein, 47 aa, Glycine max
  Coding DNA Sequence Number=SeqID_95148
MNEEHRMKNDVEIDYGHNSEMRGFYGLAAHPGELMLHSEVTLLTQTS

SEQ ID NO: 211927 - protein, 116 aa, Glycine max
  Coding DNA Sequence Number=SeqID_95149
  Subcellular localization annotation: CTP_CleavageSite=84; ConfidenceScore=5.82e-01
PGQAARSPQRKKSITSAISPFSLASSSSPGASDRGPSAVGAGYTGRSSRSNAPGPYGWPPAGQPNATCRVPPSACEVRWTPEMVAAVEVAVVRLQRAATAGPTPAAMPTLACSTSQ

SEQ ID NO: 211928 - protein, 56 aa, Glycine max
  Coding DNA Sequence Number=SeqID_95150
MEDVVPMNEVKDCDVLEEVLKESLTIKKTTILHFLKILGWWRTITSLSRDGGRSFL

SEQ ID NO: 211929 - protein, 181 aa, Glycine max
  Coding DNA Sequence Number=SeqID_95151
  Gene Ontology: Mol. function=RNA-directed DNA polymerase activity; Cellular component=extracellular region; Biological process=RNA -dependent DNA replication
MASGLKVNLQKSRFLASRNVARTKVDKFSSICGFHSTMKLDRYLGFPLLSGRVKKCDFDFILDHIQGRLAGWKMNMLSCAGRTTLAKSVLNSIPIYHMQNLWLPTGVCDEIDRVTHTFIWGYTKNHWVKWDVIIRPRNRGGLSIRTTREVNVALLGKYMWDLLHEPNKLRVSLFSTRKATG

SEQ ID NO: 211930 - protein, 57 aa, Glycine max
  Coding DNA Sequence Number=SeqID_95152
  Subcellular localization annotation: CTP_CleavageSite=29; ConfidenceScore=5.46e-01
MAVPLFSKKIVKSVSRRLSAPKVIGRSPSRDRGSNMKTKSWSLKKLEKVLSFTFQLS

SEQ ID NO: 211931 - protein, 162 aa, Glycine max
  Coding DNA Sequence Number=SeqID_95153
MQANRLTHAYLIHNPSLNNNACSLENQKFQNITRQYTLYLIHAIDSAKHASKKCQFNQTQNISLIVVHNAEKATVSLSRDRVLSEYHLLSEAAARLTSKKNLEGNLSCKHALSASSTRPTSHLSLLALSAPGSLSQISLTRAKCENGAKHAFEVKKPFLSLK

SEQ ID NO: 211932 - protein, 79 aa, Glycine max
  Coding DNA Sequence Number=SeqID_95154
MKLKVTEIKVKQDDGKAGSYTSEESHTQWEFNRRWTRQMVQCNRSQEHQTEFQVSTFNRGSQPRKPEKQLKEKNKKRKK

SEQ ID NO: 211933 - protein, 151 aa, Glycine max
  Coding DNA Sequence Number=SeqID_95155
MGYHSPLKDYRCLQKGVQHLSVEPDELPLHFALLGRAVFWCLLQKLVILCVSQLHVPLHKNVSKMNVILISMPSHLQCESGGVPYGFHPLRSTGGSSTFLRGHLQKERQQELVLSTTLAKARRGLARGYALSPNIANKRTKRVLGLARLAC

SEQ ID NO: 211934 - protein, 162 aa, Glycine max
  Coding DNA Sequence Number=SeqID_95156
MEKQVRKIRSDQRLLFSNIDQLQRIMNEFFARFLRLEEWIPNKERPILIPKVALMQYEPPPPPRATTPPSSSSSSKNSSPNMHDWFTPFVPPFYFLLDDKEGEVYERLTRHNDHVGVRELAEAPREKAEEFENLDRGGAKACDDNIPWLNMGKVAKVEDESL

SEQ ID NO: 211935 - protein, 177 aa, Glycine max
  Coding DNA Sequence Number=SeqID_95157
MNFSLVFIKCGKRLKEEEKDVSSLVIDASISEKEISDKIVEPTAERKVVSLLKMKKLKTRMQKLREMKLTMKTSTILRVWSAIPQTNHTQMREMQGCVDYHFKTPQLSVFGLEWLWDGSQKGYLWRFLTGGVIKTSIIWGITNGIKVNLSPNTVLFEDVEVGGNVIHRASRTGFRGI

SEQ ID NO: 211936 - protein, 357 aa, Glycine max
  Coding DNA Sequence Number=SeqID_95158
  Gene Ontology: Mol. function=diacylglycerol kinase activity; Cellular component=intracellular; Biological process=protein kinase C activation
  Homolog annotation: Hit_ID=Q1RTM0; Match level="QueryCoverage=97%, HitCoverage=93%, E-value=1e-150, Identity=73%"; Hit description =Tetratricopeptide-like helical
  Pfam annotation: Domain name=PPR; Domain location=161-195; Score=7.9; E_value=0.87; Accession=PF01535.11; Description=PPR repeat
  Pfam annotation: Domain name=PPR; Domain location=90-124; Score=41.2; E_value=3.6e-09; Accession=PF01535.11; Description=PPR repeat
  Pfam module annotation: Pfam domain module=PPR::PPR; Domain location =161-195::90-124
MEYHVGCLAQSASHVRCSTSFEDADMSLEALHLFCDVQLSQIKPNEVTPVALISACSNLGALSQGDMYSKCGYLNLACQLFDVLSDRDTFCYNAMIGGFAVHGHGNQALEMYRKMKLEGLVPDGATIVVTMFACSHGGLVEEGLEIFESMKGIHGMEPKLEHYRCLIDLLGRAGRLKDAEERLHDMPMKPNAILWRSLLGAAKLHGNLEMGEAALKHLIELEPETRGNYVLLSNMYASIARWNDVKRVRMLMKDRGVDKLPGFSLVEINGAMHEFLTGDKAHPFSKEIHLKIGEINRRLQEYGHKPRTSEVLFDVEEDKEDFLSYHSERLAIAFALIASPSKIEIGFTILRMGVVLV

SEQ ID NO: 211937 - protein, 154 aa, Glycine max
  Coding DNA Sequence Number=SeqID_95159
  Homolog annotation: Hit_ID=Q1SKC8; Match level="QueryCoverage=33%, HitCoverage=18%, E-value=1e-07, Identity=42%"; Hit description =Integrase, catalytic region
MKKIFQPGQQVLLFNSRLKLFPRKLKSSERNWIVNGQRLKVYNGGDIDKLTTIIHLHDLVMSAQFWMVTLRSKRAKHKCVIMIVVLNLIITEGCFQDYFNKHSKVKHCFKTNTRLLQQTSIASRLIQDQAFASKQVFPRDQGSGNRLPGSVIDY

SEQ ID NO: 211938 - protein, 235 aa, Glycine max
  Coding DNA Sequence Number=SeqID_95160
MEWRTMLEPWMRGTSLEEGGKSEAIGLQGVVGKFGGCVKEVTEKGVEVVAFLQLLENWVVQHEATSFWSPSKCVNYTVDNEDYTSSSTSLLVAITGFLTSPSFHDTTNTVLPSSIPTSSAATIAHSSSLSPPSSSSYFITPSHHSDRTEPYPAKEQRGPTRSVGISAVEEASQSLYSAAGIAPAPVPALEGIALVDEGVGDEGNGNGGEAIVSGILLVAEELLGTGLVGGEGRRR

SEQ ID NO: 211939 - protein, 467 aa, Glycine max
  Coding DNA Sequence Number=SeqID_95161
  Gene Ontology: Mol. function=RNA-directed DNA polymerase activity; Cellular component=intracellular; Biological process=RNA-dependent DNA replication
MGNGNLEMSVEDQKVTFNLFKAIKNPNDCKTCFKTDETTVEETQPIHEGGMVPKKGGMIVICNEKNDLIPTRIVTEWRMCIDYHKLNDATRNDHFLLLFMDHMLERLVGQAFYCFLDCPFNVFAYRKMPFGLYNALATFQRCMLAIYVDLVEKCIEGIALAHNISSQGIEVDKAKIDVIEKLPPPVNVKGIRSFLGHANFYRRFIKEFSKIVKPLSNLLNKGEGRITWYRSRNRMMPLSEMEDKSGLWDSHQSAPVIVAPNWSQEFALICDASDYALNYATTEKELLAIVYAFEKFRSYFIGSKVIIFTDHAAIKYLLTKVDSKPRLVNEEVTQEEKEIRDEFLDESPLSVSEWPWFANIPNFKAIGIIPNTHNWHQRDKFLHDTHYYVWDNPHLFKLGANNLLRRMPMSMCCIVISVNKLRKVLGHYNIRHKVASPYHPQTNGQAVLSNRELKKILEKTVASSKKD

SEQ ID NO: 211940 - protein, 642 aa, Glycine max
  Coding DNA Sequence Number=SeqID_95162
  Homolog annotation: Hit_ID=Q10Q83; Match level="QueryCoverage=48%, HitCoverage=65%, E-value=9e-64, Identity=46%"; Hit description =Expressed protein
  Pfam annotation: Domain name=DUF566; Domain location=202-592; Score =487.4; E_value=1.7e-143; Accession=PF04484.3; Description=Family of unknown function (DUF566)
  Subcellular localization annotation: CTP_CleavageSite=69; ConfidenceScore=5.96e-01
MSHSPSPSPSPSSTTTTTTSTSTSTTTSSSRRFPSPLLSHSSNSSTPLVPKRSQSVDRRRPRPATPLPEAAKLLVTSTRSLSVSFQGEAFSLPVSKTKAAAATPPPRKAATPERRRATPVKGENSRPVDQHRWPARTRRVDHLSKSVDVSDKKKVIGNGFGKVVRALQQSMVVEGEKRRASFDGLGGLSLDLGKAELLKGNSNSNSNANNHSNNDGGGGGGNLVNKSSLASDLTASDTDSVSSGSTSGAHESSGAAKGTKEPRGIVVSARFWQETNSRLRRLQDPGSPLSTSPASRIGVPNRNAQLKRYNSDGPMLSPRTMASPVRGNVNARPASPSKLWAGSSPSRGVSPARVRSTVASSINSGSSNTPSILSFSADVRRGKIGEDRIFDAHTLRLLYNRYVQWRFVNARADATFMVQKLNAERHLWNAWVTISELRHSVILKRIKLVLLRQKLKLTSILKGQISYLEEWALLDRDHSSSLLGATEALKASTLRLPVVEKAIADVPNLKDALGSAVDVMQAMASSIYSLSSKVEETNCLVAEILKVTSKERLLLEHCKEFLSSLAAMQLKNAYVTTFSRANFQLPDNTCVELILFDNSLLMLTLLQAFYFPQGGDITQKYLFVSEYTIYKGKEVAFHSLVS

SEQ ID NO: 211941 - protein, 279 aa, Glycine max
  Coding DNA Sequence Number=SeqID_95163
  Gene Ontology: Mol. function=protein binding; Cellular component =kinetochore; Biological process=mitotic spindle checkpoint
  Homolog annotation: Hit_ID=Q9LJN8; Match level="QueryCoverage=93%, HitCoverage=71%, E-value=1e-123, Identity=83%"; Hit description =Mitotic checkpoint protein
  Pfam annotation: Domain name=WD40; Domain location=10-48; Score=35.3; E_value=2.1e-07; Accession=PF00400.22; Description=WD domain, G-beta repeat
  Pfam annotation: Domain name=WD40; Domain location=153-191; Score =24.5; E_value=0.00038; Accession=PF00400.22; Description=WD domain, G-beta repeat
  Pfam annotation: Domain name=WD40; Domain location=57-92; Score=1.3; E_value=26; Accession=PF00400.22; Description=WD domain, G-beta repeat
  Pfam module annotation: Pfam domain module=WD40::WD40::WD40; Domain location=10-48::153-191::57-92
MEKEMLVFSSNKEDILGRHDAPVRCVEYSYAAGQLITGSWDKTLKCWDPRGASGQERTLVGTYPQAERVYSLSLVGHRLVVATAGRHVNIYDLRNMSQPEQRRESSLKYQTRCVHCYPNGTGYALSSVEGRVAMEFFDLSEASQAKKYAFKCHRKSEAGRDIVYPVNAIAFHPIYGTFATGGCDGYVNVWDGNNKKRLYQVLFLFALHNLSDQNFRKYSKYPTSVAALSFSRDGRLLAVASSYTFEDGPKSQEQDAIFVRSVNEIEVKPKPKVYPNPPV

SEQ ID NO: 211942 - protein, 171 aa, Glycine max
  Coding DNA Sequence Number=SeqID_95164
  Homolog annotation: Hit_ID=Q0PN09; Match level="QueryCoverage=65%, HitCoverage=48%, E-value=9e-47, Identity=76%"; Hit description =Lateral organ boundaries domain protein
  Pfam annotation: Domain name=DUF260; Domain location=2-107; Score =89.9; E_value=7.6e-24; Accession=PF03195.5; Description=Protein of unknown function DUF260
MSCNGCRVLRKGCSDDCMLRHCLVWIENPQAQAHATLFVAKFFGRATLMSFLSSVPSNQRSALFQSLLYEAVGRTINPVNGAVGLLWTGNWHLCQMGVEKVLRGGAALTPLPQVITSVERVMVGGEIIMCHQPKKQHVGTPPEEESEISTFGSRPLDSAPQSQTNLLTLFF

SEQ ID NO: 211943 - protein, 75 aa, Glycine max
  Coding DNA Sequence Number=SeqID_95165
MNLVAAACRHFLCPLGEEVGLVKFNATEDRFFKASWWGRRSPPMTLRLISTSGFCSNLNAQIMFFAPHLLGFVFL

SEQ ID NO: 211944 - protein, 140 aa, Glycine max
  Coding DNA Sequence Number=SeqID_95166
  Homolog annotation: Hit_ID=O82324; Match level="QueryCoverage=43%, HitCoverage=24%, E-value=2e-21, Identity=70%"; Hit description=22 kDa peroxisomal membrane protein
  Subcellular localization annotation: CTP_CleavageSite=55; ConfidenceScore=5.50e-01
MAGYGIVILGPSLHFWFNFVSKLFPRRDLFSTLKKMVMGQTLYGPAMTVIFFSLNARLQGNRVNTSLLYSIPSPPNEGFEPLIFSLSFSYPHIRSLIHGITEEGKRSLTNKGRGSEGAKIPPLAIYSLPIFEDLGGRKNT

SEQ ID NO: 211945 - protein, 446 aa, Glycine max
  Coding DNA Sequence Number=SeqID_95167
  Gene Ontology: Cellular component=nucleus
  Homolog annotation: Hit_ID=Q2QN39; Match level="QueryCoverage=75%, HitCoverage=93%, E-value=1e-42, Identity=37%"; Hit description =Expressed protein
EHSSGEVIERSSSGNFSGRRFFRMNNLFYWKNLLPKKLLEEEPSSGNYPEEPSSGRTTICSSGKLPEKSSSGRTQIVLPEEVIVRRFLGKMTISKHSFSRIDTLELKALIVRKVGHQRADKYFDQLRRLLSSKISKSEFDRICTVIIGRENIPLHNRLIRAILKNACLAKVPPVRGSARVGSATSVKDSNGSQRGSAQSLFGEAFPPSMRRISSLAARDCRFKGRHNAFGPLGKPHFGLASEELVYKTLEQQSATELNSLGSRPPISVEEGEEVEQMAGSPSIQSRSPVTAPLGVSMNFGRGRRLHSNVSLCSKDYPETCHSNGYLPDTRSLRNCLEQKLEKEGLTATVDCVNLLNNALDSYLKRLIESFMDLAGSRFGNEHLRQQNRQLVTSSNVLLPGRCMQTATRSASASVLDFRLAMELNPQVLGPDWPIQLEKICIRASEE

SEQ ID NO: 211946 - protein, 103 aa, Glycine max
  Coding DNA Sequence Number=SeqID_95168
  Gene Ontology: Mol. function=[protein-PII] uridylyltransferase activity; Biological process=nitrogen compound metabolic process
  Homolog annotation: Hit_ID=Q6ZI91; Match level="QueryCoverage=64%, HitCoverage=13%, E-value=3e-22, Identity=70%"; Hit description =Putative ACT domain-containing protein
MGKRRSSLIGEVGLMAKVCWPYFDPEYENFTNRMNPPRVSVDNASFHDCTLIKMDSVNKPGILLEVVQILTDLDFIITKAYISSDRGIVRMASVPIRTSSIKR

SEQ ID NO: 211947 - protein, 808 aa, Glycine max
  Coding DNA Sequence Number=SeqID_95169
  Gene Ontology: Mol. function=zinc ion binding; Cellular component =nucleus; Biological process=transcription
  Homolog annotation: Hit_ID=Q9SWG3; Match level="QueryCoverage=96%, HitCoverage=94%, E-value=0.0, Identity=64%"; Hit description=Far-red impaired response protein
  Pfam annotation: Domain name=FAR1; Domain location=48-257; Score =359.5; E_value=5.4e-105; Accession=PF03101.5; Description=FAR1 family
  Pfam annotation: Domain name=SWIM; Domain location=535-571; Score =35.9; E_value=1.4e-07; Accession=PF04434.8; Description=SWIM zinc finger
  Pfam annotation: Domain name=Transposase_12; Domain location=255-361; Score=-37.2; E_value=0.042; Accession=PF01610.8; Description =Transposase
  Pfam module annotation: Pfam domain module=FAR1::SWIM::Transposase _12; Domain location=48-257::535-571::255-361
MGDALNEVQHMGGAPAASPKRDITLLEGDKDFELHNGIEFESHEAAYSFYQEYAKSMGFTTSIKNSRRSKKTKEFIDAKFACSRYGVTPESDSGSSRRPSVKKTDCKACMHVKRKPDGKWIIHEFIKEHNHELVPALAYHFRIHRNMKLAEKNNIDILHAVSERTRKMYVEMSRQSSSCQNIGSFLGDINYQFDRGQYLALDEGDAQVMLEYFKHVQKESPNFFYSIDLNEEQRLRNLFWIDAKSINDYLSFNDVVSFDTTYIKSNDKLPFAPFVGVNHHSQPILLGCALLADETKPTFVWLMKTWLRAMGGQAPKVIITDQDKALKTAIEEVFPNVRHCFSLWHILESIPENLSFVIKKHQNFLPKFNKCIFKSWTDEQFDMRWWKMVSICELQDDLWFQSLYEDRKKWVPTYMGDAFLAGMSTPQRSESMNFFFDKYIHKKITLKEFVKQYGIILQNRYDEEAIADFDTLHKQPALKSPSPWEKQMSTVYTHAIFKKFQVEVLGVAGCQSRIEAGDGTIAKFIVQDYEKDEEFLVTWNELSSEVSCFCRLFEYKGFLCRHALSVLQRCGCSCVPSHYILKRWTKDAKIKELMADRTRRTQTRVQRYNDLCKRAIDLSEKGSLSEESYNVVFRTLVDALKNCVLVNNSNNNGAETSSNAYGLREAEENQVPLALKPNKKRNAARKRKGQLEQDVILVDAQDSLQQMDNLSTDAITLNGYYGTQQNVQGLVQLNLMEPPQDGYYVNQHSMQGLGPLNSMGPSHDGFFGTQQGIHGLGGQLEFRRATTFGYSLQDEPDPQFHGNSSRNT

SEQ ID NO: 211948 - protein, 121 aa, Glycine max
  Coding DNA Sequence Number=SeqID_95170
  Gene Ontology: Mol. function=oxidoreductase activity, acting on paired donors, with incorporation or reduction of molecular oxygen, 2-oxoglutarate as one donor, and incorporation of one atom each of oxygen into both ...
  Gene Ontology: Mol. function=donors; Cellular component=cytoplasm; Biological process=protein metabolic process
  Homolog annotation: Hit_ID=Q1SEC9; Match level="QueryCoverage=92%, HitCoverage=32%, E-value=2e-42, Identity=64%"; Hit description=2OG -Fe(II) oxygenase
  Pfam annotation: Domain name=2OG-FeII_Oxy; Domain location=11-112; Score=53.5; E_value=7.3e-13; Accession=PF03171.10; Description=2OG -Fe(II) oxygenase superfamily
MKFNANFKLATVQKFNILKYEVAQKYDSHYDAFNPDEYGTVESQRIASFLLYLSNVEAGGETMFPYEVKPRQGDGLLFYSLLPNGKIDKTSLHGSCPVIKGEKWVATKWIDDREQHHLLSL

SEQ ID NO: 211949 - protein, 122 aa, Glycine max
  Coding DNA Sequence Number=SeqID_95171
MELFLTTRIMVDGVRQFMTPHSLENVSIAIVEDTSNHPNGSKFQQICFRCGDGADKIQNCPKEHTSQVKYNRLDVWQNNRMDNKHKMEDANKFESNSLAKLLSNVEAFSTRHQRDGGRLSGS

SEQ ID NO: 211950 - protein, 92 aa, Glycine max
  Coding DNA Sequence Number=SeqID_95172
MDRSWMKASRISDEYENGVLVLKDMLLKKLLSFVPQYIETVQSIGLLETRHDQTRGGKGTQGVMGTPPRSPSSSDGHSKATSRKSRQSTRLR

SEQ ID NO: 211951 - protein, 90 aa, Glycine max
  Coding DNA Sequence Number=SeqID_95173
IQQAILPQISASPYQLDFTLYASGSYNAQWNAPGLLHDKHTLRSSRILRKMEVEEPWLGLFAAKFLFVGVFWFVLKVVFVIGSAVDKLCG

SEQ ID NO: 211952 - protein, 244 aa, Glycine max
  Coding DNA Sequence Number=SeqID_95174
MKSFEARAKETEQLHQRFKKLEQEWQAFKESKPTPPTTKASHKHSLQYSNETIQKPRKYSPRELMFNLQQQESPSPEEEKSKNVTRTKDRAVQEILQERREAIERGKLKGRRLFHSEEKGDESNSRHEVRSMSFYEEEDDESSGSELGVHDYCSRELSYSSSSTSSCLIGGDNHNQNNETVAPLVAMITTEMGVASNSRRANRSTRYAVFLGGVAAIILLVIATLMRLGKSFGGDDCDKIFIPT

SEQ ID NO: 211953 - protein, 99 aa, Glycine max
  Coding DNA Sequence Number=SeqID_95175
MWGWSKMKRMCWCGHNVPRELSRLAMRKPSNEGLPTRSNLRRRNTRLDNMDFSCPLCHHQEETLEHLFFLCPIASSIWSRCWNWLGVQMVLHYKPMEHF

SEQ ID NO: 211954 - protein, 225 aa, Glycine max
  Coding DNA Sequence Number=SeqID_95176
MAEATRPKTRMEHIEEAIAKLASNQLHVTTKLGELIHRITVLEARQHHSPTPPSSSSAKTFLTHIPISTLSLTSPLPPLLKPTSPPHPALMPKHPAPLSVPFPMHVPHLVTNSKHQVAYASSSVFNQLDHACAVASLDNLLSIVVHYGREAAPHDKLLEHRDMTLFERGVAPYGNIMNQPKVEQFSTEDEIAADKVETSTNLRTKRKICRPHYLKDFVTNTNPKC

SEQ ID NO: 211955 - protein, 157 aa, Glycine max
  Coding DNA Sequence Number=SeqID_95177
MVHKVKLENGLIRLSVIANSMIRIFYSLVCEKGMGKNEKRVNLICYDEVEDDVLEHRDGEGVADEDEVKDDALKHCNREVVVDKKELKDDVLKHYIEEVSVDGEDKVEDDTLKSNAKKFLEPLLVYPVLIGVGDKSTEAHGYPATWNLVLPAPVLCV

SEQ ID NO: 211956 - protein, 308 aa, Glycine max
  Coding DNA Sequence Number=SeqID_95178
  Gene Ontology: Mol. function=metal ion binding; Biological process =metal ion transport
  Homolog annotation: Hit_ID=Q9ZRE7; Match level="QueryCoverage=52%, HitCoverage=54%, E-value=3e-53, Identity=66%"; Hit description=ATFP3
  Pfam annotation: Domain name=HMA; Domain location=141-202; Score =47.6; E_value=4.1e-11; Accession=PF00403.16; Description=Heavy-metal- associated domain
  Pfam annotation: Domain name=HMA; Domain location=43-106; Score=47.2; E_value=5.6e-11; Accession=PF00403.16; Description=Heavy-metal -associated domain
  Pfam module annotation: Pfam domain module=HMA::HMA; Domain location =141-202::43-106
MAKEKNPEEEATQEKKPEQESKEEVAAAAAAPPPPPPPPPPEIVLKVFMHCEGCARKVRRSLKGFPGVDDVVTDCKSHKVVVKGEKADPLKVLERIQRKSHRQVELLSPIPKPQEEKKVQEEEKPKPNPEEKKEEPQIVTVLKVHMHCEACSQEIKRRIQRMKGVESAEPDLKNSQVSVKGVYDPAKLVEYVYKRTGKHAVIVKQEPEKKEKVEEAKEEKKEEEKKSGGEGEENKEKKEEEAKVEEATTPATTEDTNKVVPEVKINEYFYNPPRYGMEVYAYPAHPAYFHSYPPQMFSDENPNACTVM

SEQ ID NO: 211957 - protein, 97 aa, Glycine max
  Coding DNA Sequence Number=SeqID_95179
MVLKTVNDNKLPSPIVSSLSVPLCIAQRSLIHAPASNDGSWWPPIVVGGGEESVRVWVGGCLERRRAKNHVFHVEKHIYNLQILLSELVSLSGVYFW

SEQ ID NO: 211958 - protein, 129 aa, Glycine max
  Coding DNA Sequence Number=SeqID_95180
  Gene Ontology: Biological process=cell redox homeostasis
  Homolog annotation: Hit_ID=Q6JE37; Match level="QueryCoverage=52%, HitCoverage=37%, E-value=8e-26, Identity=79%"; Hit description =Thioredoxin protein
  Pfam annotation: Domain name=Thioredoxin; Domain location=49-128; Score=-27.1; E_value=0.027; Accession=PF00085.10; Description =Thioredoxin
MEWNVSKDKLKLVALGGLSFSLLVCKESYKGRYSAIYMLDQRLGLACIEILIYKQESLCSFIQKLAVEYQNKALIVKVDTDEEYEFARDMQVRGLPTVFFISPDPNKEAIRTEGLVPIQMMRDIIDKDM

SEQ ID NO: 211959 - protein, 113 aa, Glycine max
  Coding DNA Sequence Number=SeqID_95181
MARRDKNWSFCTLCHPEAAGPMTCGDKIGHSAPLCHSDTAVSDGAQRQKLVILHPLSSRGGGPDDMRRQNLVIPHPYAIQTQPCPMARRDKNWSFCTLCHPEAAGPMTCRDKI

SEQ ID NO: 211960 - protein, 142 aa, Glycine max
  Coding DNA Sequence Number=SeqID_95182
  Gene Ontology: Mol. function=microtubule motor activity; Cellular component=microtubule associated complex; Biological process =microtubule-based movement
  Homolog annotation: Hit_ID=Q2HT07; Match level="QueryCoverage=63%, HitCoverage=6%, E-value=6e-23, Identity=63%"; Hit description =Kinesin, motor region; Prefoldin
MKKDYDIALVGAFRREKDKDMELQALRDEIQASMKLVRQREDDIQSLKMRLRFREAGIKRLQTDASEKISAETHLLKEKEEHLKEIEVLRAQTLGDYISTMISRLSIRIWHGRLVVGIKSDFGKIGGWGRKALCNRNTLSSF

SEQ ID NO: 211961 - protein, 88 aa, Glycine max
  Coding DNA Sequence Number=SeqID_95183
MSSLNMRKGFEGQRIKREISTLKLLKHPNVRNLDQLEDLLNKVKLKTIRTEPPSASIAGTSWCIFGVSVDSVVAALQFVAPSAKGFFL

SEQ ID NO: 211962 - protein, 168 aa, Glycine max
  Coding DNA Sequence Number=SeqID_95184
MGKLDHLEERLRAIEGGEDYAFANLKELFLVPNIITPPKFKVLDFDKYKGTTCPENHLKMGAYAKGEEQLIDFFQESLTGVAITWYTNLEPSRVQSWKDLMVAFVRQYQYNFDMVPDRMQLQNMCKKGARIFQKNTPKGGETWQLKWHLNDGKKNDNNDSRHITSILL

SEQ ID NO: 211963 - protein, 126 aa, Glycine max
  Coding DNA Sequence Number=SeqID_95185
MVEEFEEILGCPLGGRKPIPLLQGSIPSLARISKIFQIFGEGIRPPKASRKWGGRDTEKMFGGKSKNLGRPVYPLQGHRSCVEKGKANWDQLLASMEGRLLIGSLARRKEESGLYLHAKDVQMFPR

SEQ ID NO: 211964 - protein, 196 aa, Glycine max
  Coding DNA Sequence Number=SeqID_95186
MAVKRFPFDLVRVKDHSRSANDRVAAERTHDNRVVELEDEASCSSCSAPRLLPFVDRENVYDAKGKRVMSMKRRSGVRRRRRASYDCTKVSSAVPSENLQSDVVLTPCSPCDGSIIRDKTSAGISPTSGKGVSVDDAEVDQADHDLDEKTCHSYEFSGSMVDSPGQDKYLLSLEHYINNVCDHVQIVGNGEDRIKM

SEQ ID NO: 211965 - protein, 161 aa, Glycine max
  Coding DNA Sequence Number=SeqID_95187
MAFKWTIRLAQELSLQNIIFETDCQEFSLAWKEGSVDRCTYFDDILQDYKYLLGYRSNSTLVYTRRTRYIVANHLGNMFMFTNHTRNFTSSRLIKVILVASTLTYLPSLEVASILTYLPSPEVASTRKLAKYSLKAQVEKDEGPSGEGQSPRVEKDEGPSG

SEQ ID NO: 211966 - protein, 144 aa, Glycine max
  Coding DNA Sequence Number=SeqID_95188
IQRSNRLRILCLNTLEGTSFVVQVEGTSTWVVVTENKRGYISYGSVQVEGTSTWLFKENKGGYIPCGSLLVKVFTRFKEISRTAGCLGTGSEFDIPKSSDLRTKKKILQTVGERWRQFKSDLTLKWALAHGKEGKDDKDGQKKA

SEQ ID NO: 211967 - protein, 143 aa, Glycine max
  Coding DNA Sequence Number=SeqID_95189
  Gene Ontology: Mol. function=DNA binding; Cellular component=nucleus
  Homolog annotation: Hit_ID=UPI0000E810AC; Match level="QueryCoverage =50%, HitCoverage=2%, E-value=5e-08, Identity=37%"; Hit description =PREDICTED: similar to silencing mediator of retinoic acid and thyroid hormone receptor alpha
  Pfam annotation: Domain name=Myb_DNA-binding; Domain location=22-68; Score=16.8; E_value=0.076; Accession=PF00249.21; Description=Myb -like DNA-binding domain
MFNSSNELVEDPLAVEREGAMINCWTLEERNIFSEKLAVFEKDFQKVTSFLDHKTTADCVELYYKDHKTNCFEKDKKMMGCKSRKSKTSITTMKGLVNQRTRSGRLHFWRISDESERVAVDALIDMCDSLSPEATKRCHANNL

SEQ ID NO: 211968 - protein, 37 aa, Glycine max
  Coding DNA Sequence Number=SeqID_95190
MTGESGLNVGKPPVKLAGWVQARGCRPKGELQLPLAI

SEQ ID NO: 211969 - protein, 89 aa, Glycine max
  Coding DNA Sequence Number=SeqID_95191
  Gene Ontology: Mol. function=glutamine-tRNA ligase activity; Cellular component=soluble fraction; Biological process=tRNA aminoacylation for protein translation
  Homolog annotation: Hit_ID=P52780; Match level="QueryCoverage=98%, HitCoverage=12%, E-value=1e-38, Identity=89%"; Hit description =Glutaminyl-tRNA synthetase
TPDEIKEHREKKLNSPWRDMPISESLKLFEDMKNGSIEEGKATLRMKQDMQSDNYNILPHTLMLETNGVSIQVMIMHIALWILKRISHI

SEQ ID NO: 211970 - protein, 116 aa, Glycine max
  Coding DNA Sequence Number=SeqID_95192
  Homolog annotation: Hit_ID=Q1T5D4; Match level="QueryCoverage=55%, HitCoverage=5%, E-value=1e-17, Identity=70%"; Hit description =Protein kinase; Zinc finger, RING-type
ELLLAGADPHAVDDEGESVLHRAVAKKSIECALVILENGGSRSMAILNSKNMTVVCLATSSMAGVGSSSYKGNDNILFCFHCKSKTTTFINGWQLRSGGLALLCQNCGMKFILQAY

SEQ ID NO: 211971 - protein, 43 aa, Glycine max
  Coding DNA Sequence Number=SeqID_95193
  Subcellular localization annotation: CTP_CleavageSite=55; ConfidenceScore=5.33e-01
MLNPPENPSRGASVTLPWVISQRFSTVLRRSSFVLRRSSVFNQ

SEQ ID NO: 211972 - protein, 525 aa, Glycine max
  Coding DNA Sequence Number=SeqID_95194
  Gene Ontology: Mol. function=inorganic phosphate transporter activity; Cellular component=integral to membrane; Biological process=phosphate transport
  Homolog annotation: Hit_ID=Q8GSG4; Match level="QueryCoverage=99%, HitCoverage=100%, E-value=0.0, Identity=81%"; Hit description =Phosphate transporter PT4
  Pfam annotation: Domain name=MFS_1; Domain location=25-460; Score =55.8; E_value=1.4e-13; Accession=PF07690.6; Description=Major Facilitator Superfamily
  Pfam annotation: Domain name=Sugar_tr; Domain location=20-503; Score =124.3; E_value=3.5e-34; Accession=PF00083.14; Description=Sugar (and other) transporter
  Pfam module annotation: Pfam domain module=MFS_1::Sugar_tr; Domain location=25-460::20-503
MALEVLEALDSARTQWYHVTAIVIAGMGFFTDAYDLFCISTVSKLLGRLYYFDPSTPNLPGKLPLSVNNMVTGVAIVGTLTGQLIFGWLGDKLGRKKVYGITLILMVICAICSGLSFGATPKSVMGTLCFFRFWLGFGIGGDYPLSATIMSEYANKRTRGAFIAAVFAMQGVGIIFAGLVSMTLSAIFKHYYPAPAYINDPVLSTQPEGDLLWRLVLMIGAVPAMMTYYWRMKMPETGRYTAIIEGNAKQAAADMAKVLDIEIQAEQDKLAEFNASNNYPLWSNEFFQRHGRHLIGTMSSWFLLDIAFYSQNLTQKDIFPAIGLIDKDYQMDAIKEVFETSRAMFVIALLGTFPGYWFTVFFIEKIGRYKIQLIGFFMMSFFMFVIGVKYDYLKNEGKGYFALLYGLTFFFANFGPNSTTFVLPAELFPTRVRSTCHALSAAAGKAGALVGVFGIQCLTVGGESYKIKKVMIILAVTNLLGFFSSFLVTETKGRSLEEISGEDGRESELTPTPNNRVQGSRTETM

SEQ ID NO: 211973 - protein, 50 aa, Glycine max
  Coding DNA Sequence Number=SeqID_95195
  Homolog annotation: Hit_ID=P52780; Match level="QueryCoverage=62%, HitCoverage=4%, E-value=9e-12, Identity=90%"; Hit description =Glutaminyl-tRNA synthetase
MACGASRYDDTNPEAEKKEYIDHIEEIVQWMGWKPFKLCDNINTSKNCMN

SEQ ID NO: 211974 - protein, 114 aa, Glycine max
  Coding DNA Sequence Number=SeqID_95196
MPLYLNFLNISAIMVVVSSCYILWQKEEEARAQSADGKVFKIVPWHHLEHSTSNSLSIQALSHDLTGLDRSYFQKLFMSLHAMFAFTQRGGFDQIDKDDSNLPLDTAPIKHVTQ

SEQ ID NO: 211975 - protein, 379 aa, Glycine max
  Coding DNA Sequence Number=SeqID_95197
  Gene Ontology: Cellular component=endoplasmic reticulum
  Homolog annotation: Hit_ID=Q2HRE1; Match level="QueryCoverage=90%, HitCoverage=77%, E-value=1e-120, Identity=55%"; Hit description =Lipopolysaccharide-modifying protein
  Pfam annotation: Domain name=DUF821; Domain location=1-373; Score =887.3; E_value=6.9e-264; Accession=PF05686.3; Description =Arabidopsis thaliana protein of unknown function (DUF821)
MLEGARRTAHFRLVIVDGKLYVEKYKKAIQTRDVFTLWGILQLLRMYPGKVPDLELLFDCDDRPVVSKERFKGPNAPTPPLFRYCSDQWSLDIVFPDWSFWGWAEINIKPWKHVLKEIKEGNEKTKWKDRVPYAYWKGNPLVSPTRKDLMKCNVTEKDDWNTHLYIQDWDQESSKGYKKSNLGDQCTHRYKIYVEGWAWSVSEKYILACDSTTLYVRSRFHDFFVRGMVPLEHYWPIRDNSKCKSLKFAVEWGNNNTDKAQAIGEAGSKFIHEDMDMDYVYDYMFHLLNEYAKLQRFKPTIPQNAVEYCPETMACGVDGIQRRFMEDSMVKSPSDSNPCTLPPPYEPINLQDFLEKKASSIRQVETWEDQYWEKEKGGQ

SEQ ID NO: 211976 - protein, 386 aa, Glycine max
  Coding DNA Sequence Number=SeqID_95198
  Gene Ontology: Mol. function=adenosine deaminase activity; Cellular component=intracellular; Biological process=RNA processing
  Homolog annotation: Hit_ID=UPI0000162BF0; Match level="QueryCoverage =80%, HitCoverage=99%, E-value=3e-99, Identity=59%"; Hit description =RNA binding / adenosine deaminase
  Pfam annotation: Domain name=A_deamin; Domain location=60-378; Score =106.6; E_value=7.1e-29; Accession=PF02137.9; Description=Adenosine -deaminase (editase) domain
MSMASSVSFYEESSWGKRVSEKVLSFYASLPKKGKPQGREVTVLAAFLLSSPSNDLKVVAMGTGTKCIGRSLLRTCGDVVHDSHAEVIARRALMRFFYTQIQHLTESSSKHAPGNGGKRFKLDEDHLPFEWDPGGDASLSFHVSPLETVVLGESDSTSPLDNGSKQKGMVQRKPGRGDTTLSVSCSDKIARWNVVGVQGALLSYFLQPVYLSSITVGLPLNIPENFRLEDNLKRALYERIPPLLNELTSPFLVNQPIFHAAPVPPKDFQQSESAANTLTCGYSIGWNECGLHDIIMGTTGRKQGTSAKGALYPSTQSSLCKKRLLEVFLSLRPENLISSLPNGITYRELKDGAEEYHLASKIFKGKPPFNKWFLKPLDCEAFHISE

SEQ ID NO: 211977 - protein, 147 aa, Glycine max
  Coding DNA Sequence Number=SeqID_95199
  Gene Ontology: Mol. function=DNA binding; Cellular component=plasma membrane; Biological process=cell-cell signaling
  Homolog annotation: Hit_ID=Q39087; Match level="QueryCoverage=56%, HitCoverage=42%, E-value=2e-13, Identity=53%"; Hit description=DNA -binding protein
  Pfam annotation: Domain name=Remorin_C; Domain location=84-146; Score= -16.0; E_value=0.023; Accession=PF03763.4; Description=Remorin, C -terminal region
  Pfam annotation: Domain name=Remorin_N; Domain location=23-84; Score =30.6; E_value=5.5e-06; Accession=PF03766.4; Description=Remorin, N -terminal region
  Pfam module annotation: Pfam domain module=Remorin_C::Remorin_N; Domain location=84-146::23-84
MAELQTKVEPVTVPAPAPVDPEPPLAEAPPLEKKAVAVPPPVPAAAEETKALVVVEKENEKIPEPVKKNASGGSLDRDIALAEIEKEKRLSNVKAWEESEKSKAENKAQKQLSAVAAWENSKKAALEAQLRKIEVLFVAQLLVDTMT

SEQ ID NO: 211978 - protein, 470 aa, Glycine max
  Coding DNA Sequence Number=SeqID_95200
  Gene Ontology: Mol. function=guanyl-nucleotide exchange factor activity
  Homolog annotation: Hit_ID=Q9LQ89; Match level="QueryCoverage=96%, HitCoverage=97%, E-value=1e-149, Identity=58%"; Hit description=Rop guanine nucleotide exchange factor 2
  Pfam annotation: Domain name=DUF315; Domain location=12-469; Score =797.2; E_value=9.2e-237; Accession=PF03759.4; Description=Domain of unknown function (DUF315)
MDNSSNFDDNSDVGYQPSPSSVDQNDHSITENVGYSPLFSGESFAYCRSNSEVSNFSEPIDDNSFASEPSPSLWTPMKHGASQAALSRLGVKQHRHSVDEKSDDLDLLETELDMMRERFSKLLLGEDMSGGGKGVCTAVTISNSITNLYATAFGQNLKLEPLKPEKKAMWRREMNCLLSVCDYIVEFSPTAQYLEDGTIVEMMTSKPRSDIYINLPALQKLDTMLIEILDSFQDTEFWYAEQGSISGNSTRSRGGSFRRIVQRKDEKWWLPVPCVHTGGLSDKSRKHLNEKRDCANQIHKAAMAINSSALAEMDIPETYMSNLPKSGRTSLGDTIYRCMYSADKFSPDHLLDCLKISSEHEALELADKVESSIHSKTSWNKVKDLMADTDRSDKNYILAERAETLLFCLKQRYPELSQTSLDTCKIQYNQDVGKAILESYSRVLEGLAFNIVAWIEDVLLADKSMRNQNV

SEQ ID NO: 211979 - protein, 132 aa, Glycine max
  Coding DNA Sequence Number=SeqID_95201
  Subcellular localization annotation: CTP_CleavageSite=27; ConfidenceScore=5.11e-01
MVLVLLASRAHGHAHFDNLGSTALNLRLDSLQSPFRSRSRRQSTLEEEEEEEYPDARRPGRRRTDKSRRDNHLRSTKMEIPTFQGKNDPGLYLEWEKKVEHVFNCHNYFKEKKLHVELVGLGYSSSMESFAS

SEQ ID NO: 211980 - protein, 85 aa, Glycine max
  Coding DNA Sequence Number=SeqID_95202
MKAINSIYFLQNSENKTASDKEGIVEENEANLDLDAPDETVLVEAREASGGGGAPVDDLEVPPIVDDDESGGDAIKEDEDHQEDD

SEQ ID NO: 211981 - protein, 1046 aa, Glycine max
  Coding DNA Sequence Number=SeqID_95203
  Gene Ontology: Mol. function=nucleic acid binding; Cellular component= nucleus; Biological process=response to DNA damage stimulus
  Homolog annotation: Hit_ID=Q5JL01; Match level="QueryCoverage=99%, HitCoverage=79%, E-value=0.0, Identity=57%"; Hit description =Putative rad8
  Pfam annotation: Domain name=Helicase_C; Domain location=893-970; Score=40.6; E_value=5.2e-09; Accession=PF00271.21; Description =Helicase conserved C-terminal domain
  Pfam annotation: Domain name=SNF2_N; Domain location=31-701; Score= -16.7; E_value=3.1e-07; Accession=PF00176.13; Description=SNF2 family N-terminal domain
  Pfam annotation: Domain name=zf-CW; Domain location=272-318; Score =60.4; E_value=6e-15; Accession=PF07496.5; Description=CW-type Zinc Finger
  Pfam module annotation: Pfam domain module=Helicase_C::SNF2_N::zf-CW; Domain location=893-970::31-701::272-318
MDLTRVSATCHHLRSLAASVMPYTKLNLFPHQREAVEWMLHREQNAERLPHPLFVVLSTDDGFSFHVNTVTGEIVTGEAPTIKDFCGGMFCDEPGLGKTVTALSLIMKTRGTLADPPNGAQVVWCQHNGNQKCGYYEISGNNITGVTTLGKRDVCQDTSRTNDNHDYSSKRARLTYPDQQISKLHDSCSREENKSPVDACFKEYMHSNQFTKSLSRIKKSLHFTFEEEAMIFKEREIGEGLIKAKHASDVTSHVSQNKLPGKPKGDRFEYSDTWIQCDACHKWRKLVDNSMANSSAAWFCSMNTDPLYQSCSVPEQYFHNTCKITHLPGFHIKGTCGGEEQNVSFFTSVLKEHYSLINSQTKKALMWLAEISTDNLAGMETNGIRGPILNICTASSRHFHKIFQAFGLLKRVEKGVCKWYYPQHLNNLTFDVSALGMALREPLDFVRLYLSRATLVVVPANLVDHWKTQIEKHVRPGQLRVYVWTDHRKPSVHCLAWDYDVVITTFSRLSAEWGPRKRSALMQVHWFRIILDEGHTLGSSLNLTNKLQMAISLIASNRWILTGTPTPYTPNSQLHLQPLLRFLHEESYGLNRKSWDAGVLRPFEAEMEEGRSRLLHLLQKCMISARKIDLQSIPPCMKKVVYLDFNEEHARSYNELVITVRRNILMADWNDPSHIESLLNPKQWKFRSATLKNVRLSCCVAGHIKVTHAGEDIQETMDMLVQSDLDPTSGEYTSIRYNLLYGGHCVRCKEWCRLLLITPCRHLLCLDCVSIDNTKCTYPGCSKLYEMQSREARPENPKPKWPDNWDPDWQSTSSSKVSYLVQRLKALRGTKSGTNFNTENIIDEMHIENSLHRSDDKSSIQTCFMSSTKTNLNPEKVLIFSQFLEHIHVIEQQLTIAGIKYTGMYSPMHSSNKKKSLAMFQHDSNCMALLMDGSAALGLDLSFVTHVFLMEPIWDRSMEEQVISRAHRMGASRPIHVETLAMRGTIEEQMLGFLQDADNFRRSPIKDVTESDDDSGGRGYRSLHDFAESSYLLKLRSVYTNLERPE

SEQ ID NO: 211982 - protein, 167 aa, Glycine max
  Coding DNA Sequence Number=SeqID_95204
MEAMKDQMTTMMESMMSMRKMMEVKAATIATGSVATAVDLTHPFGMNQVSRPVPDMVGQGVEALGSIGDPYFVQVQSKHPFPSYGLPSNYAPPNVVYVPNENFDHSAPIPLESQHPQSGHAHVTQPMGETHEVPRDHTLADFEPYLGYATKGQAFGGIPYPNTPGRP

SEQ ID NO: 211983 - protein, 52 aa, Glycine max
  Coding DNA Sequence Number=SeqID_95205
  Gene Ontology: Mol. function=ribonuclease H activity; Biological process=DNA integration
  Homolog annotation: Hit_ID=Q1STR6; Match level="QueryCoverage=96%, HitCoverage=7%, E-value=7e-09, Identity=54%"; Hit description =Integrase, catalytic region; Ribonuclease H
VQKDHRGKWAPNYEGLFMVKKAFSRGMLLLMNMDDEELPSPVNSDIVKRYYA

SEQ ID NO: 211984 - protein, 110 aa, Glycine max
  Coding DNA Sequence Number=SeqID_95206
MGSKIYPKVYENPRAFFSSSSPSLLESSIQYPWGASVAPTPLKIRPVPRPCDSGSKLLMSRPRVLPRLLCLPWHAILLNEGLVNWGSDELFGHDQYPVELAEACDQCWKS

SEQ ID NO: 211985 - protein, 157 aa, Glycine max
  Coding DNA Sequence Number=SeqID_95207
MESVRFLRGSRGRECVVVTRGLVPTGFDVVVFVNPRGALVLGMNPNDMYGRLRPCVDNTTTAMARSKTSTIVLSSSSLRLFRPSSARPSELRLTPEVMSSPRRAGAHPGEPNAGLGELGPRKCKEKTLLPSFLGIFCFLDQNTEWFIALHCNWCPMS

SEQ ID NO: 211986 - protein, 470 aa, Glycine max
  Coding DNA Sequence Number=SeqID_95208
  Homolog annotation: Hit_ID=Q9LV67; Match level="QueryCoverage=68%, HitCoverage=84%, E-value=1e-114, Identity=68%"; Hit description =Arabidopsis thaliana genomic DNA, chromosome 5, P1 clone:MJE7
LKQLNRKKNRILASINGNSAYDVGGGYPELEQNQNGKLHSDMSSQREALLKGGDQVISVLEEMITLLEDMNMDEESEKVAVELAAQGVIGKRVDEMESDFMMALDYMIQLAENDQDDKRKSLLEVIKETVLSHLTKKCPPQVQVIGLLCRTPKKESRHELLRRVAAGGGVFKGENELKIHIPSANLNDIANQADDLLEAMETRPVIPDRKLLARLVLIREEARDMMGGGIMDERNHRGFYTLPQPEVDFLAKLVALKPGKNVLDMIRNVMQGKDEGADKSGNDNEDDTTNGEPAEFLGRPLVTGEKTLPVRPGMFLETVSKVLSGLYAGTDSGITAQHLEWEEELREIVCLQRSGDVSSASRNLTIAQKLTNLPKSSKLGSFTLFCASVFALFKLSFNYVIPDIKKGFLILMSCLVRVSELWLSANLALSLEGDKRIAERADNALSACLHGRLPFRFLLLAKRVDASLSG

SEQ ID NO: 211987 - protein, 198 aa, Glycine max
  Coding DNA Sequence Number=SeqID_95209
MYLDQAICNWTRQSENVVIAADLLHVYVGVKRRVVVNEEQEIYEGPKNVALEDVVFGGGPEDKSGLTEYVDHVGCEQWDDLNRGELKLVAYGRKLSGLPNPPTPPPPNKEIMRVMHDSGLLPLTECSYEIGDKRLLSAFAERWHLTRTRLKTWVAIALLMELLVVDKEDTFLETKQCRGGHARLSWLRGFYVDRCMDG

SEQ ID NO: 211988 - protein, 129 aa, Glycine max
  Coding DNA Sequence Number=SeqID_95210
MHSLQELAQNRPIIPLEYFIEKVAWPEAQLPLVRPNEAAPLEPAPARVDPMSAEPQTPVVNPPPSSELDVVPPSPPLVVISNASSDEAAGPPDSPAGETTDPPASLVGGIVDLSYLSSGEVVALSDSPV

SEQ ID NO: 211989 - protein, 225 aa, Glycine max
  Coding DNA Sequence Number=SeqID_95211
  Gene Ontology: Mol. function=transferase activity, transferring hexosyl groups; Biological process=carbohydrate biosynthetic process
  Homolog annotation: Hit_ID=Q9ZVI7; Match level="QueryCoverage=49%, HitCoverage=18%, E-value=3e-34, Identity=55%"; Hit description =Expressed protein
MSGLNIIDLVRWRELGLTQTYRKLIKEFTMQEGSIEGIAWRASLLTFENEIYPLNESWVVSGLGHDYTIDTQPINTASVLHYNGKMKPWLDLGIPQYKSYWKKFLNKEDQLLMNKEPGKFHAFLAKGSRSLSSLTVFKIANISKLLEQFPKPYKLTHSCYHSMIFNLHTTSGNYFCFLLLHEIKFPPIRRQYPEVDHLSNDPCPVNIRVTSDFGIAFIFILFSSS

SEQ ID NO: 211990 - protein, 105 aa, Glycine max
  Coding DNA Sequence Number=SeqID_95212
  Gene Ontology: Mol. function=D-alanyl-D-alanine endopeptidase activity; Cellular component=integral to membrane; Biological process=cytochrome complex assembly
  Homolog annotation: Hit_ID=UPI0000162C76; Match level="QueryCoverage =75%, HitCoverage=25%, E-value=2e-21, Identity=50%"; Hit description =D-alanyl-D-alanine endopeptidase/ peptidase
MILEPTSSSGDKAGGEAIPMLLRFPRLSDPWGGYDMIGFRDILFLGLFFTYLKLYMMNGHGQPALLYLVPCTLGKLVRYPIMDRSMDNLHCCTWFHDYGIGMQKR

SEQ ID NO: 211991 - protein, 53 aa, Glycine max
  Coding DNA Sequence Number=SeqID_95213
MEDTLQHLTQRDLLLHLYLGFNVILVIMGNYGKMPLIYVVVIGIAVSENPLSL

SEQ ID NO: 211992 - protein, 122 aa, Glycine max
  Coding DNA Sequence Number=SeqID_95214
MQRYLMVIRTFCQLEASEPVDTQRLTSPSAPFLEMSVSFSRDCEKVSFAIHQTQGSSCKSDDMRRCLMVIRTFCQLEASEPVDTQRLTSSFAPFPEMSASSGRDCEKVLFAIRQTQGFGSMQ

SEQ ID NO: 211993 - protein, 146 aa, Glycine max
  Coding DNA Sequence Number=SeqID_95215
  Subcellular localization annotation: CTP_CleavageSite=29; ConfidenceScore=5.68e-01
MATQSNSSSPPPPTGAATQSPSTLKWTRKASHLRSFATRPVGAERSLVHVDLATGKADSPQSKKLRTYLGIVACDKAEFDIPEASDVRTKKKILQTVRERWRQFKSDLTSKWALAADKDSVNDADVRKKAQAIQKQNTAPHMLSRG

SEQ ID NO: 211994 - protein, 58 aa, Glycine max
  Coding DNA Sequence Number=SeqID_95216
WLSTRKNPEEDELSSSLNALLQVIKRTASAHLLSETSVLSQNPLMRAKRSRSALSARA

SEQ ID NO: 211995 - protein, 87 aa, Glycine max
  Coding DNA Sequence Number=SeqID_95217
  Gene Ontology: Mol. function=protein dimerization activity; Cellular component=nucleus; Biological process=regulation of transcription, DNA-dependent
  Homolog annotation: Hit_ID=Q00M78; Match level="QueryCoverage=94%, HitCoverage=19%, E-value=3e-29, Identity=75%"; Hit description=Bzip transcription factor
  Subcellular localization annotation: CTP_CleavageSite=37; ConfidenceScore=5.03e-01
MAHSFGNETGGGGGRPSGNFSLTRQPLVHSLTFDEFMNNMGGSRKDFGSMNMDELLKNIWTTEEVQTMGSARVCTNDGGVGASHLQW

SEQ ID NO: 211996 - protein, 269 aa, Glycine max
  Coding DNA Sequence Number=SeqID_95218
  Gene Ontology: Mol. function=nucleoside-triphosphatase activity; Biological process=defense response
  Homolog annotation: Hit_ID=Q1STU5; Match level="QueryCoverage=99%, HitCoverage=75%, E-value=5e-28, Identity=33%"; Hit description =Leucine-rich repeat
PTSNLKCLSLGEKGLEMIKRGEFQRNFIHKLQVLTLCFHNGSDVFPYEILQLAPNIEKLVVYNASFKEINVDYTGLLLQLKDLCLESLPELVSIGLENSSIQPLLGNLETLEVIGCSSLKDLVPSTVSFSNLTYLEVERCHCLLYLFTSSTARSLGQLKRMEIKWCDSIEEVVVSKEGDESHEEGIIFPQLNCLKLERIGKLRRFYRGSLLSFPSLEELSVIKCEWMETLCPGTLKADKLVQVQLEESSDAIKLENDLNSTMREAFRKK

SEQ ID NO: 211997 - protein, 192 aa, Glycine max
  Coding DNA Sequence Number=SeqID_95219
  Gene Ontology: Mol. function=transition metal ion binding; Biological process=cytoskeleton organization and biogenesis
MRVEKNLFDRVIGMLLNIQGKIKDGLNTHQDLVEMSIRDQLHPRFDVERYMKILKWYTKNLHHPFVERYIVEEAIKFCSKYIEKEKLFGLPVSQHDERVEVDSMPYFGVIEEIQELNYVKFIVCVFKHKWVGSNIGVQTDDFGFTLVDLKKLAYQNEHFIIAEQAKQVFCVQDPCDERHLAPPPNSPPPPPE

SEQ ID NO: 211998 - protein, 660 aa, Glycine max
  Coding DNA Sequence Number=SeqID_95220
  Gene Ontology: Mol. function=RNA-directed DNA polymerase activity; Cellular component=chromatin; Biological process=chromatin assembly or disassembly
  Pfam annotation: Domain name=rve; Domain location=272-393; Score=0.6; E_value=0.0053; Accession=PF00665.16; Description=Integrase core domain
  Pfam annotation: Domain name=zf-H2C2; Domain location=230-271; Score =15.5; E_value=0.0032; Accession=PF09337.1; Description=His(2)-Cys(2) zinc finger
  Pfam module annotation: Pfam domain module=rve::zf-H2C2; Domain location=272-393::230-271
MDEHLQHLETAFQKQVEYLGHLVSTNGVEPLAEKVEVVRQWPSPRTTKALRSFLGLAGFYRRFIKGCFRPTEACTVLGTSPGSSRFLGVGMGVVLSQKGHPIAYFSKPFSAKLLRSSTYVRELFAITATTLEQYMYLARLMGYDYEIHYHSGANNQAVDALSCVPELDSSIALMLSLDHHSDYVHCRNDIVTYPTKHPGFFVVNNLILHHHRIWLPKDAPIIPTLLTEFHATPTGGHSGVAKTIARVSENFYWPNLRDDVATFVVNCLDCQSTKYEAKKLAGLLCSLPYKGNTVILVIVDRFSNGVHLVMLSTAHTAFMVATLFLEMVVKIHGVPWSLVFDRDPLFLSKFWQDLFRGSGTHLRMSSALLPWAEWSHNTSLNSATGTTPYEITFDRKPFNFPEYLADDSNIDAIDTMFCDREDTFLMIRKKLLKAQDAMKEKADKHHRDVTFLPCQWVLLRLRPHCQVSARENPHISGKLAKHFYGPFQVMEVIGKVAYRLQLPPDAKIHLVFHCSILKPFHGDPGDPAISPLPSHFHDAQPIIRPATILDSRQSSASTWEVLVQWHGLSPDETSREDWSTLCQDYHLEDKVLSQGPRGDIGGDITEASNDTGSHIVEASNQHDEGGIGILLEQFQHVGDNANKLDSKYSKGTQKGSNSVN

SEQ ID NO: 211999 - protein, 88 aa, Glycine max
  Coding DNA Sequence Number=SeqID_95221
MYFMDKSNSNCRSNKLIHKQIPYINITFKPQCMDGEMYMWRCFWTELRTEREKERCARGSKDTRCNENGEEESAAETERGREPIRKRV

SEQ ID NO: 212000 - protein, 632 aa, Glycine max
  Coding DNA Sequence Number=SeqID_95222
  Gene Ontology: Mol. function=actin binding; Cellular component =cytoskeleton; Biological process=actin filament bundle formation
  Homolog annotation: Hit_ID=Q67XH3; Match level="QueryCoverage=84%, HitCoverage=94%, E-value=0.0, Identity=63%"; Hit description=Fimbrin 2
  Pfam annotation: Domain name=CH; Domain location=186-302; Score=97.5; E_value=4.1e-26; Accession=PF00307.21; Description=Calponin homology (CH) domain
  Pfam annotation: Domain name=CH; Domain location=331-433; Score=98.7; E_value=1.8e-26; Accession=PF00307.21; Description=Calponin homology (CH) domain
  Pfam annotation: Domain name=CH; Domain location=469-574; Score =107.3; E_value=4.3e-29; Accession=PF00307.21; Description=Calponin homology (CH) domain
  Pfam module annotation: Pfam domain module=CH::CH::CH; Domain location=186-302::331-433::469-574
MVIAAMRMTMKTTMIECGGGGGDSNDGVVVTTMQNVNQNKVKYKSKNYRLVVQNLVEKDAEDMSGHWGILVSDPWLQNQFTQVELRSLKSHFMSMRRESGRLVIADLASKMSRLKVVGENLSEEERASCVKDVYQNTEEEVDFELFLKVYLKLQTFVNSRTGSSPKNSSAFLKAATTTLLHTISESEKASYVAHINHYLAQDEFLKKYLPIDPSTNELFEIAKDGVLLCKLINVAVPGTIDERAINTKRILNPWERNENHTLCLNSAKAIGCTVVNIGTQDFIEGRRHLVLGVISQIIKIQLLADLDLKKTPQLLELLDDSKDMEEFMNLPPEKILLRWMNFHLKKAGYKKIVTNFSSDVKDAEAYAHLLNVLAPEHTNLSTLAVKNPFERAKLVLEHADKMGCKRYLTARDIVEGSPNLNLAFVAHIFQHRYIRLLTQLPSCRNGLSAQTKQQMSLLETFPDDTLDSREERAFRLWMNSFGNSTYINNVFEDLRNGWVLLETLDKVSPGIVNWKIANKPPIKMPFRKVENCNQVVKIGKQLKFSLVNVAGNDIVQGNKKLILAYLWQLMRYNILQLLKNLRFYSRGKEINDADILEWANSKVSSSRSQSRMDSFKVLKLYLYSPFTQASAH

SEQ ID NO: 212001 - protein, 280 aa, Glycine max
  Coding DNA Sequence Number=SeqID_95223
  Gene Ontology: Mol. function=RNA-directed DNA polymerase activity; Biological process=RNA-dependent DNA replication
MAERPTSTFGANTEMNLKEECKVIFTRRESAEKEKRIEKDTKTKREIPPASSKEAPYPLVPLRKDKERYFKQFLHIFQQLEITIPFGETLQQMSLYIKFLKDVLIKKGKHINNKTIEVGGNCSAVIQKLPPKFKDPGSITIPCSIRSVSVGNLKIDPTRMTLQLVDRSITRPFRVVEDVLANEHPSNSKTCFKVEENEQNANLVGRHLNSVFLKEDEAKLVVNPTNSSSVFLGPKQVRAQATQDIPPDPPSAVPPPDVSPPPTGHSLLFFSTGATPLYAA

SEQ ID NO: 212002 - protein, 215 aa, Glycine max
  Coding DNA Sequence Number=SeqID_95224
MALTLSKLILFQVLGSIQSYQVWEKIHDHFHKQTRARACQLQTELHVIVLVDKPMREFLLKIKAIKFESLSVEVLLLAHEAHLQKFQKHGFSNSLTINYTQTNLNFSLAYGFDGYNVLNKALQPNYENFSSNSRGGFGHGGNFNHGDQGGGGLNHKERIQKKMISSALEEKLIQKLGKKGLQEKLEELDNSLSMHCRLSVYSRLSPHYWLSAMQT

SEQ ID NO: 212003 - protein, 93 aa, Glycine max
  Coding DNA Sequence Number=SeqID_95225
MQCRSNSFSLGEIIGRLVRVILVCEKTLTIWNQHRLQGTIKPSVFTPKAYAPKSSSGPLPPDSGKRELHARDIALTTNIISQIPTVGMCKNDF

SEQ ID NO: 212004 - protein, 295 aa, Glycine max
  Coding DNA Sequence Number=SeqID_95226
  Gene Ontology: Mol. function=gamma-tubulin binding; Cellular component=microtubule organizing center; Biological process =microtubule cytoskeleton organization and biogenesis
  Homolog annotation: Hit_ID=Q9LF43; Match level="QueryCoverage=92%, HitCoverage=44%, E-value=9e-74, Identity=47%"; Hit description =Spindle pole body protein-like
MMHIKDWFSSSLQKPIPNDNGDFLVHFMDIARDELAKKPDEVSVEKLQSLLDLALRTTAAAADPFHEGLTCVVAITLRNSGDNDLEEPVSITSLETFSLSYKVHWPLSIVLSRKALTKYQLLFRFLFHCKHVDRQLCGAWQVIEPNWHLMYNRLQSANSIDEVIQHHDFFLDKCLRECLLLLPELLKKVERLKSMCLQYAAATQWLISSSIELHNPEEPIDDSKGLNKAKWKSGQVLKSTTRNMAVTDSVLKFEKEFNTELQSLGSILSNNSQAEPYLSHLAQWLLGVKSEKNGL

SEQ ID NO: 212005 - protein, 179 aa, Glycine max
  Coding DNA Sequence Number=SeqID_95227
MEDVEGRKWKGRELGWVEVKFRSSSSAAVRRRAAAVISDRFFRRDQGSDRLEKRDPPLELAPPSDAPRAASLLRVFRRVQLTRRRPGVGSCPFRSWQLRRRLLGAFQASPPSFGKPFGQLLCVFLSCVLGFAVWLLNGLLWTWFFILRDPNHHHCKAELEKLPFVVCFRGVVVPWSRTP

SEQ ID NO: 212006 - protein, 65 aa, Glycine max
  Coding DNA Sequence Number=SeqID_95228
MGFHCFWCISIQPLLSSIIDTDEMPHTTLFKLHIFRSTTYLHLLAHLSSALFSLEKDSSHTGPRA

SEQ ID NO: 212007 - protein, 99 aa, Glycine max
  Coding DNA Sequence Number=SeqID_95229
  Homolog annotation: Hit_ID=Q1SN43; Match level="QueryCoverage=86%, HitCoverage=15%, E-value=3e-07, Identity=34%"; Hit description =Nucleic acid-binding, OB-fold, subgroup
MLGRLVLDRCRIKLCVIDNNDSTTFVIFETEATNLLEFACLDMCNKQERSSALPGMLPKDIFDLKDKSFIFKVDNKNVVHKSFDQSFKVKKGYTEVEMT

SEQ ID NO: 212008 - protein, 41 aa, Glycine max
  Coding DNA Sequence Number=SeqID_95230
MVPHFHLSSPSVQTARSHMGNESFGNGEKVGTRNYHASGYL

SEQ ID NO: 212009 - protein, 136 aa, Glycine max
  Coding DNA Sequence Number=SeqID_95231
MKAQVEKDESPEAETLSRLLIVGEGPGNPCGVYPDLSSFIGSGVYPDLSSFTGSGVIQKLYSLYQVIRPVSNCFHPSLSSAPLIVFLLYPKVSCLWVDIFQLNASYASVPTSDFPYYNYQHSTSSLFNIPPHHMEF

SEQ ID NO: 212010 - protein, 122 aa, Glycine max
  Coding DNA Sequence Number=SeqID_95232
  Gene Ontology: Mol. function=hydrolase activity
  Homolog annotation: Hit_ID=Q2HSN5; Match level="QueryCoverage=93%, HitCoverage=47%, E-value=9e-14, Identity=32%"; Hit description =Transposase
FSLLDFVGVRLTGMTIFVAFVYLEGGHLNNVVWALERFQGLFLKRDVLPGVIVTGRDLTLMNAVKTVFSECTNLLCRFHIDKNVKEICKSLVGQKHPWDYVMDAWESLVDCPSKDQFDDCLK

SEQ ID NO: 212011 - protein, 140 aa, Glycine max
  Coding DNA Sequence Number=SeqID_95233
  Homolog annotation: Hit_ID=O49543; Match level="QueryCoverage=24%, HitCoverage=7%, E-value=6e-10, Identity=85%"; Hit description =Cysteine desulfurase 1, mitochondrial precursor
  Subcellular localization annotation: CTP_CleavageSite=64; ConfidenceScore=5.07e-01
MTLKMLYDIDFSHSHADVTRFNWASLDNPKSQFFFYPRSFFHSHCRHRERKGGRRNVTRVGPPRTSKTTSILALMHELLGGPNCKEAVLKLNASDDRYVFMICSMVELTVQQVEKLREMSPLYEFVKEGINIKDIQWAQH

SEQ ID NO: 212012 - protein, 50 aa, Glycine max
  Coding DNA Sequence Number=SeqID_95234
MLDGTGEAGYASDCFRVAVQGVAVQVGVGWSRQHCLRDELISANGIGDIV

SEQ ID NO: 212013 - protein, 322 aa, Glycine max
  Coding DNA Sequence Number=SeqID_95235
FTRVWILRFIGGVLFVDKSSNKVSLSATDYKIKSIGGMSILIQMWAWERCTTLTPKRTPPVIEDKPLGHSGTYPIECCDKCPSQPLNIHGLTLKGKQDENYFQLLAPMISQWNNRAEFRVDVYPRQEGLLSFNSDYMIWYRRKTNMFVDPKNANTTTLGEVAETLQYMVSPQGRNTWTFDDHVPYVEKITILSEEQERITKPVAHGHHTDMSASEHSFGGVAETHPHFLWPTMIPSQQHDAPMATPNAPLASQWNVPRAIHDMGDLLGVDLHHEFSAEVEQVEAGRHHAEAILIVKREDGIDHVAHPHVIIDIIMNDFHVSI

SEQ ID NO: 212014 - protein, 234 aa, Glycine max
  Coding DNA Sequence Number=SeqID_95236
  Pfam annotation: Domain name=Transposase_23; Domain location=161-231; Score=4.7; E_value=0.00035; Accession=PF03017.5; Description =TNP1ENSPM transposase
DVLEKAQAIQKQNTAPHILSREAEKTKKKLEQAAQSGSIDGVIDPPSPVRCHVKWKMARTKKTGEMTTEAAKEIAEKIVTQGSFVPRGRQHVLTAAIGRPEHPGRIRAAGAGVTIKQYFGSTPRTSHKGLALPPEPLVGPSGPRVSTKRSCVDPSGNDPETGDSDRCGLYIEANPDRLVALGRVYEGSTIVHNTPLLPGQVKVGVEEVKDADAPVPVPTDEVSLVGQTIDTFLA

SEQ ID NO: 212015 - protein, 87 aa, Glycine max
  Coding DNA Sequence Number=SeqID_95237
  Gene Ontology: Mol. function=serine carboxypeptidase activity; Cellular component=peroxisome; Biological process=proteolysis
  Homolog annotation: Hit_ID=Q9LSV8; Match level="QueryCoverage=88%, HitCoverage=15%, E-value=1e-35, Identity=80%"; Hit description =Serine carboxypeptidase I
MFHVSGSGDHDMCVPYTGSQVWTRSVGYKIVDEWRPWSSNGQVAGYTQGYDKNLTFLTVKGSGHTVPEYKPREALDFYKRFLAGLPI

SEQ ID NO: 212016 - protein, 70 aa, Glycine max
  Coding DNA Sequence Number=SeqID_95238
MAEWLIAPVLKTGIVRNKELSRDLMSQLRGVMERTGSKSRSIPFSNPAAAARALPACHKWPTNRKNPRTK

SEQ ID NO: 212017 - protein, 164 aa, Glycine max
  Coding DNA Sequence Number=SeqID_95239
  Homolog annotation: Hit_ID=Q9C770; Match level="QueryCoverage=48%, HitCoverage=23%, E-value=2e-27, Identity=80%"; Hit description =Integral membrane protein, putative; 85705-84183
MANSRVRKRNSLCTMACYPTGNDDAGDEGEIGELGLALECHDVSEDNGEEGGAGVNGLVERHQKLAEGDIAKNDGDTEDETEGSDLEELEAVANGLHGDHLELGDDNIAKEGAGACYLVGNDDAGHFDDHEGAGGVEAGGWFIEEAHDGVVDDVGADGDAAVKF

SEQ ID NO: 212018 - protein, 81 aa, Glycine max
  Coding DNA Sequence Number=SeqID_95240
MADKIFQLLGASPTPWCCLRLIVLAKRPKCITLVVMGTTYMLQHGPHSRTKWFHRPFLTKSCANAIEAFHRALGGRMFRHK

SEQ ID NO: 212019 - protein, 63 aa, Glycine max
  Coding DNA Sequence Number=SeqID_95241
MAPSSLSIFLLIKEKYNDISGTAPVDEDLGHPKVRYADGENHEVILVDEVDALEVPVRKGDRR

SEQ ID NO: 212020 - protein, 196 aa, Glycine max
  Coding DNA Sequence Number=SeqID_95242
  Gene Ontology: Mol. function=RNA-directed DNA polymerase activity; Cellular component=chromatin; Biological process=RNA-dependent DNA replication
MKFLILTGEIVTVKVAPHSPIREPAMPHPTTVEGTQVMTEEEGSQIQTLTIYESNLGSEFDIVSQDDTSERGSKPIEELPSDMPGILLGIICIFPQAKPISQKKMKIGEERRKAVKEEVDKLLHANFIREVRFCTWLANAVMVKKANGKWRMCTDYTNLNRAYPKDVYPLPSINRLVDEASEFQVLTFLDAYFGYN

SEQ ID NO: 212021 - protein, 196 aa, Glycine max
  Coding DNA Sequence Number=SeqID_95243
MIKFDSMRGRLGHPGIASGGSNPARLGELGLPGQGNLYTNNDAILYHVFPTSLKGEALTWHDGLSLRFIDSFDTLVKQFSAQYTTSRSHRMTSVALASLRQVDDETLRKFMDRFGCTIIQIQKPPNSMDELREQVKGYIQMEECPDSGMKFVKLDRSEKHTPRPTYASRIRGTSLIIANLVKDNGSTNLEQPKAKT

SEQ ID NO: 212022 - protein, 221 aa, Glycine max
  Coding DNA Sequence Number=SeqID_95244
  Homolog annotation: Hit_ID=Q1SKD7; Match level="QueryCoverage=54%, HitCoverage=31%, E-value=1e-10, Identity=30%"; Hit description =Ankyrin
MAYETTWYVNEGHVGACRLTVWPKQLALGSTMVLGLHPEVGKFCPPCTRRCRDAPGEGSSAIIEFDSRRFWSAEHQQRFEAIKGWSFHRERHVQLREDEYPDFQEEIARRRWEPLVTHMAKFDPKIVIEFYANAWPNEEGVRDMRSWVSGHWIPFDADALSQFLGNPLILEKDQQCEFSQRRNQVRIMRTSMTTLTHIWMMLLFNNVLPSDHNSDLPLPKC

SEQ ID NO: 212023 - protein, 156 aa, Glycine max
  Coding DNA Sequence Number=SeqID_95245
MTENKRGYISCGSVLVDGTSTRVSKRIREEVDVIGPIFGQHRPRSVLTTRRHIFTADVTEHMMQHSLPLVLPPVAFSFLFGSQKIIPVQRGYGKRQQWKITMHDGVPSVAQPWFQYLSKINLMPGDEVIFFFRFDEHVWEVVFRKEVIREDEDLSR

SEQ ID NO: 212024 - protein, 173 aa, Glycine max
  Coding DNA Sequence Number=SeqID_95246
MENHRFISKSDSTKAKSNRKHIRQQKVHLDVQHSVHASLNPASSHTEDDYNQPKTPPHSVHATADRAPHDAEDHFNICDSSENETSGSAKAGIAAHDVQRYVKESDWAAQCTRQDKMSNEELKLQDPRCRIQCPGHPARKYWTHKSVISLTDCAGSTMSDTMSRTSCPKILDT

SEQ ID NO: 212025 - protein, 427 aa, Glycine max
  Coding DNA Sequence Number=SeqID_95247
  Gene Ontology: Mol. function=structural molecule activity; Cellular component=intermediate filament; Biological process=chitin metabolic process
  Homolog annotation: Hit_ID=UPI00006A17C9; Match level="QueryCoverage =98%, HitCoverage=100%, E-value=2e-51, Identity=35%"; Hit description= UPI00006A17C9 related cluster
GLHVLTFRGQHALTFRGPNILIFRGLHVLTFIVLHALALRGLHALAFRGLHVLTVRVLYVLTFRGLHVLTLRGLHTLAFRGLHALRGLHVLAFRGLHILTFRGLYAFAFVGLGVLKFRGLHVLAIRGLHVLAFKGLYALAFIGLHVPTLRGLHALAFRGLHALTVRGLHVLAFRGLHVLTFRGLHAFAFVGLGILKFRGLHVLAFKGLYVLAFRGLHDLALRGLHVLAFRGLHILTFRGLHAFSFDLASSKFRGLHVLAIRGLHVLAIRGLHVLAFKGLYALAFRGLHVLTLRGLHALAFRGVHSLTVGGLHVLAFRGLHVLTFRGLHAFAFEGLGVLKFRGLHVLPIRGLHVLAFKGLYALAFRGLHVLALRGLHALAFRGLHVLAIRGLYVLTFRGLHILNLRGLHVLAFRGLHTLAFSGLHVRT

SEQ ID NO: 212026 - protein, 132 aa, Glycine max
  Coding DNA Sequence Number=SeqID_95248
MKLDKYRLKVQVEKDEGLSGEGQSPRVEKDEGPSNPCGVYPDLSSFTGSGVYPDLSSFTESGVIQKPYSLYQTIRPSVNKLGMLWAVGALDWVLLECGTDNQDLANILNEWRDEDYRLHQDRELETTSRMLE

SEQ ID NO: 212027 - protein, 61 aa, Glycine max
  Coding DNA Sequence Number=SeqID_95249
MSVKNFVGRLGVHDKINHTLGDQSGSRCFVRMLQSRGIGTNLKEYSNRVYLPPRPTLRRVR

SEQ ID NO: 212028 - protein, 921 aa, Glycine max
  Coding DNA Sequence Number=SeqID_95250
  Gene Ontology: Mol. function=protein serine/threonine kinase activity; Biological process=protein amino acid phosphorylation
  Homolog annotation: Hit_ID=Q1T627; Match level="QueryCoverage=98%, HitCoverage=98%, E-value=0.0, Identity=67%"; Hit description=Protein kinase
  Pfam annotation: Domain name=Pkinase; Domain location=410-689; Score =281.8; E_value=1.3e-81; Accession=PF00069.15; Description=Protein kinase domain
  Pfam annotation: Domain name=Pkinase_Tyr; Domain location=410-689; Score=122.6; E_value=1.1e-33; Accession=PF07714.7; Description =Protein tyrosine kinase
  Pfam module annotation: Pfam domain module=Pkinase::Pkinase_Tyr; Domain location=410-689::410-689
MPSWWGKSSSTKKKANKESFIDAFHRKFKIPSEGKPSGRSGGSRRHCDDSISEKGAQSPPESRSPSPSKVGRCQSFVERPHAQPLPLPGLHPSNISRADSEISIPSSRRRHGKGSKSSLFLPLPKPACMRGRLNPAELDGDLVTASVSSESSADSDEPVDSHNRSPLATDCETGTRTAAGSPSSLMQKDQSSTVSQINSREAKKPANILGNHMSSTSPKRRPLSNHVTNLQIPPHGAFFSAPDSSRSSPSRSPLRAFGTEQVLNSAFWAGKPYPEVNFGGSGHCSSPGSGHNSGHNSMGGDMSGQLFWQPSRGSPEYSPVPSPRMTSPGPSSRIQSGAVTPIHPRAGGTPNESQTGRIDDVKPQSHRLPLPPLAVTNTLPFSHSNSAATSPSMPRSPGRADNPISPGSRWKKGKLLGRGTFGHVYVGFNKESGEMCAMKEVTLFSDDAKSKESAKQLMQEITLLSRLRHPNIVQYYGSETILVYSICLFSLLIETAKSSLKQVGDKLYIYLEYVAGGSIYKLLQEYGQFGELAIRSYTQQILSGLAYLHAKNTVHRDIKGANILVDTNGRVKLADFGMAKHITGQSCPLSFKGSPYWMAPEVVIKNSNGCNLAVDIWSLGCTVLEMATTKPPWSQYEGVAAMFKIGNSKELPTIPDHLSSEGKDFVRKCLQRNPHNRPSASELLDHPFVKCAAPLERPILGPESPSDPAPAVSGITQGATASGIGQGRNPSKLDSDRLSLHSSRFLKTNPHASEIHIPRNISCPVSPIGSPLLRPRSPQHMNGRMSPSPISSPRTASGASTPLNGGSGAIPFSNHLVYIQEGLGNLPKSSNGVYVSGPAHHDLNVDIFRGMQQTSHITSELVPSESDVLGKQFARTPHNEPYDVQSVLADRVCRQLLGDNVKINQCLDLSPNSLLSRANGL

SEQ ID NO: 212029 - protein, 75 aa, Glycine max
  Coding DNA Sequence Number=SeqID_95251
  Gene Ontology: Mol. function=oxidoreductase activity; Biological process=metabolic process
  Homolog annotation: Hit_ID=Q6RVV4; Match level="QueryCoverage=87%, HitCoverage=21%, E-value=1e-19, Identity=64%"; Hit description=Short- chain dehydrogenase Tic32
LVKIVRLFGVEKILGLMAKNVQQGASTTCYVALHPQVSGINGKHFADNNLAEVYSHGRDVDLAKKLWDFSINLTK

SEQ ID NO: 212030 - protein, 86 aa, Glycine max
  Coding DNA Sequence Number=SeqID_95252
  Gene Ontology: Mol. function=oxidoreductase activity; Biological process=metabolic process
  Homolog annotation: Hit_ID=Q6RVV4; Match level="QueryCoverage=85%, HitCoverage=23%, E-value=7e-20, Identity=64%"; Hit description=Short- chain dehydrogenase Tic32
MATKFSVNIPPYGLGAETARVLALRDVHVIMGVIDMIGAKTVKEAILKEVPTAKVDVMELDLSSMTSIRNFASKFNSYGLSLNILM

SEQ ID NO: 212031 - protein, 129 aa, Glycine max
  Coding DNA Sequence Number=SeqID_95253
  Gene Ontology: Mol. function=DNA binding; Biological process=DNA integration
  Homolog annotation: Hit_ID=Q1SKC8; Match level="QueryCoverage=80%, HitCoverage=25%, E-value=2e-35, Identity=67%"; Hit description =Integrase, catalytic region
MVYGKSCHLPVELEHKAYWALKFLNFDETASGEQRKTQLLVLEEMRWNAYESFRLYKDKIKAYHDKKMLKKEFRPGQQVLMFNSILKLFTGKLKSKWSGPSLSKRTHERAMRQANDVKRALTGRQPSPF

SEQ ID NO: 212032 - protein, 444 aa, Glycine max
  Coding DNA Sequence Number=SeqID_95254
  Gene Ontology: Mol. function=lipoxygenase activity; Cellular component=cytoplasm; Biological process=electron transport
  Homolog annotation: Hit_ID=Q93YI8; Match level="QueryCoverage=98%, HitCoverage=49%, E-value=1e-137, Identity=53%"; Hit description =Lipoxygenase
  Pfam annotation: Domain name=Lipoxygenase; Domain location=1-423; Score=440.7; E_value=2e-129; Accession=PF00305.9; Description =Lipoxygenase
MEHGRIFMLDHHDYLIPYLNRINANGVCAYASRTLLFLRSDGMLKPLTIELSLPGQYPHLEIHRVFLPAKQGTQAALWQLAKAHVLANDVVYHQLISHWLYTHAVIEPFIIATKRRLSVMHPIHRLLNPHFKDTMHINALARLILINSGGIFERILFPGEICMQISCDLYKEWRFKEQGLPADLLKRSMAVKDSDINNPTGIQLLLLDYPYATDGLEIWVVIKEWVKDFCSFFYKDNEAIEGDVELQAWWSEIRTNGHGDKHNDTWWYQLTTLSNLVEALTTLIWIASAKHASLNYGQHAYNGYPPNRPTLCRKFVPLEGRVEFGEFLKDPDKFFLGMLPNRFEMSLAVALVDVLSRHTSDEVYLGCQQSPGWIDNEVIQNRFAEFKQEIKEIQSRIMQRNRDLKLKNRRGPANIEYTLLYPDTSSSASTSGITGRGIPNSISI

SEQ ID NO: 212033 - protein, 398 aa, Glycine max
  Coding DNA Sequence Number=SeqID_95255
  Gene Ontology: Mol. function=lipoxygenase activity; Cellular component=cytoplasm; Biological process=electron transport
  Homolog annotation: Hit_ID=Q93WZ2; Match level="QueryCoverage=83%, HitCoverage=38%, E-value=8e-70, Identity=41%"; Hit description =Bacterial-induced lipoxygenase
  Pfam annotation: Domain name=Lipoxygenase; Domain location=176-398; Score=-337.0; E_value=0.014; Accession=PF00305.9; Description =Lipoxygenase
  Pfam annotation: Domain name=PLAT; Domain location=62-164; Score =40.8; E_value=4.6e-09; Accession=PF01477.13; Description=PLATLH2 domain
  Pfam module annotation: Pfam domain module=Lipoxygenase::PLAT; Domain location=176-398::62-164
  Subcellular localization annotation: CTP_CleavageSite=34; ConfidenceScore=5.31e-01
MNINGMPKKASSSVPKWQYSSSVTTKMLNNLNPICQATQQLTLKGKFVITHNHSKSIPGKLISVQIYSGTEVDPETGKGKLSEKACFKQCESMKHSHDAQTMIYKIKIHIDSHFGTPRAFLIQNKHKKKFFLQSASIETNDHIIHFDCNSWIYPIKKTKSDRLFFSNRCCLPSHTPRALVELRKEELDRLRGNGMGERKEWDRIYDYDCYNDLGDPDKGPEHLRPVLGGSRLFPYPRRGRTGRKHSTAGPSCESRPQPMNFDIYVPSDERFGPNKLKELKSNCVHAMVHFLSPKAEFLPRRISADFHSFEELLDMFSSNRNQTIEGWMRDNLKKLIPVEHLKEINHAMKENHGQLPIPQIISENEWAWKDDMEFGRQMIAGTHPTRIQCLTVLHTLMT

SEQ ID NO: 212034 - protein, 331 aa, Glycine max
  Coding DNA Sequence Number=SeqID_95256
  Gene Ontology: Mol. function=protein binding; Cellular component =integral to membrane; Biological process=xylan catabolic process
  Homolog annotation: Hit_ID=Q1SWI7; Match level="QueryCoverage=89%, HitCoverage=99%, E-value=1e-81, Identity=39%"; Hit description =Leucine-rich repeat
  Pfam annotation: Domain name=LRR_1; Domain location=146-168; Score =7.9; E_value=9.6; Accession=PF00560.23; Description=Leucine Rich Repeat
  Pfam annotation: Domain name=LRR_1; Domain location=170-192; Score =15.1; E_value=0.25; Accession=PF00560.23; Description=Leucine Rich Repeat
  Pfam annotation: Domain name=LRR_1; Domain location=194-216; Score =14.6; E_value=0.37; Accession=PF00560.23; Description=Leucine Rich Repeat
  Pfam annotation: Domain name=LRR_1; Domain location=218-239; Score =6.7; E_value=16; Accession=PF00560.23; Description=Leucine Rich Repeat
  Pfam annotation: Domain name=LRR_1; Domain location=25-48; Score =11.5; E_value=2; Accession=PF00560.23; Description=Leucine Rich Repeat
  Pfam annotation: Domain name=LRR_1; Domain location=50-72; Score =11.2; E_value=2.2; Accession=PF00560.23; Description=Leucine Rich Repeat
  Pfam annotation: Domain name=LRR_1; Domain location=74-96; Score =16.1; E_value=0.13; Accession=PF00560.23; Description=Leucine Rich Repeat
  Pfam module annotation: Pfam domain module=LRR_1::LRR_1::LRR_1::LRR _1::LRR_1::LRR_1::LRR_1; Domain location=146-168::170-192::194 -216::218-239::25-48::50-72::74-96
MITAFSSFCVLCSVLNFWSLKKTGQLISLDLGENNLSGCIPTWVGEKLSNMKILRLRSNSFSGHIPNEICQMSRLQVLDLAKNNLSGNIPSCFRNLSAMTLVNRSTYPRIYSQAPNNTRYSSVSGIVSVLLWLKGRGDEYRNILGLVTSIDLSSNKLLGEIPREITDLNGLNFLNLSHNQLIGPIPEGIGNMGSLQCIDFSRNQLSGEIPPTISNLSFLSMLDVSYNHLKGNIPTGTQLQTFDASSFIGNNLCGPPLPINCSSNGKTHSYEGSHGHGVNWFFVSATIGFVVGLWIVIAPLLICRSWRHAYFHFLDHVWFKLQSFSSYSITV

SEQ ID NO: 212035 - protein, 312 aa, Glycine max
  Coding DNA Sequence Number=SeqID_95257
  Homolog annotation: Hit_ID=Q1S7C5; Match level="QueryCoverage=28%, HitCoverage=7%, E-value=2e-13, Identity=43%"; Hit description =Integrase, catalytic region
MTLGVKSMHEYLSQITAIYDSLASVGSPIMLQEHIDSILEGLSSDYHSIIVIIESKFEPQPIIQVEVLLLTHETCLNKFKQSLSESPSINYTQAQTVPNKQEPESFSNFHGGSSHGGGFGGGFNSSGEKKGNPMPLFMRSLGLEMRMGMGCPVDLAGSSNRMDQIYSSKGHIQSPQHEKEAAHATWQGYQQNMHPRGMNSEFDYATKFVIDLIPLGEISNYNKIGLHGEARKKRPTQPHMADNAVRRKSQPRCTYKHVTAQMATKLPGTTMLILVMMSRKLIEKVVRAGNSAKHLNRRKRAAGMRHMARNED

SEQ ID NO: 212036 - protein, 84 aa, Glycine max
  Coding DNA Sequence Number=SeqID_95258
MKQDKEINGADGVNKFQSGEEEEDKEQCSPVSVLDPPFDDDDDGHDDDHEGDGFDLDCSYANVQTFYVVWSSSINMPSYTLLQS

SEQ ID NO: 212037 - protein, 1125 aa, Glycine max
  Coding DNA Sequence Number=SeqID_95259
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=94%, HitCoverage=69%, E-value=0.0, Identity=41%"; Hit description=Chromo
  Pfam annotation: Domain name=RVP_2; Domain location=344-459; Score= -36.5; E_value=0.0007; Accession=PF08284.2; Description=Retroviral aspartyl protease
  Pfam annotation: Domain name=RnaseH; Domain location=834-952; Score= -17.8; E_value=0.0026; Accession=PF00075.14; Description=RNase H
  Pfam annotation: Domain name=zf-H2C2; Domain location=1028-1069; Score=33.4; E_value=7.9e-07; Accession=PF09337.1; Description=His(2)- Cys(2) zinc finger
  Pfam module annotation: Pfam domain module=RVP_2::RVT_1::Retrotrans _gag::RnaseH::zf-H2C2; Domain location=344-459::591-809::102-192::834- 952::1028-1069
MADSHSHDASPRSLEDILLRLGDTMTSVTLKLDEILHRLSPTSPFPTPQPTPIPPPPNPVPATIHKMKLEVPQFDGTEPLGWIFKINQYFEYHGTPERDRLTIASFYMEGRALAWFQWMTSNAQFTSWPGFLQALQTRFAPSQYEDPTGALFKLTQKGSVGQYLSEFEDLANRIIGLPPPFILSCFISGLSPEIRREVQALQPLTLVQAAGLARLQEEKLADIRPSPRPRPPPPPQIIPHTNPNSQPSCAASLPPLLPAPPRQPPPVMKRLSPEEITSRRERGLCFNCDERYHRGHRCASRVFLLITEEEEPPLANIDPNNPQPEPITDPPDLPDPYPAHISLHSLSGHLAPETLRFEGTIRAHPLVLLVDGGSTHNFVQQPLVSQLGLPCRPTPPLRVLVGNGHHLECTTVCEAVPISIQNIEFLVDLYVLPIAGANIVLGVQWLKTLGPILTDYNSLSMQFFYQHRLVQLKGESAAQLGLLNHHQLRRLHQTHEPVTYFHIAVLTEPSSPTSPTPLPPPIQHLLAQFSTLFQDPQGLPPARETDHHIHLLPQSDPVNVRPYRYPHYQKNEIEHQVHLMLQKGLIQPSTSPFSSPVLLVKKHDGSWRFCVDYRALNAVTVRDRFPIPTIDELLDELGGAQYFSKLDLLQGYHQIQMHGPDIPKTAFRTHHGHYEFKVMSFGLCNAPSSFQATMNSIFRHHLRHFIIVFFDDILIYSNTFEAHIQHLTTAFQLQVEYLGHMVSKRGVEPVASKVEAVLHWPTPHSSRAVRGFLGLAGFYRRFIRGYATIAAPLVKLTTKDPFQWTPHAQSAFEDLKAALSSAPVLTLPNFQMPFTVETDASGVGMGAVLSQGGHPIAYFSKPFSPKLLRASAYIRELFAITAAIKKWRQYLLGQRFTILTDHHSLKELLTQVIQTPEQHMYLARLMGYDYTIQYRAGKHNQAADALSRLPEQGPSLLLILSVPSLTFLEELRRQLHNHPEYIQRRQELQQNPSNFPTFTISQDLILQKGRIWLPRELPITSTLLLEYHNTPAGGHAGIAKTLARISENFTWSGLREDVRRVVSNCLDCQMTKYEARKAAGLLCPLPIPCRPWEDLSLDFIVGLPPCQGHTTILVVVDRFSKGIHL

SEQ ID NO: 212038 - protein, 70 aa, Glycine max
  Coding DNA Sequence Number=SeqID_95260
GNTGSNKDRRKSLNVYQSHTVRGEKVASAQDFVGNQRERTTLGRGQGLTFSPWVKVYDKLGFWLKACRTA

SEQ ID NO: 212039 - protein, 188 aa, Glycine max
  Coding DNA Sequence Number=SeqID_95261
MVIPHPFVIQRRRVRWHAETNYGHSAPFCHPEATGPMTCGDKLWSFRTPFAIETQSCPMACGDNYGHSAHLLPFRQSRDRRHAETNYGHSAPFCHPEAAGPMTCGDKLWSFRTPFAIQTQSRPMAHKDKLWSFCALLSSRGGGPDDMRRQIMVIPHTFCHSDTVVSDGTQRQIMVILRPFVIQRRRAR

SEQ ID NO: 212040 - protein, 110 aa, Glycine max
  Coding DNA Sequence Number=SeqID_95262
MVACSGNACASRGCVQRRVGRRSPLGEHSEGVAASELAPEERRSRHLVMTSLPEPEMQFSPQHPVRRGLEWLLWSVRDKGDGEFSGAVGCNLKLILNLKLFLKRERRIWV

SEQ ID NO: 212041 - protein, 161 aa, Glycine max
  Coding DNA Sequence Number=SeqID_95263
  Gene Ontology: Mol. function=RNA-directed DNA polymerase activity; Biological process=RNA-dependent DNA replication
  Homolog annotation: Hit_ID=Q1RXD8; Match level="QueryCoverage=98%, HitCoverage=19%, E-value=4e-13, Identity=30%"; Hit description=RNA -directed DNA polymerase
GFLLSGVGLCSMTLVPYGNKSLIHSMEGGRVCARWVDKYASLWWRDVRKVCDDESVDRWFQKMREWKISDGHLTRFWEDSWFEEDKLASTFPRLYNNFLQQGECIGLMGSWSMEEWEWVFNWGRGWSAYAALHDMRFGTEEDDLLSKVWDLEILPKAKFMI

SEQ ID NO: 212042 - protein, 111 aa, Glycine max
  Coding DNA Sequence Number=SeqID_95264
MVELDQILHPEGTVMVKDTPKVIEKVARVAHAVSDMRGNNFTDTIPDNIGNCTNLQSCILELWKLKHLFEFVSGVNLLQLLSSKNLANNHLEGSIPLNISSCTTLNKLSGF

SEQ ID NO: 212043 - protein, 75 aa, Glycine max
  Coding DNA Sequence Number=SeqID_95265
MPHCFSMPHKENHDHEESSIYSSQEEATSSPSSSGNEGESKGDEHIEKVYPYEEGDLLMGNYISDIKAVRPMKTG

SEQ ID NO: 212044 - protein, 214 aa, Glycine max
  Coding DNA Sequence Number=SeqID_95266
MQERHIIFNSGAEGRVNERNSIPFKLPVRVRESILWNSKFIRTADFVDTLAWSSCTRVTTIAGSLYLIWHISGSTARDKKQRRLNLVLVMQLLLIMWLLNPQLLPQNQSPILMHKKKHSILIHKAVTIAAKNSKELKRRKKKQKVVMVTGSSTGTSLISILEKGKLLNSERGKEDEVEVDKEGLKLGEEHELASRLICMAMSLLERAGDTLVTA

SEQ ID NO: 212045 - protein, 83 aa, Glycine max
  Coding DNA Sequence Number=SeqID_95267
MECLIYDLGKKVWTSKGEEKEAAKKEFIEALKLLEEQLGDKTYFGGDNIGTHYLFSKHQFFIFANPPSVNTQYEVNKLITILL

SEQ ID NO: 212046 - protein, 106 aa, Glycine max
  Coding DNA Sequence Number=SeqID_95268
MGLNQAHSFKKRVSSSQGSARADEGRHGGHERANGHNDGSHDEYEKMLEVNTTTVIAASTAIEGGEALGSTGGPHFVQFQNKHSFPPYGLPPNIHHPMLHTLPMGI

SEQ ID NO: 212047 - protein, 302 aa, Glycine max
  Coding DNA Sequence Number=SeqID_95269
  Gene Ontology: Mol. function=protein phosphatase type 2C activity; Cellular component=protein serine/threonine phosphatase complex; Biological process=protein amino acid dephosphorylation
  Homolog annotation: Hit_ID=Q2QN36; Match level="QueryCoverage=90%, HitCoverage=70%, E-value=1e-104, Identity=71%"; Hit description =Protein phosphatase 2C family protein, putative, expressed
  Pfam annotation: Domain name=PP2C; Domain location=1-240; Score=59.3; E_value=1.3e-14; Accession=PF00481.12; Description=Protein phosphatase 2C
MPTVVVFSVILPQIEAREFATEQGGLSVDVIKKAFSATEEEFLHLVKLSMPISPQIASVGSCCLFGAISNNVLYVANLGDSRAVLGRRDTERKNSPVVAQRLSTDHNVADEEVRKEVEALHPDDSHIVVYSRGVWRIKGIIQVSRSIGDVYLKKPDFYRDLGFQQFGNPIPLKRSVMTAEPSIIIRELESEDLFLIFASDGLWEQLSDEAAVQIVFKHPRAGIAKRLVRAALHEAAKKREMRYDDIKKIDKGIRRHFHDDITVVVIYLDHHAGSSKQTAVGYTTAPVDIFSLNADGMLGTVA

SEQ ID NO: 212048 - protein, 680 aa, Glycine max
  Coding DNA Sequence Number=SeqID_95270
  Gene Ontology: Mol. function=binding; Cellular component=plastid chromosome; Biological process=positive regulation of transcription, DNA-dependent
  Homolog annotation: Hit_ID=Q6ZLH4; Match level="QueryCoverage=98%, HitCoverage=85%, E-value=0.0, Identity=53%"; Hit description =Putative pentatricopeptide (PPR) repeat-containing protein
  Pfam annotation: Domain name=PPR; Domain location=101-136; Score=6.6; E_value=1.2; Accession=PF01535.11; Description=PPR repeat
  Pfam annotation: Domain name=PPR; Domain location=137-171; Score =39.8; E_value=9.6e-09; Accession=PF01535.11; Description=PPR repeat
  Pfam annotation: Domain name=PPR; Domain location=172-206; Score =45.9; E_value=1.4e-10; Accession=PF01535.11; Description=PPR repeat
  Pfam annotation: Domain name=PPR; Domain location=207-241; Score =48.6; E_value=2.1e-11; Accession=PF01535.11; Description=PPR repeat
  Pfam annotation: Domain name=PPR; Domain location=242-276; Score =49.7; E_value=9.6e-12; Accession=PF01535.11; Description=PPR repeat
  Pfam annotation: Domain name=PPR; Domain location=277-311; Score =39.1; E_value=1.5e-08; Accession=PF01535.11; Description=PPR repeat
  Pfam annotation: Domain name=PPR; Domain location=31-65; Score=10.6; E_value=0.41; Accession=PF01535.11; Description=PPR repeat
  Pfam annotation: Domain name=PPR; Domain location=312-346; Score =35.4; E_value=1.9e-07; Accession=PF01535.11; Description=PPR repeat
  Pfam annotation: Domain name=PPR; Domain location=347-381; Score =43.6; E_value=6.6e-10; Accession=PF01535.11; Description=PPR repeat
  Pfam annotation: Domain name=PPR; Domain location=382-416; Score =35.4; E_value=1.9e-07; Accession=PF01535.11; Description=PPR repeat
  Pfam annotation: Domain name=PPR; Domain location=417-451; Score=6.5; E_value=1.3; Accession=PF01535.11; Description=PPR repeat
  Pfam annotation: Domain name=PPR; Domain location=452-486; Score=9.2; E_value=0.6; Accession=PF01535.11; Description=PPR repeat
  Pfam annotation: Domain name=PPR; Domain location=487-521; Score =20.5; E_value=0.0062; Accession=PF01535.11; Description=PPR repeat
  Pfam annotation: Domain name=PPR; Domain location=522-556; Score =35.1; E_value=2.4e-07; Accession=PF01535.11; Description=PPR repeat
  Pfam annotation: Domain name=PPR; Domain location=557-591; Score =37.7; E_value=4e-08; Accession=PF01535.11; Description=PPR repeat
  Pfam annotation: Domain name=PPR; Domain location=592-626; Score =38.8; E_value=1.9e-08; Accession=PF01535.11; Description=PPR repeat
  Pfam annotation: Domain name=PPR; Domain location=627-661; Score=8.3; E_value=0.79; Accession=PF01535.11; Description=PPR repeat
  Pfam annotation: Domain name=PPR; Domain location=66-100; Score=40.6; E_value=5.4e-09; Accession=PF01535.11; Description=PPR repeat
  Pfam module annotation: Pfam domain module=PPR::PPR::PPR::PPR::PPR::PP R::PPR::PPR::PPR::PPR::PPR::PPR::PPR::PPR::PPR::PPR::PPR::PPR; Domain location=101-136::137-171::172-206::207-241::242-276::277-311::31 -65::312-346::...
  Pfam module annotation: Domain location=347-381::382-416::417 -451::452-486::487-521::522-556::557-591::592-626::627-661::66-100
GLGFNNKFDLALSLFDFIRTRNDRVSLLNGSVIAVIVSILGKTGRVSRAASLLHNLEADGFEVDVYGYTSLITAYANNKKYRDALKVFGKMKEVGCEPTLITYNAILNVYGKMGMPWAKIIALVQDMKCHGLAPDLCTYNTLISCCRAGSLYEEALDLFEEIKVAGFRPDAVTYNALLDVYGKSRRPKEAMEVLKQMESNSFRPSVVTYNSLVSAYVRGGLLEDALVLKRKMVDKGIKPDVYTYTTLLSGFVNAGKEELAMEVFEEMRKVGCKPNICTFNALIKMYGDRGKFEEMVKVFKEIKVCKCSPDIVTWNTLLAVFGQNGMDSEVSGVFEEMKRSRFAPERDTFNTLISAYGRCGSFDQAMAAYKRMLEAGVSPDLSTYNAVLATLARGGLWEQSEKVLAEMKDGGCKPNEVTYSSLLHAYANGREVERMNALAEEIYSGTIKTHAVLLKTLVLVNSKVDLLVETERAFLEFRKRGISPDVTTSNAMLSIYGRKKMVPKANEILNFMYESGLTLSLTSYNSLMYMYSRTENFHKSEQIFREILDKGIEPDVISYNIVIYAYCRNDMMDEAKRIIEEMKVPAPVPDVVTYNTFIAAYAADSMFVEAIDVIRYMIKQGCKPNHNTYNSIVDWYCKLKLRDEACSFVQNLGDLDPQISEDEKSRLLERIAKKWSQVDP

SEQ ID NO: 212049 - protein, 208 aa, Glycine max
  Coding DNA Sequence Number=SeqID_95271
MAIHLMSRLSKGHKILLGCTKVHHFEATLDVHKNYIQVPLNYHINWYPKYPTYVVLKVNGDNSYFVRVRRFSAADKNTTFHVSFSTPAYRQLSATSPATTQRHVFTVDVDEDMLQQKKPLVLPPEASFQFHNINHCYRSNVERSSRRCCLWKINVENDVRTLADPWFQYLADNDFMSGDEVLFYYTFKKHGWDVLYRKQLIWDDDQSD

SEQ ID NO: 212050 - protein, 236 aa, Glycine max
  Coding DNA Sequence Number=SeqID_95272
  Subcellular localization annotation: CTP_CleavageSite=43; ConfidenceScore=5.72e-01
MTTTDAPTASTLVSPSIISNRPFRSNFLITSHFRFQSPRSLSRCTPVYSFQAVFHVDRNYIEVPRSYHKQWAPHYPAYVKIEYNGALHIIKVRKNGQQYYLADGLKQFRRNFNINEGVLPTCGRPPTTPRNYVFTVDVTDDIISKPTPLLLPTAAVHFVDASTPFMTVQHSSGVRDIWTISMHNGEQHVDDHWNRLLTDNDLMGGDEVIFYYRPNEHVWEIIFRKEPIWDEDDDST

SEQ ID NO: 212051 - protein, 528 aa, Glycine max
  Coding DNA Sequence Number=SeqID_95273
MVIDIESLEDRRHDVLPNSSILSSLFKAEVKKSNHEPCSMEILIDDLKDVDIAPLLDLCMNLDTSEIEAVDVRNESSSVLNGEYALSLMRAINQKLRVVHLQDSSFGKDFLRDISQRGLACQVLTLRCSRFRKLNLMGEFMHIHTLNLDFSSSLTSFQEDCFNCMPNLMRLSMCDTQITNLWTTVAALSKLPSLIELRFQYLQYCNDAVTSFIPSSGKSDDTADFSPLDSVPFIGEPHTDTTELTDPNFNAEDPLRNFYSFDEEVINPDVQSMVEDSSDDSEVGFTSRHHKYWFADVFPGWSSEVPLQNENEDGEESLQGAFTDRIADVSMKYMSCHASPICYEKHYREFMIASLPNLKNLDNMPIRKIDKERATRIFSQYFEYLPYKWKHKESVVSILQKREIKSGHNKVQSSKHRPSYPSGKSQYFYTRSLSAAKLGSSTWPILHPLSLVGCELDKGFHPRQFEYHPSDSSLMVFGTLDGEVVVINHETEHIVSYIPSLGAMNSVLGLCWLKKYPSKIILGSWYGY

SEQ ID NO: 212052 - protein, 75 aa, Glycine max
  Coding DNA Sequence Number=SeqID_95274
MDINIGGLCVVDDNNARWMRMGHVTMVKDEGGAVRSCGGLGWGWVWWWWTGVGSQEGGGDNFRSEEKGKRWGLNP

SEQ ID NO: 212053 - protein, 154 aa, Glycine max
  Coding DNA Sequence Number=SeqID_95275
  Gene Ontology: Mol. function=protein binding
  Homolog annotation: Hit_ID=Q5CTC1; Match level="QueryCoverage=77%, HitCoverage=30%, E-value=4e-13, Identity=37%"; Hit description=2x WD domain containing protein
MHRGHINVVKFANHSQSIFATSSFDHDVKMWDLRQKPIHPCFTVSSSRGNVMVCFSPDDQYILASAVDNEVVRQYQAVDGRLHLVFDIAPTESSQNYTRSYYMNGRDYIISGSCDEHIRICCAQTGRRLRDISLEGRNLGNSIFIQSLRGDPYR

SEQ ID NO: 212054 - protein, 123 aa, Glycine max
  Coding DNA Sequence Number=SeqID_95276
  Gene Ontology: Mol. function=oxidoreductase activity; Cellular component=membrane; Biological process=electron transport
  Homolog annotation: Hit_ID=Q8LF37; Match level="QueryCoverage=83%, HitCoverage=22%, E-value=2e-28, Identity=55%"; Hit description =Cytochrome P450, putative
MGSKKIVSKALLLIEDNAQRRRITDIISDIMCKRKEHFTMERYLLGHLLNYNDEKGQMLSDDQIADNVIGVLFEAQDITASVLTWIHKYLQDDHKLLEAIKVEKMGVYEANEGGNMPLTWGQT

SEQ ID NO: 212055 - protein, 150 aa, Glycine max
  Coding DNA Sequence Number=SeqID_95277
MEYQSFGRVPTAKGANIMQALKVKHSTNNTENYSDQTKLDEGHGVLLLGEKKMPSRLDEMAFPDSGNADFAAEAKESSNGRNDESDGAKEDKAQQELLRQKYRKMCRKRLHTAQTIELGQEAEAGTIIPPTTLAYKPKVYAYIFGAIYNP

SEQ ID NO: 212056 - protein, 49 aa, Glycine max
  Coding DNA Sequence Number=SeqID_95278
DFNMSVLAAYMQPGSKSKIVKINLLASSSHANKDDSDDLRPCRFHSMGG

SEQ ID NO: 212057 - protein, 89 aa, Glycine max
  Coding DNA Sequence Number=SeqID_95279
MGTSMSSGISNRHQVPTYVQASPVPMACEHQHLELPQHRPSHDHCPKECGARLWTPHKLFQRKLGEQNEKPQAQEEMCGSLLKPVQSIV

SEQ ID NO: 212058 - protein, 102 aa, Glycine max
  Coding DNA Sequence Number=SeqID_95280
MSNAMMEDVEQDRAWDLSLKEEPMEEHVEEKESKLNKFCIMSRGTIVQTSDDEFAQWCAPWKGSLVVHVWGTQGWLLDHAMASIPDLHLHAKVMHYTTLESL

SEQ ID NO: 212059 - protein, 59 aa, Glycine max
  Coding DNA Sequence Number=SeqID_95281
MKVVRGEEMRGGGCKEGYQRERMDFMRAVMRASELRAYDGALNFELRTISSRNPLENPR

SEQ ID NO: 212060 - protein, 158 aa, Glycine max
  Coding DNA Sequence Number=SeqID_95282
  Gene Ontology: Mol. function=ribonuclease H activity; Cellular component=nucleus; Biological process=DNA replication
MEFNGVVFKMVQFDVASVVEEAMRWVVGVVGVSKRLGLHENNWVKANSDGSVQLGEMGFQRLVIECDAQVVVQFLNHGVDADHLYVALAAIICESLSNDWEVRVNHVYREANVVGDFLASLTHNQELGVHVLSNPPTGFSMFLLSDVVRAPLTRFVRV

SEQ ID NO: 212061 - protein, 106 aa, Glycine max
  Coding DNA Sequence Number=SeqID_95283
MALLHGCHNEPCMQLYVFVSFMESTCTSSCRLQIKDFCCFFKVETPQKQHLCVHGFGEGENVECCIVGGWRGWWGLQGTRRRRVKKSNNGFELELLGGGNDNLMRQ

SEQ ID NO: 212062 - protein, 615 aa, Glycine max
  Coding DNA Sequence Number=SeqID_95284
  Homolog annotation: Hit_ID=Q9SEL1; Match level="QueryCoverage=59%, HitCoverage=84%, E-value=1e-146, Identity=82%"; Hit description=Seed maturation protein PM23
  Pfam annotation: Domain name=Thioredoxin; Domain location=73-177; Score=-16.1; E_value=0.0034; Accession=PF00085.10; Description =Thioredoxin
MDKGKIQEVIENQVLTVAQAVEDKIDDEIAALERLDADDIEALRERRLQQMKKMAEKRSRWISLGHSEYSEIPSEKDFFSVVKASERVVCHFFRENWPCKVMDKHLNILAKQHIETRFVKLNAEKSPFLAEKLKIIVLPTLALIKNAKVDDYVVGFDELGGTDEFSTEELEERLAKAQVIFYEGRKGKRPTFSIGEGGIYRVPRHGERREGRVGVGGCPPPSSWVWQPSPPLFLFSIATLTLTLILRSFAPPFPSPSPSLALNPVVPPFSFSLPLPTISPPTPRYPFLYNSLILRLILEFVSIASLHKSVLTELIQEIEPLDVSHIQKDVPPTTTDAMKRTISGMLGLLPSDQFHVVIEALWEPLSKLLISSMMTGYTLHNVEYRLCLEKNLDMFEGDIEKPKAESTKVDLQGLMHDSVNVIDFGRDKSLSSKVEKLHEDADIQELGDISAEALQYIFNLQSRLSSMKKELHEVKRKSAALQMQQFVGEEKNDLLDYLRSLQPEQVAQLSEFTSPELKDTILFVVHGLLATLSPKMHSKPSTISENTTVGATNVGNEDCAEVVENSAHQFQPTQVPITSAKELSLLTEEYCIPAMYQFSVSSSVRASVGSKMVGM

SEQ ID NO: 212063 - protein, 107 aa, Glycine max
  Coding DNA Sequence Number=SeqID_95285
MKLFSFPNLLHNFRNNDHNNITISRKYLSSWLRPRKEPKPLSRERLKEEYEIRDGRFKEEKAKQVGETRDGENEKEMKWCERGTYGVGVSNSAANGKGSARREKGSI

SEQ ID NO: 212064 - protein, 39 aa, Glycine max
  Coding DNA Sequence Number=SeqID_95286
MVAQVALERDWEVVLIPPHENLPVSEDIVNNKFKLSYKN

SEQ ID NO: 212065 - protein, 198 aa, Glycine max
  Coding DNA Sequence Number=SeqID_95287
  Gene Ontology: Mol. function=transition metal ion binding; Cellular component=cytoplasm; Biological process=electron transport
MGDHLEEMIRDLGQESFQQAHDLMYDTLQNDLKKPLYPGCKKSLTLLSAMLCLDNVKARYGWNDKRFTSLLQVVQDMLLEENTLPKGYYQAKKILCMMGMKYQKIHACPNDCILYRHEFEEMQTCPRCGVTRYKVKDDDECSSDESTKKGPLVKMGEIAMECSTIRLIPLYTNFRLTLNSIAMKSSLFWFFQALSSSL

SEQ ID NO: 212066 - protein, 110 aa, Glycine max
  Coding DNA Sequence Number=SeqID_95288
  Homolog annotation: Hit_ID=P48786; Match level="QueryCoverage=35%, HitCoverage=3%, E-value=2e-09, Identity=69%"; Hit description =Pathogenesis-related homeodomain protein
MLRSLGSSGRALRSRTKEQPKEPEPTSNLVDGNSNDGVKRKSGRKKKKRREEGITDQFSRIRSHLRYLLNRISYENSLIDAYSGEGWKGYRIRCPVTYLLQATTPFVAFG

SEQ ID NO: 212067 - protein, 191 aa, Glycine max
  Coding DNA Sequence Number=SeqID_95289
  Gene Ontology: Mol. function=nucleic acid binding; Cellular component= intracellular; Biological process=chromatin modification
  Homolog annotation: Hit_ID=Q1H8M0; Match level="QueryCoverage=65%, HitCoverage=63%, E-value=9e-29, Identity=53%"; Hit description=Cys2 -His2 zinc finger protein
MMITEDETTLTTGKEQQSEVMNGDKDNHGSEDGNPKEWLNLSIGGTSSLSTSGDTDSQARPPATAKVFSCNFCMRKFFSSQALGGHQNAHKRERGAARRYQSQRSMAIMGFSMNTPTMFRSLGVQPHSLVHKPRRGGGTMVTPGFHDANAHARLGMAWTPFSTEDQADMVWPGSFRLVPREPLKLDLGLRL

SEQ ID NO: 212068 - protein, 90 aa, Glycine max
  Coding DNA Sequence Number=SeqID_95290
MVELRSGFLKKRHRIAVVWRVKDGGRHIHGGHGGCGVEAEFGGIFFFLSAVGVRLTRPNPTRCNPSKLQHTARPRNPATTPATSHDSSHA

SEQ ID NO: 212069 - protein, 283 aa, Glycine max
  Coding DNA Sequence Number=SeqID_95291
  Homolog annotation: Hit_ID=Q015R4; Match level="QueryCoverage=89%, HitCoverage=36%, E-value=1e-18, Identity=28%"; Hit description=[S] KOG3224 Uncharacterized conserved protein
  Pfam annotation: Domain name=TIP41; Domain location=61-277; Score =244.2; E_value=2.8e-70; Accession=PF04176.4; Description=TIP41-like family
MELEVDENDLKAAGAELFAEGGRRGIRINGWLIETRRHSILNSSTFQEWEQKLDTSHLPEMVFGENTLILKHLSSGTNIHFNAFDALRGWKQEALPPVEVPAAAKWKFRSKPSQQVILDYDYTFTTPYCGSGTIEIDKDLNEGETSKETSDIHWEDCKDQIDVVALASKEPILFYDEVGKRAQVKESSLPLCSFLRIDHAVNLQRCNSLVKSAKVVLYEDELADNGVSLLTIKVLRVDGVLIRLRETRMHCVFGGSTNPIILRESCWRESTFQALSAIMDEVL

SEQ ID NO: 212070 - protein, 900 aa, Glycine max
  Coding DNA Sequence Number=SeqID_95292
  Gene Ontology: Mol. function=hydrolase activity, hydrolyzing O -glycosyl compounds; Biological process=tRNA aminoacylation for protein translation
  Homolog annotation: Hit_ID=Q339Q0; Match level="QueryCoverage=93%, HitCoverage=96%, E-value=0.0, Identity=50%"; Hit description=Large secreted protein, putative, expressed
VVGTALGLHSDAARLAATGMARGPKGEWVKDGERVMVRNTPQKYWWKPSLTNDEPPPRPLKVTFAEPATHWTDAIPIGNGRLGAMVWGAVPSEALQLNDIFFKFIEFVINNVNDTGPVDVVLNSFKIFVRIQLYGMRLESQLEVWDSEDTLWTGIPGDYTNKSAQQALAEVRKLVDDRKFSEATAAAVKLSGDPSDVYQLLGDIKLEFHDSHLNYSKESYYRELDLDTATAKIKYSVGDVEFTREHFASNPDQVIVTRLSTSKPGSLSFTVYFDSKMHHDSRVSGQNQIIIEGRCPGSRIRPIVNSIDNPQGIQFSAVLDMQISKDKGVIHVLDDKKLRVEGSDWAILLLTASSSFDGPFTKPEDSKKDPASESLSRMVSVKKISYGDLYARHLADYQNLFHRVSLQLSKSSKTVSGKSVLDRRKLVSSQTNISQMGGDDTIPTSARVKSFQTDEDPSFVELLFQYGRYLLISCSRPGTQVANLQGIWNKDVEPAWEFVFPSLFIPLLAIVFTGAPHLNINLQMNYWPSLACNLHECQEPLFDFISSLSVIGKKTAKVNYEANGWVVHQVSDIWGKTSPDRGEAVWALWPMGGAWLCTHLWEHYTYTMDKGRGGLLETNPSTSPEHMFTAPDGKTASVSYSSTMDISIIKEVFSMIISAAEVLGRHNDTIIKRVTEYQSKLPPTKVARDGSIMEWAEDFVDPDVHHRHVSHLFGLFPGHTISVEKTPDLCKAVEERMVQGGQQLGKLHFGHIFTIPDHERDFEGGLYSNLFTAHPPFQIDANFGLAEKKALFGVSFSGAVAEMLVQSTMKDLYLLPALPHDKWANGCVKGLKARGGVTVNICWKEGDLLEFGLWTENQNSKVRLHYRGNVVSASLSPGRVYSYDNQLKCAKTYSLSEVNP

SEQ ID NO: 212071 - protein, 114 aa, Glycine max
  Coding DNA Sequence Number=SeqID_95293
  Subcellular localization annotation: CTP_CleavageSite=66; ConfidenceScore=5.89e-01
MAFRSGSLSRSLMSTARASLRPAAPSSTLPRLRPPPLAAPRVQSRRFSMPASSCPMVPSVVLVKIASSLVVSLAAFFDVASLLDTTGSVLTGPGWGWRGATAWDGRRMRKGKGV

SEQ ID NO: 212072 - protein, 533 aa, Glycine max
  Coding DNA Sequence Number=SeqID_95294
  Gene Ontology: Mol. function=sequence-specific DNA binding; Cellular component=nucleus; Biological process=regulation of transcription, DNA-dependent
  Homolog annotation: Hit_ID=Q04996; Match level="QueryCoverage=82%, HitCoverage=69%, E-value=3e-62, Identity=53%"; Hit description =Homeobox protein HAT3.1
  Pfam annotation: Domain name=Homeobox; Domain location=391-445; Score= 37.4; E_value=5e-08; Accession=PF00046.19; Description=Homeobox domain
  Pfam annotation: Domain name=PHD; Domain location=57-112; Score=60.9; E_value=4.3e-15; Accession=PF00628.19; Description=PHD-finger
  Pfam module annotation: Pfam domain module=Homeobox::PHD; Domain location=391-445::57-112
MEKLKPEKELQRAKSEILRRKLKIRDLFRNLDSLCAEGKFPESLFDSAGEIDSEDIFCAKCQSKELSTNNDIILCDGVCDRGFHQLCLDPPLLTEDIPPGDEGWLCPGCDCKDDCMDLVNDSFGTSLSISDTWERVFPEAASFAGNNMDNNLGLPSDDSDDDDYNPNGSDDVKIEGDESSSDESEYASASEKLEGGSHEDQYLGLPSEDSDDGDYDPDAPDVDCKVNEESSSSDFTSDSEDLAAAFEDNTSPGQDGGINSSKKKGKVGKLSMADELSSLLEPDSGQGGPTPVSGKRHVERLDYKKLYEETYHSDTSDDEDWNDAAAPSRKKKLTGNVTPVSPNANASNNSIHTLKRNAHQNKVENTNSSPTKSLDGRSKSGSRDKRSGSSAHKRLGEAVVQRLHKSFKENQYPDRSTKESLAQELGLTYQQVAKWFDNTRWSFRHSSQMETNSGRNASPEATDGRAENEGEKQCESMSPEVSGKNSKTTSSRKRKHLSEPLSEAQLDINGLATSSPNVHQTQVGNKMKTRKRK

SEQ ID NO: 212073 - protein, 87 aa, Glycine max
  Coding DNA Sequence Number=SeqID_95295
MDKSLKVEEDEWREKERRSTKFCASNEWQLEESFPREESGSSLRKVVRRIIRKIPKRICGMFPHGSLAVKDLLNYQRISPFLYTVLP

SEQ ID NO: 212074 - protein, 162 aa, Glycine max
  Coding DNA Sequence Number=SeqID_95296
MVCRVRGTNLVEVESCSFEERDCKVSQDKMKKIGLVSSCKALGFFSSMPTNMTCWVEKEYDPWEDQQRKLMDFMDQDKKDVALMKLELAKKEATFVALSEKYEQPLAAKAIAEKDLDDAKSQLTLLEGEKTKLEKHLKDLSIFELQAKGFGEEVKAFKAKLG

SEQ ID NO: 212075 - protein, 276 aa, Glycine max
  Coding DNA Sequence Number=SeqID_95297
  Gene Ontology: Mol. function=transcription regulator activity; Cellular component=nucleus; Biological process=regulation of transcription
  Homolog annotation: Hit_ID=Q9LT67; Match level="QueryCoverage=79%, HitCoverage=78%, E-value=1e-36, Identity=45%"; Hit description =Similarity to ER33 protein
  Pfam annotation: Domain name=HLH; Domain location=135-191; Score=5.0; E_value=0.043; Accession=PF00010.16; Description=Helix-loop-helix DNA- binding domain
MEAKKEYEVDHLTTLTGTSFSQLLFGDDDDDYDESALGLAVDQSYTRSPLFSIHKAPQMLCFANHQNQGDVLLPETNVTPQKSVITSSDSSSASASSCNHTNTAFNSLPKSNSLQKKRNGMGQESVTKVGVGSQRQTKKNKAENPTSTGHAKRKEKLGERIAALQQLVSPFSKTDTASVLHEAMGYIRFLHDQVQVLCSPYLQSLPSSYHQNQHGDGVINEEEVNKDLRSRGLCLIPVGCTVHVAGSNGADFWSSAAIGNNVNFTISQAVKRNQDQ

SEQ ID NO: 212076 - protein, 44 aa, Glycine max
  Coding DNA Sequence Number=SeqID_95298
MSASCGRHCNKVSFAIQMSASSGRDCEKVSFAIRQTPSPVACSD

SEQ ID NO: 212077 - protein, 184 aa, Glycine max
  Coding DNA Sequence Number=SeqID_95299
  Homolog annotation: Hit_ID=Q71DJ5; Match level="QueryCoverage=24%, HitCoverage=11%, E-value=1e-07, Identity=58%"; Hit description =Triacylglycerol lipase 1 precursor
  Pfam annotation: Domain name=Abhydro_lipase; Domain location=3-62; Score=-7.9; E_value=0.029; Accession=PF04083.6; Description=ab -hydrolase associated lipase region
MAKKVVASLFCFVTFQIQTKDGFLLGLQRVSSSSLGLGYDGERGPPVLLLLLHGLFMDLAMYDLAEMINYINSVTNAKLLVLGHPQGKMSFAAFTQPEIAEKADWKIKTAVKTPTSAVTARATVGSGVGTPKFCKSKYRNTAQGRKGGKSVQKEKHDTPQDTNKQDPLQNLVINHKAEGREERE

SEQ ID NO: 212078 - protein, 66 aa, Glycine max
  Coding DNA Sequence Number=SeqID_95300
  Subcellular localization annotation: CTP_CleavageSite=16; ConfidenceScore=5.18e-01
MSSSSLPWRKEVLTSSCSNSMSRVATWGNKTHMKVASDGFDSCSQSPQLVLNSNVEGAFEDPDQSH

SEQ ID NO: 212079 - protein, 136 aa, Glycine max
  Coding DNA Sequence Number=SeqID_95301
  Gene Ontology: Mol. function=hydrolase activity
  Homolog annotation: Hit_ID=Q8L9J9; Match level="QueryCoverage=51%, HitCoverage=27%, E-value=3e-14, Identity=57%"; Hit description =Probable carbohydrate esterase At4g34215
METNTLPNQQTPKTKRQIFILSGQSNMAGQGGGGIRDANNRKRWDGVVPPESRPDPSILRLSATLQWELANEPLHVDRQIICVIIQLKIDKSEELVKMTEENIKDSGWDSCATFPSRITPEVGERQRVNFLWIPSE

SEQ ID NO: 212080 - protein, 114 aa, Glycine max
  Coding DNA Sequence Number=SeqID_95302
MEMHGVVMKNEENRILGAGVTGGDNELFTQIILFWVVKALSNSNKKKSVSQQNGDSNHSHPSINNTTSSAFAASLHIMLGGWTRHAPLTPRRSYVFTGKDHHTSQLLANSNSGL

SEQ ID NO: 212081 - protein, 433 aa, Glycine max
  Coding DNA Sequence Number=SeqID_95303
  Gene Ontology: Mol. function=citrate transporter activity; Cellular component=integral to membrane; Biological process=citrate transport
  Homolog annotation: Hit_ID=Q70MT2; Match level="QueryCoverage=99%, HitCoverage=100%, E-value=1e-152, Identity=66%"; Hit description =Na+/H+ antiporter precursor
  Pfam annotation: Domain name=CitMHS; Domain location=5-368; Score= -52.1; E_value=1.7e-05; Accession=PF03600.6; Description=Citrate transporter
MALLFLIGYAVIIFEEYLGINKSGVGLLMAVGLWVIRSIWAPSTDIAVSELTHASAEVSEIVFFLLGAMTIVEIVDTHGGFKLVTDNITTQNPRLLLWVIGFITFFLSSVLDSLASTIVMISLLQKLVPLSEYQKILGGVVVIAANAGGAWSPIGAVTTTMLWINGQVSAVQTMKGLFLPSVISLVVPLVLMSLTSGVNGKEQRSLDVFASEPIAPRGQLVFSVSLGALIFVPVFRSLTGLPPYIGMLLGLGMLWIFVDAIHYGESERQKLKVPHALSRIDTQGALFFLGILLSVSSLEVAGILREIANYFDAHVPRCELIASAIGLISAVIDNVPLVAATMGMYDVSSFPQDSEFWQMIALCASTGGSILIIGSAAGVAFMGMEKVDFFWYLRKVSGFALAGYAAGIAAYLALHNLNIFQPTLAEVHFLSGS

SEQ ID NO: 212082 - protein, 97 aa, Glycine max
  Coding DNA Sequence Number=SeqID_95304
MNAVQHHELAVLNKQNEDTAQDHWTYQWFLNLRNFATCKKRKVSFSVIGKTHATENKKIEWSSQTADNRTLLEAMVPEWKPRRESVCEKPLSVLWSV

SEQ ID NO: 212083 - protein, 176 aa, Glycine max
  Coding DNA Sequence Number=SeqID_95305
  Homolog annotation: Hit_ID=Q9M7I9; Match level="QueryCoverage=49%, HitCoverage=59%, E-value=6e-15, Identity=53%"; Hit description =Stress enhanced protein 1
  Subcellular localization annotation: CTP_CleavageSite=36; ConfidenceScore=5.44e-01
MALVEAYASLSISSGGSISNSQLKCVAVARLFTPPKCSPTAHFPHRNFVATRPSFIVGSPLLIQRNHGRKAACKAIPVPIRCEQSTQQGNGLDVWLGRLAMVGFAVAITVEISTGKGLLEVYDTIVRVNVGNFKIQCVSKGTLARRIFAYPFTIAHIRAREGNGLHKKIWAYTSNH

SEQ ID NO: 212084 - protein, 117 aa, Glycine max
  Coding DNA Sequence Number=SeqID_95306
  Homolog annotation: Hit_ID=Q7X6G3; Match level="QueryCoverage=76%, HitCoverage=32%, E-value=7e-23, Identity=55%"; Hit description=Plant viral-response family protein
  Pfam annotation: Domain name=DUF716; Domain location=2-103; Score =25.9; E_value=5.3e-06; Accession=PF04819.3; Description=Family of unknown function (DUF716)
MEEGRKRRNIPVLYLHPIPVDLCNDIAIALQSLWFYQTAFVLYGPVMPSGCKLRENSVTCDSIDSEVWGELLANIQLFVAVLVVLVGTVASYGFAASRYGNSEVKNLHAIQAELDQD

SEQ ID NO: 212085 - protein, 253 aa, Glycine max
  Coding DNA Sequence Number=SeqID_95307
  Gene Ontology: Cellular component=intrinsic to vacuolar membrane; Biological process=vacuole fusion, non-autophagic
  Homolog annotation: Hit_ID=Q1S5D9; Match level="QueryCoverage=98%, HitCoverage=96%, E-value=9e-77, Identity=59%"; Hit description=SPX, N-terminal
  Pfam annotation: Domain name=SPX; Domain location=1-152; Score=69.3; E_value=1.2e-17; Accession=PF03105.10; Description=SPX domain
MKFDKILKRLIEQTLPHWRDKFLCYKILKKQLNVMCPEDGQALPQLNAKELDHFLNLLQLEIAKFNNFFVDKEEEYVIKLKEFQDRVVEAVDSNVDLMSLGREIVDFHGEMVLLENYSALNYTGMLCLVKIIKKHDKKTGALLRSPFIQSVVNQPFYEIDVLNKLVKECEVILSILFTNGPSSSISQDFMQNGFGSMSGNENKETVMQVPEELSEIKNMKNMYIQLTLSALHTLEQIRGRSSTVSMFPSSPNN

SEQ ID NO: 212086 - protein, 187 aa, Glycine max
  Coding DNA Sequence Number=SeqID_95308
MKILECPGTKFMNRWGDELDDHIGYSLWGSYWAKTARRYETLLSKAKIFQQIVNKTARRYETLLSKAKIFQQIVNKTGRSVGRNLEKTTEEERVDVEEDATQAKQRRKKRMDAPPSKAAPTQKHQPPTLVAPKETGVMENVSKRSAPKKQQKPSPSTKGKGQKPQQKSLSTTHHLRDLTETKSEDDT

SEQ ID NO: 212087 - protein, 125 aa, Glycine max
  Coding DNA Sequence Number=SeqID_95309
  Pfam annotation: Domain name=DUF1168; Domain location=11-124; Score =37.4; E_value=2.5e-09; Accession=PF06658.2; Description=Protein of unknown function (DUF1168)
MPNSVMFTSALWKIGRVMDIVLSVFLICFKLWFQQYRQMRRKEQDRLARMEVDYQKRKELAEFNLRREERLKAAEERTAKKRAKRQKKKQRKKEKKTKLNAGEQLQEKEDSSGDEDSDNDEEAAP

SEQ ID NO: 212088 - protein, 81 aa, Glycine max
  Coding DNA Sequence Number=SeqID_95310
MRDGGEQVYLGDSKTTAVLGKGKVLIELIYGKTLALSDMLHVPTIRVNLVSIALLMKGSIVYGGYSSNVGFFSPRVLGHLD

SEQ ID NO: 212089 - protein, 293 aa, Glycine max
  Coding DNA Sequence Number=SeqID_95311
MMAHHISIQRVNNPPFKMMLLLTPLYLMFNQFARRLQLFNSLKEAYEELRQYSLRKKSELSPILTWTMNEAKLQPKIDWTQFPLEVEEEEVTCPPSKHQEPYVTSKAFEKDPPTGIEVLPPPKWKQLHPKVFKPSSLTAQRKDVYKISSGAYIQKVSYDKDTICWFCKNVAQKIDPSSNDFLPPFLRPQHVNSSIQCLTLSLTKDNDATCTHMCRNVPFAGERGRGSRVRFPKEERGTESPPTFICGKRRKNRRKPVKNKILSSGFVFTLEEGRQKRGFCSYVPSFGEEIRPT

SEQ ID NO: 212090 - protein, 100 aa, Glycine max
  Coding DNA Sequence Number=SeqID_95312
MSTGKPRGGDFQMVPAPGTSKPPLPPAAASNAIVEYTPVSLKEEEEDLEVKLRRIIDNVPVRVSNTSGSSAGSGSGDFHQMLDHWFTAVVMRNVMMATRG

SEQ ID NO: 212091 - protein, 85 aa, Glycine max
  Coding DNA Sequence Number=SeqID_95313
MQRTPSRELHGRKHVEGYDSRTWFSFNVVLYLCSQVDDKVNPQGGVVEDLIVEDDATVVATVAIGGELPQEDPGGSMWKVVRRIL

SEQ ID NO: 212092 - protein, 79 aa, Glycine max
  Coding DNA Sequence Number=SeqID_95314
MAEVDEVQERIKADLEAMKEKMVTMMEAMMSMKKIMEVNAATVAATSAVAEVDPTPPSSLNQINHAILDMVGQRGKELG

SEQ ID NO: 212093 - protein, 485 aa, Glycine max
  Coding DNA Sequence Number=SeqID_95315
  Gene Ontology: Mol. function=monooxygenase activity; Cellular component=membrane; Biological process=electron transport
  Homolog annotation: Hit_ID=Q1WCN7; Match level="QueryCoverage=98%, HitCoverage=95%, E-value=0.0, Identity=69%"; Hit description =Cytochrome P450 monooxygenase CYP83G2
  Pfam annotation: Domain name=p450; Domain location=17-480; Score =393.7; E_value=2.7e-115; Accession=PF00067.12; Description =Cytochrome P450
MAIMTKKRKTSKKPTFPPGPRGLPFIGNLYQLDGSTLCLKLYELSKKYGPIFSLQLGSRPALVVSSPKLAKEVMKTHDLEFCGRPSLISTMKFSYNGLDMAFSPYRDYWRHTRKISIIHFLSLKRVLMFSSIRKYEVTQLVKKITEHASCSKVTNLHELLTCLTSAVVCRTALGRRYEEEGIERSMFHGLLKEAQELTASTFYTDYIPLVGGVVDKLTGLMGRLEKMFKVLDGFYQNAIDEHLDPERKKLTDEQDIIDALLQLKNDRSFSMDLTPAHIKPLMMNIILAGTDTSAAAVVWAMTALMKSPIVMKKAQEEIRNIFGGKDFIEEDDIQKLPYVQAVIKETMRIYPPLPLLLQRETIKKCSIAGYEIPEKTLVYVNAWAVHRDPETWEEPEEFYPERFLDSKIDFRGYDFELIPFGAGRRICPGINMGIITVELVLANLLYSFDWEMPQGMKREDIDTDMLPGLIQHKKNPLCLVAKKQG

SEQ ID NO: 212094 - protein, 166 aa, Glycine max
  Coding DNA Sequence Number=SeqID_95316
MAPLLWGRTQKIACHVFVMGKVDVYPGTTCMFYDIANGHKQINPRHDVKVYSFRNGNMALNLGQVSLPHDRFGTDVTSRKSTYKGFLLVKNYDHSYDRLMLLGIKYGRSMISGGMLVIVAGYRAEEAGSRVQPTEDLFFTSSNSVRTNGTRINLKILHGCFISVDA

SEQ ID NO: 212095 - protein, 80 aa, Glycine max
  Coding DNA Sequence Number=SeqID_95317
MDRKVKPFILSALLLLLFLHLQLLSGVEARPLEVRKLDSTTLRMWAMLHSGPSPGGKGHKSETEDAPIPRELKQSVPSPG

SEQ ID NO: 212096 - protein, 77 aa, Glycine max
  Coding DNA Sequence Number=SeqID_95318
MAAQVVPLMMEREVIAMIVDTLPVSYYEKMVGYMPSSFADLVFAGERIKMGLRRGKFDCLALTSKKPGANRENEKGE

SEQ ID NO: 212097 - protein, 88 aa, Glycine max
  Coding DNA Sequence Number=SeqID_95319
  Subcellular localization annotation: CTP_CleavageSite=34; ConfidenceScore=5.38e-01
MDTRLKSVSLLTLVLLASLFTPLLPVSEARPLFSSSPSKNCISIIREVNGVFRTLKSSGPSPGVGHRLKNLQNLGGMKDSGPSPGQGH

SEQ ID NO: 212098 - protein, 37 aa, Glycine max
  Coding DNA Sequence Number=SeqID_95320
MGSPPFSNGIYSIPSNFTQSQSAKAPKHQCMLAPPEQ

SEQ ID NO: 212099 - protein, 140 aa, Glycine max
  Coding DNA Sequence Number=SeqID_95321
  Gene Ontology: Mol. function=RNA-directed DNA polymerase activity; Biological process=RNA-dependent DNA replication
  Homolog annotation: Hit_ID=Q1RV13; Match level="QueryCoverage=99%, HitCoverage=32%, E-value=3e-21, Identity=45%"; Hit description=IMP dehydrogenase/GMP reductase
MGIPKYKKGRDKILQFKYLTYLSTTSSSTLIPPNLLLREFTFNPDAISKHLNKLLIATTLLILISPTKIGSYVYCNRLTSTYFSPTLKSKNKFSEVVYLIKPLSPSATMLIRKEAKGSRVFLLKSSLQYELHRRTTIDKD

SEQ ID NO: 212100 - protein, 106 aa, Glycine max
  Coding DNA Sequence Number=SeqID_95322
  Gene Ontology: Mol. function=protein transporter activity; Cellular component=type II protein secretion system complex; Biological process=protein secretion by the type II secretion system
  Homolog annotation: Hit_ID=Q9PD60; Match level="QueryCoverage=98%, HitCoverage=63%, E-value=1e-23, Identity=53%"; Hit description =General secretory pathway protein G
  Pfam annotation: Domain name=GSPII_G; Domain location=43-106; Score =11.3; E_value=9.5e-07; Accession=PF08334.2; Description=Bacterial type II secretion system protein
  Pfam annotation: Domain name=N_methyl; Domain location=19-42; Score =20.2; E_value=0.0073; Accession=PF07963.3; Description=Prokaryotic N- terminal methylation motif
  Pfam module annotation: Pfam domain module=GSPII_G::N_methyl; Domain location=43-106::19-42
MIASRRPIRLSFTAARNQSGMSLLEIIIVIVLIGAVLTLVASRVLGGADRGKANIAKAQVQTVASKVDNYQIDTGKLPGSLNDLVTAPAGAGGWLGPYAKPADLND

SEQ ID NO: 212101 - protein, 104 aa, Glycine max
  Coding DNA Sequence Number=SeqID_95323
MAAGKLQSFAFIVIILSFSSWVKIQHGMARPLNTLVLHRDADQEPIRRAILESSHTVVRSSKINVGDIDAQKNTIRKLVVDNSGPSPDGPGHKGLLTSYSQLNN

SEQ ID NO: 212102 - protein, 89 aa, Glycine max
  Coding DNA Sequence Number=SeqID_95324
MARKFQCFAFFLIFLSFSWLCIQQGMPRPLDTFVLHKDANEKPKSTFLKASHVDAVVVKGSIVEGYAKKNINSSGPSPCGPGHCPKLNN

SEQ ID NO: 212103 - protein, 83 aa, Glycine max
  Coding DNA Sequence Number=SeqID_95325
MQGPMDNDHDSLVRESYHIPAKTQQALGQSGGIVEAQLIDNLERAKVNVNNSFNINRDVGTPPAESHRNYINNVVDIGTSICN

SEQ ID NO: 212104 - protein, 91 aa, Glycine max
  Coding DNA Sequence Number=SeqID_95326
  Subcellular localization annotation: CTP_CleavageSite=63; ConfidenceScore=5.30e-01
MLKLWIALRLGVSFPSASSSLYRVQGFTVGFLRAKLGVGAKPGVRAKPEVCAKPRVHAKPRVCAKLEVCAKPGVHAKRAVQFFQLFFKVFS

SEQ ID NO: 212105 - protein, 251 aa, Glycine max
  Coding DNA Sequence Number=SeqID_95327
  Homolog annotation: Hit_ID=UPI0000D661A7; Match level="QueryCoverage =89%, HitCoverage=55%, E-value=5e-09, Identity=24%"; Hit description =PREDICTED: similar to Nucleosome binding protein 1 (Nucleosome binding protein 45) ...
  Homolog annotation: Hit description=(NBP-45) (GARP45 protein)
MLIKIVKSFNVEVHRQKGNIQILDSGLSLSGSRHSQLKKDNIQILDSGPSPDGSGHPQLKKGNIQILDSGPSPSGSGHLQLKKNNIQILDSGPSPNGSRHPQLKKGNIQVLESGSRHGGLGHPQLKKGNIQILDNASSPGGSGHPQQQKGCIRILDSGTSLGGSGHPKQQKCNIQVLESGPSPSGSGHPQLKKGNIQILDNGLSPGGLGHPQQQKDNIQILDNSPSPHGSWHPQLKQGSIQILKNGSNVSE

SEQ ID NO: 212106 - protein, 138 aa, Glycine max
  Coding DNA Sequence Number=SeqID_95328
  Subcellular localization annotation: CTP_CleavageSite=49; ConfidenceScore=5.65e-01
MASSPASPPPPPPDASASPSGVKRTRKASRLRSLSTRPAGAERPVVHVDSATGKADGPHRKKLRTYLGIVARDKVDVMYENWKKAEFEIPEALDNRTKKSYLRLSARDGGSLNQTSRGNGPLQPIRTVWTTLSVRNMT

SEQ ID NO: 212107 - protein, 51 aa, Glycine max
  Coding DNA Sequence Number=SeqID_95329
MWTKKIARGNERGKQTFQMVRQSEVTMRVRACDDDDDGTRELRRKHSLGWD

SEQ ID NO: 212108 - protein, 104 aa, Glycine max
  Coding DNA Sequence Number=SeqID_95330
  Gene Ontology: Mol. function=transferase activity, transferring hexosyl groups; Biological process=metabolic process
  Homolog annotation: Hit_ID=Q1S5T6; Match level="QueryCoverage=70%, HitCoverage=16%, E-value=1e-20, Identity=66%"; Hit description=UDP -glucuronosyl/UDP-glucosyltransferase
MVFLLPCYGFNPVLSSPLTTATSTNCFEELEHDYINYLTKFVPTRTIGPLFKTPIATGTSEIRGDFMKSDDCIEWLNSRAPASVVYISFGSIVYLPQEQLERPC

SEQ ID NO: 212109 - protein, 243 aa, Glycine max
  Coding DNA Sequence Number=SeqID_95331
  Gene Ontology: Mol. function=solute:hydrogen antiporter activity; Cellular component=integral to membrane; Biological process =regulation of pH
  Homolog annotation: Hit_ID=Q9SIT5; Match level="QueryCoverage=91%, HitCoverage=26%, E-value=2e-65, Identity=56%"; Hit description =Putative Na/H antiporter
MEATNMAYRSINQYVLANAPCSVEILVDKGLSGSNHLAGNQVSHHVAVLFFGGPDDREALCYGWRMVEHHGISLTIMRFVQSDQVQVEPLRQQHGGIDLEEPRVLTVQTDRDIQKQHDEKLIHEFRMRCGDDDAVDYVEKVVSNGEDTVTTIRTMDDIHDLFIVGRGQGVISPLTAGLTDWSECPETGAIGDMLASSDFAATTSVLVVQQYVGDGSQYEGLETPYGEESTPLPPGHKMFTSEH

SEQ ID NO: 212110 - protein, 44 aa, Glycine max
  Coding DNA Sequence Number=SeqID_95332
MENKVDFKDNKSVDPEKYTFSLTGRKPISLEEKRKLGEGYIPLL

SEQ ID NO: 212111 - protein, 83 aa, Glycine max
  Coding DNA Sequence Number=SeqID_95333
  Homolog annotation: Hit_ID=P16181; Match level="QueryCoverage=42%, HitCoverage=22%, E-value=3e-08, Identity=77%"; Hit description=40S ribosomal protein S11-1
MEFVFVEFVSATYRLSSKKTRKGKSLEKGGNRFWKSIGLGFKTAREAIEGFKYLPTILLCEDSVPLMVEAKDTNCLSCCSQFR

SEQ ID NO: 212112 - protein, 283 aa, Glycine max
  Coding DNA Sequence Number=SeqID_95334
  Homolog annotation: Hit_ID=Q1S322; Match level="QueryCoverage=61%, HitCoverage=86%, E-value=2e-55, Identity=63%"; Hit description =Uncharacterized Cys-rich domain
  Pfam annotation: Domain name=PLAC8; Domain location=60-159; Score =148.0; E_value=2.6e-41; Accession=PF04749.7; Description=PLAC8 family
MYPTVDEHEEVYAAHHRHPGYVLPVVVPPNYGPPQIPSYAPPYINNSVSVRGPVIRTQRWSTGLCRSTDDPGNCLVTCFYPCVTFGLIAEIVDKGNTTCTCAGAIYGTLLALSGLACLCSYYYRSKLRVQYDLPEAPCMDCLVHFCCETCALCQEYRELKNHGFDLSIVESSNLCYKSEIKQTLDQHIESGSLSSEINNSASQVDSPQPIITSPGNANALAVAALENKDLEFLVAQLGSDSHQSNNKNNSDGHDNSQISFRKVAENMSQLSCAYIASRLGKGD

SEQ ID NO: 212113 - protein, 51 aa, Glycine max
  Coding DNA Sequence Number=SeqID_95335
  Homolog annotation: Hit_ID=Q71DJ5; Match level="QueryCoverage=57%, HitCoverage=7%, E-value=2e-07, Identity=70%"; Hit description =Triacylglycerol lipase 1 precursor
MGGIYGVGYVDVDGKNCCFNESRVEFYLEQEPHPSSSKNLKHLFQSMLHYL

SEQ ID NO: 212114 - protein, 150 aa, Glycine max
  Coding DNA Sequence Number=SeqID_95336
  Homolog annotation: Hit_ID=Q9M7I9; Match level="QueryCoverage=99%, HitCoverage=100%, E-value=5e-23, Identity=46%"; Hit description =Stress enhanced protein 1
  Subcellular localization annotation: CTP_CleavageSite=24; ConfidenceScore=5.48e-01
MALVEASASLSISSGVARLFTPPKCSPTAHFPHRNFVATRPSFIAGGGTKELFELSLVIRRNHGRKAACKAMPVTIRCEQSTQEGNSLDVWLGRLAMVGFAVAITVEIATGKGLLENFGLTSPLPTVALAVTALVGVLTAVFIFQSASKN

SEQ ID NO: 212115 - protein, 367 aa, Glycine max
  Coding DNA Sequence Number=SeqID_95337
  Gene Ontology: Mol. function=citrate transporter activity; Cellular component=integral to membrane; Biological process=citrate transport
  Homolog annotation: Hit_ID=Q9LT68; Match level="QueryCoverage=81%, HitCoverage=82%, E-value=2e-39, Identity=53%"; Hit description =Similarity to Na+/H+ antiporter
MYWHVPKIRPETLHLLPFSLNKAHSNSFSQLKCALCIMEKCTLVCYKVIEAASYMLMLTLLFTLKMFEDSYQPKTDFLKAVAILAAAATGALTINHSWVATNQDLAMALLFVIGYAGIIFEESPAFNKSGVGLLMTAPSTDIAVSELTHASVEVSEIVFFLLGAMTIVEIVDAHQGFKVVTGNITTQNPRLLWMFIIIIIAPRGQLVFSVGLGALIFVPVFKALAGLPPYMGMLLGLCVLWILTDAIHYGESESLEAAGILREIANYLDAHVPSSELIASSIGLISALIDNVPLVADGNLIAFCAGTGGSMLIIGSAAGVAFMEDGKGGLLLVLTKGYAAGIVPYLALHNLNISLPTLAEVPFLSGS

SEQ ID NO: 212116 - protein, 202 aa, Glycine max
  Coding DNA Sequence Number=SeqID_95338
  Gene Ontology: Mol. function=carboxylic ester hydrolase activity; Biological process=lipid metabolic process
  Homolog annotation: Hit_ID=Q71DJ5; Match level="QueryCoverage=39%, HitCoverage=20%, E-value=1e-25, Identity=70%"; Hit description =Triacylglycerol lipase 1 precursor
  Pfam annotation: Domain name=Abhydro_lipase; Domain location=63-129; Score=44.4; E_value=4e-10; Accession=PF04083.6; Description=ab -hydrolase associated lipase region
MDGRTRKHYMIGVVRVASEVDAIQNNNKGWMRIQRFLATLAITVSILLGNGNPVQCFDGGSHQKQQHSLCEELIIPYGYPCSEHTIQTKDGFLLGLQRVSSSSSLRLRNDGERGPPVLLLHGLFMELALYDVAEMINYINSVTNSKIFVVGHSQGTIISFAAFTQPEIVEKVEAAALLSPISYLDHISAPLVLRMVKMHIDQ

SEQ ID NO: 212117 - protein, 41 aa, Glycine max
  Coding DNA Sequence Number=SeqID_95339
MALGATVIAWKKDRDGGRRKVLVGKWEKQHVGKGEGSREVE

SEQ ID NO: 212118 - protein, 144 aa, Glycine max
  Coding DNA Sequence Number=SeqID_95340
  Gene Ontology: Mol. function=acetylglucosaminyltransferase activity; Cellular component=membrane
  Homolog annotation: Hit_ID=Q9FLD7; Match level="QueryCoverage=57%, HitCoverage=23%, E-value=1e-10, Identity=38%"; Hit description =Glycosylation enzyme-like protein
MDKAFARFFSGGNDTNINEPIPVITLDQAYSSGVESVGDHGKTTIGDEVGLGDNSHIVEFLDGDVVGKGCSDGKGTNNGGGFTSKVRGEVGDVRHRGKGEVVDDSTIVTCSTKVMNLGWSGRKTCGDGDPSLRWLRGEWWCCGG

SEQ ID NO: 212119 - protein, 110 aa, Glycine max
  Coding DNA Sequence Number=SeqID_95341
  Gene Ontology: Mol. function=protein binding
  Homolog annotation: Hit_ID=Q8LDD9; Match level="QueryCoverage=96%, HitCoverage=36%, E-value=6e-24, Identity=43%"; Hit description =Putative leucine-rich repeat disease resistance protein
MEGGIVPEKELDRRVKVWRFESKEIEEGIGPKKLLSARSSVVRPQMKEVRRGSEHGSVVKFHEARHDQGVMEEGLIEALKALSAAMSEGEVCAWTRMQWKWMRVREMMVR

SEQ ID NO: 212120 - protein, 157 aa, Glycine max
  Coding DNA Sequence Number=SeqID_95342
  Gene Ontology: Mol. function=nucleic acid binding; Cellular component= endoplasmic reticulum membrane; Biological process=DNA integration
  Homolog annotation: Hit_ID=Q1T010; Match level="QueryCoverage=78%, HitCoverage=9%, E-value=1e-33, Identity=53%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MVEEPTKVVIEAFIDEPSDSSAVVIDDSDQGGVRKSQRARQPSSRLHDSTIGEEGELVHLALFAESESVSLEEAMNDTKWTDAMKEELKAIEKNNAWQLVPLPAKKKPIAVKWVYKVKKNLKGEISKYKARLVAKGFLQKAGIDFKEMFAPVARMET

SEQ ID NO: 212121 - protein, 64 aa, Glycine max
  Coding DNA Sequence Number=SeqID_95343
MVTQNNESNKFLLWDRECAELIGETADDANRVKIEQLVNLCCFWHDGDLDLKASPQALDKLLAH

SEQ ID NO: 212122 - protein, 46 aa, Glycine max
  Coding DNA Sequence Number=SeqID_95344
MTGVVIMIMIRMLVILRPTEQVPACKDVKTNNILLQKCLEKECQEK

SEQ ID NO: 212123 - protein, 48 aa, Glycine max
  Coding DNA Sequence Number=SeqID_95345
MASVQEWYQYGFILFFMVYGSVLVLMMDEGFYAFWEDSYVQSLTIHFL

SEQ ID NO: 212124 - protein, 292 aa, Glycine max
  Coding DNA Sequence Number=SeqID_95346
  Gene Ontology: Mol. function=metalloendopeptidase activity; Cellular component=proteinaceous extracellular matrix; Biological process =peptidoglycan metabolic process
  Homolog annotation: Hit_ID=Q6Z7S6; Match level="QueryCoverage=86%, HitCoverage=73%, E-value=2e-33, Identity=34%"; Hit description =Putative zinc metalloproteinase
  Pfam annotation: Domain name=PG_binding_1; Domain location=49-111; Score=58.3; E_value=2.5e-14; Accession=PF01471.9; Description =Putative peptidoglycan binding domain
  Pfam annotation: Domain name=Peptidase_M10; Domain location=141-291; Score=201.0; E_value=2.7e-57; Accession=PF00413.14; Description =Matrixin
  Pfam module annotation: Pfam domain module=PG_binding_1::Peptidase _M10; Domain location=49-111::141-291
MALNLLNLSILFFLLFIVNPFPFVEPRALQLPVFTKTLQNLRGVHKGQKANGVGELRSYLQHFGYLTNGDSSNDNFDNNVESALKHYQEFNHLRSTGVVDDETIKRMSLPRCGMPDIVTQPNANQLLVAPNNYSFFPGQPKWRKFALTYGHMSSVVLSNNFFSSVRAAKLRALQTWARVTNFTFTERAPPADIVYGFHRGDHGDGYPFDGPYGVLAHAFAPQNGRCHYDADEPWDFNGQNIDFETVALHECGHLLGLGHSNTRGSVMEATYAGQRRSLTQDDIDGIRALYQF

SEQ ID NO: 212125 - protein, 289 aa, Glycine max
  Coding DNA Sequence Number=SeqID_95347
MVYLDNNDDSNSATEHHTDHIAEATNRPRRVTVALESRYSYQLVRPALLYRSSLADAEHAPSLIANLARLDTSMANLVVAQTSMDSDLHASHLRLDALQASMLSKLDFIILKLDTMISRQGSLFPSSVQPPPPPPPLFSPSAQPPPSPPAPPSYASSYHPSQYPPPPRYHVPPPMAGQRDNPAIGIDSSTIDFPVSVWQHHRADINSQFQSIQLWPLSLRTNPHCYRKIPYDNGIFLLGDDVVAHRIRPCWIWILFATEILLCSVRHRRQRPPPHTPPPLKPPHPPSSP

SEQ ID NO: 212126 - protein, 107 aa, Glycine max
  Coding DNA Sequence Number=SeqID_95348
  Gene Ontology: Mol. function=oxidoreductase activity; Cellular component=membrane; Biological process=electron transport
  Homolog annotation: Hit_ID=Q2PEY1; Match level="QueryCoverage=95%, HitCoverage=20%, E-value=2e-35, Identity=67%"; Hit description =Putative flavonoid 3'-hydroxylase
MGPAPHQGLAALAQTHGPLMHLRLGFVDVVVASSASVAEQFLKIHDANFCSRPCNSRTTYLTYNQQDLVFAPYGPRWRFLRKLSTVHMFSAKAMDDFRELRQNFTEI

SEQ ID NO: 212127 - protein, 72 aa, Glycine max
  Coding DNA Sequence Number=SeqID_95349
MDEFDAQVAWLGAHPSPSRGDAHMAQEEGTSIDQIPEPSPAPVPEETQPSTPVTEAEQLIQDSSAASALDKN

SEQ ID NO: 212128 - protein, 187 aa, Glycine max
  Coding DNA Sequence Number=SeqID_95350
MHVAQLISDAIHYLQGSRPQDTQWTRRSLTGLWGFQLWLWASVSPTGCASPQQGIAPARHPVDPEESNRVLGFPALITRLCQFYGVPVAPKKFIRPPINRVFIKKYCAPQVGVGRDTTTAWGWPAAGNRRTAATSRAAQLIYQGWSIAYDLWLTSRQPSPKPKVRKSTRSVTDESSRVQLKTLKKRY

SEQ ID NO: 212129 - protein, 58 aa, Glycine max
  Coding DNA Sequence Number=SeqID_95351
GIIVLGNSQRSRQGQRQKPIKVLRDERKERLGSRPIGHHPLLSLGQTESVAAKQPNIL

SEQ ID NO: 212130 - protein, 77 aa, Glycine max
  Coding DNA Sequence Number=SeqID_95352
  Gene Ontology: Mol. function=oxidoreductase activity, acting on single donors with incorporation of molecular oxygen, incorporation of two atoms of oxygen; Biological process=electron transport
  Homolog annotation: Hit_ID=Q2DFW9; Match level="QueryCoverage=81%, HitCoverage=18%, E-value=5e-13, Identity=58%"; Hit description =Dioxygenases related to 2-nitropropane dioxygenase-like
MTAWRKITMTTALCQLLKLQYPLIQAPMAGVATPQLAAAVSNAGALGSISVGAVTPQQAADMIAHTKELTRGPINVN

SEQ ID NO: 212131 - protein, 128 aa, Glycine max
  Coding DNA Sequence Number=SeqID_95353
  Homolog annotation: Hit_ID=UPI00005F7DEF; Match level="QueryCoverage =36%, HitCoverage=11%, E-value=7e-17, Identity=80%"; Hit description =COG0477: Permeases of the major facilitator superfamily
MAGYAQGLDVQRQKRHHQAEGGAGEKAPYPGDEKVAFPVNGFCCRSHKCPLPKGDAFCRRQKDEGQNVKAGQRLETGGGGGGAKVSDLVVGHGVKRIFGQDGVQPRTLNALGQDHAACAGILAAGGDE

SEQ ID NO: 212132 - protein, 283 aa, Glycine max
  Coding DNA Sequence Number=SeqID_95354
  Gene Ontology: Mol. function=tetracycline:hydrogen antiporter activity; Cellular component=integral to membrane; Biological process=response to antibiotic
  Homolog annotation: Hit_ID=UPI00005F7DEF; Match level="QueryCoverage =99%, HitCoverage=68%, E-value=1e-121, Identity=82%"; Hit description= COG0477: Permeases of the major facilitator superfamily
  Pfam annotation: Domain name=MFS_1; Domain location=1-281; Score =43.1; E_value=9.5e-10; Accession=PF07690.6; Description=Major Facilitator Superfamily
  Subcellular localization annotation: CTP_CleavageSite=50; ConfidenceScore=5.27e-01
MWSGLLFSITFLFSAIAAPFWGALADRRGRKLMLLRSALGMAIVMVLMGMAQTVWQFLALRAVLGLLGGFIPNANALIATQVPRNRSGWALGTLSTGGVGGALVGPLIGGLLADLYGLRPVFYITAAVLFVCFVLTLLYVKEQFTPVQKRDMLHAKQVFASLKNPKLVLSLFVTTMIIQIATGSIAPILTLYVRDLAGATHNLAFISGLIASVPGVAALMSAPRLGKLGDRIGPERILVFMLIVSVLLLIPMAFVQTPWQLGVLRFLLGGGRRRAAAGGTDAV

SEQ ID NO: 212133 - protein, 71 aa, Glycine max
  Coding DNA Sequence Number=SeqID_95355
MYNYHEKGKAPNLESVLADFMTYQASSKGDCYSMQQQGTQFERDYSFADYQWESEWQPYYCGVPKLMTGLL

SEQ ID NO: 212134 - protein, 79 aa, Glycine max
  Coding DNA Sequence Number=SeqID_95356
NDVPKGKLYKVSEFQQTLSTITKQKRKHKREYESVDPTVMWLRMPPDSWVTVTKGRVVDKSRVFATTYPQFRDEELRST

SEQ ID NO: 212135 - protein, 82 aa, Glycine max
  Coding DNA Sequence Number=SeqID_95357
MYTYVLGTSSKLFESIQRLTNWNEENVTGLGGVDGDPMLRGTRIRATWGYVSLVEGGQLGMVGSCLICECGRVDLHHRPIAT

SEQ ID NO: 212136 - protein, 406 aa, Glycine max
  Coding DNA Sequence Number=SeqID_95358
  Gene Ontology: Mol. function=transferase activity, transferring acyl groups, acyl groups converted into alkyl on transfer; Cellular component=mitochondrion; Biological process=carboxylic acid metabolic process
  Homolog annotation: Hit_ID=Q2RUD3; Match level="QueryCoverage=95%, HitCoverage=71%, E-value=1e-145, Identity=67%"; Hit description =Yeast 2-isopropylmalate synthase
  Pfam annotation: Domain name=HMGL-like; Domain location=1-269; Score =266.3; E_value=6.1e-77; Accession=PF00682.9; Description=HMGL-like
MDNARKREFYQLLLQCGFKEIEVAFPSASQTDFDFVRTLIDEQLIPDDVTIQVLTQSRDDLIDRTFEALQGAPRAIVHLYNATAPMFRDIVFRQDKAATVALAVNGARRIRRQCEAQPDTAWCFEYSPETFCFTELEFALEICEAVAAVWQPGPQRPMIINLPATVEVSTPNVYADQIEWFCRHFSRRADVTISVHPHNDRGTGVACAELALLAGADRVEGCLFGNGERTGNVDLVTLALNLYTQGVAPGLDFSRLKQVVEVVELCNQLPVHPRHPYAGELVFTAFSGSHQDAIKKGFAAQRQDGWWQVPYLPLDPADVGCSYEAVIRVNSQSGKSGAAWLLEQNHGLALPRARDRRQRQGNERRAAVALIPRHLWAGGATALAAAELPDGKPRRRGLQLQCAGCL

SEQ ID NO: 212137 - protein, 101 aa, Glycine max
  Coding DNA Sequence Number=SeqID_95359
MTDRKRKSTCIVKKYKSFVKSKRIFWEQWTDAQSLVSGITEIRMDEFIELMKEHNLETSAMTNFARCFQIIIVTRALWNNMEVRPEIDTLTPKCVTPQIPR

SEQ ID NO: 212138 - protein, 200 aa, Glycine max
  Coding DNA Sequence Number=SeqID_95360
  Subcellular localization annotation: CTP_CleavageSite=32; ConfidenceScore=5.18e-01
MAEPSKKRKGTSSRSQRHSGSHEAPIPPSIPSGSLFSSEEQRTQYTNLFSSRSIADPKFIDMEFFSNENFECFQAFENSNLIPFMSLKLPVYSELVKAFYSNLEIHEDVLMSEIYGIKMVIDQSLFYDLTKLPSEGVPFEGALIDEWKFDFSMHDARRLVCTNQADMTGRLLAGSLAFESRILHYLIVRILLPRSSNLAQ

SEQ ID NO: 212139 - protein, 142 aa, Glycine max
  Coding DNA Sequence Number=SeqID_95361
MGSIDLNELFFVQQEFDAITKHLKEVDIAGMITIKNKLREITLPNMTSMCPHVDKVKTKDDDKGDDKKLKGQSKNEFKIFKIESRTLQDSRGKLISRIKNQDSRDQDFKNQDSRDQDSRLKIQESREGLIKISMKRFFSKIE

SEQ ID NO: 212140 - protein, 55 aa, Glycine max
  Coding DNA Sequence Number=SeqID_95362
MSPRNFVRGHLYAMEATSLRRRGKGSCVIQECDVGGNISFAPYVTSLFLYEVMLM

SEQ ID NO: 212141 - protein, 100 aa, Glycine max
  Coding DNA Sequence Number=SeqID_95363
MTITLNDVALLLDIPIIDPFYNCEHIDKEATILVLVELLGVEYKDAFDETKKIRGEQCNLCGGMLQVFIEASALTYLYEHLTSVSFAGTKQIGGYATLGY

SEQ ID NO: 212142 - protein, 155 aa, Glycine max
  Coding DNA Sequence Number=SeqID_95364
MSMRGIGGPLLCIGDLLNDVGEEEQQHGQGHSLLRETFPSSSNFNYNDPPPDLTKLFQVPFLFIPHSFISFEFEHYDHLNSALSGTDHSWTSLTLKLCTALETSNQLVQSTNTNVASLSKKVEDLQKIVKRGDSAIAAAKALYYVTPDNHSSASK

SEQ ID NO: 212143 - protein, 631 aa, Glycine max
  Coding DNA Sequence Number=SeqID_95365
  Gene Ontology: Mol. function=RNA-directed DNA polymerase activity; Cellular component=chromatin; Biological process=RNA-dependent DNA replication
MAEYNTRSQDFRKFEDSIKETLKEMSQNIKKIVDHVDGQETHISTLNHQNTVFMERMNQEAHHGGSSHGSGSFHRDRSYMAARQFFEIDGTPVEMKMKLASINLEGRALSWHQNFVRFQPKAEQLGKVSDYYYQFDYWVGRVQIFGEIALGIFLNGFKPPIQHHLRSFMPASVNQAYTLALLQETSLRTLQQEFSSNCRRPPLLPTPRTQHMNSSSTWKPTPKPFVDSKGKVVIDFDDRRSKGLCFWCDENYVKGHKCKKKELFVIEVTELNDVEGDQEGFVEETEEKEEDEGNPQISVYAINGVATKSYQTMRVTMTVNKKPLHILNDSGSTHNFLDVRVAKKLGCKVEEMGPMKVDVANGGNLKCMAICKGLTWTLQGTKIPLKEGVSTINVKPYRYSIVQKDVIKLMTKELLDVGLVQPNNSPFSSPIVLVKKKNGSWRMCIDYRDLNKSTIKDKYPILVIEELLDELHGSGWFSKIDLRSGYHQIRMYLTDVPKTAFRTHNGHYEFLVMPFGLTNSPATFQSLMNDMFKPFLRKFILVFFDDILIYSRSLKEHVQHLKCTFELLRNNHLLEKKSKCDFACRYVEFCIKALKIAMVTPPTLALPDFQEEFFIETDASNKGIGAVFVTP

SEQ ID NO: 212144 - protein, 87 aa, Glycine max
  Coding DNA Sequence Number=SeqID_95366
MASTSTNVTPPSPKTARLGAEMIKLGEQMRRMSYEDEERMESMRKENEESLGRIHRSSEALSARIENIERRREDMMRILKLPKYRDI

SEQ ID NO: 212145 - protein, 59 aa, Glycine max
  Coding DNA Sequence Number=SeqID_95367
MGMRMRQIGALRFWRVRGENQHDERGQRQQRGDEIESPGVAAGLLADHANHHRADKTAE

SEQ ID NO: 212146 - protein, 314 aa, Glycine max
  Coding DNA Sequence Number=SeqID_95368
  Gene Ontology: Mol. function=transcription factor activity; Biological process=regulation of transcription, DNA-dependent
  Homolog annotation: Hit_ID=Q3KIE0; Match level="QueryCoverage=96%, HitCoverage=84%, E-value=1e-17, Identity=33%"; Hit description =Transcriptional Regulator, RpiR family
  Pfam annotation: Domain name=HTH_6; Domain location=78-191; Score =32.6; E_value=1.3e-06; Accession=PF01418.8; Description=Helix-turn -helix domain, rpiR family
  Pfam annotation: Domain name=LacI; Domain location=112-137; Score =10.3; E_value=0.35; Accession=PF00356.11; Description=Bacterial regulatory proteins, lacI f
  Pfam annotation: Domain name=LacI; Domain location=35-60; Score=5.3; E_value=1.6; Accession=PF00356.11; Description=Bacterial regulatory proteins, lacI f
  Pfam module annotation: Pfam domain module=HTH_6::LacI::LacI; Domain location=78-191::112-137::35-60
MDIVWQLQQQSARFDAQESKLARFILDNLHASAQATMESLAAQAGVSPAVLQRFAASAGYRDLDDFLHQVRQAGQQESAFMTVIRQRQASLSQQEQRVARAILRDAAFAASATIEQLASRAEVSAATITRFARSVGCDDIRDLRMRLARASAEPASASHGAVPQLVSLHQALTQQWQQLDDSRWQQAAQALRQARSVLLIGAAGQHTPLVAEVQQRLSEAGLALAWIQDDNLLRLTLSRLQPDDLLLILAPDTINSSVLSAVHHAHIQQTPVMALCPAALDLASQANYWLPLPDAAPARRYGILLALDRLAAAL

SEQ ID NO: 212147 - protein, 305 aa, Glycine max
  Coding DNA Sequence Number=SeqID_95369
  Gene Ontology: Mol. function=hydrolase activity, hydrolyzing O -glycosyl compounds; Biological process=tricarboxylic acid cycle intermediate metabolic process
  Homolog annotation: Hit_ID=Q7CFV6; Match level="QueryCoverage=76%, HitCoverage=53%, E-value=7e-99, Identity=76%"; Hit description =Phospho-beta-glucosidase
  Pfam annotation: Domain name=Glyco_hydro_4; Domain location=72-305; Score=4.1; E_value=2.2e-10; Accession=PF02056.6; Description=Family 4 glycosyl hydrolase
  Pfam annotation: Domain name=Ldh_1_N; Domain location=71-237; Score= -29.9; E_value=0.0012; Accession=PF00056.13; Description =lactatemalate dehydrogenase, NAD bind
  Pfam annotation: Domain name=PTS_IIA; Domain location=1-96; Score =21.4; E_value=6e-07; Accession=PF02255.7; Description=PTS system, LactoseCellobiose specific IIA subunit
  Pfam module annotation: Pfam domain module=Glyco_hydro_4::Ldh_1 _N::PTS_IIA; Domain location=72-305::71-237::1-96
MLLLVQAGAARSAALSALRLARAGQFDAAQQQLAAARENVSSAHQQQTALISLDEGSGRLPVTLILEKTMLKIAIIGGGSSYSPELVEGIINRYAQLPVTELALVDVAAGREKVQIIADLTHRMLQKNGLEQVKVSVHFALDEAIRGARFVLTQLRVGQLAARAADERLGLKYGRLGQETTGVGGFAKALRTIPVMLEIARKVEQLAPDAFIINFTNPAGIVTEAVARYSNAKIIGLCNVPVNMHHMIAGMLQAPFDEVALRFAGLNHLVWVHQVLCRGEDVTAGVIEQLCEGQALTMNNIKEMP

SEQ ID NO: 212148 - protein, 362 aa, Glycine max
  Coding DNA Sequence Number=SeqID_95370
  Gene Ontology: Mol. function=oxidoreductase activity, acting on the CH-OH group of donors, NAD or NADP as acceptor; Cellular component =cytoplasm; Biological process=metabolic process
  Homolog annotation: Hit_ID=Q44471; Match level="QueryCoverage=96%, HitCoverage=96%, E-value=1e-154, Identity=77%"; Hit description =Probable tartrate dehydrogenase/decarboxylase ttuC
  Pfam annotation: Domain name=Iso_dh; Domain location=5-348; Score =323.3; E_value=4.4e-94; Accession=PF00180.10; Description =Isocitrateisopropylmalate dehydrogenase
MRNYKIAAIPADGIGPEVISAGIEVLQALTRHDEQLTFDVQTFDWGSDYYKQHGVMMPEDGLQTLKQFDAIYFGAVGAPDVPDHITLWGLRLPICQGFDQYANVRPTKILPGVTSPLRNRGPGDLDWVIVRENSEGEYSGNGGRAHRGLPEEVGTEVAIFTRVGVTRIMRYAFKLAQSRPRKLLTVVTKSNAQRHGMVMWDEIAAEVAQEFPDVQWDKMLVDAMTHRMTLHPQSLDTIVATNLHADILSDLAGALAGSLGVAPTANIDPERRFPSMFEPIHGSAFDITGKGIANPIATFWTAVQMLEHLGERNAAALIMQGIEHVCAAGILTPDVGGSATTADVTRALVQFIEAKSQVAATA

SEQ ID NO: 212149 - protein, 114 aa, Glycine max
  Coding DNA Sequence Number=SeqID_95371
MLSIPLGAQCHSLSIGIGLSASLGAQRLSHSVGIGLSAPLALTERLNVVIFKIPTGVTQCITIRGKLKMRLHCHQVSRRPIMTTDRPPLLMAHIDPGIGPSISMCVQGVGVMCL

SEQ ID NO: 212150 - protein, 291 aa, Glycine max
  Coding DNA Sequence Number=SeqID_95372
MARAPIFCNSSIMEGLFFILHYKHNTAEPFNFHWDSVPEGLPWVDVENLDKSINISPENQWSSTPGILQKEMPASKSVSSNSESKDCLDIEAPLAKVLDSFEQCNRDDGMCEQSSSLEEFILKDLEMVIGQFTERTRICFRDALYRLARNTEEQHVMLDQNEDLNIQKAIPHTDHNETMRSQDKKPMESATNNIDRIIANLMFKSMEFNIHHSPITSSTNSIQQVIESNNGLHGNSSKAMNMEEKFCYSHPQKLLVDAEIPRFGLSNQPRDTGSNITCEGPIKTSFMIGFD

SEQ ID NO: 212151 - protein, 722 aa, Glycine max
  Coding DNA Sequence Number=SeqID_95373
  Gene Ontology: Mol. function=RNA-directed DNA polymerase activity; Cellular component=chromatin; Biological process=chromatin assembly or disassembly
  Pfam annotation: Domain name=RVP_2; Domain location=340-464; Score= -56.8; E_value=0.027; Accession=PF08284.2; Description=Retroviral aspartyl protease
  Pfam module annotation: Pfam domain module=RVP_2::RVT_1::Retrotrans _gag; Domain location=340-464::536-706::105-195
MADATRSKVPSDRLEDAIVKLTTSQLAMNSKIDDLLHRMSQLEANQQPPQTLPSSSAGQTLPSYSLVHRMKLDVPRFDGSNPTGWTFKITQFFEFHSTPDQERLTIASFYMEGPVLAWFQWMHRNAQLSSWSAFLHTLHSCFATTTYEDPTGLLCKLQQRLSVTTYLSEFESLANRIVGLPAPFELSCFISGLSPSIRREVQVLHSISLAQVVSYARLQEEKLFDAHRPSSYRTPAPTAGATTTRSPSTNTTPSLLPTPVRTSTSIPFKRLTPEELVIRREKGLWFHCDEKFSRGHKCMSSLVLLVMEDDESAIDADQLRAPSPTPKLLPESPPAQLSLHALSGHLAPKTLRLKGFINNHPISILIDKGSIHNFLHNRVVLNLGLEPTETTLLRITMGNNKEIHCHQLCTVIKVHIQQHSFTIDFHVLPLCGADVVLGVQWLKTLGPVLTDYGALTMKFIAGGKLIELHRDREKEVEQVSPSQLRRFVHTNPASTFFHIRVEPTSNHTPQPGHSLLEITTLIAKYASLFQPLANLPPSRPIDHTINLLPNSAPVNVRPYRALNSITVHDGFPIPMVDELLDELGGAQWFSKLDLMQGYHQILMNTTDISKTAFRMHQGHYKFRVMPFGLCNAPSSFQAMMNQLLQPYLRKYIIVFFDDILIYSRTIHDHLLHLETAFKVLMAGQFSLKLSKCTFTQQKLEYLGHVVSGNKVTPVPNKVQAIQ

SEQ ID NO: 212152 - protein, 375 aa, Glycine max
  Coding DNA Sequence Number=SeqID_95374
  Gene Ontology: Mol. function=nucleic acid binding; Cellular component= chromatin; Biological process=DNA integration
  Homolog annotation: Hit_ID=Q1SRN1; Match level="QueryCoverage=91%, HitCoverage=23%, E-value=5e-76, Identity=45%"; Hit description =Integrase, catalytic region
MWQMARKARTYVDEDGKAGRDEKKSRKSHRLPSSSESVYTSLDLFPYYTFLKTFGCASFPLRRPYNNHKVDFRSAECLFLGYSTSHKGYKCMSSSGRIYISKDVIFNESKFPYADLFETSTSLSQSTSSSIPFQFPSIPIIQSPNLSHPTSNSPQTHTSLFPVISILLMLDSLHLFLHSPLLIISQFSLTLTYLFQLLVQHLVQFSPLVLNPRISLFLLLLLFVPAISSEATSSSINPTSPHRPLNTYPMQSRSKSGIHLPRINPTLMLAHCEPKSVKQALTDPNWLSAMQQEYEALMKNHTWDLVPLPPHRKPIVCKWVFRVKENADGSINKYKARLVAKGLNQVAGFDFSETFSPGVKPVTVRLISTLAITNQ

SEQ ID NO: 212153 - protein, 37 aa, Glycine max
  Coding DNA Sequence Number=SeqID_95375
MALRSKVFQQESQTNGKCQLAIVVQANCDLNGQDSAI

SEQ ID NO: 212154 - protein, 156 aa, Glycine max
  Coding DNA Sequence Number=SeqID_95376
  Gene Ontology: Mol. function=transition metal ion binding; Cellular component=chromatin; Biological process=cytoskeleton organization and biogenesis
  Pfam annotation: Domain name=Transposase_21; Domain location=1-139; Score=45.9; E_value=1.6e-18; Accession=PF02992.5; Description =Transposase family tnp2
MVILGTRQPGNDIDVYLSPLIEDLRKLWGERVDVFDGSQNEAFKLCAMVFCTINDFLAYGNLSGYSVKGHHACPICEENISYAQLKHRTKAVYTRHQRFLKPYHSYRRLKKDFNGSQEHEIAPIPLTGQQVLEWVEDIITIFGKTQKKLTIQTCIR

SEQ ID NO: 212155 - protein, 70 aa, Glycine max
  Coding DNA Sequence Number=SeqID_95377
MTIICLCVPSDTTVSGWRKDGEKVCGMAIICLRMSSGSPPLDDKRAQNDHNFPLRAIGHDCVWMAKRCAE

SEQ ID NO: 212156 - protein, 264 aa, Glycine max
  Coding DNA Sequence Number=SeqID_95378
  Pfam annotation: Domain name=Transposase_23; Domain location=134-204; Score=-8.1; E_value=0.0088; Accession=PF03017.5; Description =TNP1ENSPM transposase
MVEKTKKRLKEAAKSGSIEGIIDLPSPIRRHVKWKMARTKKTGQMTFETAKEITDRIESVTRIVRPPWTSGYPDCCHWATRAPGCVRAVGAGVTIKQYFGSELALPPKPEVGLSDPCVSTKESCVAPSGNDPGTGDSDKCGLYIEENPSRLVSLGRIYEGSTTVHNIPLLHGQVKIGVEEVKVAEALVPLPTDEVTLVGQILNTFLAWPTHLVKRLSEQTIVSPAKPPEIPDEEVDDPLYLMTLTIPQLFLKPLQVMWDATIYG

SEQ ID NO: 212157 - protein, 95 aa, Glycine max
  Coding DNA Sequence Number=SeqID_95379
MGGSGALFGEGHCFDNEIDTTGVFLNEVQDMAIQQHGPDVWEWTADPTGIVRMMQFSFFGPGLRTLRKASQNILITGAVVLDKLFCTSRGYNFGY

SEQ ID NO: 212158 - protein, 365 aa, Glycine max
  Coding DNA Sequence Number=SeqID_95380
MGSAFGWYGPLIDLSTTSSRIGDFVQLLVFVHRSFPVQCKSWKRGRDLTRTDIEVGDDTMPFFVVSLWQKQMGSMVSAGDVVLLQNLKIAKYGNAVEARTVQWSSLLCLVHPYQSLLSKAVEELVTGCRVGTTTKDKLRRVIKWVQQSRSTICNIKLQSNQTQKIEHLPRNWTVLEEEKPRDCFSLMEVSQLTTSCKAIVCASIGEIVPLHTSRTLGDTKKEKLYVWDESDYMPILVKNRAAEILFGNIKAGKVYSAYKEQMNNQNLGPRNDKDAIGRLAIDPRLSGEGLPSTSTLEVGKSLQLQEKHLPDKLNYYRVWLILLKMLLKQGKNGPLKLEIIVDPSLDIENGKFELVSATMPCFGTK

SEQ ID NO: 212159 - protein, 142 aa, Glycine max
  Coding DNA Sequence Number=SeqID_95381
  Homolog annotation: Hit_ID=Q6WIX2; Match level="QueryCoverage=75%, HitCoverage=40%, E-value=7e-09, Identity=41%"; Hit description=S1 self-incompatibility locus-linked pollen G211 protein
EGLTVEWLETTSTLVLSMSTSKCAFRRGCPNKWRAFEEVALLTCPYNLDFTMDNSNQSEVMKVDDSITAMDREEPISRSDLSETEIDPAFFPLTVCLLSTIPVALHAVGDPVCNQRFLCDESVDSLNGMHSAPLWKIVYSST

SEQ ID NO: 212160 - protein, 459 aa, Glycine max
  Coding DNA Sequence Number=SeqID_95382
  Gene Ontology: Mol. function=ribonuclease activity; Cellular component=cytoplasm; Biological process=electron transport
  Homolog annotation: Hit_ID=Q0WPN0; Match level="QueryCoverage=99%, HitCoverage=42%, E-value=1e-171, Identity=65%"; Hit description =Putative 3'-5' exoribonuclease
  Pfam annotation: Domain name=RNB; Domain location=1-343; Score=426.5; E_value=3.6e-125; Accession=PF00773.9; Description=RNB-like protein
DPSTATDLDDALSIEELPNGNYRVGVHIADVSYFVLPDTPLDSEAQFRSTSVYMLQRKLPMLPALLSENIGSLSPGGDRLAVSMLLDINLAGDVVDRWIGRTVIHSCCKLSYEHAQDIIDKAFDFEGSNFSEDGYPRVYGHFEWPDVIKSLKSLYEISNVLKQKRFTDGALRLENPKVVILFDENGVPYDSMLSERKESNFLVEEYMLLANRIAAEVICRAYPDGALLRRHPEPNMRKLREFMAFCQKHGLELNTSSSGQFHWSLEQIREKLKGDPVLYNILISFATRPMQLASYFCSGDLKDSENEWGHYALAVPFYTHFTSPLRRYPDIIVHRTLLATIEAEELYMKHQKALQGYKEVKVQKRCFTDISFDKIAAESMEGREALSAAAVKHSVPCAETLADIAAYCNERKLASRNVKDACDKLYIWFLLKKKEVLLSEARILGLGPRFMSIYIQKLA

SEQ ID NO: 212161 - protein, 513 aa, Glycine max
  Coding DNA Sequence Number=SeqID_95383
  Gene Ontology: Mol. function=ribonuclease activity
  Homolog annotation: Hit_ID=Q0WPN0; Match level="QueryCoverage=89%, HitCoverage=39%, E-value=2e-75, Identity=38%"; Hit description =Putative 3'-5' exoribonuclease
MRATVEGSMTERFDDGEKEKKKKRRSNRRSKQNPPSSSASEVNEAQGVSPESGKIGTPTHASPSFGSSLKQVNVCSPNEQGLSKSSNVAFNSMPPMHINEQVEPGDLRIVPMYDGGIDSKSFSEPTGCRGSSVINKNKDSVPCGQIGLSGQKNYFSPHWSVEAVEKALEKGDIFKALLHVNAHNRLEAYCKIDGMSTDVFIGGIPAQNRAVQGDIVAVKFDPLPLWTKMKGPNGSCNNTATLEGCNLLTEDKEVGGNICNGKAKVGAEYESAHCRSYPGQNKEDADQNSSYRSYPLPEKTMVYDDITSQGSTNHLDLHGMASHDSINGHHCAAPDSIKNNSCSGQSNALEKMCLLVNSFPSKRPTGRVVAIMERSPRREGIVGHINVKQWVSFRDTGKKDLKKNKNLISEHEYIQLTPTDPKFPNMMLLVRKLPNCIKKRMKSGDVTIEMDLVAAQIDDWVEESPFPEAHILRVFGRGGEVQTQLDAILFQNAICLSEFLPEALSCLPCVPWE

SEQ ID NO: 212162 - protein, 76 aa, Glycine max
  Coding DNA Sequence Number=SeqID_95384
MCPVVGFGPWLGLGKPLVEILPPGQLRGFCPLLAWLGSAVLGYGPDAKFRIGWPPPPPRDQFCCQDFANFGLRPVG

SEQ ID NO: 212163 - protein, 268 aa, Glycine max
  Coding DNA Sequence Number=SeqID_95385
  Gene Ontology: Mol. function=chitin binding; Cellular component =extracellular region; Biological process=chitin metabolic process
  Homolog annotation: Hit_ID=UPI000044A8F0; Match level="QueryCoverage =97%, HitCoverage=99%, E-value=5e-38, Identity=29%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MSSTSEDYMSSTSKDYTFSPLEDYMSLPYEGYTASPFEDYTPSPSEDYTGLHVLTFNRLQALAFRGLHVLTFKGLHVLAFSGLQALAFVGLHAPTLKGLLILTFRGLHVLTFSGLHALALTGLHVLTYRGLHNLAFRGLDALAFRGVHILPLRGLHALTFVGLHTLTFKGVHILNFRGLYIVAIRGLHILAFRGLHVLPFRGQHDLPFRGMQALALTGLHVLIFRGLHNLAFRGLDALAIRGVHILPLRGLHALAFVGLDTLTFKGVH

SEQ ID NO: 212164 - protein, 166 aa, Glycine max
  Coding DNA Sequence Number=SeqID_95386
MMSLTPHPLFYIDAIKTMLKHNDALHVDRFSGFLCCQRMPNVPGARIHIIDFCFVWTQPMPPYYHFVMPVPMVFILLESHSLSANVEMCSFGFYSSLKDIVATCPSLMSPCSILLETWVPLGMEMVNRMSEDEGEDLKEETLHMDDLSMDKKYPLTESEIMEEDSS

SEQ ID NO: 212165 - protein, 189 aa, Glycine max
  Coding DNA Sequence Number=SeqID_95387
MSTWEDLDDTSSDEDYEEANICLMVDIAFDEFELDQEDGILKNQEFKGQPQDVVKLHEEIRTLKTTLAKFVNGTDNLNKLLGYYRSSSEKSRNGYDGKVYVHDKDTIVCYFCEINLRRVQPTFMANIKGLKKIWVSKKKIILVANVLDCRKRMPIMVPRLWLLTTHDERKMYVPMPDSVSWWNNYFWRK

SEQ ID NO: 212166 - protein, 89 aa, Glycine max
  Coding DNA Sequence Number=SeqID_95388
MYQGLGRGVYHNKYRPTISQPQQLHHMRPRQPSRHKRLPNPVEQRNGNGHRGVKVEAINVDELAELEAMEKEDLGGQVGAGKARTIPMS

SEQ ID NO: 212167 - protein, 140 aa, Glycine max
  Coding DNA Sequence Number=SeqID_95389
MDKGDKTQIVAQLQGSECDVVCFIKRGVHQVKEEQTQSPHSFMNKNFNKTKDLKAKSLRLLAVRRTRRHHHLENKSREVCPKLLKLRIHLMMVLRKTPMERGSPSFRKRFTKYGEAKVTASGKIPQEECPKKRKIKTKAS

SEQ ID NO: 212168 - protein, 142 aa, Glycine max
  Coding DNA Sequence Number=SeqID_95390
MYGSKASQLVKEFASGEKGPYLHFPNISTIFIHLPILKERKGNLAALIIVRTYFGLSELLIFQFVTSPSLDGENDLIREVVAECTQHHLDFQSLIRKFHIACLNSWDVAYISVGQYHKGSIGFKMKSNMLSEPIVRLGSRLF

SEQ ID NO: 212169 - protein, 51 aa, Glycine max
  Coding DNA Sequence Number=SeqID_95391
MTNIVSCTFPGDVSVFRPRQRKSLICYLSDSKSGDVSVFRPRLQKCLICYP

SEQ ID NO: 212170 - protein, 51 aa, Glycine max
  Coding DNA Sequence Number=SeqID_95392
MLPTPTKERWASKRSPRKSAILVKKRSSRDIYGEPMLLRAGDHLMIEDKHR

SEQ ID NO: 212171 - protein, 82 aa, Glycine max; identical to SEQ ID NO: 156095
  Coding DNA Sequence Number=SeqID_95393
  Homolog annotation: Hit_ID=Q9SD67; Match level="QueryCoverage=53%, HitCoverage=5%, E-value=7e-12, Identity=77%"; Hit description=FtsH metalloprotease-like protein

SEQ ID NO: 212172 - protein, 134 aa, Glycine max
  Coding DNA Sequence Number=SeqID_95394
MRLKLRKKVISLGTRNQEGPKERTRASKGFEGLYRAAIVSSSSEEVKGNHPRVKGMILKDELKASLRSKRSLSQQLSETEGNMWAVIDECKEKLNLAATHEQRLEDEYAKISAESEARERVIDSWHQEATMWTD

SEQ ID NO: 212173 - protein, 81 aa, Glycine max
  Coding DNA Sequence Number=SeqID_95395
  Homolog annotation: Hit_ID=O23708-2; Match level="QueryCoverage=45%, HitCoverage=37%, E-value=2e-10, Identity=89%"; Hit description =Isoform 2 of O23708
  Subcellular localization annotation: CTP_CleavageSite=26; ConfidenceScore=5.31e-01
MAHPSKPSSHLLALMLASFKSSLKTLVMTGSCACSYVPLLTVFMFEGQISGKNIEIGIIGADKNFRVLTPAEIDDYLAEVE

SEQ ID NO: 212174 - protein, 563 aa, Glycine max
  Coding DNA Sequence Number=SeqID_95396
  Gene Ontology: Mol. function=hydrolase activity, hydrolyzing O -glycosyl compounds; Biological process=carbohydrate metabolic process
  Homolog annotation: Hit_ID=Q5BMA5; Match level="QueryCoverage=99%, HitCoverage=96%, E-value=0.0, Identity=61%"; Hit description =Putative endo-1,4-beta-xylanase
  Pfam annotation: Domain name=CBM_4_9; Domain location=11-169; Score =86.8; E_value=6.5e-23; Accession=PF02018.8; Description=Carbohydrate binding domain
  Pfam annotation: Domain name=Glyco_hydro_10; Domain location=216-507; Score=229.7; E_value=6.5e-66; Accession=PF00331.11; Description =Glycosyl hydrolase family 10
  Pfam module annotation: Pfam domain module=CBM_4_9::Glyco_hydro_10; Domain location=11-169::216-507
MANYDGAAFGVNIIENSNLANGTNGWFPLGNCTLSVGTGSPRIIPPIARDSLGPHESLSGRHILVTNRTQTWMGPAQMITEKLKLFLTYQVSAWVRIGSRSTGPQNVNVALSVDNQWVNGGQVEVADDRWHEIGGSFRIEKQPSKVMVYIQGPASGLDLMVAGLQIFAVDRHARFKYLRRQTDKYFSLAPMQIRKREIILKFSGLDSIGNLGTLVRVKQVQNDFPIGSCISRSNIDNEDFVDFFVKHFNWAVFGNELKWYWTEPQQGNLNYKDADEMLDLCQKNKIDTRGHCIFWDVDGTVQQWIKSLNKNDLMTAVQNRLNGLLTRYIGKFKHYDVNNEMLHGTFYQDRLGKDIRANMFKIAHQLDPSATLFVNDYHVEDGCDTRSSPEKYIQHVLDLQEQGAPVGGIGIQGHIDSPVGPIVCSALDKMGTLGIPIWFTELDVSSTNEYVRADDLEVMLREALAHPAIDGVMLWGFWELFMSRENSHLVNAEGELNEAGKRYLALKQEWLSHSHGYVDEQGQFSFRGFSGTYNVEVVTLAKKVTKTFVVDKGDSSLVVSIDL

SEQ ID NO: 212175 - protein, 98 aa, Glycine max
  Coding DNA Sequence Number=SeqID_95397
  Gene Ontology: Mol. function=DNA binding; Biological process=DNA integration
  Homolog annotation: Hit_ID=Q1SS72; Match level="QueryCoverage=100%, HitCoverage=6%, E-value=4e-35, Identity=65%"; Hit description =Integrase, catalytic region
MALQNFVDFSTNSANPYYLHPNENPALVLVSPSLTAKNYHTWSHSMHIALISKNKDKFIDGSLPKPPVSDPLYAPWIRCNTMVLAWIHRSISDSIAKS

SEQ ID NO: 212176 - protein, 103 aa, Glycine max
  Coding DNA Sequence Number=SeqID_95398
  Subcellular localization annotation: CTP_CleavageSite=46; ConfidenceScore=5.18e-01
DREALVNDPSLISAIPTSLFQLSSRAKRNLWAQLASITNLNYNMLSVMRESGRAQESRPCAKQDIRLLPGSTHNWHQAQIHLLALSAMVALSVISRFQRPFKA

SEQ ID NO: 212177 - protein, 117 aa, Glycine max
  Coding DNA Sequence Number=SeqID_95399
MNSTSFQGLENQKTLERFWYKEEEEELQRDFKACKGLIGKAKAFFLSLEFFLILELERFWYKEEEEELQRDFKACKGLIGKAKVFKIVVRKIDLEYKTKPCFYRLFMSGQEGHSEEL

SEQ ID NO: 212178 - protein, 154 aa, Glycine max
  Coding DNA Sequence Number=SeqID_95400
MADKVTLSHLETSRCLFPEFSGQDSGSFEALRLDEEPAAVPKEEKGRGSPPTWHVTGTELDSLYMRGRLTLEKVNAAINDMVSYAEANALLIVVPKKKLAENLWEKALEIRDIASMEGIKGKHSFLEADIKGPSLKLDNTGKAILIVSILVSNM

SEQ ID NO: 212179 - protein, 139 aa, Glycine max
  Coding DNA Sequence Number=SeqID_95401
MATGKQTVPGAGALNPSKGDRCGGFGYYQLDTNVGALGTINRVNSWELWMIEFLQPGGSTSSRAAATAVELQFALYWRNSEEARTDRPSQQLRSLNGEWDAPCSGALSAAGVVVTRSVTATLASADVRRCFCRYAPPRQ

SEQ ID NO: 212180 - protein, 70 aa, Glycine max
  Coding DNA Sequence Number=SeqID_95402
  Homolog annotation: Hit_ID=Q1SEE1; Match level="QueryCoverage=99%, HitCoverage=5%, E-value=1e-19, Identity=62%"; Hit description =Integrase, catalytic region; Zinc finger, CCHC-type; Peptidase aspartic, catalytic
MTLEEGKVKIEKFDDKDFSFLKMQIENYLYQKKLYQPLSGVKPYDMKQEEWNFLDQQTIGVIRLTLAKNV

SEQ ID NO: 212181 - protein, 217 aa, Glycine max
  Coding DNA Sequence Number=SeqID_95403
  Gene Ontology: Mol. function=sequence-specific DNA binding; Cellular component=nucleus; Biological process=regulation of transcription, DNA-dependent
  Homolog annotation: Hit_ID=Q5UL95; Match level="QueryCoverage=95%, HitCoverage=58%, E-value=4e-63, Identity=57%"; Hit description =Homeobox transcription factor KN3
  Pfam annotation: Domain name=KNOX1; Domain location=99-143; Score =80.2; E_value=6.6e-21; Accession=PF03790.4; Description=KNOX1 domain
  Pfam annotation: Domain name=KNOX2; Domain location=150-201; Score =101.3; E_value=2.9e-27; Accession=PF03791.4; Description=KNOX2 domain
  Pfam module annotation: Pfam domain module=KNOX1::KNOX2; Domain location=99-143::150-201
MEEYTNNHLSQNTSPRANLLYSLAGGSSVGNRHHQLIPFNTFHLQTGRSDHCFQPDQAPHPSVKTESNNSHLHYPLMRSNLHHMLHPQQGGSQSSNELEAIKAKIIDHPHYSNLLQVYMDCQKVGAPPEVAARFATVKENFEARQRSLVRSMETCKDPELDQFMEAYYDMLVKYREELTRPIEEAKDFMQRIESQLNTLCNGTVRIFSGILSFYLWE

SEQ ID NO: 212182 - protein, 121 aa, Glycine max
  Coding DNA Sequence Number=SeqID_95404
  Homolog annotation: Hit_ID=Q4VPF1; Match level="QueryCoverage=32%, HitCoverage=16%, E-value=7e-09, Identity=77%"; Hit description =Homeobox knotted-1-like protein KNOX2
  Subcellular localization annotation: CTP_CleavageSite=34; ConfidenceScore=5.12e-01
KWLLSSRSSAWGSISINSVSRPLLSLSSSDDEPMFSHLSSAQQHMSRIKFEVGKFDGTGDFGLWWHRDELQERIVATICLCLADEILCHVMDGVDICRMPMKEIRANEISETETAWSSSSS

SEQ ID NO: 212183 - protein, 251 aa, Glycine max
  Coding DNA Sequence Number=SeqID_95405
  Homolog annotation: Hit_ID=Q1RUD8; Match level="QueryCoverage=69%, HitCoverage=34%, E-value=3e-15, Identity=32%"; Hit description=IMP dehydrogenase/GMP reductase
MVAVLADLFDTFDRRCEKSSTRIICCLPALCVWLVSHLFLQDTRHPCLLQSHRSCAEKRRIDWDQLLASVGGRTINWFPRWKEGKEGVLFSCKGYPNIPLIGTRGCINYNPALAIRQLGYPMRGAPMEESMSPFLVRDFGAQNFKAIQRIHKAWETPLRKDQELRGIRNGIIGGYHEWLKVHIRGLDWLAKLKVVSEDSFEAPEEDEEVQALKNELGKAKLAKEKFKLAATHIWKGVCRITGKECNYRKSP

SEQ ID NO: 212184 - protein, 120 aa, Glycine max
  Coding DNA Sequence Number=SeqID_95406
  Gene Ontology: Mol. function=sequence-specific DNA binding; Cellular component=nucleus; Biological process=regulation of transcription, DNA-dependent
  Homolog annotation: Hit_ID=P46604; Match level="QueryCoverage=82%, HitCoverage=35%, E-value=2e-19, Identity=52%"; Hit description =Homeobox-leucine zipper protein HAT22
  Pfam annotation: Domain name=HALZ; Domain location=21-66; Score=48.0; E_value=3.1e-11; Accession=PF02183.8; Description=Homeobox associated leucine zipper
MVLTVYMILYIIVLVLMTKLKQTEVERELLKKCCETLTEENKMLEKELQELKSTKTSMGPFYMQLPVESLRICPSCERISGGNNGSSPTTALLEAPKAHKDQPFYKNNYTFTQSSAAFAS

SEQ ID NO: 212185 - protein, 54 aa, Glycine max
  Coding DNA Sequence Number=SeqID_95407
MAEISREPENFGTKEDDVGRGPRRGNKFEERKKHTHVILGCSLLGPWGTVKSTK

SEQ ID NO: 212186 - protein, 353 aa, Glycine max
  Coding DNA Sequence Number=SeqID_95408
  Gene Ontology: Cellular component=nucleus; Biological process =regulation of transcription, DNA-dependent
  Homolog annotation: Hit_ID=Q6UEI3; Match level="QueryCoverage=99%, HitCoverage=48%, E-value=9e-48, Identity=33%"; Hit description=Early flowering 3
MKRGKDDEKVMGPMFPRLHVNDTEKGGPRAPPRNKMALYEQFSIPSQRFNSGVLPLNPNISSNTVPPASSSLRTVPERNCVYPVHLPPQRPIHRAEKCNSRQSEGTNLSASLEQRKKVDEDDFRVPVYFHSRTGQCNDKSVESFNGKKLTPTGSRYFGGSISGQSDCERDPKQFGSSVVNMRKDVRSEIDVLPQVSTSKEQASMSVRSISTRENIHTLLRQAKVTPNREFQDCHVSKFNRLQQGETCLQLECGVESRSNDIGDNGCLVESARETDKGNAPTANQTSPADAINDTEHHDTRMGSPIQRGNLNESDNASKISMVENLSTVRISPDDVVGIIGQKHFWKARRAIAK

SEQ ID NO: 212187 - protein, 125 aa, Glycine max
  Coding DNA Sequence Number=SeqID_95409
  Pfam annotation: Domain name=Rick_17kDa_Anti; Domain location=75-111; Score=10.5; E_value=0.016; Accession=PF05433.5; Description =Rickettsia 17 kDa surface antigen
AVSAIQYRFFDANLYHGKTCDLVITQPLGQPPTNVIAQAGDADLCAVAIDAVKQAIDANTFPMRPAYLKEKIPAEAKGCLKGAVAGGVAGHLVHHGIAGAAAGCAVGHHMAAKKQKEAEQKQQQQ

SEQ ID NO: 212188 - protein, 115 aa, Glycine max
  Coding DNA Sequence Number=SeqID_95410
WLRAHVQGLDWLLSLRTAKREEVEAPEEDEEVQALRAELEQAQTIKERLKSAALNIRKENAELRDTNIATTKALERETKRARNKFRGALWGSNSELKLQREGKGPIASRQFDLEG

SEQ ID NO: 212189 - protein, 92 aa, Glycine max
  Coding DNA Sequence Number=SeqID_95411
MESKKEDRRSSDQINFRRGNHVQNKVMVQLWFGIRVKKPGGPFGPANKSYSEPHELIVIHASSTIESRAPGIDCLALFVYPPPSNLIRRPMN

SEQ ID NO: 212190 - protein, 124 aa, Glycine max
  Coding DNA Sequence Number=SeqID_95412
  Homolog annotation: Hit_ID=Q9LZ20; Match level="QueryCoverage=32%, HitCoverage=7%, E-value=4e-07, Identity=63%"; Hit description=Amino acid transport-like protein
  Subcellular localization annotation: CTP_CleavageSite=69; ConfidenceScore=5.24e-01
TYQGNPCGVYPDLSSFTGSGVYPDLSSFTGSGVYPDLSSFTGSGVYPDLSSFTGSGVIQKLYSLYQITRVMSKMTATTTKSISLKPLGRDGTVRRHLVEEILIVVPRYAVKHMVTVALESTDQR

SEQ ID NO: 212191 - protein, 37 aa, Glycine max
  Coding DNA Sequence Number=SeqID_95413
MVTMMAMTSPEICLDVTVVSSREEGGFCPKRSREAAL

SEQ ID NO: 212192 - protein, 50 aa, Glycine max
  Coding DNA Sequence Number=SeqID_95414
MGKTKVAILLLWVLLALCIRLQLTVEARASSPLERQIEAKLKQPTKILPY

SEQ ID NO: 212193 - protein, 60 aa, Glycine max
  Coding DNA Sequence Number=SeqID_95415
  Subcellular localization annotation: CTP_CleavageSite=35; ConfidenceScore=5.29e-01
MASSQVVIMTAMAVLLAVVSAAHAADAPAPSPSSPASVISPSFAVGFLTAAVALVFEIEA

SEQ ID NO: 212194 - protein, 87 aa, Glycine max
  Coding DNA Sequence Number=SeqID_95416
MPVVVDGPDDGIVFTLYRDLSTKDYKLLLTDKLSLITREETRVLLVSPGAWLCDLTLERYEVREKKISKKQRPRGLKAMGNMDSDSE

SEQ ID NO: 212195 - protein, 149 aa, Glycine max
  Coding DNA Sequence Number=SeqID_95417
  Subcellular localization annotation: CTP_CleavageSite=42; ConfidenceScore=5.07e-01
MSSVREKNGGDGSLLLRASSDSARQATTSNLVLQWGNRKRLRCMKVQVKDDSSGPVQRTTVRVDRRVVRTDKDSLNKATFGVNYNNHHHQSNGYPNLRERPSSPQPRILSKRKDSVFFFALISDDIKFAVVINSKQAAHGVCVKYLIKS

SEQ ID NO: 212196 - protein, 272 aa, Glycine max
  Coding DNA Sequence Number=SeqID_95418
  Gene Ontology: Mol. function=cysteine-type endopeptidase activity; Cellular component=vacuole; Biological process=proteolysis
  Homolog annotation: Hit_ID=Q9XFZ4; Match level="QueryCoverage=93%, HitCoverage=51%, E-value=1e-124, Identity=83%"; Hit description =Asparaginyl endopeptidase
  Pfam annotation: Domain name=Peptidase_C13; Domain location=43-272; Score=344.9; E_value=1.3e-100; Accession=PF01650.8; Description =Peptidase C13 family
MDRFPILFLLATLITLASGARHDILRLPSEASTFFKAPGGDQNDEGTRWAVLIAGSNGYWNYRHQMTDEPLSFHQSDVCHAYQLLRKGGLKEENIVVFMYDDIAFNEENPRPGVIINSPHGNDVYKGVPKDYIGEDVTVGNFFAAILGNKSALTGGSGKVVDSGPNDHIFIYYSDHGGPGVLGMPTNPYMYASDLIEVLKKKHASGSYKSLACESGSIFEGLLPEGLNIYATTASNAEESSWGTYCPGEYPSPPSEYETCLGDLYSVAWMED

SEQ ID NO: 212197 - protein, 165 aa, Glycine max
  Coding DNA Sequence Number=SeqID_95419
  Gene Ontology: Mol. function=hydrolase activity, hydrolyzing O -glycosyl compounds; Biological process=carbohydrate metabolic process
  Homolog annotation: Hit_ID=Q5BMA5; Match level="QueryCoverage=76%, HitCoverage=30%, E-value=2e-46, Identity=49%"; Hit description =Putative endo-1,4-beta-xylanase
  Pfam annotation: Domain name=CBM_4_9; Domain location=44-156; Score= -16.9; E_value=0.078; Accession=PF02018.8; Description=Carbohydrate binding domain
MGGCGPLASQAESPSNLHSHCKKIVFIKSVLLTTNKGCVSTEEESIIINPQFDDGLNNWSGRGCKIALHDSMGEGKILPKTGKVFASATERTQSWNGIQQEITGRVQRKLAYEVTAVVRIFGNNITTSDVRATLYVQAPDCREQYIGIAKLVSMSLSHFLITAFH

SEQ ID NO: 212198 - protein, 138 aa, Glycine max
  Coding DNA Sequence Number=SeqID_95420
  Homolog annotation: Hit_ID=Q9LTP9; Match level="QueryCoverage=28%, HitCoverage=15%, E-value=9e-12, Identity=80%"; Hit description =Arabidopsis thaliana genomic DNA, chromosome 3, P1 clone: MQC12
MEDGDNILDAIYEEDNLDDDVDMVDVEEGELVEPDAQNVLGQSSAGDINEANQEPLSKNQKRRANKKKNKKKRKGSGSNAMDINRFVLDTCRRLKEKKSYMVYTAVGCLGVSALSDLVNECLITGMIITVYPEDLPTQ

SEQ ID NO: 212199 - protein, 100 aa, Glycine max
  Coding DNA Sequence Number=SeqID_95421
MKWFGQEHRSSSRGLEGANKHLEEKSARLGTKLHTSENMDSRMVLERVDNQLKGHPNLNRKARSNGKSTEKAIKPVTEAKIGSIQKVAIGPCKPNNICKN

SEQ ID NO: 212200 - protein, 388 aa, Glycine max
  Coding DNA Sequence Number=SeqID_95422
  Pfam annotation: Domain name=DUF333; Domain location=317-380; Score= -7.4; E_value=0.068; Accession=PF03891.5; Description=Domain of unknown function (DUF333)
CVMRKSLSVTFRVPAELSEAFIGAVNAADGDKTAWLVDAIRQKLSLPESNPDARMMALVERMELAAAALIGGKQGIPPLPYNEEAVIRIASETIRQGFDNGRIIAERLNEAGYQTKAGKAWDKDIYSAWKRQADHKAKGACSHHGGVGSGGGISLISALALAGYSFYRLDKAEAHEKCMIYESSKQNVWFEFSLTSAPFNPQEHYSIKGNALSYTYLSSINSKPECLTVAISDAESTKIEKLARTLASHSNAPNMPVLDGLDVSLTINIGDTATFHAQQAVTLFGQQGLRYVGADSFSPFLFTVNAQAFFMRNAAGGIEFFTYTTDHLSGSDKNEPASVVMANPASVYCQKVGGALEIVKNETGESAIIVAGIALLIWFIASGAYAPG

SEQ ID NO: 212201 - protein, 160 aa, Glycine max
  Coding DNA Sequence Number=SeqID_95423
  Gene Ontology: Mol. function=chitin binding; Cellular component =extracellular region; Biological process=chitin metabolic process
  Homolog annotation: Hit_ID=UPI000044A8F0; Match level="QueryCoverage =99%, HitCoverage=100%, E-value=2e-19, Identity=31%"; Hit description= PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MRGQHVLAFRGLHVLTFRGLHVLTSKGLAPSPSEDYMPSPSENYTSSPLEDYTTSPSQSYTPSPSEDYTSSPPEGYRPSPSEDYTSSPSEGYTSLPSEGYTPSPSEDYTSSPSEGYTSLPSEGYTPSSSEDDTCSPSKDYRAYLQRATCPHLKRTTGPRL

SEQ ID NO: 212202 - protein, 84 aa, Glycine max
  Coding DNA Sequence Number=SeqID_95424
MGGGGVQIAILKFGHPEYFRSWIASPGSNPARLGELGDNLLPLFPINRLKGVVLRVPDPPGDVFQLFWVKKIVSVKKIQAEVLP

SEQ ID NO: 212203 - protein, 92 aa, Glycine max
  Coding DNA Sequence Number=SeqID_95425
MEQLRIVVPNPIDTEDPDVDFEWLVNQAEEEENEDWGLPPNLRRMVEQEEREMKPHQEETEVVNLGTGEEKKEVKIGTCVSANDRDKLVALL

SEQ ID NO: 212204 - protein, 83 aa, Glycine max
  Coding DNA Sequence Number=SeqID_95426
MEGKSKFFGLNKYLNHVWSCCKNHDGGFKGLEGSALERIEREEEEKEKEEEERRGNEAEALPNRERDHSLRRFLFCVLRAIVG

SEQ ID NO: 212205 - protein, 89 aa, Glycine max
  Coding DNA Sequence Number=SeqID_95427
  Gene Ontology: Mol. function=ribonuclease H activity; Biological process=DNA integration
MWDKGTKTTNSNKGLTRDATLYIAWAIPFSLVYGMEAEARFDQLNLIEGKKLAAMSHGRLYQSRVKNAFDKRVCSCKFSERDLVLKKVS

SEQ ID NO: 212206 - protein, 190 aa, Glycine max
  Coding DNA Sequence Number=SeqID_95428
MADMYSAPEEVHGLLDYCARTNEGRYGGRSYPSLCHKPSKPTHPEHGGIRRGGVGQYRWSTHGQPQPVGGAHEEPLKRAQGDFDPCPTFTAEGSTCNAMPQPNTVGVPQPRPLQPLYFSIGGSPLVEEGREKLDLIVERLRAIEGFRDYPFTDMIKLCLVPNVVIPPKFKGQQSADAFLPRKLGRGGSHL

SEQ ID NO: 212207 - protein, 90 aa, Glycine max
  Coding DNA Sequence Number=SeqID_95429
MVADLLAVGGDFWLPQFQVSGSLLKSDVKLLYKLNHFINKHKLSFNQKIRVYLFYLSESDSPKFWGGIQEHPGYIKGLSQPLCVALAEKE

SEQ ID NO: 212208 - protein, 134 aa, Glycine max
  Coding DNA Sequence Number=SeqID_95430
MKRAVEEEPAVENKAPLKMACKTINEEEEPRRCRTESLCSFVFSCHPYWSRIEAVSSLRKPYLSRIPAYRYRIRVRHRHFSIFHVFGLHRRLGWVKVKVHSGVWCCGDRQWHTAYEIKLPVTDQVDSQDFCGST

SEQ ID NO: 212209 - protein, 137 aa, Glycine max
  Coding DNA Sequence Number=SeqID_95431
MSWSKRIGRKKIGFGVFLYDVDDDDDGGGIVGNNNIGRIASGDGDNSGSGDIGDGSNAGSNGDNSSNNDDGSDNDSDNGGDNDTSGAGDDGGNISVCGDNDDGGGDIGGDGDAGGDSGGSKDSNGGNNVGDGGVGSQ

SEQ ID NO: 212210 - protein, 708 aa, Glycine max
  Coding DNA Sequence Number=SeqID_95432
  Gene Ontology: Mol. function=protein dimerization activity; Cellular component=chromatin; Biological process=DNA integration
  Homolog annotation: Hit_ID=Q2R1C3; Match level="QueryCoverage=95%, HitCoverage=88%, E-value=0.0, Identity=50%"; Hit description=HAT family dimerisation domain containing protein
  Pfam annotation: Domain name=DUF659; Domain location=174-339; Score =99.9; E_value=7.7e-27; Accession=PF04937.6; Description=Protein of unknown function (DUF 659)
  Pfam annotation: Domain name=hATC; Domain location=552-641; Score =44.1; E_value=4.7e-10; Accession=PF05699.5; Description=hAT family dimerisation domain
  Pfam annotation: Domain name=zf-C2HC_plant; Domain location=16-78; Score=22.1; E_value=9.8e-05; Accession=PF07567.3; Description =Protein of unknown function, DUF1544
  Pfam module annotation: Pfam domain module=DUF659::hATC::zf-C2HC _plant; Domain location=174-339::552-641::16-78
MSRITEMFASSEYQDDHAPLWSFVTIKEKIGDGGGNRLWSCNFCEKVVKSSYSRVKAHLLRICGSGIDTCPKVTDAYLVYLRRVCEEAESILKSKNVPLPTDKRTPTPPTLPPKRRKSSNIESAFNIEDRNHLRAEIARMFYSASLSFHLARNPYFVSSYSFAANCNLSGFLPPSYNALRTSLLQQERSYIERLLQPIKSLWSLKGVTLVVDGWTDAQIRPLINFMAISEEGPMFLKAIDGSKEYKDKHYMFDLLKDVIKEVGPQSVVQVITDNAYVCKAAGLLIEVEFPHIFWTPCVVHTLNLGVKNICAAKNVDGNENVFNEGGWIAEVIGDASFIKVFIMTHSMRLAIFNEFSSLKLLSIAETRFASMIVMLKRLKLLKRCLQNMVISDQWNSYREDDVRKAAHVKELILNDIWWDKVDYILSFMDPIYSMIRICDTNASNLHLVYEMWDSMIEKVKTTIYRHDEVLENEVSTFFEVIHEILNSRWSKSCNPLHCLAHSLNPRYYSDNWLNEVPNRVPPHRDDELSSQRNKCLKRYFPNVNVRTKVYEEFSKFSSCAGDFGSFDIIEDRWALDSKTWWVMHGSSTPILQKVALKLLVQPCSSSCCERNWSTYSFIHSLKRNKMDPKKAKDLVFVHSNLRLLSRKEEGYKKGETRLWDINGDVHDPLDDSAGVLEMTDLSLDEPDLEAMLFLDDGNGGEENETIRV

SEQ ID NO: 212211 - protein, 241 aa, Glycine max
  Coding DNA Sequence Number=SeqID_95433
  Gene Ontology: Mol. function=transferase activity; Biological process= DNA integration
  Homolog annotation: Hit_ID=Q2HRZ3; Match level="QueryCoverage=69%, HitCoverage=93%, E-value=1e-46, Identity=53%"; Hit description=FAR1
  Pfam annotation: Domain name=FAR1; Domain location=76-235; Score =239.3; E_value=8.1e-69; Accession=PF03101.5; Description=FAR1 family
MAELWKAKILPYKQAIAAYGTAIVGLPSQIAYGVDPNEGCRVLESSSWGELGICEDHAIQEPYEGMEFESEDAAKLFYDEYARRLGFVMRVMSCRRSERDGRILARRLGCNKEGYCVSIRGKFASVRKPRASTREGCKAMIHIKYDKSGKWVITKFVKDHNHPLVVSPREARQTMDEKDKKIQELTAELRLKKRLCATYQEQLTSFMKIVEEHNEKLSAKIHHVVNNLKEFESIEELLHQT

SEQ ID NO: 212212 - protein, 82 aa, Glycine max
  Coding DNA Sequence Number=SeqID_95434
MGISTLDKPACIAGSHMAPSSLSDILCLTFVIVRTSCGKHEQIPFEALLILDFPIPIEMSHVMWVPLPCCIEHVNFKGVTLT

SEQ ID NO: 212213 - protein, 137 aa, Glycine max
  Coding DNA Sequence Number=SeqID_95435
MTQTTLDFSPTFQLHHTTATLIIMPYSSMPLSLTLHHHHYYYPLIATNSNSFIINIIIIIHHPLIALDDHNHLHQHNKELPSHTKQGHKQAQGEVDDKVKRVFVGFAARSNNSSWGIKHLGPIRFSFGYDYEYIPCY

SEQ ID NO: 212214 - protein, 364 aa, Glycine max
  Coding DNA Sequence Number=SeqID_95436
  Homolog annotation: Hit_ID=Q1SGA9; Match level="QueryCoverage=23%, HitCoverage=23%, E-value=6e-36, Identity=76%"; Hit description=Zinc finger, RING-type; RINGv
  Pfam annotation: Domain name=PHD; Domain location=152-197; Score=0.6; E_value=0.05; Accession=PF00628.19; Description=PHD-finger
  Pfam annotation: Domain name=zf-C3HC4; Domain location=153-194; Score= 34.9; E_value=2.7e-07; Accession=PF00097.15; Description=Zinc finger, C3HC4 type (RING finger)
  Pfam module annotation: Pfam domain module=PHD::zf-C3HC4; Domain location=152-197::153-194
MDPHLPKNGTQQHHGTPTPSPASVANNIIIPHPEFRIPSFKEHHKNVPQLAMIVMACMVGVIMFLCAVSVLIRYFYSRRYSRNNQNRRVDAPILFDLNGDSPPSSDNDDDVEELAVVHPIWYIRTVGLQQSLIDSITVFKYKKGEGIIDGTECSVCLGEFEHDESLRLLPKCSHAFHIPCIDTWLRSHKNCPLCRAPVLRDETDGAHVIRAVDQSNQTVSNVSGHQEARVESSDHERVEDDDVSSAAVEVVEATQPLRRSVSMDSSSANSMVLFGDVVVDLDTHHCGEKVNYSSNKDMSVVVNEKHGSGSSTSTTIINNKLASIGRALQKRPISVSMRMRRSFSHNTKFLFSRHCRSQSSTLPL

SEQ ID NO: 212215 - protein, 503 aa, Glycine max
  Coding DNA Sequence Number=SeqID_95437
  Gene Ontology: Mol. function=3,4-dihydroxy-2-butanone-4-phosphate synthase activity; Cellular component=chloroplast; Biological process=riboflavin biosynthetic process
  Homolog annotation: Hit_ID=P47924; Match level="QueryCoverage=79%, HitCoverage=75%, E-value=1e-162, Identity=71%"; Hit description =Riboflavin biosynthesis protein ribAB, chloroplast precursor [Includes: GTP ...
  Homolog annotation: Hit description=cyclohydrolase-2 (EC 3.5.4.25) (GTP cyclohydrolase II); 3,4-dihydroxy-2-butanone 4-phosphate synthase (DHBP synthase)]
  Pfam annotation: Domain name=DHBP_synthase; Domain location=159-356; Score=433.8; E_value=2.3e-127; Accession=PF00926.10; Description=3,4- dihydroxy-2-butanone 4-phosphate synthase
  Pfam annotation: Domain name=GTP_cyclohydro2; Domain location=361 -503; Score=121.5; E_value=2.3e-33; Accession=PF00925.11; Description= GTP cyclohydrolase II
  Pfam module annotation: Pfam domain module=DHBP_synthase::GTP _cyclohydro2; Domain location=159-356::361-503
MVIFPIQQCARMHSNAQVPKLEVGGFYVRGRISYMKAWLDKYMVEKRQYIVSGTPPLNTSGYKSDFMLASPIRKVKFSFKVDKMRAVISGEGDLLSHPNNYNSPRQLDKLAEEPIKIRQQLDTFAFGTVSDEINPTINGFFADRNEYDLDCPTQGFSSIPDAIADIRQGKLIIVVDDEDRENEGDLIMAASMVTPKAIAFIVKYGTGIVCVSMKEEDLERLQLPLMVTQKDNGEKLCTAFTVTVDAKQGTTTGVSAQDRATTILKLASRNSRPDDFNRPGHIFPLKYREGGVLKRPGHTEASVDLAVLAGLEPATVLCEIVDDDGSMARLPKLRQMAKKENLKIISIADLIRYRRKREKLVECASAALIPIMWGPFKAYCYRSCLDGIEHIAMVKGEIGDGQDVLVRVHSECLIGDIFGATCQCGNQLELALKQIEAASRGVLVYLRGHEGRGIGLGHMVRGYPSEDDKYEELQLPVDSRKFGIGAQVQKVHPSWGRQCDTSR

SEQ ID NO: 212216 - protein, 513 aa, Glycine max
  Coding DNA Sequence Number=SeqID_95438
  Gene Ontology: Mol. function=hydrolase activity, acting on acid anhydrides, catalyzing transmembrane movement of substances; Cellular component=integral to membrane; Biological process =magnesium ion transport
  Homolog annotation: Hit_ID=Q9HUY5; Match level="QueryCoverage=99%, HitCoverage=55%, E-value=1e-110, Identity=43%"; Hit description =Mg(2+) transport ATPase, P-type 2
  Pfam annotation: Domain name=Hydrolase; Domain location=6-317; Score =20.9; E_value=0.0009; Accession=PF00702.16; Description=haloacid dehalogenase-like hydrolase
MNENIRDILCIDKTGSLTMNHAIMVNHLDCRGLPQEKILRYAFLNSYFKSDQKYPLDDAILAFVYSNGFRFQPSKWRKIDEIPFDFIRRRVSVILETEGGHSQFFGRFLLTKGALLEVLRVCSFIENFDKDEISPFSSNDYQRILNLSEDLSNEGLRVIAVAIRKLEMPQICETSNGSKREEEDIERDMVFIGLITFFDPPKDSAKQALWRLSEKGVKAKVLTGDSLSLTTRVCREVGISTTHVITGPELEQLDQNTFHETVQRATVLARLTPIQKQRVVQSLQTIGNHVVGFLGDGVNDSLALDAANVSISVDSGVAIAKDMADIILLEKDLNVLVAGVEHGRLSFGNTMKYLKMSVIANLGSVISLLIATLLFKYEPLTSRQLLTQNFIYSVGQIALAWDKMDEEYVKTPHKSSERGLSMFMLWNAPVCTLCDVATLLFLWFYYKAYTDVTQKFFHSAWFIEGLLLQTLIIHLIRTEKIPFIQDVASWPVIFLHCCDICNWNCTSIHTPWE

SEQ ID NO: 212217 - protein, 245 aa, Glycine max
  Coding DNA Sequence Number=SeqID_95439
VRVRGHLVKFDEDTLNTFLKTPVIIEEGETLSAYSRFALLRLDPQELAAKLCIPGRGFELNLDGQPRKILRKKMTTLAQTWSVLYCSNLVPTFHTSDITLERAKFIYGIIMKMDMNLGYLISHQISIIAQHDSSRLGFLALITALCKTRGVTPNSRSLESLSPATNLAYIKKKCWNLDDPTVSFRGPRKAKGKRSEIPPSTAPYLLIFLLYQLQLPLPYQLHQFQLLLQDPPYSLQRHYLSCCRA

SEQ ID NO: 212218 - protein, 157 aa, Glycine max
  Coding DNA Sequence Number=SeqID_95440
  Pfam annotation: Domain name=Cation_ATPase_N; Domain location=12-92; Score=3.9; E_value=0.0015; Accession=PF00690.16; Description=Cation transporterATPase, N-terminus
  Subcellular localization annotation: CTP_CleavageSite=35; ConfidenceScore=5.20e-01
METQKPRKRRKSTLGYTPWPSQTKTWFSSTLGPLREASLSFTEADRRLRENGPNVPLEYSFPRWWHLLWNSLFHPFIIILIVLSVLSFITCDSPNGFIMLILVFISVTLRFYQEYSSSKAAMKLSEFVKCPIKVQRCAGRVVQKELVVQVDQRDVVQ

SEQ ID NO: 212219 - protein, 273 aa, Glycine max
  Coding DNA Sequence Number=SeqID_95441
  Gene Ontology: Mol. function=protein farnesyltransferase activity; Cellular component=cytoplasm; Biological process=positive regulation of fibroblast proliferation
  Homolog annotation: Hit_ID=Q04903; Match level="QueryCoverage=97%, HitCoverage=65%, E-value=1e-125, Identity=82%"; Hit description =Protein farnesyltransferase subunit beta
  Pfam annotation: Domain name=Prenyltrans; Domain location=180-224; Score=37.5; E_value=4.7e-08; Accession=PF00432.11; Description =Prenyltransferase and squalene oxidase re
  Pfam annotation: Domain name=Prenyltrans; Domain location=32-75; Score=60.9; E_value=4.2e-15; Accession=PF00432.11; Description =Prenyltransferase and squalene oxidase re
  Pfam annotation: Domain name=Prenyltrans; Domain location=77-113; Score=19.1; E_value=0.016; Accession=PF00432.11; Description =Prenyltransferase and squalene oxidase re
  Pfam module annotation: Pfam domain module=Prenyltrans::Prenyltrans::P renyltrans; Domain location=180-224::32-75::77-113
MKEKLMFELATLPFLDSYWNQVASVLNILDDELIKNVGDYILSCQTYEGGIAGEPGSEAHGGYTFCGLATMILIGEEWAVFRQGKECGFQGRTNKLVDGCYSFWQGGAVALLQRLSSIINKQMEEASQTFTISDVSEAKESLDGTSSHATCHGTSQSCSADYKSIGYNFINEWRAQEPLFHSIALQQYILLCAQEQAGGLRDKPGKRRDHYHTCYCLSGLSLCQYSWSKHPDSPPLPNLVLGPYSNLLEPIHPLFNVVLERYREAHVFFFTES

SEQ ID NO: 212220 - protein, 319 aa, Glycine max
  Coding DNA Sequence Number=SeqID_95442
  Gene Ontology: Mol. function=phospholipid binding; Cellular component= coated pit; Biological process=endocytosis
  Homolog annotation: Hit_ID=Q1SDM1; Match level="QueryCoverage=99%, HitCoverage=99%, E-value=2e-94, Identity=58%"; Hit description =Phosphoinositide-binding clathrin adaptor, N-terminal
  Pfam annotation: Domain name=ANTH; Domain location=24-258; Score= -61.1; E_value=0.00019; Accession=PF07651.6; Description=ANTH domain
  Pfam annotation: Domain name=ENTH; Domain location=24-153; Score= -9.4; E_value=0.00018; Accession=PF01417.11; Description=ENTH domain
  Pfam module annotation: Pfam domain module=ANTH::ENTH; Domain location=24-258::24-153
  Subcellular localization annotation: CTP_CleavageSite=61; ConfidenceScore=5.50e-01
MTKLTNLIGIIKDKASQSKAALLSKRTTLSLLRATSHDSSTPPTRKHLATLLSSGDGSRATASAAVEVLMDRLQGTNNAAVALKCLIAVHHIIHHGSFILQDQLSVYPSAGGRNYLNLSNFRHNTDPTSWELSSWVRWFAQHIEQLLCTSRILGFFLGTSTDSEDRVSGVANADLLTEFNSLVALVEGICKRPEPNGNRLVEEIVKLAREDWGVAQVEVGVRVSEFKERLGGLKFGEAVELVCCLKRLEQCQEMMDGARQLRFWDLVREVKDKAGIQLCREEAKLRRETLKLRLSQSDRFSSRLLNSPHFLRFPSGRFM

SEQ ID NO: 212221 - protein, 225 aa, Glycine max
  Coding DNA Sequence Number=SeqID_95443
MKLGMSGTWLMTVLVCGVWGLTENIDHIFRLCPITRVVWYLLLPASKHQDFFNQDTKTWMLLNFRDTAMVNGRSWLLIFVVALDIIWQNRSNFIFQGLTSQPADIVKHILSKVEFANFNPNMHSVSLDERKTAASGVIGNHFGAVIFAFAALGSVLCYMESYGQYILGLALLGTEATRILLVESDSQLAINLLRHGCASYHTCLAWCRVFSPSFKREDDWSGLML

SEQ ID NO: 212222 - protein, 105 aa, Glycine max
  Coding DNA Sequence Number=SeqID_95444
MAEESPRKSYSFDSDDTWPTLCNEDSMKLTSLWFRFYSNTRLYQQRQASDAESVEAELGVTLSGLFALGLLHRRHKPSLYSIALEGECWDLCVLPFLIASNLLPL

SEQ ID NO: 212223 - protein, 391 aa, Glycine max
  Coding DNA Sequence Number=SeqID_95445
  Gene Ontology: Mol. function=beta-1,4-mannosylglycoprotein 4-beta-N -acetylglucosaminyltransferase activity; Cellular component=membrane; Biological process=protein amino acid N-linked glycosylation
  Homolog annotation: Hit_ID=Q700J8; Match level="QueryCoverage=99%, HitCoverage=99%, E-value=0.0, Identity=78%"; Hit description =Putative N-acetylglucosaminyltransferase III
  Pfam annotation: Domain name=Glyco_transf_17; Domain location=32-391; Score=884.0; E_value=7e-263; Accession=PF04724.4; Description =Glycosyltransferase family 17
MWWMMGETGGNYCCKKSDDLCTNVCGQESSQVSGMSRIRCILRGLDVKTYIFMFAVIPMCVFGFYIHGQKISYFLRPLWEKAPKPFNVIPHYYNENVTMENLCRLHGWGVREYPRRVYDAVLFSNELEILTLRWKELYPYITEFVVLESNSTFTGLPKALVFNSNREQFKFVEPRLTYGTIGGRFKKGENPFVEEAYQRVALDQLLKIAGITDDDLLIMSDVDEIPSAHTINLLRWCDEVPSILHLQLKNYLYSFEFRVDDKSWRASIHRYETGKTRYAHYRQSDDILADAGWHCSFCFRRISDFIFKMKAYSHYDRVRFSHYLNPERIQKVICKGTDLFDMLPEEYTFRDIIGKMGPIPHSYSAVHLPAFLLENSDKYKFLLPGNCKRER

SEQ ID NO: 212224 - protein, 129 aa, Glycine max
  Coding DNA Sequence Number=SeqID_95446
  Gene Ontology: Mol. function=protein kinase activity; Biological process=protein amino acid phosphorylation
  Homolog annotation: Hit_ID=Q1T5D4; Match level="QueryCoverage=61%, HitCoverage=6%, E-value=1e-28, Identity=73%"; Hit description =Protein kinase; Zinc finger, RING-type
  Pfam annotation: Domain name=zf-C3HC4; Domain location=8-53; Score =43.8; E_value=6.1e-10; Accession=PF00097.15; Description=Zinc finger, C3HC4 type (RING finger)
MKTREPFCSVCQTRYDEELRVPLLLQCGHGFCRDCLSRMFSASTDTTLTCPRCRHVSSVGNSVHALPKNFPVLALLRSPSSSNAVRSVLDFDFDYTDDEDEDPDQDQDYRSYLKDDEVLWRNGGGGLRL

SEQ ID NO: 212225 - protein, 109 aa, Glycine max
  Coding DNA Sequence Number=SeqID_95447
MEGNQGFLRARVRPRACYCTLLLRYCGLHNESLFQLNGVPWWELNCPKRVVLWYRCGGEVLSVGLKEFKDDKGALEMMLMIHLVITLQVITMKIIRGSYFVECGSEPAI

SEQ ID NO: 212226 - protein, 339 aa, Glycine max
  Coding DNA Sequence Number=SeqID_95448
  Gene Ontology: Mol. function=protein binding; Cellular component =membrane; Biological process=defense response
  Homolog annotation: Hit_ID=Q1SVB4; Match level="QueryCoverage=98%, HitCoverage=70%, E-value=2e-51, Identity=36%"; Hit description=Beta tubulin
  Pfam annotation: Domain name=LRR_1; Domain location=137-162; Score =7.6; E_value=11; Accession=PF00560.23; Description=Leucine Rich Repeat
  Pfam annotation: Domain name=LRR_1; Domain location=26-47; Score=8.9; E_value=6.1; Accession=PF00560.23; Description=Leucine Rich Repeat
  Pfam annotation: Domain name=LRR_1; Domain location=3-24; Score=10.2; E_value=3.5; Accession=PF00560.23; Description=Leucine Rich Repeat
  Pfam annotation: Domain name=LRR_1; Domain location=81-112; Score =3.1; E_value=75; Accession=PF00560.23; Description=Leucine Rich Repeat
  Pfam module annotation: Pfam domain module=LRR_1::LRR_1::LRR_1::LRR _1; Domain location=137-162::26-47::3-24::81-112
MENITHLSLEYTAISKLPNSIRELVRLQSLELHNCGMVQLPSSIVTLRELEVLSICQCEGLRFSKQDEDVKNKSLLMPSSYLKQVNLWSCSISDEFIDTGLAWGIPPNLETLSAIRCTSLKDLDLAVPLESTKEGCCLRQLILDDCENLQEIRGIPPSIEFLSATNCRSLTASCRRMLLKQELHEAGNKRYSLPGTRIPEWFEHCSRGQSISFWFRNKFPVISLCLAGLMHKHPFGLKPIVSINGNKMKTEFQRRWFYFEFPVLTDHILIFGERQIKFEDNVDEVVSENDWNHVVVSVDVDFKWNPTEPLVVRTGLHVIKPKSSVEDIRFIDPYKPTFL

SEQ ID NO: 212227 - protein, 44 aa, Glycine max
  Coding DNA Sequence Number=SeqID_95449
MEEKLKRSRGMPLSGVKVLQELASLGGKFKEISAEFIKILMTGI

SEQ ID NO: 212228 - protein, 197 aa, Glycine max
  Coding DNA Sequence Number=SeqID_95450
  Homolog annotation: Hit_ID=Q9XGX0; Match level="QueryCoverage=43%, HitCoverage=26%, E-value=1e-22, Identity=59%"; Hit description =Putative zinc finger protein SHI
  Pfam annotation: Domain name=DUF702; Domain location=50-170; Score =83.9; E_value=4.9e-22; Accession=PF05142.3; Description=Domain of unknown function (DUF702)
MTMFPLTTEVGPPPQPRPLFCQDHYSALGVGPSKTISDDQSWLRSKFMLRRAAGGGISCQNCGNQAKKDCPHMWCRTCCKSRGFDCQTHVKSTWVPASRLRERLQQLFALQQTLEPPFSGGGKTLTLRGRREKGLLTYLRARAAVAGERVEVSAKEASVAVGVSVLVEPAALGLLQSPQFHPCFCSLFEVEGCRACG

SEQ ID NO: 212229 - protein, 49 aa, Glycine max
  Coding DNA Sequence Number=SeqID_95451
MNEGWVGKRRNEMNAKRSVKVRWIMDGDWVSCAVSEVGNWDAHVVEEVN

SEQ ID NO: 212230 - protein, 227 aa, Glycine max
  Coding DNA Sequence Number=SeqID_95452
  Homolog annotation: Hit_ID=Q9FGA1; Match level="QueryCoverage=54%, HitCoverage=87%, E-value=1e-53, Identity=79%"; Hit description =Arabidopsis thaliana genomic DNA, chromosome 5, P1 clone:MPF21
  Pfam annotation: Domain name=DUF393; Domain location=84-203; Score =88.3; E_value=2.3e-23; Accession=PF04134.3; Description=Protein of unknown function, DUF393
  Subcellular localization annotation: CTP_CleavageSite=67; ConfidenceScore=5.66e-01
MILRFAAAAASASASVSRISKPHNPPFLSLPHPNTLKFHNQPSHNPRNNVLLPLPSRSQRCYIRAISDATVEPEISKKEQNESPKDWKIKMLYDGDCPLCMREVNMLRERNKSYGTIKFVDIGSDDYSPEENQGLDYETVMGRIHAILSDGSVVTDVEAFRRLYEHVGLGWVYAITKYEPIAKIADSIYGVWAKYRLQITGRPPIEEILETRKKKGEVCKDSNACKM

SEQ ID NO: 212231 - protein, 156 aa, Glycine max
  Coding DNA Sequence Number=SeqID_95453
MAFLWNKTSIASHFRSHSQKTEGLASFPRRRFHVEPGAREKALLAEDATLKPFKSYKKSVKQLRKIGNALTVVVVAGLKLLVNELKGLCLFERTLFLQFMFVVNKLKDFRLLMKQSKVCSLVVARTLLNWKWSEPDLMFDLGKALGDLEIQYASAV

SEQ ID NO: 212232 - protein, 205 aa, Glycine max
  Coding DNA Sequence Number=SeqID_95454
  Gene Ontology: Mol. function=RNA-directed DNA polymerase activity; Biological process=RNA-dependent DNA replication
  Homolog annotation: Hit_ID=Q1SDI2; Match level="QueryCoverage=83%, HitCoverage=23%, E-value=2e-10, Identity=24%"; Hit description=RNA -directed DNA polymerase
MAQGKGKSFCYLSHIAQFRNLLVGDLIDQQYHKRKIVIRQRKYGRQQTFGIIFSRDSTQQKALISCNLTNNINLQSSFGLFGEIETTRSGTMQNPMPTYLSRRDFNSPSNGSRFVLTNINKFIILLIKSPLGFPLQLVSLNAILTLPYSRRKTLLVLAYAFGVLTEPSSKLTQNFTKEFQDPRKQKPSLCTKLSSGLLTNINGRI

SEQ ID NO: 212233 - protein, 658 aa, Glycine max
  Coding DNA Sequence Number=SeqID_95455
  Gene Ontology: Mol. function=nucleic acid binding; Cellular component= beta-galactosidase complex; Biological process=DNA integration
  Homolog annotation: Hit_ID=Q1SIY6; Match level="QueryCoverage=99%, HitCoverage=99%, E-value=8e-57, Identity=40%"; Hit description =Integrase, catalytic region; Zinc finger, CCHC-type
  Pfam annotation: Domain name=rve; Domain location=193-366; Score =39.3; E_value=1.3e-08; Accession=PF00665.16; Description=Integrase core domain
  Pfam module annotation: Pfam domain module=RVT_2::rve; Domain location=453-535::193-366
MDTKASFSQVVLPVFNGENYNLWVEAIEEDYGVLQLPDNPTVAQMKNHKERKNRKAKAKACLFAGVSKRIFIRIMKLKTASAIWNYLKEKMKEFETIKDFSGRLFDIANKEGSIEDAFQVKLQTNNNGKSLSNRPEVFANNKNQNNNTQLRHVERICKFQQQQEEVKVPEDQSQESSGCTNHMTYDRELFTELDEAIFSKVKIENGAYIEVKGKGIVAIEGHTGLKLISDVLYVPEISQNLLSVPQLLEKGYKGYRKAEIDTHRKAEIWICFMKFKSEVVDIFWKFKAWMETQSKCKLQLTTPYSPQQNGTAERKNKTIIEMARCLLHEKELPKKLWAKAANTAIFLLNRLLTKALKKKTLFEAWYDYKSELLNLKIFGCLCFSYIPQVKREKLDKKVEPGIFVGYSLISKAYRIYLPHHDKVIVSRNVGFLELDNWNWEDDKKILFQKENGNVDEEHVRGTISLFDIYQRLLFVLAAQNGWAIHQMDVKSTFLNGYLEEEIFVEQPEGLLSKDRRRRKFNMEECKPTRTPMNQEEKFCKIDEAKRVDERLYKSLIGCLMYLITTRPDIMYVVSLLSSQVRSFNLLGYSDSDWTRCVDDMRNTSSYCFTLGSVQKDGKVKLVHCRKEYQNVDILTKALPKNKFEFLRKRLGICSFSVK

SEQ ID NO: 212234 - protein, 152 aa, Glycine max
  Coding DNA Sequence Number=SeqID_95456
MLKTGSNFGDHGMESILSHSGFDWDDTKYIITIDDENAWTEYVSSHKRAKNFRFKEIPNWDYIMDLCAKDRVISRGAKNIMDVDEVMSTGVNEVEFMGLEDVNTSIDLEELGFGLKRMGQSSSSTSVQPQRRKTREKNGITALIKQVVESFD

SEQ ID NO: 212235 - protein, 69 aa, Glycine max
  Coding DNA Sequence Number=SeqID_95457
MKAKNESLFLDDGDLSRPTVNGRTARKPHYKRNLKESWASSSKGNNTRKSGLPWIQTENAIETLKQKRK

SEQ ID NO: 212236 - protein, 128 aa, Glycine max
  Coding DNA Sequence Number=SeqID_95458
MTRGNPSDLQPFDPEIDRTFHILVRHHFIPFELSVIGESEHFVIGNFEHPGFEHYGFEHSDFEHSENMAQPPPRERTLREMAAPDFTYENSCIQYHDEDVPYVLITGLIHLLPKFHGLAGEDPHKHLK

SEQ ID NO: 212237 - protein, 199 aa, Glycine max
  Coding DNA Sequence Number=SeqID_95459
  Gene Ontology: Mol. function=hydrolase activity, acting on glycosyl bonds; Biological process=base-excision repair
  Homolog annotation: Hit_ID=Q9JT88; Match level="QueryCoverage=51%, HitCoverage=55%, E-value=2e-26, Identity=57%"; Hit description=DNA-3- methyladenine glycosylase I
  Pfam annotation: Domain name=Adenine_glyco; Domain location=95-194; Score=17.0; E_value=1.3e-11; Accession=PF03352.4; Description =Methyladenine glycosylase
MDQNNLDKIIERALDIREKYHRLEKQQNGSEWTLEQDALAYLTDAGIVGRDIMSHEKTWIKKDASAELEHKLAENIWWLIILADRTAIEKMQPESRKALHQKYHDYHYGFPIHDDNELFGRLVMEINQAGLSWETILKKEESFRNAYDQFNIQKVAAYTEEDRERLLNDSGIIRNKLKVNAAIENAKTIIELQKRIRII

SEQ ID NO: 212238 - protein, 135 aa, Glycine max
  Coding DNA Sequence Number=SeqID_95460
  Gene Ontology: Mol. function=isomerase activity; Biological process =cell redox homeostasis
  Homolog annotation: Hit_ID=Q8A386; Match level="QueryCoverage=82%, HitCoverage=26%, E-value=5e-12, Identity=37%"; Hit description =Putative disulphide-isomerase
MEKGEGIDLAKKYNVKAFPTYLFINANGEEVHRTLGYVEENDFVQFAKDAEDPNKRLTALKQKFENGEKDPEFLKNLAGLTIYNDSEFAGKVLDRYFQGKSSLNQEDVQILLAGIQSTESPLYKIFKDKKADIVK

SEQ ID NO: 212239 - protein, 62 aa, Glycine max
  Coding DNA Sequence Number=SeqID_95461
MKIQKGDQGVPMNPKRIKVIPEWPTPPSVEEKSMEFQEPRDLRPNPFHGGGNDAILPRKGIG

SEQ ID NO: 212240 - protein, 62 aa, Glycine max
  Coding DNA Sequence Number=SeqID_95462
MGENHIASLSLTPHVGNIENKDQLAASEILCKEGCQNLVLAVAPLLVGAVILGRALSGLVIT

SEQ ID NO: 212241 - protein, 118 aa, Glycine max
  Coding DNA Sequence Number=SeqID_95463
MYNYLWRQSTKDEHSHHIPYAHKGKAVANNEGVIKHSSHKWEMRLLPATRLSLQGFRSEPQYGVHMLEHKIQDQQKDMKLSQPTSRRDDEGKINKSKAFVSKGENEQSRHQRLFEEKR

SEQ ID NO: 212242 - protein, 648 aa, Glycine max
  Coding DNA Sequence Number=SeqID_95464
MGEVRKLENGPRRQSTNECEEVKIAFYGDARGGPCDHKEVLQAMGLNIVDITTFKRKGQRLLSNSLSRNQIKECSRMLLIKNDQEEVMRLWELGKKLRVIFSCEDEDIVKRIMEVERRDKREEHQEEGHKRRGFKGKGEVGMPTRNQDGGGNGGNVQSYKLWRWKRFVWGMVFGFEGNVEGGLDERRDPRNNLMGGRELEEFDEFIYDMELEEMVEKWWASYEVNGWVAYVINEKLKYLKRDLRKWHEECFGDVQQKTNDVVQKINDLDIKDEEEGMEVKKVKGWEAIPRWVEFESIGDSENQDLCATFNEDEVKEVVWECGRDKSLGFNGFNFHFIKKCWGFKKGDFMNMVGEFWEHGKIPSSGNPSFITLIPKKENAQRLGLTRLVRQAVNLNSFQGYHVINNLVEVLILQFVDDTLFVAKALSTNIMCLKTILRCFDLGSNPKVNFFKSKLIGIEVDNNSLLQFAREHEDFLVQMGRCVSNGGGGLCQIKAGYGKKCLCLSIGVIQLRWKRYGCKIVARCVGGGRMPSQKVWKTILKLITKGQYGGGGWGMDRGLMGIEAPMEEGAVMQHVVMDQFSEDKVLWKGSLSGTFSIKEAYILISTVSSSDQGILAKVWQVHCYKQKLCSMNPSARGLGASRKTSANTE

SEQ ID NO: 212243 - protein, 154 aa, Glycine max
  Coding DNA Sequence Number=SeqID_95465
  Gene Ontology: Cellular component=microtubule
  Homolog annotation: Hit_ID=Q9FGA2; Match level="QueryCoverage=92%, HitCoverage=83%, E-value=4e-29, Identity=47%"; Hit description =Arabidopsis thaliana genomic DNA, chromosome 5, P1 clone:MPF21
MGNCQAIDAATLVIQHPNGKVDKFYAPLSATHVMKTNPGHYVALLISTTLCPTKDIQNCPNKSDIKNKNANNPVRITRIKLLKPTDTLVLGQVYRLIKTQEVMKGLKEKQKAKMRQNVPESAHKPDLEKEKVARRSEMEDNKELATIIGLVVKI

SEQ ID NO: 212244 - protein, 126 aa, Glycine max
  Coding DNA Sequence Number=SeqID_95466
MGFAVTQRSRIGDWGFETLVRKPWWCCLDFMVVMRDNAMVKCVAKGNGIDSQGGGRRHTMVVCANINSDSAAAHHQSAYQSATWYQGECLMVRYNLRLGWGTNKQFRHTPFIYLEHVHLYMVSLAK

SEQ ID NO: 212245 - protein, 312 aa, Glycine max
  Coding DNA Sequence Number=SeqID_95467
  Gene Ontology: Mol. function=transporter activity; Cellular component= membrane; Biological process=transport
  Homolog annotation: Hit_ID=Q9FM07; Match level="QueryCoverage=84%, HitCoverage=49%, E-value=1e-136, Identity=88%"; Hit description =Permease 1
  Pfam annotation: Domain name=Xan_ur_permease; Domain location=1-224; Score=-111.3; E_value=0.00057; Accession=PF00860.11; Description =Permease family
MSVFHGDCHRCVRDGLIWPPSNPLRQNGLNIKLLAIGCHRVLIKNFFFRIRIPYPFQWGAPSFDAGEAFAMMMASFVALVESSGAFIAVYRYASATPLPPSILSRGIGWQGVGILLSGLFGTVNGSSVSVENAGLLALTRVGSRRVVQISAGFMIFFSILGKFGAVFASIPPPIIAALYCLFFAYVGAGGLSFLQFCNLNSFRTKFILGFSIFVGLSVPQYFNEYTAINGYGPVHTGARWFNDIINVPFQSKPFVAGVVAYFLDNTLFKREAAIRKDRGKHWWDKYKSFKGDTRSEEFYSLPFNLNKYFPSV

SEQ ID NO: 212246 - protein, 67 aa, Glycine max
  Coding DNA Sequence Number=SeqID_95468
MVLTVAIFTTGEKVKLIDKEEVEVGHDEVWVGRVEQGMKWTQARKMKQKMVIQLCWFRVEGISDWVY

SEQ ID NO: 212247 - protein, 46 aa, Glycine max
  Coding DNA Sequence Number=SeqID_95469
  Homolog annotation: Hit_ID=Q9FM07; Match level="QueryCoverage=95%, HitCoverage=8%, E-value=2e-14, Identity=82%"; Hit description =Permease 1
MAGGGAPAKADEPQPHPPKDQLPNISYCITSPPPWLAIQASFRSYY

SEQ ID NO: 212248 - protein, 98 aa, Glycine max
  Coding DNA Sequence Number=SeqID_95470
MDKEKKGVGKRSHMLKKQTKERNSGLLKEYIKKGEVGIVCLQETKMEGVRDKEDGNVWGKSLVLYMPTLNAVWHKKGASGMSFKKLKGKWMMAYNASL

SEQ ID NO: 212249 - protein, 73 aa, Glycine max
  Coding DNA Sequence Number=SeqID_95471
MKIFILFSITFAYGFLGSVVSNANPLPYEVIFDFGDSIWDTGNAAKYHQQMPNNSPYGSTYFKHPCGCMQMDD

SEQ ID NO: 212250 - protein, 43 aa, Glycine max
  Coding DNA Sequence Number=SeqID_95472
MCFSEENLSRGAVVTLPRHFREQIHEDFPSFFTVIRSFCGLQS

SEQ ID NO: 212251 - protein, 65 aa, Glycine max
  Coding DNA Sequence Number=SeqID_95473
MVVTITTIMIVAITIVVAINMIVVVVASTAVDDHGSGCSGGHDICNRNDHDGCGGHGDHRDFRMS

SEQ ID NO: 212252 - protein, 86 aa, Glycine max
  Coding DNA Sequence Number=SeqID_95474
  Subcellular localization annotation: CTP_CleavageSite=31; ConfidenceScore=5.12e-01
MCHPTAYVCVYYNGQICNTNEGTTFVSNNTKTFMVNKMMLMFDKCSTISYNNPSLPFVELFSIICDNHNPTSNQHGSSSNLEDLSE

SEQ ID NO: 212253 - protein, 305 aa, Glycine max
  Coding DNA Sequence Number=SeqID_95475
  Gene Ontology: Mol. function=DNA binding; Cellular component=nucleus; Biological process=transcription
  Homolog annotation: Hit_ID=Q53J12; Match level="QueryCoverage=76%, HitCoverage=14%, E-value=5e-73, Identity=58%"; Hit description=BAH domain-containing protein, putative
  Pfam annotation: Domain name=BAH; Domain location=114-229; Score =38.6; E_value=2.1e-08; Accession=PF01426.8; Description=BAH domain
  Subcellular localization annotation: CTP_CleavageSite=36; ConfidenceScore=5.15e-01
MDQSMVVTHFPRQPISSHILHTSPHLPHGCGVRVLRGSRVSRVLRAAGVELGGGFDGTRWGKCEAMHGCGGEKGKGTRHMWKAPVRGDSSLNADVSSSSSSSSSTVKSFCKDGRKISVGECALFKPSEDRPPFIGIIHCLTFGKEKKLKLGVSWLYRSIEVKLNKGVPLEAAPNEIFYTFHKDETDAESLLHPCKVAFLRKGAELPSGFSSFVCRRVYDIANKCLWWLNDQDYINDCQEEVDQLLYRTCVRMHATVQPGGRSPKPMSSPTSTSQLKSVSDSVQNNTSSFPSHIKGRKRERADSRL

SEQ ID NO: 212254 - protein, 1196 aa, Glycine max
  Coding DNA Sequence Number=SeqID_95476
  Gene Ontology: Mol. function=DNA binding; Cellular component=nucleus; Biological process=transcription
  Homolog annotation: Hit_ID=Q53J12; Match level="QueryCoverage=99%, HitCoverage=74%, E-value=0.0, Identity=39%"; Hit description=BAH domain-containing protein, putative
  Subcellular localization annotation: CTP_CleavageSite=49; ConfidenceScore=5.49e-01
MNIKDAKSGSGPTVHWPAKSRSSDVGHGGNRHSGASSDIAMKSSVTQLSASKTASVKIVQGENTIRSASTSTFPGPAKSVLSPASVTANLKDGQPCIAAVSGGSDLPMVNARDEKSSSSSQSHNNSQSCSSDHAKTGGHSGKEDARSSTAMSVNKISGGSSRHRKSINGFPGSTPSGGQRETGSSRNSSLHKNLTSEKISQPGLMDKALDGTSLEGVTCKLIVKIPSQGRSPAQSASAGSFDDPTIMNSRASSPVLPEKHDQFDHCSKEKSDLYRANIGSDINTESWQSNDFKDVLTGSDEADGSPAAVTDEERCRIVNDCKKTFEVPKAASSSSGNENKAGNLQDASYSSINALIEGVKYSEADDVGMNLLASVAAGEILKSELLTPTGSPERNTAAVEQSCTGNDMVKSSEENLVRDECHSNNGLDGEHKNQGSVTDDLGANDESDSDFRASGEKAARELNKSVNACSMDLQQVSEIILESKGKLNEKSVSTALRGLSESSVQEARDGDRSKQLQEVGRGVNGGEIVDVKVSSVAEVEAEATEKLSHIAVKVDVQSDNCTAEGSSGGGRTAAVLVPSDLARGKDENVLHSSAYSVDKVPEDLTERESEKADDVDAENLPSQSKKERNECESDTLTMPENRGLCSIVTGIAAEHVEENLETKEVHDQPAREELPKDSPSVRSQEMDKHLDSKGSKLTAMEAEEAEECTSTTADASSVSAAAVSDADAKVEFDLNEGLNADDEKCGEFNSSAPAGRLVSPVPFPASSMSCGIPAPVTGAAAAKGRFVPPEDLLRSKGEIGWKGSAATSAFRPAELRKVMEMPFGALTSSIPDAPAGKQSRAPLDIDLNVADERILDDISSQPCARHTDSVSLTTDGHDPVSSKMASPVRCSGGLGLDLNQVDEASDVGNCLSSNHKIDVPIMKVKSSLGGPPNREVNVHRDFDLNNGPSVDEVTTESSLFSQHARSSVPSQPPVSGLRVSTAEPVNFSWLPSSGNTYSAVTISSIMPDRGDQPFSIVAPNGPQRLLTPAAGGNPFGPDVYKGPVLSSPFEYPVFPFNSSFPLPSASFSAGSTTYVYPTSGNRLCFPVVNSQLMGPAGAVSSHYPRPYVVGLTEGSNSGSAETSRKWARQGLDLNAGPGGSDMEGRDDNSPLPSRQLSVASSQALAEEQARIQLAGSVCKRKEPDGGWDGYNQSSWQ

SEQ ID NO: 212255 - protein, 99 aa, Glycine max
  Coding DNA Sequence Number=SeqID_95477
  Homolog annotation: Hit_ID=Q67VP4; Match level="QueryCoverage=44%, HitCoverage=20%, E-value=3e-16, Identity=90%"; Hit description=Rac -like GTP-binding protein 4
MAIMSNIITIEQSTITLSNQLDLKNKKKENTLGTDFCIYDCVYDEHADLREDKHYMADHPSLVPVTTDQGEELRKHIGATYYIECSSKTQQVCHVDDAQ

SEQ ID NO: 212256 - protein, 262 aa, Glycine max
  Coding DNA Sequence Number=SeqID_95478
  Gene Ontology: Mol. function=DNA binding; Cellular component =intracellular; Biological process=DNA integration
MSDIPRRVQEYEGEVRLPLLISKASLQLEGFVDPKEVGKVSENSIVFLVLYVDDILLIGNDIPSLQHVKTWLESFFSINNLGKRSHVLGIRIYRYRSLRLIGLSQSTYIDKVLRCFSMHDSRKGFMPASHGMHLSKGQSLTTSYKREHMSKISYAFAIRSIIYTMVCTQPDASYALSMTSKYQSDFGESHYMDVKNILNNVMSWKSSKQEIVVDSIIEVEYIATSSATKEAIWIRKFISELSVVLSIMDLIDLYCDNDGAIV

SEQ ID NO: 212257 - protein, 285 aa, Glycine max
  Coding DNA Sequence Number=SeqID_95479
  Gene Ontology: Mol. function=protein kinase activity; Cellular component=integral to membrane; Biological process=protein amino acid phosphorylation
  Homolog annotation: Hit_ID=Q6H4R9; Match level="QueryCoverage=76%, HitCoverage=34%, E-value=4e-37, Identity=37%"; Hit description =Putative receptor kinase
  Pfam annotation: Domain name=LRR_1; Domain location=122-144; Score =16.5; E_value=0.095; Accession=PF00560.23; Description=Leucine Rich Repeat
  Pfam annotation: Domain name=LRR_1; Domain location=146-167; Score =8.2; E_value=8.4; Accession=PF00560.23; Description=Leucine Rich Repeat
  Pfam annotation: Domain name=LRR_1; Domain location=169-190; Score =5.9; E_value=22; Accession=PF00560.23; Description=Leucine Rich Repeat
  Pfam annotation: Domain name=LRR_1; Domain location=191-221; Score =6.2; E_value=20; Accession=PF00560.23; Description=Leucine Rich Repeat
  Pfam annotation: Domain name=LRR_1; Domain location=98-120; Score =10.7; E_value=2.8; Accession=PF00560.23; Description=Leucine Rich Repeat
  Pfam module annotation: Pfam domain module=LRR_1::LRR_1::LRR_1::LRR _1::LRR_1; Domain location=122-144::146-167::169-190::191-221::98-120
MSLKPIWVFFIAIFLFLLVANSEEEEVIKALVTFMDKLAPGNVPRDPMWGWNLNSDPCIDKWHGVKCYSDNKYVKSVILEKFNFGGVVDASSVCIAKSLRILRLTDNILHDSISEDIGNCQSLTQLFLSGNQLSGDLPISIGKLSNMKRLHVSDNHFTGELPNMVHVSGLISFFAQNNNFTGEIPSFDFSNLDAFNVSNNNLQGQVPDVKGKFHEDSFSGNPNLCGKPLSQECPPPEKKDQNSFPNDLSIYSGYLVLGLIVLSSLSIPSTSRGGPVPAFVPFSEG

SEQ ID NO: 212258 - protein, 503 aa, Glycine max
  Coding DNA Sequence Number=SeqID_95480
  Gene Ontology: Mol. function=Rab GTPase activator activity; Cellular component=intracellular; Biological process=regulation of Rab GTPase activity
  Homolog annotation: Hit_ID=Q1SDX8; Match level="QueryCoverage=76%, HitCoverage=84%, E-value=1e-106, Identity=49%"; Hit description =RabGAP/TBC
  Pfam annotation: Domain name=TBC; Domain location=249-464; Score= -2.7; E_value=2e-07; Accession=PF00566.9; Description=TBC domain
MEKQKLKQLLLSHPSTLHFLLFQLGRFLCKLGHNSAAMLKGKLKLPAPDKVGRVFPDRLDSLVSGFYEKGHEIEGSEFKLESGEELEPVQPGELGFHMESDDDDDKERKIRQRPNRDSVTQVSVLKSVSEEEKRSDLEYELSQREINLEKLQRIANIGIPDGGGLRATAWKLLLGYLPSSHDLWDKKLKENRQKYANLKEDLLCNPFSLIILLNLRQSRHIWKECEELSSTRRHEDNDVDGPLRRHEISHEDHPLSLGKASLWSQYFQYTEIVEQIDRDLQRTHPDLPFFSGESSISCKNREAMKNILLLFAKLNPEIRYVQGMNEVLAPIYYVFSTDPDKQNAANVEADSFSCFVRILGDSVDHFCQQLDNSSSGILATLSRLSDLLEVNDEQLWRHLELRTKVKPQFYAFRWITLLLTQEFKFESILRIWDTLLSNPFGVQDMLLRICCAMLLCVKSKLLSGDFVTNIKLLQHYPDDINVEYLLQVAKDISPDTSNYCLSL

SEQ ID NO: 212259 - protein, 631 aa, Glycine max
  Coding DNA Sequence Number=SeqID_95481
  Gene Ontology: Mol. function=protein kinase activity; Cellular component=integral to membrane; Biological process=protein amino acid phosphorylation
  Homolog annotation: Hit_ID=Q6H4R9; Match level="QueryCoverage=79%, HitCoverage=80%, E-value=4e-72, Identity=34%"; Hit description =Putative receptor kinase
  Pfam annotation: Domain name=Pkinase; Domain location=295-554; Score=- 16.1; E_value=1.3e-07; Accession=PF00069.15; Description=Protein kinase domain
  Pfam annotation: Domain name=Pkinase_Tyr; Domain location=288-548; Score=-85.7; E_value=3.3e-07; Accession=PF07714.7; Description =Protein tyrosine kinase
  Pfam module annotation: Pfam domain module=Pkinase::Pkinase_Tyr; Domain location=295-554::288-548
  Subcellular localization annotation: CTP_CleavageSite=86; ConfidenceScore=5.01e-01
WNLLRADQRLIFAKSWPRASRYQQGHQDLFILRSDLPSQHRRTSALASVAVTLRVTTTPAALNAPLQGASHSPFRLRNCWEGRSVRASSLLRQLAKGGCAARRLSWGELELHRGGGRSRTSGSPGLQEFDPSFDFSNLDAFNVSNNNLQGQVPDVKGKFHEDSFSGNPNLCGKPLSQECPPPEKKDQNSFPNDLSIYSGYLVLGLIVLLFLTFKLLSKLKIKEKALDVEKKEMAEETVSVAGKASEISNSIVSKNGTVIRSECSLTSLESGMTTSGLVLLSSRTLRGLQFEDLLGAPAELIRRGKHGSLYKVMLDNGVLLAVKRIKDWGISKQDFERRMNLIAQAKHPRVLPPVAYYCSQQEKLLAYEYLQNGSLFMFLYGSQSGHSFDWRSRLNVAANIAEALAYMHEEFLENGIGHGNLKSSNILFDKNMDPCISEYGLMMAENQDQLVPSHNKGLKSKDLIAATFKADVHAFGMILLELLTGKVIKNDGFDLVKWVNSVVREEWTVEVFDKSLISQGSSEEKMMCLLQVALKCVNPSPNDRPREIKPLRDDKTEQAGWVEWGSQPTSPMWPALPNPPIYWTKVMKDRASEIILKSQRGINVAIEQQYLRLPPDLGALLKLHLVFGWRI

SEQ ID NO: 212260 - protein, 55 aa, Glycine max
  Coding DNA Sequence Number=SeqID_95482
MEFVTTIEEEPIIKSKKRNTISTKTKKSIFLDMGGFEDDSILPTFLHLLASDSSR

SEQ ID NO: 212261 - protein, 110 aa, Glycine max
  Coding DNA Sequence Number=SeqID_95483
MKKPGRTTTKFGADNKPMCLQSDLEGSKCSIHNIRVSFNSLTQYAIDSIVIKTTRRSIKIGSIKTRNWGSIAGAGRFLRERNPDIKVDLFTMRTFFTGREQGNKFLMLTL

SEQ ID NO: 212262 - protein, 238 aa, Glycine max
  Coding DNA Sequence Number=SeqID_95484
  Gene Ontology: Mol. function=transcription factor activity; Cellular component=nucleus; Biological process=regulation of transcription, DNA-dependent
  Homolog annotation: Hit_ID=Q2HUA6; Match level="QueryCoverage=88%, HitCoverage=98%, E-value=3e-50, Identity=53%"; Hit description =Pathogenesis-related transcriptional factor and ERF
  Pfam annotation: Domain name=AP2; Domain location=4-68; Score=130.4; E_value=5e-36; Accession=PF00847.10; Description=AP2 domain
MVQSKKFRGVRQRHWGSWVSEIRHPLLKRRVWLGTFETAEEAARAYDQAAILMSGRNAKTNFPITQTPEGDPKSTNSEDTPSTTSKDLEEILHAKLRKCSKVPSPSMTCLRLDTENSHIGVWQKRAGRRSDSNWVMTVQLGKKTVNNNETHQADSSSSSSLSSSLPSSQHHHHESPSLSVAGNLHHHQEVVRGEIDEEERIALQMIEELLNDRNCPSPSFDNNIQERDGADHHDNFFL

SEQ ID NO: 212263 - protein, 44 aa, Glycine max
  Coding DNA Sequence Number=SeqID_95485
MYSTKSIFTQFGRGILLCAAMLRYILEDKAEPPPEGRLSDATDG

SEQ ID NO: 212264 - protein, 221 aa, Glycine max
  Coding DNA Sequence Number=SeqID_95486
  Gene Ontology: Mol. function=protein serine/threonine kinase activity; Biological process=protein amino acid phosphorylation
  Homolog annotation: Hit_ID=Q6ZCR4; Match level="QueryCoverage=89%, HitCoverage=97%, E-value=8e-14, Identity=37%"; Hit description =Putative S-receptor kinase homolog 2
  Subcellular localization annotation: CTP_CleavageSite=34; ConfidenceScore=5.42e-01
MEAKEAFAIKSAISFSFPWPSISTSLPFMVSCIFAFEVTGGSSRLAVHTTVLLSPLTNQIATTKTLPSPCGYKPNANLPEGEIQKVFGTSKAPGSILVYCVSTLVSEDDETSKYLAPEWQKDAPISQREIHLSSWAYQCFAAGQLNKHVKEDEGTVDWRILERMVKVGLWCVQDSPPLHPSIKNVVLMLEGLKEIPHVPSTVVSFSSCIVVHVVLVIDMQS

SEQ ID NO: 212265 - protein, 541 aa, Glycine max
  Coding DNA Sequence Number=SeqID_95487
  Gene Ontology: Mol. function=protein serine/threonine kinase activity; Cellular component=cell surface; Biological process =protein amino acid phosphorylation
  Homolog annotation: Hit_ID=Q6Z9B2; Match level="QueryCoverage=92%, HitCoverage=61%, E-value=7e-62, Identity=33%"; Hit description =Putative S-receptor kinase homolog 2
  Pfam annotation: Domain name=B_lectin; Domain location=72-179; Score =63.6; E_value=6.6e-16; Accession=PF01453.15; Description=D-mannose binding lectin
  Pfam annotation: Domain name=S_locus_glycop; Domain location=214-321; Score=-38.9; E_value=0.026; Accession=PF00954.11; Description=S-locus glycoprotein family
  Pfam module annotation: Pfam domain module=B_lectin::S_locus_glycop; Domain location=72-179::214-321
MKDDAEPSAGDVMLEIYGTRVEMKQIQPGASLVPNTTLAWWPSPSGQFAFGFYPQEQGDAFVIAIWLVSGENKIVVWTARRDDPPVTSNAKLQLTKDGKFLLIDEHGEEKSIADIIAKASSASMLDSGNFVLYNNNSSIIWQSFDYPTDTLLGGQSLPNGHQLVSASSNNSHSTGRYRFKMQDDGNLVMYPVSTTDTALDAYWASSTTNSGFKTNLYLNQTGLLQILNDSDGSIMKTLYHHSSFPNDGNRIIYRSTLDFDGFFRLYKHFDNGSFQKAHHWPDENACAVKGFCGFNSYCTFNDTQPLCTCLPDFELIYPTDSTRGCKRSFQNEDCNGQKDSATFYDMKPMEDTFVGTDNPYFKAKMPKEDCSSACLADCSCEAVFYDDTEESCMKQRLPLRYLRRPGQDEFGVNQALLFLKVGNRSLNNGTGNDNPVPEQPSPTPIKTTRNKATVQIVVITSVFSLLLCSTIVISSHYMYKIRILSYERLMEMGNWGLSEELTLKRFSYSELKRATNNFKQKLGRGSFGAVYKGGLNKGVGK

SEQ ID NO: 212266 - protein, 353 aa, Glycine max
  Coding DNA Sequence Number=SeqID_95488
  Gene Ontology: Mol. function=superoxide dismutase activity; Cellular component=integral to membrane; Biological process=superoxide metabolic process
  Homolog annotation: Hit_ID=Q8LBH4; Match level="QueryCoverage=80%, HitCoverage=100%, E-value=9e-96, Identity=66%"; Hit description=Ids4- like protein
  Pfam annotation: Domain name=SPX; Domain location=1-162; Score=159.4; E_value=9.1e-45; Accession=PF03105.10; Description=SPX domain
MKFGKSLSSQIEKTLPEWRDKFLSYKELKKKLKQFDPPAAADERPGKRLKSDAVPDAADMSKEESDFRNLLENELDKFNTFFVEKEEEYIIRLKELQDRVAKVKDSSEEMMKIHKEIVDFHGEMVLLENYSALNYTGLVKILKKYDKRTGALIRLPFIQKVLQQPFFITDLLYKLVKECETMLDRLFPVNDPAPVSSETTPQAEGFDPSTSTTTKSDGLLIPKELAEIEYMESLYMKSTVSALHVLQEIRSGSSTVSMFSLPPLKISGSEETWKKIPVLEQTAKMHLEVTFISTLLPFHFLFLFDNNRADAKLHSEGGVIEKFNGSSGRLNGNYISGTDSVNIDINGGKHVEV

SEQ ID NO: 212267 - protein, 659 aa, Glycine max
  Coding DNA Sequence Number=SeqID_95489
  Gene Ontology: Mol. function=protein serine/threonine kinase activity; Cellular component=cell surface; Biological process =protein amino acid phosphorylation
  Homolog annotation: Hit_ID=Q6ZCR4; Match level="QueryCoverage=98%, HitCoverage=79%, E-value=1e-104, Identity=39%"; Hit description =Putative S-receptor kinase homolog 2
  Pfam annotation: Domain name=B_lectin; Domain location=74-182; Score =71.9; E_value=2e-18; Accession=PF01453.15; Description=D-mannose binding lectin
  Pfam annotation: Domain name=Pkinase; Domain location=511-656; Score=- 80.4; E_value=0.0009; Accession=PF00069.15; Description=Protein kinase domain
  Pfam annotation: Domain name=Pkinase_Tyr; Domain location=512-654; Score=-85.9; E_value=3.4e-07; Accession=PF07714.7; Description =Protein tyrosine kinase
  Pfam annotation: Domain name=S_locus_glycop; Domain location=202-326; Score=-34.1; E_value=0.012; Accession=PF00954.11; Description=S-locus glycoprotein family
  Pfam module annotation: Pfam domain module=B_lectin::Pkinase::Pkinase_ Tyr::S_locus_glycop; Domain location=74-182::511-656::512-654::202-326
MDDLLQCTTASQLLKLRIPEQGTGKRVIELGSRLSPEGNQSSWASSSGHFAFGFYSQGDGFAVGIWLVNVSPAENTIVWTANRDSPPLSSNSTLQLTKTGLLFFQDGRQGQVLLSNFVDVTSSASMLDSGNFVLYDDTHNTVVWQSFEHPTDTILGGQNLSINAKLVSSVSNSSHSSGRFFLLMQGDGNLVAYPVNSPETGGDAYWASNTKGSTFQHLSLNVLGFLCLSGPGNLHCFFNHSISPGMKLQNKTSIYRSTVDVDGNLRLYEHQLEGNGSSHVQVLWSTPLKKCETKGFCGFNSYCSIVTGHAMCECFPGFVPSKSNGSVSLDCVLAHSKGSCKSSEDAMISYKITMLENMSFSDSDDPYWVSQMKKEECEKSFLEDCDCMAVLYLNGNCRKYRLPLTYGRTIQNQVAVALFKVPSGIVDSSTPNNSTLKPRIIVDNKKRLVMVLAITLGCFLLLSLALAGFIFLIYKRKVYKYTKLFKSENLGFTKECSLHPFSFDELEISTRSFTEEIERGSFGAVYRGTIGDTNTSIAVKRLETIADEGEREFRTEITAIARTHHKNLVKLIGFCINGARKLLVYEYVSNGSLASLLFNDEKHMSWRDRLKIALDVARGVLYLHEECEVRIIHCSINPRNILMDEYGLQRSLILDWQSY

SEQ ID NO: 212268 - protein, 81 aa, Glycine max
  Coding DNA Sequence Number=SeqID_95490
MDTRLRVIGDPMNGVQRYTKMKFGGVVPFLIPMTRGEGHNSLFEDSPSECGGGAATVRYGLISKGHSRNKIQAQGRVTCYH

SEQ ID NO: 212269 - protein, 211 aa, Glycine max
  Coding DNA Sequence Number=SeqID_95491
MAEKTKKRLEEAAQSGSTEGVIDPLSPIRRHVKWKMARTEKTGQMTSEIVKEIAKKIDSLEEQASQGLFVPHGRPDLLTAAIGRPEHPGRGLALPPKPEVGPSATRVSTKESCVDPSPIDPETGDSNKCGLYIEDNPSRLIVLGRVYEGSTTVHNILLLHGQVKVGVEEVKDAEAPVPVPTDKAAVSLAKPPDRPNHKVDDPLYLMTLIIT

SEQ ID NO: 212270 - protein, 223 aa, Glycine max
  Coding DNA Sequence Number=SeqID_95492
  Homolog annotation: Hit_ID=Q5XM22; Match level="QueryCoverage=45%, HitCoverage=78%, E-value=2e-19, Identity=38%"; Hit description =Resistance-like protein HAAS-2
MATRHLCSKCDVRHWTIAARAYLMYLLGCTLFANKSAIHVHMVFLDAFRDLSQSGSYAWGAATVVHMYDNLNDASKSSDRQLVHFPSVAEAINVEDYHERSPCACRWTSTKASMKTNIDVYSDDSSTLPGLKIRLRRLNGLVLHDFTSIHEAGTAQGSSQTSTCRARFRYVKQDMLQYPVAVTTIEEAPVHAPSDVEQPRHAVEACQAIAERLERLLNLKDRY

SEQ ID NO: 212271 - protein, 43 aa, Glycine max
  Coding DNA Sequence Number=SeqID_95493
MYFINFLKVVGPLKMEALSHRSPSACVQNNTNGGSWILEVNHE

SEQ ID NO: 212272 - protein, 74 aa, Glycine max
  Coding DNA Sequence Number=SeqID_95494
  Subcellular localization annotation: CTP_CleavageSite=57; ConfidenceScore=5.21e-01
AGRDTTAARGWPTAGNKRTTATSQAPQLIYKGLSVAYDPWPTSRRPSPKPKVSKSTRSVTKSSRVQLKTLKKHY

SEQ ID NO: 212273 - protein, 64 aa, Glycine max
  Coding DNA Sequence Number=SeqID_95495
KQVPIAQKDLIWEDIQAEFDIPEASDVRTKKKILQAVGEQWRQFKSDLTLKWALAADKGSVDDT

SEQ ID NO: 212274 - protein, 87 aa, Glycine max
  Coding DNA Sequence Number=SeqID_95496
MSWGQETLGTSGGVLLPKTKLDQSRPNPGIVGQLENEVRKLGELLVIDYQGDVIDYQASERNWNTVEASGNRLPAWCNLLHRGMGPL

SEQ ID NO: 212275 - protein, 247 aa, Glycine max
  Coding DNA Sequence Number=SeqID_95497
  Gene Ontology: Mol. function=chitin binding; Cellular component =extracellular region; Biological process=chitin metabolic process
  Homolog annotation: Hit_ID=UPI000044A8F0; Match level="QueryCoverage =94%, HitCoverage=99%, E-value=8e-38, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
LHVLACRGLHVLAIRGQHPLTFRGQHVLAIRVLHDLTFRGLHVLAIRGLHALTFRGLHVLAIRGLHTLAFRGLQVLTIGGLQALTFRGLHVLAIRRLHTLAIRGLHVLAIRGQHALTFRGLHVLAIRGLHALSFRGLHVLAIEGLHALTFRGLHVLAIRGLHILSCRGLHVLAIRGLHALTFRELYVLAIRGLHALTFRGLHVLAIGRLHALTFRGLHVLVIRGLHVLACRGLHVLAIREFYVLTCR

SEQ ID NO: 212276 - protein, 49 aa, Glycine max
  Coding DNA Sequence Number=SeqID_95498
MMEDDDAAIEVRNHVSPEPEVENAGVASLSNPKRLVTNSECKMILKVQR

SEQ ID NO: 212277 - protein, 165 aa, Glycine max
  Coding DNA Sequence Number=SeqID_95499
  Gene Ontology: Mol. function=nucleic acid binding; Biological process= DNA integration
  Homolog annotation: Hit_ID=Q1SKA8; Match level="QueryCoverage=81%, HitCoverage=52%, E-value=6e-10, Identity=29%"; Hit description=Zinc finger, CCHC-type
  Pfam annotation: Domain name=zf-CCHC; Domain location=93-110; Score =27.5; E_value=2.8e-05; Accession=PF00098.13; Description=Zinc knuckle
MSLATLFGKLQEHEMKLLRLNQHEENDKRKGITLKASSSNQEESDKEDTIEIDENDDLSLFVKGLNKFLRVRGNQRRPNFKPKRRAEDSSSTSKCYECNQPGHLRVDCPIFKKRMEKSEKKNFNEKKAKRAYITWDDNDMDSSEDSENEVVNLSLMAKSYENDEE

SEQ ID NO: 212278 - protein, 194 aa, Glycine max
  Coding DNA Sequence Number=SeqID_95500
  Gene Ontology: Mol. function=RNA-directed DNA polymerase activity; Biological process=RNA-dependent DNA replication
  Homolog annotation: Hit_ID=Q8H6Q8; Match level="QueryCoverage=75%, HitCoverage=44%, E-value=7e-34, Identity=51%"; Hit description=CTV.20
  Pfam annotation: Domain name=Ku_C; Domain location=101-184; Score= -0.6; E_value=0.098; Accession=PF03730.4; Description=Ku70Ku80 C -terminal arm
MSDASVLTILNACGTEKIAQHFIGDPSLWKDRSAELLSNLKCRTLADFRWYRDTFLTRVYTREDSQQPFRKEKFLAGLPRSLGDKVRDKIRSQSANGDIPYENLSYGQLISYVQKVALKICQDDKIQRQLAKEKAQTKRDLGSFCEQFGLPACPKQKKKQTSRKEIQDHKPANRRGFSKRRYSQKPSTSKVWRP

SEQ ID NO: 212279 - protein, 167 aa, Glycine max
  Coding DNA Sequence Number=SeqID_95501
  Gene Ontology: Mol. function=nucleic acid binding; Biological process= DNA integration
MPFGEALQQMSLYSKFLKDMLTRKHMYIHQENIIVEGNCSAVIQKILPPKHKDPGSVTIPCLIGDVNVGKALIDLGANINLMPLSMCRRLGELEIMPTRKTLQLADRSITRPYGVIENVLVRVKHFIFPVDFVVMDISEDIDIPVILGRPFVLTASCIVDMERESCS

SEQ ID NO: 212280 - protein, 81 aa, Glycine max
  Coding DNA Sequence Number=SeqID_95502
MVISILQLDSMNLFVKARAWFNPITQGMAILIANTSTTFHRDERLGNMHTMHRKMQGSRTSKHENKRYAVCRTKSMLNAYA

SEQ ID NO: 212281 - protein, 135 aa, Glycine max
  Coding DNA Sequence Number=SeqID_95503
  Gene Ontology: Mol. function=protein binding; Cellular component =retromer complex; Biological process=retrograde transport, endosome to Golgi
  Homolog annotation: Hit_ID=Q0WRZ0; Match level="QueryCoverage=60%, HitCoverage=12%, E-value=9e-28, Identity=66%"; Hit description =Putative vacuolar sorting protein 35
AANDCDLEPVAYEFFTQAFVLYEEEIADSKAQREREYQGNHSTSAPKYSAKLLKKPDQCRAVYACSHLFWVDDQDGIKDGERGSSLCEGMGEGCCTQPYPCICKEAVSGFEPMTNKSPRHNFTAAPGFALYASAS

SEQ ID NO: 212282 - protein, 568 aa, Glycine max
  Coding DNA Sequence Number=SeqID_95504
MPFASASMEKRSEELGLSLMNTDSANHDRIPGVRHQNDTTVPLPLVSPSPFPHWHLHETSQYYNNEPAGVNSMIDSSQFRSYQNFQMDHNYYHRAEHNFLPCETDSCFPCPEGYIGWPYQYDRHNNLTIPVDVRDASFNLNNFEKPGNGGMCVTPSYGSASRLQMANPSGASMSANTGQPSLDMNLGMALCNPNKGCVEPLLTIGKRDERFMTTGSGSNNKESKSSAVTLKFNLTGNSDREFLPPVNIYHNQLGSRSSLNPGLDMNATFSAFQNDSEVISDLAPASNHEALFDSRPGLRLGPSYAFQWPAAGDQNHYLGQVNRDLGLGGVKDTSMEFTAVGHKNGLGCMDLNSLPIVGSLTMPFESGQRWANRQLAPSSSGTVTDKLPTELLPKNNDKFSLQLFSSPPLAVASGSTREQDLSNSWPPVGNHGQSQAGGSIQQSNSLLRPQSTSDVGIQAGKGYITAQVSRPSNLSSLKRAASQPLSSTIQNQQRKTLPTQFIHPSIPTPWTRLAPSVPNTSRAMSPLVRPALSLTPQAPHSVVPPSFPMTWTKSVLQAPNTTWAIPPR

SEQ ID NO: 212283 - protein, 296 aa, Glycine max
  Coding DNA Sequence Number=SeqID_95505
  Homolog annotation: Hit_ID=Q47522; Match level="QueryCoverage=14%, HitCoverage=54%, E-value=2e-19, Identity=100%"; Hit description=LacZ protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSIALEPAQALQAAGLQRPLQELRLALASGGRPVYVATPATELEPGRSSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 212284 - protein, 282 aa, Glycine max
  Coding DNA Sequence Number=SeqID_95506
  Pfam annotation: Domain name=Transposase_23; Domain location=62-126; Score=-7.7; E_value=0.0079; Accession=PF03017.5; Description =TNP1ENSPM transposase
MTMALKEAIKIELSHKGSLESLIIQPELQQLGARVSTKGSNAQSNAQPSREYDGDVIPKMGLYVQRKDGTLGLVAMGRIMDRDSVIRTVAYADDVVRVSVDTVIDPDAEIPYATSEIQYVKQTLHTFVAWPTDLVKLVLDEDEVIIPHKVDAHGDKPTNVEADDPMRGLIKYSFDIYNNPVEFKFDGSKFGIVDAPTSIFLTYSDVSEIIAGDKSLNISVQQLWLMYMHEWSETLGQGSNYAFLEPQSLVVSKDTHGECEKYLERWLKESDREVYIGPYFHQ

SEQ ID NO: 212285 - protein, 404 aa, Glycine max
  Coding DNA Sequence Number=SeqID_95507
  Gene Ontology: Mol. function=oxidoreductase activity; Cellular component=endoplasmic reticulum; Biological process=electron transport
  Homolog annotation: Hit_ID=Q2LAK0; Match level="QueryCoverage=99%, HitCoverage=79%, E-value=0.0, Identity=85%"; Hit description =Cytochrome P450 monooxygenase CYP701A16
  Pfam annotation: Domain name=p450; Domain location=44-404; Score=1.8; E_value=4.7e-11; Accession=PF00067.12; Description=Cytochrome P450
MESLTLSVTVAVVAFSILLFLLLLTRRHAGVGAGAGAGSLPPVPAVPGLPVIGNLLQLKEKKPYKTFTHMTHKHGPIYSIRTGASTLIVLNSPHLAKEAMVTRFSSISTRKLSNALKILSSDKCMVATSDYNEFHKTVKRHILTNLSGANAQKRHRIRREAMMENILSQFSEHIKTFSDLAANFRKIFATQLFGLALKQALGSNVETIYVEELGSTLSKEDIYKILVVDISEGAIEVDWRDFFPYLKWIPNRRMEMKIQNLHVRRKAVMKALMNEQKNRMASGKKVHCYFDYLVSEAKELTEDQISMLIWETIIGTSDTTLVTTEWAMYELAKDKTRQDRLYEELQYVCGHENVIEDQLSKLPYLGAVFHETLRKHSPAPMVPPRYVHEDTQLGGYHIPAGSEV

SEQ ID NO: 212286 - protein, 470 aa, Glycine max
  Coding DNA Sequence Number=SeqID_95508
  Gene Ontology: Mol. function=pepsin A activity; Cellular component =endoplasmic reticulum; Biological process=proteolysis
  Homolog annotation: Hit_ID=Q69P39; Match level="QueryCoverage=97%, HitCoverage=98%, E-value=1e-115, Identity=47%"; Hit description =Putative nucleoid DNA-binding protein cnd41, chloroplast
  Pfam annotation: Domain name=Asp; Domain location=121-465; Score= -75.6; E_value=3.8e-09; Accession=PF00026.14; Description=Eukaryotic aspartyl protease
MAASTPYSLFLLSLYLVIGIASGVQTKTFHLQRKLQHGTPECLLPQSRKEKGAIILEMKDRGECSESERKGDWVEKQLVLDGLHVRSIQNHIRKRTSSSQIADSSETQVPLTSGIKFQTLNYIVTMGLGSQNMSVIVDTGSDLTWVQCEPCRSCYNQNGPLFKPSTSPSYQPILCNSTTCQSLELGACGSDPSTSATCDYVVNYGDGSYTSGELGIEKLGFGGISVSNFVFGCGRNNKGLFGGASGLMGLGRSELSMISQTNATFGGVFSYCLPSTDQAGASGSLVMGNQSGVFKNVTPIAYTRMLPNLQLSNFYILNLTGIDVGGVSLHVQASSFGNGGVILDSGTVISRLAPSVYKALKAKFLEQFSGFPSAPGFSILDTCFNLTGYDQVNIPTISMYFEGNAELNVDATGIFYLVKEDASRVCLALASLSDEYEMGIIGNYQQRNQRVLYDAKLSQVGFAKEPCTFT

SEQ ID NO: 212287 - protein, 517 aa, Glycine max
  Coding DNA Sequence Number=SeqID_95509
  Gene Ontology: Mol. function=4-coumarate-CoA ligase activity; Cellular component=peroxisome; Biological process=metabolic process
  Homolog annotation: Hit_ID=Q8W558; Match level="QueryCoverage=98%, HitCoverage=98%, E-value=0.0, Identity=80%"; Hit description=4 -coumarate:CoA ligase
  Pfam annotation: Domain name=AMP-binding; Domain location=54-441; Score=346.1; E_value=5.8e-101; Accession=PF00501.18; Description=AMP- binding enzyme
MAVVERRRELIFRSKLPDIYIPKHLPLHTYCFENLPEYGARPCLINAPTGDVYSYEEVESTARKVARGLKKEGVEQGQVIMILLPNCPEFVFSFLGASHRGAMATAANPFFTPAEIAKQAHASNAKLLITQASYYDKVKDLRHIKLVFVDSCPPQHLHFSQLCEDNGDADVDIKPDDVVALPYSSGTTGLPKGVMLSHKGLVTSIAQQVDGDNPNLYYHCHDTILCVLPLFHIYSLNSVLLCGLRAKATILLMPKFDINSLLALIHKHKVTIAPVVPPIALAISKSPDLHNYDLSSIRVFKSGGAPLGKELEDTLRAKFPNAKLGQGYGMTEAGPVLTMSLAFAREPIDVKPGACGTVVRNAELKIVDPETGHSLPRNHSGEICIRGDQIMKGDIGYIDDDDELFIVDRLKELIKYKGFQVAPAELEALLLTHPKISDAAVVPMKDEAAGEVPVAFVVISNGYTDTTQDEIKQFISKQVVFYKRINRVFFIDAIPKSPSGKILRKDLRAKLTATVPT

SEQ ID NO: 212288 - protein, 356 aa, Glycine max
  Coding DNA Sequence Number=SeqID_95510
  Gene Ontology: Cellular component=nucleus; Biological process =response to DNA damage stimulus
  Homolog annotation: Hit_ID=Q84L33-2; Match level="QueryCoverage=75%, HitCoverage=65%, E-value=1e-33, Identity=79%"; Hit description =Isoform 2 of Q84L33
  Pfam annotation: Domain name=UBA; Domain location=104-144; Score=9.3; E_value=0.32; Accession=PF00627.21; Description=UBATS-N domain
  Pfam annotation: Domain name=UBA; Domain location=314-350; Score =30.1; E_value=7.6e-06; Accession=PF00627.21; Description=UBATS-N domain
  Pfam module annotation: Pfam domain module=UBA::UBA; Domain location =104-144::314-350
MEICRNIIFPLRRLCLALSARLKPRKNGAGLLKLQDDVQTCGYQDVQVMWEMLQRTEAFWNKCYEIENFAGFAGAEPASLAGTGDISGTDTYGQAASNLVAGSSLEQTIQQIMDLGGGSWDRDTVSRALRAAYNNPKRARIPEAAEIAVPAAPYPISQTTETGGVTAGAVSGVILIVQMDHQKFLYLVTAGAVSGAGAGIGSLELYKKCQDIKQKYLLLEHSRLLQLFYGLYDWIGAIWKCMMNMHMPSQYTAGIFSFKHYAQWCNPIHKFCRLIQEHHGEFLQLINDPVEGSEGDIFDQPEQDMPHAINVTPAEQEAIGRLEAMGFDRASVIEACDRDEQLAANYLLENAGDFED

SEQ ID NO: 212289 - protein, 105 aa, Glycine max
  Coding DNA Sequence Number=SeqID_95511
MAKKTVKRKGHKHNEKGEAKVGGKNAAAGGFRAEPVTDGPGMGEGAWCLALTERWETVMGRGHGVEEDGKSWLITLESNDIEFEIHGSLVAAEGLAPRFYTSNFY

SEQ ID NO: 212290 - protein, 239 aa, Glycine max
  Coding DNA Sequence Number=SeqID_95512
  Gene Ontology: Mol. function=cation transporter activity; Cellular component=integral to membrane; Biological process=cation transport
  Homolog annotation: Hit_ID=Q9ZQT4; Match level="QueryCoverage=99%, HitCoverage=52%, E-value=5e-91, Identity=78%"; Hit description =H+/Ca2+ exchanger 2
  Pfam annotation: Domain name=Na_Ca_ex; Domain location=139-235; Score= 25.1; E_value=0.00025; Accession=PF01699.14; Description =Sodiumcalcium exchanger protein
VVQQSLLGSILSNMLLVLGCAFFTGGLAHYKKVQVFDKAAAVVNSGLLLMAVMGILFPAVLYFTHSEVHQGKSVLSLSRFSSCIMLLAYASYLFFQLRSQQNVYSPVGEGGENGENSDVEEDLELTQWEAIIWLAILTAWVSILSGYLVDAIQGASESLNMSVAFISVILLPIVGNAAEHASAIMFAVKDKLDITIGVAIGSSTQISMFVEKVDDSYSLENCRSLSVWLLDGAWEKKWT

SEQ ID NO: 212291 - protein, 321 aa, Glycine max
  Coding DNA Sequence Number=SeqID_95513
  Gene Ontology: Mol. function=enzyme inhibitor activity; Cellular component=cell wall; Biological process=cell wall modification
  Homolog annotation: Hit_ID=Q1STF1; Match level="QueryCoverage=88%, HitCoverage=57%, E-value=2e-55, Identity=40%"; Hit description =Pectinesterase; Pectinesterase inhibitor
  Pfam annotation: Domain name=Pectinesterase; Domain location=21-303; Score=331.7; E_value=1.2e-96; Accession=PF01095.10; Description =Pectinesterase
MDSTTAVLLIFVSVLVCCHSTVIVSKDGSGNYTTVSEAIMKAPDMSDKPYTIHVRAGTYEEYVTIPAKKTNIKLVGDGPHLTKLVGYQNGSTIDVRGDGFMAEKMGFENWAGLKASAAVAVRNEAKKSVFFECSIQGVQDTLWAVSGSQFYKNCDIYGTVDFIYGNAAAVFQDCMLYARYSEYVTFTAQSREDPKEKTGFSFQRCKFTMSPQDSARKSKVLRATLGRPLRAYSTVAIFHSYIDSMVDPKGWEPMAHQPTDKVTYIEFHNFGPGSKTDHRVDWPGVKQTVDALPESGYTLIKEQQLIMETELSKEYMKNIDD

SEQ ID NO: 212292 - protein, 665 aa, Glycine max
  Coding DNA Sequence Number=SeqID_95514
  Gene Ontology: Mol. function=zinc ion binding; Cellular component =nucleus; Biological process=transcription
  Homolog annotation: Hit_ID=Q1SW42; Match level="QueryCoverage=92%, HitCoverage=89%, E-value=1e-163, Identity=46%"; Hit description =Heavy metal transport/detoxification protein
  Pfam annotation: Domain name=FAR1; Domain location=46-256; Score =192.8; E_value=8.2e-55; Accession=PF03101.5; Description=FAR1 family
  Pfam annotation: Domain name=SWIM; Domain location=527-577; Score =20.3; E_value=0.0022; Accession=PF04434.8; Description=SWIM zinc finger
  Pfam module annotation: Pfam domain module=FAR1::SWIM; Domain location=46-256::527-577
METAWYQRSLSLLPALEGAIEEKKNEAVPVAPAVGMEFDSYDDVYYFYNWYAKEQGFGVRVTNTWYRKTKERYRAKLSCSSAGFKKRTEANRPRPETRTGCPAMIKFRLMDSTRWRIIEVELDHNHLINPTSGKFYKSHKHIPLGTKRTFHLDDDHDHHHHLDAAAAQQVHKITMFRTVIVDAQDEGESQNALYSNQLKLNKGDSQAILNFFSHQQLADPHFFYVVDVNERGCLRNLFWADAKSRVAYTYFGDVVAIDTACLTAEFQVPLVLFLGINHHKQSILFGCGLLAGDTIESYTWLFRAWLTCILGRPPQVIITNQCGILQTVVADVFPRSTHCLCLFNIMQKIPEKLGVCIDYEATNAALSRAVYSSLMAEEFEATWEDMMKSNETRDNKWLQSLYEDRKRWAPVYLKEIFLAGMLPIQPSDVASFFFDGYLNEQTSLKEFLEKYDQILQTKRQLEALADLDSKSSSFEPKSRSYFVLQVSKLYTNEILRMFEREVEGMFSCFNSRQINADGPVVTYIVQEQVEVEGNQRDARDYKVCYNEAEMEVLCICGLFNFRGYLCRHALFILSQNGIKEIPAQYILSRWRKDMKRSNVDDHNGGGIHISNPVHRYDHLYRQVVKVVEEGKKSHDHYRTAVHALENILSKLHLVNVEDPNIMYKY

SEQ ID NO: 212293 - protein, 121 aa, Glycine max
  Coding DNA Sequence Number=SeqID_95515
RRETTTMGSGPDKVVGGSCMGSKSGGDGGGGDGGGMAGGVCMIVVAISMGDGVSSNGGDSGGVSGEVRGRGSNGARLGGGRVAEVVIGEERPVGCPGGGSESSVGGRQPWKLRMVSDNHGR

SEQ ID NO: 212294 - protein, 87 aa, Glycine max
  Coding DNA Sequence Number=SeqID_95516
  Gene Ontology: Mol. function=cation transporter activity; Cellular component=integral to membrane; Biological process=cation transport
  Homolog annotation: Hit_ID=Q9ZQT4; Match level="QueryCoverage=50%, HitCoverage=10%, E-value=3e-14, Identity=81%"; Hit description =H+/Ca2+ exchanger 2
MGGSVVEDNHDLDHDLDLDDTPLASASSKSHQQFHSFDFEDTTKINLLLPFGPFAILLHYVTGHHGWVFFFTLLGITPSAERLGYAT

SEQ ID NO: 212295 - protein, 1086 aa, Glycine max
  Coding DNA Sequence Number=SeqID_95517
  Gene Ontology: Mol. function=transmembrane receptor protein kinase activity; Cellular component=integral to membrane; Biological process=protein amino acid phosphorylation
  Homolog annotation: Hit_ID=P93194; Match level="QueryCoverage=99%, HitCoverage=98%, E-value=0.0, Identity=51%"; Hit description =Receptor-like protein kinase precursor
  Pfam annotation: Domain name=LRRNT_2; Domain location=22-64; Score =27.5; E_value=4.6e-05; Accession=PF08263.3; Description=Leucine rich repeat N-terminal domain
  Pfam annotation: Domain name=LRR_1; Domain location=116-138; Score =12.3; E_value=1.4; Accession=PF00560.23; Description=Leucine Rich Repeat
  Pfam annotation: Domain name=LRR_1; Domain location=140-162; Score =14.3; E_value=0.44; Accession=PF00560.23; Description=Leucine Rich Repeat
  Pfam annotation: Domain name=LRR_1; Domain location=164-186; Score =13.2; E_value=0.92; Accession=PF00560.23; Description=Leucine Rich Repeat
  Pfam annotation: Domain name=LRR_1; Domain location=188-210; Score =14.9; E_value=0.29; Accession=PF00560.23; Description=Leucine Rich Repeat
  Pfam annotation: Domain name=LRR_1; Domain location=212-235; Score =4.6; E_value=39; Accession=PF00560.23; Description=Leucine Rich Repeat
  Pfam annotation: Domain name=LRR_1; Domain location=237-259; Score =17.4; E_value=0.053; Accession=PF00560.23; Description=Leucine Rich Repeat
  Pfam annotation: Domain name=LRR_1; Domain location=261-283; Score =3.6; E_value=60; Accession=PF00560.23; Description=Leucine Rich Repeat
  Pfam annotation: Domain name=LRR_1; Domain location=285-307; Score =11.5; E_value=2; Accession=PF00560.23; Description=Leucine Rich Repeat
  Pfam annotation: Domain name=LRR_1; Domain location=309-331; Score =17.1; E_value=0.062; Accession=PF00560.23; Description=Leucine Rich Repeat
  Pfam annotation: Domain name=LRR_1; Domain location=333-355; Score =8.7; E_value=6.7; Accession=PF00560.23; Description=Leucine Rich Repeat
  Pfam annotation: Domain name=LRR_1; Domain location=357-379; Score =11.1; E_value=2.4; Accession=PF00560.23; Description=Leucine Rich Repeat
  Pfam annotation: Domain name=LRR_1; Domain location=381-400; Score =7.1; E_value=14; Accession=PF00560.23; Description=Leucine Rich Repeat
  Pfam annotation: Domain name=LRR_1; Domain location=405-424; Score =12.2; E_value=1.5; Accession=PF00560.23; Description=Leucine Rich Repeat
  Pfam annotation: Domain name=LRR_1; Domain location=429-451; Score =11.6; E_value=1.9; Accession=PF00560.23; Description=Leucine Rich Repeat
  Pfam annotation: Domain name=LRR_1; Domain location=453-474; Score =12.3; E_value=1.4; Accession=PF00560.23; Description=Leucine Rich Repeat
  Pfam annotation: Domain name=LRR_1; Domain location=476-498; Score =15.4; E_value=0.21; Accession=PF00560.23; Description=Leucine Rich Repeat
  Pfam annotation: Domain name=LRR_1; Domain location=500-522; Score =7.3; E_value=12; Accession=PF00560.23; Description=Leucine Rich Repeat
  Pfam annotation: Domain name=LRR_1; Domain location=524-546; Score =18.6; E_value=0.022; Accession=PF00560.23; Description=Leucine Rich Repeat
  Pfam annotation: Domain name=LRR_1; Domain location=548-570; Score =3.4; E_value=67; Accession=PF00560.23; Description=Leucine Rich Repeat
  Pfam annotation: Domain name=LRR_1; Domain location=572-591; Score =10.4; E_value=3.3; Accession=PF00560.23; Description=Leucine Rich Repeat
  Pfam annotation: Domain name=LRR_1; Domain location=596-618; Score =6.8; E_value=15; Accession=PF00560.23; Description=Leucine Rich Repeat
  Pfam annotation: Domain name=LRR_1; Domain location=645-666; Score =16.1; E_value=0.13; Accession=PF00560.23; Description=Leucine Rich Repeat
  Pfam annotation: Domain name=LRR_1; Domain location=668-690; Score =9.4; E_value=5; Accession=PF00560.23; Description=Leucine Rich Repeat
  Pfam annotation: Domain name=LRR_1; Domain location=92-114; Score =18.5; E_value=0.024; Accession=PF00560.23; Description=Leucine Rich Repeat
  Pfam annotation: Domain name=Pkinase; Domain location=796-1074; Score= 132.0; E_value=1.7e-36; Accession=PF00069.15; Description=Protein kinase domain
  Pfam annotation: Domain name=Pkinase_Tyr; Domain location=796-1074; Score=52.5; E_value=1.1e-15; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR_1::LRR_ 1::LRR_1::...
  Pfam module annotation: Pfam domain module=Pkinase::Pkinase_Tyr; Domain location=22-64::116-138::140-162::164-186::188-210::212 -235::237-259::261-283::285-307::309-331::333-355::357-379::381 -400::405-424::429-451::...
  Pfam module annotation: Domain location=453-474::476-498::500 -522::524-546::548-570::572-591::596-618::645-666::668-690::92 -114::796-1074::796-1074
  Subcellular localization annotation: CTP_CleavageSite=19; ConfidenceScore=5.24e-01
MSMIWIVFFSLSCMSCAVVSSLTSDGVTLLSLLRHWTSVPPSINATWLASDTTPCSSWVGVQCDHSHHVVNLTLPDYGIAGQLGPEIGNLSRLEYLELASNNLTGQIPDAFKNMHNLNLLSLPYNQLSGEIPDSLTHAPQLNLVDLSHNTLSGSIPTSIGNMTQLLQLYLQSNQLSGTIPSSIGNCSKLQELFLDKNHLEGILPQSLNNLNDLAYFDVASNRLKGTIPFGSAASCKNLKNLDLSFNDFSGGLPSSLGNCSALSEFSAVNCNLDGNIPPSFGLLTKLSILYLPENHLSGKVPPEIGNCMSLTELHLYSNQLEGNIPSELGKLRKLVDLELFSNQLTGEIPLSIWKIKSLKHLLVYNNSLSGELPLEMTELKQLKNISLFSNQFSGVIPQSLGINSSLVLLDFTNNKFTGNIPPNLCFGKKLNILNLGINQLQGSIPPDVGRCTTLRRLILQQNNFTGPLPDFKSNPNLEHMDISSNKIHGEIPSSLRNCRHITHLILSMNKFNGPIPSELGNIVNLQTLNLAHNNLEGPLPSQLSKCTKMDRFDVGFNFLNGSLPSGLQSWTRLTTLILSENHFSGGLPAFLSEYKMLSELQLGGNMFGGRIPRSVGALQSLRYGMNLSSNGLIGDIPVEIGNLNFLERLDLSQNNLTGSIEVLGELLSLVEVNISYNSFHGRVPKKLMKLLKSPLSSFLGNPGLCTTTRCSASDGLACTARSSIKPCDDKSTKQKGLSKVEIVMIALGSSILVVLLLLGLVYIFYFGRKAYQEVHIFAEGGSSSLLNEVMEATANLNDRYIIGRGAYGVVYKALVGPDKAFAAKKIGFAASKGKNLSMAREIETLGKIRHRNLVKLEDFWLREDYGIILYSYMANGSLHDVLHEKTPPLTLEWNVRNKIAVGIAHGLAYLHYDCDPPIVHRDIKPSNILLDSDMEPHIADFGIAKLLDQSSASNPSISVPGTIGYIAPENAYTTTNSRESDVYSYGVVLLELITRKKAAESDPSFMEGTIVVDWVRSVWRETGDINQIVDSSLAEEFLDIHIMENITKVLMVALRCTEKDPHKRPTMRDVTKQLADANPRARSTKG

SEQ ID NO: 212296 - protein, 130 aa, Glycine max
  Coding DNA Sequence Number=SeqID_95518
  Subcellular localization annotation: CTP_CleavageSite=64; ConfidenceScore=5.56e-01
MHLATPVTLLLLSLPPSTQPLLAAWVDSSSFSSSSCATSIGGGASPCSAFFFFVLLLTIADDVEASIDPHRDLGLPRHVIAKTLEQHLNEVTPDTSTHEIIQKCLRIVRVVTEDDNLYVRSQRRRCTDQP

SEQ ID NO: 212297 - protein, 81 aa, Glycine max
  Coding DNA Sequence Number=SeqID_95519
MEINIHPVEFRDKGKKENEKSEMEMGKQNSTKSTLLPCLRIMQWQLINCLSSMLIITFESRELLKARTSSSRTAGIKAQLD

SEQ ID NO: 212298 - protein, 156 aa, Glycine max
  Coding DNA Sequence Number=SeqID_95520
TGAASQLPSTLKRTRKATRLRSLATRPVGAERPLVHVDPVTGKGDGPHIKKLRTYLGIVAHDKVDVTYENWKQVPANQKDLIWEDIQLNLISLKWALSADKESVDDTVCEKYDISKEKWTQFCQTRRHMAETKFKTGCVPRSLPEWGTLANGHHFA

SEQ ID NO: 212299 - protein, 83 aa, Glycine max
  Coding DNA Sequence Number=SeqID_95521
MVKKAKESLTLRQMRVFSLDTLEDTQNEERNMKRKRDDEDKDDQDDTAQENDNLPKEWKTSKNHPLDNIIGDISKGVTTRHPS

SEQ ID NO: 212300 - protein, 76 aa, Glycine max
  Coding DNA Sequence Number=SeqID_95522
GVYPDLSSFTGSGVYPDLSSFTGSGVIQTSVACIKRSAPQDSHHKGSVDPRTGALIPNDMNPHGTRADLGSSRIKP

SEQ ID NO: 212301 - protein, 173 aa, Glycine max
  Coding DNA Sequence Number=SeqID_95523
  Gene Ontology: Mol. function=protein serine/threonine kinase activity; Cellular component=integral to membrane; Biological process=protein amino acid phosphorylation
  Homolog annotation: Hit_ID=Q2HV99; Match level="QueryCoverage=78%, HitCoverage=17%, E-value=3e-31, Identity=53%"; Hit description =Protein kinase; Type I EGF
MVQGTFGYLDPEYMLTSQLTEKSDVYSFGVVLVELLTGEKPHSFGKPEEKRSLANHFLSCLKEDRLFDVFQVGIVNEENKKEIVEVAILAAKCLRLNGEERPSMKEVAMELDAIRQKEKHPWISGDQNIEETQFLLHDASSSIYADGDSSSHQYTTGYDSIRDHVLIALDNGR

SEQ ID NO: 212302 - protein, 112 aa, Glycine max
  Coding DNA Sequence Number=SeqID_95524
  Gene Ontology: Mol. function=hydrolase activity, acting on glycosyl bonds; Biological process=peptidoglycan catabolic process
  Homolog annotation: Hit_ID=Q5PJR8; Match level="QueryCoverage=84%, HitCoverage=80%, E-value=7e-14, Identity=43%"; Hit description=Phage- like lysozyme
MNGLTLEISSAAIELIKKHQGLSLEKYRDEHGLWVIGYGHVIRDREQFHGPVTPLEADALLHEDIRLCEALLRENVTRPLTQQQHDTLVMMMFSFGEIPSLPEAIFQAVARV

SEQ ID NO: 212303 - protein, 348 aa, Glycine max
  Coding DNA Sequence Number=SeqID_95525
  Homolog annotation: Hit_ID=Q7N8F0; Match level="QueryCoverage=37%, HitCoverage=87%, E-value=6e-31, Identity=45%"; Hit description=MrfG protein
MVGGRRVFALRPGALPLILLGKLQQRRHAVVRLRNAGEQQSDTAEQTQPHLTCSPRSASPRIHRLLRVAVYPRAQIGVLRSAAHQAVEGLFIALMLLLVDVAAGTAAAARPHAACAKPLLTALAQPDFGCGGAQRQQAQQAHAQGAIEGLYHHCVFCPCRRLFVFQRKSGHRAEGAAANGLRLDSLRLPLHIGLQRERGVAGIQAEFIAGAIERQRLAAAVLQPDADPRSHAAGIQRQQAGQFGVLGAGKRNGHRIAQAEIALGQVQRESLAMGAGVQIQRPVKAHVFRRVRRLCHHAGHHDHACPQQRAPAPAEIDRRTVGAGAQRRRGAHRRHRIRQGVLSRRQQD

SEQ ID NO: 212304 - protein, 37 aa, Glycine max
  Coding DNA Sequence Number=SeqID_95526
MQYLGSDPRSSPNEQWSIKAACTSDFNLEIKSSVYVA

SEQ ID NO: 212305 - protein, 462 aa, Glycine max
  Coding DNA Sequence Number=SeqID_95527
  Gene Ontology: Mol. function=hydrolase activity, acting on glycosyl bonds; Cellular component=membrane; Biological process=nucleoside catabolic process
  Homolog annotation: Hit_ID=Q6FE32; Match level="QueryCoverage=54%, HitCoverage=86%, E-value=3e-78, Identity=57%"; Hit description =Putative MTA/SAH nucleosidase [Includes: 5'-methylthioadenosine nucleosidase ; ...
  Homolog annotation: Hit description=S-adenosylhomocysteine nucleosidase]
  Pfam annotation: Domain name=PNP_UDP_1; Domain location=211-455; Score=54.2; E_value=4.3e-13; Accession=PF01048.10; Description =Phosphorylase family
MCAAHDLTKAHQHAERNAAAPAPPGQARALRIKQEKQRHDRETARGVPAGETAAGARQRRHRTEQREGHRLAAVLDQIPRTGVRAGGLENAHHQRADAEKQHADDQARAAAIDAPKQRQYRPDDHYLLQQAVVDQIQPIIVLPREMPAGGIVPKVADRPVQLFAAGEPQEQQAADQQAKNLPTNNARVLLLAAAGAAFSPLSFGQPAAAGPIVVQGAMPVEAERFAQRLENPREEQIGGWRFWHGTVDGYPVVVSETLKGMSNAAAATAIAATQFRPVAIINQGTAGGHDPALKVYDIVLGKYSVNLGAFKTPAKMLGEGSDSRQWQPMDLLASKGSAGEDKKAHSLRQFPADPNLLAIAQSVKSDYRQGKVVEGVIGSADVWNSELDRIRYFHDSYQTSVEEMETASAAQIAAEFKVPFVGIRVLSNNITNQGKYDPQTGLACQDYVYQVVKAYIANLKKH

SEQ ID NO: 212306 - protein, 131 aa, Glycine max
  Coding DNA Sequence Number=SeqID_95528
  Subcellular localization annotation: CTP_CleavageSite=27; ConfidenceScore=5.48e-01
MRGVGKTQLKIASSLVYGLFCVRKASRCSSRSVVPSYHSRLSGFQPRVWEQSARRLRGISHKPPVDHVSVMVVGEGLKPLEGVFHLRPDRVLTMGEKKKGCRVCFTTTPQWVTNALTKIGSFLMSGWTWLR

SEQ ID NO: 212307 - protein, 214 aa, Glycine max
  Coding DNA Sequence Number=SeqID_95529
MVEWGLGLHTSALKVPLTGGGTCKTEDSDAQGVCPVSREFVWGDSLDKQRRGSLDECESHSSMWLVKPLSLGMHCSCCLCHVICDGLVFGVPCELPPITEKFISPIKWSGHLIRVTAHCPPAFLLLDFRLPLLLSSLLKPIRDWEVILIGGSWSKDTHRGASDSESFSSKRGTTFFDCLGASPGYCNPPPSASGVRGELVVVERIDERLSAHHG

SEQ ID NO: 212308 - protein, 131 aa, Glycine max
  Coding DNA Sequence Number=SeqID_95530
  Gene Ontology: Mol. function=signal transducer activity; Cellular component=integral to membrane; Biological process=signal transduction
  Homolog annotation: Hit_ID=P77172; Match level="QueryCoverage=91%, HitCoverage=16%, E-value=5e-44, Identity=71%"; Hit description=Inner membrane protein yfgF
  Pfam annotation: Domain name=EAL; Domain location=1-118; Score=9.1; E_ value=3.4e-11; Accession=PF00563.11; Description=EAL domain
LIFELTENHSLSNPEQAQQTLARLQELGCRVAIDDFGTGYASYARLKTLNVDMLKIDGSFIRNLVTSSLDYQVVVSICRLAQIKNMQVVAEYVESPEIRQAVISLGIDYMQGFDIGMPVPIEQLACAADVA

SEQ ID NO: 212309 - protein, 94 aa, Glycine max
  Coding DNA Sequence Number=SeqID_95531
MRSLSQHIGGYILCGTSRGYIYLGLTENKRRYISCGSVLMKGTSTRFKENKGGPLDPTPPSRLAWLKAPTAVSALILRLARDFDANALPYSPLR

SEQ ID NO: 212310 - protein, 76 aa, Glycine max
  Coding DNA Sequence Number=SeqID_95532
MMSTSSRRLGDSSPEFHFLHPAAVILLPRTMFVIITAPLPYVISLGAQRCCLPNDKSPQYKVHLTTVIIFPVSYEL

SEQ ID NO: 212311 - protein, 94 aa, Glycine max
  Coding DNA Sequence Number=SeqID_95533
MELKFIKLSLCLHFNLRMCVFYMNLRNDGPAEGSGGTANQPIPSLLLVVPLSPQHVPQILLAVPLGIPYPAIVTDGSIFSPVSMMTPISRSDPP

SEQ ID NO: 212312 - protein, 49 aa, Glycine max
  Coding DNA Sequence Number=SeqID_95534
MESHEDRTLSKQSEEKLEESQEIARDAVIAAGTYVSPLRGKGCVYRNWG

SEQ ID NO: 212313 - protein, 512 aa, Glycine max
  Coding DNA Sequence Number=SeqID_95535
  Gene Ontology: Mol. function=binding; Cellular component =intracellular; Biological process=regulation of transcription
  Homolog annotation: Hit_ID=Q9LWW0; Match level="QueryCoverage=96%, HitCoverage=97%, E-value=1e-123, Identity=46%"; Hit description =Pentatricopeptide (PPR) repeat-containing protein-like
  Pfam annotation: Domain name=PPR; Domain location=119-152; Score =17.2; E_value=0.061; Accession=PF01535.11; Description=PPR repeat
  Pfam annotation: Domain name=PPR; Domain location=181-215; Score =35.3; E_value=2.1e-07; Accession=PF01535.11; Description=PPR repeat
  Pfam annotation: Domain name=PPR; Domain location=284-318; Score =34.5; E_value=3.6e-07; Accession=PF01535.11; Description=PPR repeat
  Pfam annotation: Domain name=PPR; Domain location=319-353; Score=3.4; E_value=3; Accession=PF01535.11; Description=PPR repeat
  Pfam annotation: Domain name=PPR; Domain location=355-389; Score =14.9; E_value=0.13; Accession=PF01535.11; Description=PPR repeat
  Pfam annotation: Domain name=PPR; Domain location=421-455; Score=5.2; E_value=1.8; Accession=PF01535.11; Description=PPR repeat
  Pfam annotation: Domain name=PPR; Domain location=84-118; Score=9.1; E_value=0.63; Accession=PF01535.11; Description=PPR repeat
  Pfam module annotation: Pfam domain module=PPR::PPR::PPR::PPR::PPR::PP R::PPR; Domain location=119-152::181-215::284-318::319-353::355 -389::421-455::84-118
MRQVKQIHGYTLRNGIDQTKILIEKLLEIPNLHYAHKVLHHSPKPTLFLYNKLIQAYSSHPQHQHQCFSLYSQMLLHSFLPNQHTFNFLFSACTSLSSPSLGQMLHTHFIKSGFEPDLFAATALLDMYTKVGTLELARKLFDQMPVRGVPTWNAMMAGHARFGDMDVALELFRLMPSRNVVSWTTMISGYSRSKKYGEALGLFLRMEQEKGMMPNAVTLASIFPAFANLGALEIGQRVEAYARKNGFFKNLYVSNAVLEMYAKCGKIDVAWKVFNEIGSLRNLCSWNSMIMGLAVHGECCKTLKLYDQMLGEGTSPDDVTFVGLLLACTHGGMVEKGRHIFKSMTTSFNIIPKLEHYGCMVDLLGRAGQLREAYEVIQRMPMKPDSVIWGALLGACSFHDNVELAEIAAESLFALEPWNPGNYVILSNIYASAGQWDGVAKLRKVMKGSKITKSAGHSFIEEGGQLHKFIVEDRSHPESNEIFALLDGVYEMIKLNRSAFECHLDLDLSNYS

SEQ ID NO: 212314 - protein, 1004 aa, Glycine max
  Coding DNA Sequence Number=SeqID_95536
  Gene Ontology: Mol. function=ubiquitin-protein ligase activity; Cellular component=ubiquitin ligase complex; Biological process =protein ubiquitination
  Homolog annotation: Hit_ID=Q1SHI6; Match level="QueryCoverage=99%, HitCoverage=100%, E-value=0.0, Identity=67%"; Hit description=U box
  Pfam annotation: Domain name=Arm; Domain location=445-485; Score=1.7; E_value=7.6; Accession=PF00514.13; Description=Armadillobeta-catenin -like repeat
  Pfam annotation: Domain name=Arm; Domain location=527-567; Score =27.4; E_value=5.1e-05; Accession=PF00514.13; Description =Armadillobeta-catenin-like repeat
  Pfam annotation: Domain name=Arm; Domain location=663-704; Score=3.7; E_value=4.2; Accession=PF00514.13; Description=Armadillobeta-catenin -like repeat
  Pfam annotation: Domain name=Arm; Domain location=707-745; Score=0.3; E_value=11; Accession=PF00514.13; Description=Armadillobeta-catenin -like repeat
  Pfam annotation: Domain name=Arm; Domain location=749-795; Score =12.7; E_value=0.32; Accession=PF00514.13; Description=Armadillobeta -catenin-like repeat
  Pfam annotation: Domain name=Arm; Domain location=872-912; Score =14.2; E_value=0.21; Accession=PF00514.13; Description=Armadillobeta -catenin-like repeat
  Pfam annotation: Domain name=Arm; Domain location=916-956; Score =12.3; E_value=0.36; Accession=PF00514.13; Description=Armadillobeta -catenin-like repeat
  Pfam annotation: Domain name=HEAT; Domain location=532-569; Score =9.9; E_value=2.6; Accession=PF02985.12; Description=HEAT repeat
  Pfam annotation: Domain name=HEAT; Domain location=669-706; Score =13.4; E_value=0.83; Accession=PF02985.12; Description=HEAT repeat
  Pfam annotation: Domain name=HEAT; Domain location=804-840; Score =7.9; E_value=4.7; Accession=PF02985.12; Description=HEAT repeat
  Pfam annotation: Domain name=HEAT; Domain location=877-914; Score =2.5; E_value=21; Accession=PF02985.12; Description=HEAT repeat
  Pfam annotation: Domain name=HEAT; Domain location=921-958; Score =7.6; E_value=5; Accession=PF02985.12; Description=HEAT repeat
  Pfam annotation: Domain name=U-box; Domain location=262-331; Score =52.4; E_value=1.5e-12; Accession=PF04564.6; Description=U-box domain
  Pfam module annotation: Pfam domain module=Arm::Arm::Arm::Arm::Arm::Ar m::Arm::HEAT::HEAT::HEAT::HEAT::HEAT::U-box; Domain location=445 -485::527-567::663-704::707-745::749-795::872-912::916-956::532 -569::669-706::804-840:...
  Pfam module annotation: Domain location=:877-914::921-958::262-331
MMVLDVLSGPTGTAISQTVDTIADFLVTANDVLVQKDSFKELAAYMERIKPVLEELRKGKVSDSERFNRTIEIMNKEIKDANQLCLDCSKKSKFYLLMNCRSIAKSLENHTKQLSRALGLLPLATTGLSSGIGEEIEKLCEDMKTAGFKAALAEEEILEKIESGIRENNVDRSYANKLLLDITDAVGIGNERSTIKIELEEFKSEIENARVRKDLAEAMQMDQIIALLERADAASSTKDKELKYFAKRQSLGTQIMEPLQSFYCPITQDVMVDPVEISSGQTFERSAIEKWFAEGNKLCPLTLIPLDTSILRPNKKLKQSIQEWKDRNIMITIATLKEKILSGNDEEVLHDLETLQTLCEEKNQHREWVILEDYIQTLIQILSKNRDIRKLSLFILGMLAKDNEDAKKRISAADHAIESIVRSLGRRPEERKLAVALLLELSKYDAAREHIGKVQGCILLLVTMSSGDDNQAARDATELLENLSYSAQNVIQMAKTNYFKHLLQHLSTGPDDVKMTMATNLAEMELTDHNRESLFDGGVLVPLLHMFLHNDLQVKTVAIKALKNLSSSKKNGQEMIRQGAARPLLNLLFNQSLHTTGLWEDVAAIIMQLAASTISQDSQTPVLLLDFDDDVSRLFNLVSVPQSAVQVQQNIIQTFYSLCQTPSASFIRTKLIECSAVPELVQLCENENLNLRASAVKLFSCLVESCDEGIIQEHVNQKCINTLLQIIKSPSDEEEILSAMGIICYLPEVDQITQWLLDAGALPIIKTYVQNGENRDHQRNNLVENAIGALCRFTVPTNLEWQKSAAETGIMTLLVQLLENGTNLTKQRVAQSLAQFSKSSFKLSRPISKRKGLWCFSAPADIGCMVHEGICSVKSSFCLLEANAVGPLTRTLGEPDPGVCEASLDALLTLIEGERLQSGSKVLSEANAIPLIIRYLGSTSPGLQEKSLHALERIFRLVEYKQMYGASAQMPLVDLTQRGNGSVRSMSARILAHLNVLHDQSSYF

SEQ ID NO: 212315 - protein, 68 aa, Glycine max
  Coding DNA Sequence Number=SeqID_95537
IFGPDVLDIVSDIVDPAAFVLPCALCSNSSIFGQDVLDIVSDIVDPAASILHLTFYLALCIVQPDLIP

SEQ ID NO: 212316 - protein, 304 aa, Glycine max
  Coding DNA Sequence Number=SeqID_95538
  Gene Ontology: Mol. function=adenosylmethionine-8-amino-7 -oxononanoate transaminase activity; Cellular component=cytosol; Biological process=biotin biosynthetic process
  Homolog annotation: Hit_ID=Q1H4D9; Match level="QueryCoverage=99%, HitCoverage=69%, E-value=1e-112, Identity=68%"; Hit description =Adenosylmethionine-8-amino-7-oxononanoate aminotransferase
  Pfam annotation: Domain name=Aminotran_3; Domain location=1-301; Score=233.3; E_value=5.3e-67; Accession=PF00202.11; Description =Aminotransferase class-III
MLAGFTHEPVVALSEKLSALTGLGHAFYGSDGASATEIALKMSFHYWRNIGQPLKTKFISLQNSYHGETLGALSVTDVAIFKDTYAPLILQSAQMQSPDSRLAEAGETEEAYALRCAEALEAYVAEHHATLAAFIIEPLVQGAAGMAMYHPVYLQRAREICSRYQVHVIADEIAVGFGRTGTLFACEQAGEKVSDIADFICLSKGITGGYLPLSVVLTTDKVYQAFYHDQTVKGFLHSHSYTGNPLACSAAVATLQLFESADVLANNLRTAQTLLASVNEYDFDRQHIRQRGMITAFEVTTDNP

SEQ ID NO: 212317 - protein, 171 aa, Glycine max
  Coding DNA Sequence Number=SeqID_95539
  Gene Ontology: Mol. function=nucleoside-triphosphatase activity; Cellular component=membrane; Biological process=cell division
  Homolog annotation: Hit_ID=Q1SHI2; Match level="QueryCoverage=95%, HitCoverage=32%, E-value=2e-50, Identity=65%"; Hit description=AAA ATPase
MDGIVSACCGEERVMVFTMNSKECVDPDLLRPGRVDVHIHFPVCDFSAFKTLASSYLGVRKHKLFAQVEEIFRHGATLSPAEISELMIANRTSPSRAIKSVIGALQSDGDGRRSYADSIRRRIEGDDVDKAPCGGDGFSTVKDIRKLYGFFKLRNGRRTSQQQSNSSPHDT

SEQ ID NO: 212318 - protein, 169 aa, Glycine max
  Coding DNA Sequence Number=SeqID_95540
MAIAEALERETKRDRKEEHGRNKFRGALWGSNSELKLRRNERDQSRVEVMILKDELKASLRSKRSLSQQLSETEGNMLAIIDKYKEELNLAATHEQRLKDEYAKVSVEKDAKGRVIDSLYREAMMWMNIFAFTLNGSQELPQLLAKAKAMANVYLAPKKFMGSSTIAST

SEQ ID NO: 212319 - protein, 261 aa, Glycine max
  Coding DNA Sequence Number=SeqID_95541
  Gene Ontology: Mol. function=nucleotide binding; Cellular component =membrane; Biological process=small GTPase mediated signal transduction
  Homolog annotation: Hit_ID=Q9ST41; Match level="QueryCoverage=99%, HitCoverage=100%, E-value=1e-100, Identity=75%"; Hit description=PRA2
  Pfam annotation: Domain name=Arf; Domain location=17-210; Score= -82.5; E_value=0.0021; Accession=PF00025.11; Description=ADP -ribosylation factor family
  Pfam annotation: Domain name=MMR_HSR1; Domain location=33-165; Score=- 10.9; E_value=0.0099; Accession=PF01926.13; Description=GTPase of unknown function
  Pfam annotation: Domain name=Miro; Domain location=34-165; Score =60.0; E_value=7.6e-15; Accession=PF08477.3; Description=Miro-like protein
  Pfam annotation: Domain name=Ras; Domain location=34-212; Score =285.2; E_value=1.3e-82; Accession=PF00071.12; Description=Ras family
  Pfam module annotation: Pfam domain module=Arf::MMR_HSR1::Miro::Ras; Domain location=17-210::33-165::34-165::34-212
MNPEMNGVEAEKRQENGHEKVDYDVQEKIDYVFKVVVIGDSAVGKTQILSRFAKNEFCFDSKSTIGVEFQTRTVTINAKVIKAQIWDTAGQERGDKPTKINSHKFNTLHRYRAVTSAYYRGALGAMLVYDITKRQSFDHVARWVEELRAHADSSIVIMLVGNKADLVDQRMVPTEDAVEFAEDQGLFFSETSALSGDNVESAFLKLLEEINRVVSKKALECGLGKENGDTNVASLKGTKVDIILGPELEISEMKKLSSCSC

SEQ ID NO: 212320 - protein, 68 aa, Glycine max
  Coding DNA Sequence Number=SeqID_95542
MAPCVTSLNSELELQLDPCRGCDALKVRCMKVVVKTLKMETILLEDDNVAKALLSFISESWVLTPQIL

SEQ ID NO: 212321 - protein, 196 aa, Glycine max
  Coding DNA Sequence Number=SeqID_95543
  Gene Ontology: Cellular component=chloroplast inner membrane
  Homolog annotation: Hit_ID=Q01FV7; Match level="QueryCoverage=99%, HitCoverage=86%, E-value=3e-41, Identity=45%"; Hit description =Homology to unknown gene
MASLFLYTLWAGYLGWQWRRVRTIQNEINELKKQVKPTPVTPEEVPPPSEIELKIQQLTEERKELLKGSYKDRHYNAGSILLGFGVLEAVGGGLNTWIRTGKLFPGPHLFGGAVFKHVAFWFIVGMENDCLGQILSPAIAVLWALSAALVPSMQRGSETARSLHIALNTLNVLLFVSQLPTGFDILLKVFEFTNWP

SEQ ID NO: 212322 - protein, 131 aa, Glycine max
  Coding DNA Sequence Number=SeqID_95544
MANPIPIRPWPRLPSLEATNTSSHEKTKENETKVKGILHTNPSGYDEANGIRVITIVGENRGAEMKITQSQKKQQPIQKSDKAVRTLSSTPIMNVVYSTNSNVQCVNNSLVFNSTSCNHHNPGVLHLIIPN

SEQ ID NO: 212323 - protein, 217 aa, Glycine max
  Coding DNA Sequence Number=SeqID_95545
  Homolog annotation: Hit_ID=Q1SHI0; Match level="QueryCoverage=98%, HitCoverage=99%, E-value=6e-14, Identity=25%"; Hit description =Probable extensin [imported]-Arabidopsis thaliana, putative
MTNPIPIRPWSRLASLRSVPAPESHPKPHTAELSLKATNTFSNDNNESATKSLPITPDLHSPIEQKLKLTTPITFPTAKLKAQPQIEGNIEKPDGNGNGIGQKNEKEVMMTTKENELMKEKGIHTKLSGSGGQYGIRVITISGENKGACIQITKSHKKPFHKMRSLYANSNVQCVNNSMVFHTSLTHHDPGVHLIIPKKQFGEGLIHLKERDSGQRN

SEQ ID NO: 212324 - protein, 289 aa, Glycine max
  Coding DNA Sequence Number=SeqID_95546
MKIFNWVHKRFHHHNTLKDGFATNMKKTEPTINNTDSQALLKQVALTESLGGWEDGILTIGTLGYDPLKSINPHKEYFALEIEVEQEDGEGENNIMVDDHQEEEKGYNAAHEELNPLIYNSFEHNFEVDVVSENNHDDGDVVVRSFNDEIVVAPPVISYEVMESNDVDADEKKKKGERITLADLFLADTDVKIKLDPYAKVCHLASSEKPNLKAKHGLSFAKKLIPRVKDNPHPMKDIKKLMKKMLKRKIHPDLDVKNHKPEGQEVSAAGLNIDNHMNEGNGSSYFLPI

SEQ ID NO: 212325 - protein, 59 aa, Glycine max
  Coding DNA Sequence Number=SeqID_95547
MVNKVQTHISKFDFNDLSVRHDVSSVEETEMGSKTKTFTFEEVAKHNHRKDCWIIVKGK

SEQ ID NO: 212326 - protein, 158 aa, Glycine max
  Coding DNA Sequence Number=SeqID_95548
  Gene Ontology: Mol. function=transition metal ion binding; Cellular component=endoplasmic reticulum; Biological process=electron transport
  Homolog annotation: Hit_ID=Q1SHH9; Match level="QueryCoverage=72%, HitCoverage=79%, E-value=2e-34, Identity=58%"; Hit description =Cytochrome b5
  Pfam annotation: Domain name=Cyt-b5; Domain location=28-93; Score =40.8; E_value=4.8e-09; Accession=PF00173.18; Description=Cytochrome b5-like HemeSteroid binding doma
MSFEEFQRYPKQAINVLEYKCECKSPRVYSPQFPNNWYQSQVYDVTPFLDDHPGGDEVLVTATEKDATTDFEDIGHSDSATQMMEKYFVGEVDTNTLPAQVTSNNSVRQPTQAPPAYNNQSSGFVVKMLQYIVPLLILAFAFGLQYYGKKNKSTESEN

SEQ ID NO: 212327 - protein, 178 aa, Glycine max
  Coding DNA Sequence Number=SeqID_95549
  Gene Ontology: Mol. function=transcription regulator activity; Cellular component=nucleus; Biological process=regulation of transcription
MQKGKWEIGGKKRERRKKEGGAFLSIHLSIGGARSKKGVQEAITCSGRTPAWFEPWGSSLALVGLGYGLASPGRQKRCHYSGTRFGSESEKAWSGRRVTLSGRTSCICRHLPEVLPSPFSCPTTSTSEDIAFSRLAFDDIGESGCFARSLEDIVTPRAVAFALTSKREGDNGGIGGRS

SEQ ID NO: 212328 - protein, 91 aa, Glycine max
  Coding DNA Sequence Number=SeqID_95550
MPTAPEAVELLSSNWSQMKSNMVSERTLTLGPRLRFRCDEHPPFVVHAPSPTSVGREGGVLGNTQVPHRLPQSLECSLYTCWTTSLNANWF

SEQ ID NO: 212329 - protein, 282 aa, Glycine max
  Coding DNA Sequence Number=SeqID_95551
  Gene Ontology: Mol. function=chitin binding; Cellular component =extracellular region; Biological process=chitin metabolic process
  Homolog annotation: Hit_ID=UPI00006A17C9; Match level="QueryCoverage =97%, HitCoverage=100%, E-value=3e-43, Identity=32%"; Hit description= UPI00006A17C9 related cluster
GLHVLHFRGLHDLPFRGLHALALTGLHVLTFRGLHNLAFRGLDALAFRGVHILPLRGLHALAFVGGLHVLAFRGLHIQAFRGLHVIALRGLHVLHFRGLHVLHIRGLHVLPFGGLHVLALRGLHGFTFSGLHALTFRGLHVLAFRGLHVLTFRGLHVLTFYRLHALAFIGLHVLTFKGLHVIALRGLHVLAFSGLQALAFIGLHTPTLKGLLILTFRGLHVLTFRGLHALAFTGLHVLTYRGLHNVAFRGLDALAFRGVHILPLRGLHALAFVGLHTLTFKG

SEQ ID NO: 212330 - protein, 180 aa, Glycine max
  Coding DNA Sequence Number=SeqID_95552
  Gene Ontology: Mol. function=nucleic acid binding; Cellular component= signal recognition particle, endoplasmic reticulum targeting; Biological process=SRP-dependent cotranslational protein targeting to membrane
MEGGIGSHTKHHSQRREKDRKDSRERKVPLATLSFQGVCPLLVDFPCYGKKGFMGDPLVEYWNDLKSALRKRHIPSYYEMKLMDKLQWLREGSMSVEEYRQQMELLFLRAGLREEERTSIARFLSGLNIEVRDKVELFPYRDLDELVQLCIREEQQLKRKPSSKSYGSHFYPRKDQAHGI

SEQ ID NO: 212331 - protein, 335 aa, Glycine max
  Coding DNA Sequence Number=SeqID_95553
  Gene Ontology: Mol. function=aminopeptidase activity; Cellular component=integral to membrane; Biological process=proteolysis
  Homolog annotation: Hit_ID=Q8UDF6; Match level="QueryCoverage=88%, HitCoverage=58%, E-value=2e-70, Identity=46%"; Hit description =Hydrolase
  Subcellular localization annotation: CTP_CleavageSite=58; ConfidenceScore=5.50e-01
QNDEKRQFGHGGARRRSHDPSSPSAPVRPAFRPAFSTANFVATRLFRRQQIIHYAFVNAAVDAVQRQRMPVAFAGDQRAFKGGGHHLRVAVRRGRIVALGDEQQRRQRGGRHRRVRPIFAAIRPQIAHLQRVFVQRQIVGIQSGGIDLLPLPAQLLRIGRRVGDVSAGDDVQGVIGIRRIAFVDQIGNLLPGDPGIELAQHGRQLMPTLRPQQQRTRDRQHVVGGDFITRRGDERLLMQLAQQGVIALQRLIGAATQLAAVGFSAVGGEAQEALLEAPLLVQPLGEIVLRQIHHPVEHQRARFLRKTLGIQRRHLGAVRVRHRRQPRFAQRVADR

SEQ ID NO: 212332 - protein, 113 aa, Glycine max
  Coding DNA Sequence Number=SeqID_95554
MEHETFHATWLAEIDFSPNGLDGGSSQYCIIIVILQRILLGERAVYAMMLVFPPEFSPLKSILFGNPSQDTVEPLMEALEEDYKDGNEINESRQFIGGVLDLEKRINRLDTLT

SEQ ID NO: 212333 - protein, 110 aa, Glycine max
  Coding DNA Sequence Number=SeqID_95555
  Homolog annotation: Hit_ID=Q3BXI4; Match level="QueryCoverage=44%, HitCoverage=13%, E-value=2e-10, Identity=63%"; Hit description =Riboflavin biosynthesis protein RibD
  Subcellular localization annotation: CTP_CleavageSite=26; ConfidenceScore=5.16e-01
MPGACHCATTAATSGCPHPPAADPPRAAAAAGPSPRCRGRPAADDRYRPAAWAPDTAAVRPPSRRAARHRPASRRLRSASTAPRSNRPSTQGALANSASAASGALTAVPC

SEQ ID NO: 212334 - protein, 124 aa, Glycine max
  Coding DNA Sequence Number=SeqID_95556
MKIEQLVPCKVTAYTPRKGRQTGSNSWLVWLRCKRLIESNVATVAITSAATEADPTHPSTMNQAHQPTPDMVGQGGEVLGSADGPHTGYNRNAYPYSLPSNYTPPTMHENVDHAIPVTFEGQQP

SEQ ID NO: 212335 - protein, 466 aa, Glycine max
  Coding DNA Sequence Number=SeqID_95557
  Gene Ontology: Mol. function=RNA-directed DNA polymerase activity; Cellular component=extracellular region; Biological process=RNA -dependent DNA replication
MGDGGSGKEPPDGRGGDKQRVYSKIRSWGNKAVAPPRQQEDALVVKLLGKSIVYNVMKSRLTRLWRLTLGFDILDIGNNFYMVKFDTEMDRTKVMEEGPWMIFDHYLSTKNAISKVLVNKICPHLDHLIGPLQSSFITKRGRSDNALFCQEFDNQVYKKKRGKKGFVIFKIDFEKAYGRVDWGFVKMTLQEFGFPPQIVTLIMNCTNSTKLSMKWNGEKLRSFEPNRRLRQGEPMSLYLFVLCMEKLSLFIQQKVQERAWLPVKLKCNAPKVLDAFCHASGLCVNIHKSKFMTSNNVSNTKVDKFKMISHFHHTKQIGKYLGFPMPKGRIKNSVFNFVLDKINSRLARWKMNLLNRAGRVTLPKSVLSLMPTQVMGLVIGETILVWGTILHAEAMEDASYTYNSIIKDTDFLKLGFQELQNHVIDNEMDDIIIWGPSSNGVYTSNSAFKWLMVESPSPNTHRANWS

SEQ ID NO: 212336 - protein, 760 aa, Glycine max
  Coding DNA Sequence Number=SeqID_95558
  Gene Ontology: Mol. function=RNA-directed DNA polymerase activity; Cellular component=nucleus; Biological process=RNA-dependent DNA replication
  Homolog annotation: Hit_ID=Q1RY72; Match level="QueryCoverage=48%, HitCoverage=98%, E-value=1e-53, Identity=34%"; Hit description =Endonuclease/exonuclease/phosphatase
  Pfam annotation: Domain name=Exo_endo_phos; Domain location=391-623; Score=8.3; E_value=0.0036; Accession=PF03372.13; Description =EndonucleaseExonucleasephosphatase family
MGRGRGRGRGRPAKIPMPPSTTTQKSPPKLNPEPSNASHEVTVEDYVSSEDDESEETPIPSANLPNCNVPEKPKEETNENKVPRKLWTDVISGNRKPENGMTLEFFAPKIVEGKPIAKIEPEDIIGELKYWESALIMYVIGRDLSMNSVKQFMEKNWSFVKLPDLFYNDEGYFIMRFHSSQDKDEILSKGPYTIMNMTMLLRDWSPEFNLKRDMLRTIPIWIKLPQLPLYLWGAKTMGKIGSILGKPIVTDECTAQRLRISYARMLVEIDITQEMPKEVTIADNEGHELIQAVEYEWKPKYCGKCKKFGHVCEKPKVRKEKVWVPKPILKSNEQEEGGPSNKETQMINTTNTEDLVSEWTTVQKAGKKTVTDTGTMQKAGKKIIIDTGESAMMISWNIRGLNKVGKTIEISSRLKSLNPTIIVLLETRLRKNKALTVRNKLNLNMKYLDNYDKHENGRIWFIWDDSKVMIKHICSTSQLIHCGVYNPNGDFLHWCTAIYALNHLDDRRKLWKDIEDLRVQQADPWCLLGDFNNVLKAEDRIGGRDVTESEYADLREMMSRVGLYEMDTCGDFFTWTNKQADNTIYSRIDRFLGNLNWLQMHIDSTLKILAPSISDHALMFLSCKDQSSRLRGRFKYRNSLARLNGFHDEVKKNWNLGVHGNPMYKLWTKLSRLQSVLKNLSSPLNGLREKIDEARRNLQQAHEDLCRDRFNVDNINRVKDRTSELLQLNELEDSDLRQKAKIYWIRQGDGNNSYFHATIK

SEQ ID NO: 212337 - protein, 84 aa, Glycine max
  Coding DNA Sequence Number=SeqID_95559
  Gene Ontology: Cellular component=integral to membrane
  Homolog annotation: Hit_ID=Q9FHY3; Match level="QueryCoverage=85%, HitCoverage=47%, E-value=2e-15, Identity=54%"; Hit description =Arabidopsis thaliana genomic DNA, chromosome 5, P1 clone:MJC20
  Pfam annotation: Domain name=ORMDL; Domain location=14-83; Score= -33.5; E_value=3.9e-05; Accession=PF04061.5; Description=ORMDL family
MEFIITDPDQVRLASWRAFEGAKTVIFQELIIPKSALKGYLIASHTTDYQNPMFLFNTVAVIVLVVAKFPHMHKVRIFGINADK

SEQ ID NO: 212338 - protein, 102 aa, Glycine max
  Coding DNA Sequence Number=SeqID_95560
  Gene Ontology: Cellular component=integral to membrane
  Homolog annotation: Hit_ID=Q9FHY3; Match level="QueryCoverage=61%, HitCoverage=40%, E-value=8e-26, Identity=79%"; Hit description =Arabidopsis thaliana genomic DNA, chromosome 5, P1 clone:MJC20
MARGSVFVGKENSGCHFITECKKVAEKVWFSVLIQRKQEIEGYSKVCEINDGPSDARGTTEDGEYEDPRKEKDEDVCGPNARVREPLRVPVQIRRWHRLHVQ

SEQ ID NO: 212339 - protein, 497 aa, Glycine max
  Coding DNA Sequence Number=SeqID_95561
  Gene Ontology: Mol. function=RNA-directed DNA polymerase activity; Cellular component=chromatin; Biological process=RNA-dependent DNA replication
MIAVRSVTYVFNINGRFTRRLEARRGIRQGDPISPLLFILVMEYLNRILSQLDKIPNFNYHSKCEKMKITNLCFADDLLLFSRGDIGSVQIMLDKFNTFLRSMGLHVNPSKCNIYCGSVDINVKEQLLLISGFKEGKMLFRYLGIPLSSKKLNIKHYQVLIDKIVGRITHWSAGLLSYAGRVQLIQSVIFATINFWMQCLPLPKFVIMRINAICRSFLWIGNSNISRKSPIAWEKVCSPKINGGLNIINLAIWNKISILKLLWNVRNKSDNLWIKWLHTYYIQGQSIWSMVLKKSHSWIMSSMMKLRPLLLQYQSRMQDVFKMKKIYLALFEESEKMSWRTLMCNNLARPRALFCLWQACHFRLASKDRLIKFGLNVDANCAFCSSMESHEHLFFGCIELKTIWTAVLNWLQIIHMPSTWSEELNWITRKCKGKGWRAMLLKCAFTETIYHIWAYRNHRVFGGNVNNRKVEDSIISTIIYRVWNRKRYRRYIAELMI

SEQ ID NO: 212340 - protein, 44 aa, Glycine max
  Coding DNA Sequence Number=SeqID_95562
MNSGAVLALPPVSNVFRTREPHDFEDDFVEKDPTGRGRWNVLIA

SEQ ID NO: 212341 - protein, 621 aa, Glycine max
  Coding DNA Sequence Number=SeqID_95563
  Gene Ontology: Mol. function=protein serine/threonine kinase activity; Cellular component=cytoplasm; Biological process=protein amino acid phosphorylation
  Homolog annotation: Hit_ID=Q6EU49; Match level="QueryCoverage=98%, HitCoverage=93%, E-value=1e-145, Identity=48%"; Hit description =Putative MAP kinase
  Pfam annotation: Domain name=Pkinase; Domain location=1-243; Score =177.4; E_value=3.6e-50; Accession=PF00069.15; Description=Protein kinase domain
  Pfam annotation: Domain name=Pkinase_Tyr; Domain location=1-243; Score=10.7; E_value=4e-13; Accession=PF07714.7; Description=Protein tyrosine kinase
  Pfam module annotation: Pfam domain module=Pkinase::Pkinase_Tyr; Domain location=1-243::1-243
YRGFDEVDGIEVAWNQVKIDGLMHSVDDLAKLYSEVNLLKSLKHENIIKFYDSWIDDKQKTVNMITELFTSGNLRLYRKKHKYVEMKAIKGWARQILHGLVYLHSHRPPIIHRDLKCDNIFVNGNQGEVKIGDLGLAVVMQQPTAQSVIGTPEFMAPELYEEAYTELVDIYSFGMCILEMVTLEYPYSECKNPAQIFKKVTSGIKPASLNKVSDPQLKEFIEKCLVPASERLSAEELLKDPFLQVENPKDPILYPLQPPSRTLRAYSFKSGSLSMDMDSDCKPFSMSICSESNQENPHCPVFEVQRTNNKHEFRLKGTKNDDNSVSLTLRIADTCGRVRNIHFLFYLDTDTAVSVATEMVEHLELADHDVDFIAELIDYLIMKLLPWWKPSPDHFSCGELSPYSTNIDGQWPWGSVLTSIPSELAIDQDGFSGSDTTPKEDFVASEKSSVSKNDSNATFEGDCNSSSLVKLEDRYSQGSRASEMIVENTSMKNDNCHDSNADVSSESLSNSMSELEIGGAYFEDCKLQPAEYCSGEGVVINEFPKNSGSVLGTSINVENPTNSCSYVSSTEEDIIDLELQFKLDEIEAHYQHWIDELKKMMLEALDSTRRSWVAKKKLAVQ

SEQ ID NO: 212342 - protein, 274 aa, Glycine max
  Coding DNA Sequence Number=SeqID_95564
  Homolog annotation: Hit_ID=Q47522; Match level="QueryCoverage=15%, HitCoverage=53%, E-value=8e-19, Identity=100%"; Hit description=LacZ protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDKDVGKKPAYCKIRVTPFQSKTTIMTGVWLQQQVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 212343 - protein, 85 aa, Glycine max
  Coding DNA Sequence Number=SeqID_95565
  Gene Ontology: Mol. function=isomerase activity; Cellular component =nucleus
  Homolog annotation: Hit_ID=Q9T096; Match level="QueryCoverage=97%, HitCoverage=70%, E-value=5e-18, Identity=42%"; Hit description =Protein yippee-like At4g27740
  Pfam annotation: Domain name=Yippee; Domain location=2-83; Score =57.1; E_value=5.7e-14; Accession=PF03226.5; Description=Yippee putative zinc-binding protein
MAELMASQAYCCFKCQNLVAFHDDIVSKDFQARQLITGLHTLVDVFCSDCGEELVWKYIKAYEETQKYKEGKCVLDKFKIIKSNG

SEQ ID NO: 212344 - protein, 357 aa, Glycine max
  Coding DNA Sequence Number=SeqID_95566
  Gene Ontology: Mol. function=nucleic acid binding; Cellular component= nucleus
  Homolog annotation: Hit_ID=P92964; Match level="QueryCoverage=92%, HitCoverage=94%, E-value=3e-63, Identity=63%"; Hit description =Arginine/serine-rich-splicing factor RSP31
  Pfam annotation: Domain name=RRM_1; Domain location=175-239; Score =57.3; E_value=4.9e-14; Accession=PF00076.12; Description=RNA recognition motif. (a.k.a. RRM, R
MRPIFAGNLEYDTRQSELERLFSKYGRIDRVDMKSGTSTKGKYAELLSWFANLSANFFWEGKLPACLLSFYSQICIFTSDHWSLTSSSPNIDISIRMLNNMPMSFIIISASNTSYVTGFAFVYYEDERDAEEAIRALDNVPFGHEKRRLSVEWARGERGRHRDGSKANQKPTKTLFVINFDPIRTRVRDIEKHFEPYGNVLHVRIRRNFAFVQFETQEDATKAIECTNMSKILDRVVSVEYALRDDGERGDNYDSPRRGGYERSPSPYHRRPSPDYGRPRSPVYDRYNGGGPDRRRSPDYGRHRSPDYGRRRSPDYGRRKSPDYGKPRSPEYAVRRCEVSANGSIGPEYETGNPVYC

SEQ ID NO: 212345 - protein, 415 aa, Glycine max
  Coding DNA Sequence Number=SeqID_95567
  Gene Ontology: Mol. function=hydrolase activity, acting on acid anhydrides, catalyzing transmembrane movement of substances; Cellular component=integral to membrane; Biological process=calcium ion transport
  Homolog annotation: Hit_ID=Q8VZX6; Match level="QueryCoverage=99%, HitCoverage=39%, E-value=0.0, Identity=86%"; Hit description=Type IIA calcium ATPase
  Pfam annotation: Domain name=Hydrolase; Domain location=20-411; Score= 77.6; E_value=4e-20; Accession=PF00702.16; Description=haloacid dehalogenase-like hydrolase
MAQKNAIVRKLPSVETLGCTTVICSDKTGTLTTNQMAVTEFFTLGGKTTASRLIGVEGTTYDPKDGGIVDWGCYNMDVNLQVMAEICAVCNDAGIYFDGRLFRATGLPTEAALKVLVEKMGVPDAKSRNKIRDNTELAANNMMNGNTVVKLGCCEWWNKRSKKVATLEFDRIRKSMSVIVREPNGQNRLLVKGAVESLLERSSHVQLADGSVVPIDDQCRELLLQRLQEMSSKGLRCLGFAYNDDLGEFSDYYADTHPAHKKLLDPTHYSSIESDLVFVGIIGLRDPPREEVHKAIEDCKEAGIRVMVITGDNKSTAEAICREIKLFSKDEDLTGQSLTGKEFISFSPSEQVKILLRPGGKVFSRAEPRHKQEIVRLLKEMGEIVAMTGDGVNDAPALKLADIGIAMGITGTEVT

SEQ ID NO: 212346 - protein, 144 aa, Glycine max
  Coding DNA Sequence Number=SeqID_95568
  Gene Ontology: Mol. function=transcription factor activity; Biological process=regulation of transcription, DNA-dependent
  Homolog annotation: Hit_ID=UPI00005F901B; Match level="QueryCoverage =95%, HitCoverage=43%, E-value=9e-46, Identity=63%"; Hit description =COG0583: Transcriptional regulator
  Pfam annotation: Domain name=HTH_1; Domain location=13-72; Score =86.4; E_value=8.8e-23; Accession=PF00126.17; Description=Bacterial regulatory helix-turn-helix protein, lysR family
MVRMSTLTSVDRIELMQTFIRIVESGSLSAAAAQLGTTQPTVSRRLQALEQRLGLKLILRTTHALKLTDDGERCYVQARQLVATWHALEDELTGANDDPIGTLRVRAPHAFGQDQLIAPLMDYLQRYPRLAVEWMLNDRTPDFV

SEQ ID NO: 212347 - protein, 159 aa, Glycine max
  Coding DNA Sequence Number=SeqID_95569
  Gene Ontology: Mol. function=transporter activity; Cellular component= integral to membrane; Biological process=transport
  Homolog annotation: Hit_ID=UPI00005FA16A; Match level="QueryCoverage =86%, HitCoverage=36%, E-value=9e-42, Identity=65%"; Hit description =COG0477: Permeases of the major facilitator superfamily
MSAMSQSSAMPAEKLPAPLVFTLAAGAGLSVASIYYSQPMLDIISKQFNVGIGSVGMVPMLTQAGYALGILLLAPLGDRHDRRTIILIKGLLLVAALLLCGFSGGINALLIASFVTGLTATVAQDIVPASAALAPERSRGKTVGTVMTGLLVGILLSRV

SEQ ID NO: 212348 - protein, 114 aa, Glycine max
  Coding DNA Sequence Number=SeqID_95570
MKILMSHNNSFQNCPMYGVACQCYDSTSDSPQISASPYQLDLTLYASGSYNAQWNAPGLLHDKHTLRSSRILRKMEVEEPWLGLFAAKFLFVGVFWFMLKVVFVIGSAVDRLCG

SEQ ID NO: 212349 - protein, 134 aa, Glycine max
  Coding DNA Sequence Number=SeqID_95571
PHLFESSVPGLFPEGATQLSFVLTQGPEGPTSGSGAVVGLQEAWWKNCGTFVEPIQRHPNAHGGRTIPVTPALPKNPGPSALLIAGSTLTTDLSTLGGLVANDHSCVTLRVCFNVDGDADASTGGGGGGGGGEA

SEQ ID NO: 212350 - protein, 59 aa, Glycine max
  Coding DNA Sequence Number=SeqID_95572
  Homolog annotation: Hit_ID=Q9ATG0; Match level="QueryCoverage=71%, HitCoverage=32%, E-value=2e-18, Identity=88%"; Hit description =Putative chaperon P13.9
MAHATEDKTTQSKTIRSIVCSDCDGNGAKSCTQCKGTGVNSVDHFNGQFKAGGLCWLCR

SEQ ID NO: 212351 - protein, 318 aa, Glycine max
  Coding DNA Sequence Number=SeqID_95573
  Gene Ontology: Mol. function=protein serine/threonine kinase activity; Cellular component=cell surface; Biological process =protein amino acid phosphorylation
  Homolog annotation: Hit_ID=Q6ZCR4; Match level="QueryCoverage=94%, HitCoverage=37%, E-value=1e-84, Identity=52%"; Hit description =Putative S-receptor kinase homolog 2
  Pfam annotation: Domain name=Pkinase; Domain location=30-301; Score =154.0; E_value=4e-43; Accession=PF00069.15; Description=Protein kinase domain
  Pfam annotation: Domain name=Pkinase_Tyr; Domain location=31-301; Score=99.7; E_value=9e-27; Accession=PF07714.7; Description=Protein tyrosine kinase
  Pfam module annotation: Pfam domain module=Pkinase::Pkinase_Tyr; Domain location=30-301::31-301
MNRKLREKGMRLEELTLKRFSYSELKRATNNFKQKLGRGSFGAVYKGGLNKGRRLIAVKRLEKLVEEGEREFQAEMRAIGKTHHRNLVRLLGFCAEGSKRLLVYEYMPNGSLENLIFGAQSQRRPGWDERVRIALEIAKGILYLHEECEAPIIHCDIKPQNILMDEFWTAKISDFGLAKLLMPDQTRTITGARGTRGYVAPEWDKLNIPISVKVDVYSYGIVLLEILCCRRNIEVHVSEPEAALLSNWAYKCFVSGQLNKLFLWESVDNKTSVENIVKVALWCIQDEPFLRPTMKSVVLMLEGITDIAIPPCPNSSYV

SEQ ID NO: 212352 - protein, 320 aa, Glycine max
  Coding DNA Sequence Number=SeqID_95574
  Gene Ontology: Mol. function=oxidoreductase activity; Cellular component=vacuole; Biological process=hydrogen peroxide catabolic process
  Homolog annotation: Hit_ID=O80822; Match level="QueryCoverage=97%, HitCoverage=95%, E-value=1e-131, Identity=71%"; Hit description =Peroxidase 25 precursor
  Pfam annotation: Domain name=peroxidase; Domain location=37-279; Score=446.9; E_value=2.6e-131; Accession=PF00141.13; Description =Peroxidase
  Subcellular localization annotation: CTP_CleavageSite=18; ConfidenceScore=5.07e-01
MDAILGSLMILVMTSAVQAQLKTGFYSTSCPNAEAIVRSTVVSHFSKDLSIAPGLLRLHFHDCFVQGCDGSILIADSSAEKNALPNIGLRGFEVIDDAKSQIEAICPGIVSCADILALAARDAVDLSDGPSWPVPTGRRDGRISLSSQASNMPSPLDSVSVQRQKFAAKGLDDHDLVTLVGAHTIGQTECRFFSYRLYNFTTSGSADPTINVAFLAQLQALCPKNGDGLRRVALDKDSPAKFDVSFFKNVRDGNGVLESDQRLWEDSATQSVVQNYAGNVRGFLGLRFDFEFPKAMIKLSSVEVKIGTDGEIRKVCSKFN

SEQ ID NO: 212353 - protein, 948 aa, Glycine max
  Coding DNA Sequence Number=SeqID_95575
  Gene Ontology: Mol. function=catalytic activity; Cellular component =alpha,alpha-trehalose-phosphate synthase complex (UDP-forming); Biological process=trehalose biosynthetic process
  Homolog annotation: Hit_ID=Q2TSD5; Match level="QueryCoverage=90%, HitCoverage=97%, E-value=0.0, Identity=66%"; Hit description =Trehalose 6-phosphate synthase
  Pfam annotation: Domain name=Glyco_transf_20; Domain location=112 -598; Score=817.8; E_value=5.7e-243; Accession=PF00982.11; Description=Glycosyltransferase family 20
  Pfam annotation: Domain name=Hydrolase_3; Domain location=646-912; Score=-73.6; E_value=0.0073; Accession=PF08282.2; Description =haloacid dehalogenase-like hydrolase
  Pfam annotation: Domain name=Trehalose_PPase; Domain location=647 -903; Score=338.5; E_value=1.1e-98; Accession=PF02358.7; Description =Trehalose-phosphatase
  Pfam module annotation: Pfam domain module=Glyco_transf_20::Hydrolase_ 3::Trehalose_PPase; Domain location=112-598::646-912::647-903
MEMDFVIIPDLERWRASPGAAVKLCLGDLLVMGSNPETVSLHMQGYVFVNYTAALYRDNNYFSSIFAGDMLNFPQTPRSLPRVMTDPVIMSSGDGKQSNDDDSGVFSSEYRRKIIIVSNSLPLNAKRDKVSGKWCFSYDEDSIFWQLKDGLSPEADVVYVGSLKADVDANEQEKVSLQLLEEFNCVPTFIPSDLYKQFHDGFCKQQLWPLFHYMLPMYPGNRRFDRSQWQAYVSANKIFADKVMEVLNPEDDYVWVHDYHLMVLPTFLRKRCSRVRLGFFLHSPFPSSEVYKTLPVRGEILKALLNADLVGFHTFDYARHFLSCCRRMLGLEHESKRGYIGLEYFGRTIFIKILPPGIHMGRLQSTLDHPSSSNKVREIHQQFKGKKLIVGVDDMDLFKGIGLKFLAMEQLLQQYPEQQGELILIQILNPPSSSDKDVEDAKEEAYISAKRINERFGLEGYEPIIIIDRHVPFYEKAAYYALAECCIVNAVRDGLNLVPYKYTVCRQGSSKLDEALEIASDSPRVSALVVSEFIGCSPSLSGAIRVNPWDIDAVAEALNLAITMPDGEKQLRHEKHYRYVSSHDVAYWARSFEQDLVFSCKDHYNNRCWGFGFGLNFRILSLSPSFRRLSIDHIVPAYERSSCRAIFLDYDGTVVPQASIVKPPSPEVISVLNNICSDVRNTVFIVSGRGKTSLSEWFDQCENLGIAAEHGYFISGCHVTVKFFKLMVFLFDFYHRWGKHTSWQMSHADTDFAWKKIAEPVMRSYMEATDGSSVETKESALVWHYRDADPDFGSWQAMELLDHLENVLANEPVVVKKGQHIIEVKPQGITKGSVAQEVLSSLTKKGKSPDFVLCIGDDRSDEDMFESILAKPYSTTSSSAPQIFACTVGQKPSKARYYLDDTVDVMALLEGLGATSGPKSRYSTETPFEKRENVGSSSFRSQKLSTGD

SEQ ID NO: 212354 - protein, 71 aa, Glycine max
  Coding DNA Sequence Number=SeqID_95576
MDEDQWRYDFAMSHEVDMDYDYDNQEECGVNERHVDCSNAFNTSQGCVVGFEDCDRGASVHLEKKIPNMGT

SEQ ID NO: 212355 - protein, 81 aa, Glycine max
  Coding DNA Sequence Number=SeqID_95577
MEQRFRCGRPIDHVPSTFNRKVVKILLLTYLDIPTEEEVITVINAGAKVRLTWQANLYHRGCGTNVWPYLPLGDVVLPRGP

SEQ ID NO: 212356 - protein, 420 aa, Glycine max
  Coding DNA Sequence Number=SeqID_95578
  Gene Ontology: Mol. function=acetylglucosaminyltransferase activity; Cellular component=membrane; Biological process=isopeptide cross -linking via N6-(L-isoglutamyl)-L-lysine
  Homolog annotation: Hit_ID=Q9FLD7; Match level="QueryCoverage=86%, HitCoverage=81%, E-value=1e-145, Identity=67%"; Hit description =Glycosylation enzyme-like protein
  Pfam annotation: Domain name=Branch; Domain location=74-299; Score =407.6; E_value=1.7e-119; Accession=PF02485.11; Description=Core-2I -Branching enzyme
METNNKQQKKKWFIPLVLSLLLSTLLILFSIFVSSDSSSLLYLYRTRGRVEEPRFVESKLRLSATSSSDSVPRIAYLISGSMGDGGTLKRTLKALYHPRNQYVVHLDLEASSQERLELANFVKNEPLFSKVGNVRMVVKANLVTYRGPTMVTNTLHAAAILLKEGGLWDWFINLSASDYPLITQDDLLHTLSSIPRHLNFIEHTSDIGWKEDQRAKPVIIDPALYSVNKSDLFWVTEKRNVPTAYKLFTGSAWMMLSRQFVEYLLWGWDNLPRIVLMYYANFLSSPEGYFHTVICNAEEFRNTTVNHDLHFISWDNPPKQHPHFLTIDNYQKMVDSNTPFARKFGRNEPLLDKIDTELLGRNEHGYVPGRWFDQANPNITESYSAIRNITELKPGPGAERLKRLINGLLSSEDFHTKQCS

SEQ ID NO: 212357 - protein, 126 aa, Glycine max
  Coding DNA Sequence Number=SeqID_95579
MDKAEAILALIPNFKSFFLCGDDENGDGSDVNNNDSDRDISGDHSDNDGGGGRGDIGSGGNDDVVVVTVLVVTTNGCGGSNVGGVGDDNGGNDGGGVVVEAVGGGNRGGIIGSGDGDKGDLVGSGG

SEQ ID NO: 212358 - protein, 309 aa, Glycine max
  Coding DNA Sequence Number=SeqID_95580
  Gene Ontology: Mol. function=transferase activity; Biological process= DNA integration
  Homolog annotation: Hit_ID=Q1RWN2; Match level="QueryCoverage=41%, HitCoverage=9%, E-value=2e-38, Identity=60%"; Hit description =Peptidase S8 and S53, subtilisin, kexin, sedolisin; Integrase, catalytic region; Zinc finger, CCHC-type
  Pfam annotation: Domain name=Spermine_synth; Domain location=1-132; Score=-82.6; E_value=0.0055; Accession=PF01564.7; Description =Sperminespermidine synthase
VAVGYKDPRVKLHIIDGTLFLNSVPKGMYDAIIVDAFDPIRPDHELFESEFFELVSKALRPGGVLCIQAESIWFHSLDIEELLTKCRQTFKGSSDYAWTTVPAYPRQASFNNPSVSLMVSEPGSFPMATELQAAMENFLRSKEYWSAIDRAILETILCKETFKDIWESMKRKYEGFVRVKRAQLQALRRDFETLAMKDGESVTTYFARTMEISNKMWFHDEKMTDVTMVEKILRSLTTNFNYVVCSIEESKDIDVLSIDELQSSLLEGEGGEVEVGVEEKENVEAEKITRIPELILQAKAEDNTLTDPS

SEQ ID NO: 212359 - protein, 114 aa, Glycine max
  Coding DNA Sequence Number=SeqID_95581
MDHVPNRNEEQERAPRITRIPSPRNPSGFSLHREADRGTGTLAVVNERESAVQFTEYSAHNFFFPKRVGSNQTGYKTERFLTRFTEYSTHTLSVRASLPRPRIQTNYPKVPENK

SEQ ID NO: 212360 - protein, 169 aa, Glycine max
  Coding DNA Sequence Number=SeqID_95582
  Gene Ontology: Mol. function=transferase activity; Cellular component= cytosol; Biological process=spermidine biosynthetic process
  Homolog annotation: Hit_ID=Q852Q9; Match level="QueryCoverage=81%, HitCoverage=42%, E-value=1e-47, Identity=65%"; Hit description =Spermidine synthase
  Pfam annotation: Domain name=Spermine_synth; Domain location=41-169; Score=44.3; E_value=4.2e-10; Accession=PF01564.7; Description =Sperminespermidine synthase
MENHPSGRVISNGKIGFSTPNCTHERDDEEPEIRVHPQIPEWFSENSPLWPGQAHFLKVEKICFQGKSEYQNMLVFQSSTYGKVFVLDGALQLTEKDECAYQEMMTHLPLCSIPSPKKVLLIGGGDGGILREISRHSSVEQIDICEIDTMLIDVSKMFDLLSLNQRVKL

SEQ ID NO: 212361 - protein, 75 aa, Glycine max
  Coding DNA Sequence Number=SeqID_95583
VVLPSPIPTRTEPAPTESQPPVVDPPASLEVEILSPPLAPPAPPLILILDDSDAEAVAPSNSPAYYLEDGSDFSD

SEQ ID NO: 212362 - protein, 87 aa, Glycine max
  Coding DNA Sequence Number=SeqID_95584
MFTRFHQHPHDKSGLGLEKEASSSKSQFDSHKYDFNGSIEKDQYIVKTEDDMSFFTACDINGSGMEKEEREEMPLQGEDESRRSSPP

SEQ ID NO: 212363 - protein, 108 aa, Glycine max
  Coding DNA Sequence Number=SeqID_95585
  Gene Ontology: Mol. function=identical protein binding; Biological process=negative regulation of enzyme activity
  Homolog annotation: Hit_ID=Q2HV71; Match level="QueryCoverage=88%, HitCoverage=12%, E-value=2e-28, Identity=63%"; Hit description =Protease-associated PA; Proteinase inhibitor I9, subtilisin propeptide
  Subcellular localization annotation: CTP_CleavageSite=72; ConfidenceScore=5.36e-01
MVCQLLTSTKDTPSVIKYAKSNKKPIATIKFQQKFVGVKLAPAVNFNSSRGPSTSYHWVLKPHIMAPGSNVLVAYVPTEPTTRIGTNVMLSSGYKLLSGTPTKHLIQV

SEQ ID NO: 212364 - protein, 473 aa, Glycine max
  Coding DNA Sequence Number=SeqID_95586
MEPRKNEVIVILGINNEKDAKNVFLEDSFIHGGWVSFQSLEEEGFTIKGCKVYVSDRDRFCTYKMMVGKKVDLLEVIFYYWMQTFKGRFNPKVKKNHVPYVKKELKDKPQSVVGQTMGTQDQLSPPHTQPKPTLSPINKKKVATFAKDKKKSLVEAYKKAKLDETLERKEAQELEESFLSSMKALSTEENKKKLAKYARLATLATMMYIDGELVPKVVIVESIQAHTEQELKKVEMDELKRVQFAAKYVAEFLSMDVAQRQEVDEDIMETYPRVDHVYPRPVFEVNEQIIIVAQSVAMDEDRLGTWRKHMELQKEEDALSAYGEKEPMLRDFSIRYTIAPDPNNLQQLLGIMWTMNIILSWDHTTLGETFQIEDINLEELEANSREIRSRKALLRRIESLNTHIPFMIGSQFSCLPTPEIQFQIAKCYKGKEILIKDDEDAPPTRYVKAHPEKLFKHELKAIKQKIEHKSLDW

SEQ ID NO: 212365 - protein, 107 aa, Glycine max
  Coding DNA Sequence Number=SeqID_95587
MYLALEGSSTVEAISLKNCLECLANKCFQASSGDLRRLPQAPLSPPSLCRDLRIMPQAPLPFVIVIVYLTQSQQPTASGRCALSFIHAWCLSYYQFVDIVNLCLFKP

SEQ ID NO: 212366 - protein, 685 aa, Glycine max
  Coding DNA Sequence Number=SeqID_95588
  Gene Ontology: Mol. function=voltage-gated potassium channel activity; Cellular component=integral to membrane; Biological process=potassium ion transport
  Homolog annotation: Hit_ID=Q9SU64; Match level="QueryCoverage=94%, HitCoverage=93%, E-value=0.0, Identity=67%"; Hit description =Putative cyclic nucleotide-gated ion channel 16
  Pfam annotation: Domain name=Ion_trans; Domain location=86-360; Score= 60.2; E_value=6.8e-15; Accession=PF00520.21; Description=Ion transport protein
  Pfam annotation: Domain name=cNMP_binding; Domain location=461-561; Score=28.5; E_value=2.3e-05; Accession=PF00027.19; Description =Cyclic nucleotide-binding domain
  Pfam module annotation: Pfam domain module=Ion_trans::cNMP_binding; Domain location=86-360::461-561
  Subcellular localization annotation: CTP_CleavageSite=39; ConfidenceScore=5.29e-01
MSSDLYRFAVSSHFSSFPKSFSLRKKVPWWYQILDPRSRFVARWNRTFLYVCIVALFLDPLYFYFPITGDKACMQTDIVLGVFVTFSRTIADLFFLFHMVLKFRTAFVSPLSSVYGRKDLVTDPRQIASRYLRSDFAIDLFATLPLPQIVIWFVIPAVKDSTAAHVNHTLSLIVLIQFIPRLFQIFPLQRRILKTSGLIAKTALAGALYNLGSYMLASHVLGASWYVSSIQRQYECWIITCKKEMNRTHSPSCNPSFLDCGTLADHERQAWFKRTRVLTACDALNDKNEFQFGMFADAFTDHVSSSRFFQKYFYCLWWGLKNLSSYGQNLQTSTYSGETLFSSFICIAGLILFAHLIGNMQNYLQSSTAKVEEWRLKQKDTEEWMNHRQLPPELQQRVRRFVQYKWLATRGVDEEAILRALPLDLRRQIQRHLCLDIVRRVPFFGQMDDQLLDAICERLVSSLNTKDTYIVREGDPVREMLFIIRGQVESSTTDGGRTGFFNSITLRPGDFCGEELLTWALMPSSTLNLPSSTQTVKTLTEVEAFALRAEDLKFVASQFKRLHSKKLQHAFRYYSHQWRAWGAHFIQAAWRRHRKRKLAMELLKENLYYTNVVEDDDDEEEGSAGESSMAGHTQNFGATFLASKFAANTKKGAIKKVAIKLPDADSLKMPKMFKPTEPDFSTFHD

SEQ ID NO: 212367 - protein, 201 aa, Glycine max
  Coding DNA Sequence Number=SeqID_95589
  Gene Ontology: Mol. function=ubiquitin-protein ligase activity; Cellular component=ubiquitin ligase complex; Biological process =protein ubiquitination
  Homolog annotation: Hit_ID=Q9C7R6; Match level="QueryCoverage=96%, HitCoverage=28%, E-value=2e-15, Identity=27%"; Hit description=Arm repeat-containing protein, putative; 6839-9028
  Subcellular localization annotation: CTP_CleavageSite=59; ConfidenceScore=5.40e-01
MADKINNSCEHQRRPLSFPAVRPCVSTSPSTLLASLITLAQNICNFHSNSFVFHRRNVRETTRQIAILLVLFQELHDRGSIIPHSIRLCFSDLHVTFQKIHFLMQDCSRESARLWMLTKSQFIATQFRVLVREVAIVLDAIPVCCIDINNEIKELVELVTKQANRGNLQLDRNDENEAKRLRFLLAQLERGIEPDVDVVKS

SEQ ID NO: 212368 - protein, 148 aa, Glycine max
  Coding DNA Sequence Number=SeqID_95590
  Gene Ontology: Mol. function=aldehyde dehydrogenase (NAD) activity; Cellular component=mitochondrion; Biological process=metabolic process
  Homolog annotation: Hit_ID=Q84V96; Match level="QueryCoverage=79%, HitCoverage=25%, E-value=2e-51, Identity=73%"; Hit description =Aldehyde dehydrogenase 1 precursor
  Pfam annotation: Domain name=Aldedh; Domain location=1-138; Score= -254.1; E_value=8.7e-05; Accession=PF00171.12; Description=Aldehyde dehydrogenase family
MHILSLAGLPPGVPNVVSGFGPTAGSALASHMDVDKSNLKPVTLELGGKSPFIVCEDADVDKAVELAHFALFFNQGQCCCAGSRTYVHERIYDEIFEKAKATALRRVVGDTFKKGLDQGPQGEKGIYSLQNYLQVKAVVTPLKNPSQL

SEQ ID NO: 212369 - protein, 209 aa, Glycine max
  Coding DNA Sequence Number=SeqID_95591
  Gene Ontology: Mol. function=RNA-directed DNA polymerase activity; Biological process=RNA-dependent DNA replication
  Homolog annotation: Hit_ID=Q1RTD3; Match level="QueryCoverage=57%, HitCoverage=18%, E-value=3e-25, Identity=47%"; Hit description=IMP dehydrogenase/GMP reductase
MVCLLKLSQEKEIKEAAWDFDGNKSPESNGFNFNFIKSCWEMVKVDIVRAFKEFHFDQRLPRETNASFLTLIPKKENALGLEEFRSIFLIGCLYKTIAKVLANRMGRVLGKVVDEKQSTFFSNKFYQQNPVWRIADNRIQCKANLHKRNALPTVLTNLNIERETGVKQCNCVSSKREVWGSELVMGVKETTIVFMSGQGLIGLVVMGLI

SEQ ID NO: 212370 - protein, 235 aa, Glycine max
  Coding DNA Sequence Number=SeqID_95592
  Gene Ontology: Mol. function=transporter activity; Cellular component= integral to membrane; Biological process=transport
  Homolog annotation: Hit_ID=Q392E2; Match level="QueryCoverage=67%, HitCoverage=39%, E-value=2e-23, Identity=40%"; Hit description=Major facilitator superfamily (MFS_1) transporter
MGVALGNEHGVARGQRMQRAVGAAQRRVANRQVVEVGVAGAGAETQADRRADLDAAVLHAAQAHAGQHGLRWPHVARGGCAARLDGGVFAGDGGVRLADRGVPAGQPADADGARPGRLRGAGRAGGDGDGGGGAVCRTAGAGSDARARSARGAAGLQHPDGGLQSAGGAVFQPGGAAGDAYFARRCAGRFLEHGGGGGHAPGAARPAAARVGDHLQWHCRGDRGGGAARQLSGRQ

SEQ ID NO: 212371 - protein, 104 aa, Glycine max
  Coding DNA Sequence Number=SeqID_95593
MHPPPKEFGAMLHDCQSVDPLVQSSILPFSSEPHECHCLALFMHPPPKEFGAMLHDCLSVDPLVQSSILHFFRSPMNVIAKRCSCILHPKSLELCFMIAKVWTL

SEQ ID NO: 212372 - protein, 152 aa, Glycine max
  Coding DNA Sequence Number=SeqID_95594
METAKSTQQALQSVEIQVGELADVVTQFMSRREKSFVEAEAQEKSPIKEHESREKDEEKDEEQAQQQWDKYSIVENQQENILPSNNLPHQLIDKKGSQGEHEETLSDILSLITNTFLEMIWNVLPNYMKFMEFLAKRRNFKEDVFFVTFMPP

SEQ ID NO: 212373 - protein, 189 aa, Glycine max
  Coding DNA Sequence Number=SeqID_95595
  Homolog annotation: Hit_ID=Q1SP02; Match level="QueryCoverage=30%, HitCoverage=12%, E-value=5e-08, Identity=45%"; Hit description=IMP dehydrogenase/GMP reductase
MCVSMHCDEEDCEEGIYSDVQAAPGSSEDPKCLLDVICEAPTCAGLSSNFVLLGTAPLGACCCQIQTREGYASVRCHMMTWMILGRTTQTIWRQQVIYVLCQTVPPRDAYATQPSHIPHEVALASTHADPDANEPGHAVACHVIVEALEQHLNAPGTSTHEEVIQKCLRIAKGVTEDVRSRRRRRTDQQ

SEQ ID NO: 212374 - protein, 68 aa, Glycine max
  Coding DNA Sequence Number=SeqID_95596
MVVVIKAIMGCFDLASELEVNFSKSSFWRYGDGGRSFVEEEPNSGDIPRMILMHQGSLWLKSRALEAL

SEQ ID NO: 212375 - protein, 381 aa, Glycine max
  Coding DNA Sequence Number=SeqID_95597
  Gene Ontology: Mol. function=ubiquitin-protein ligase activity; Cellular component=ubiquitin ligase complex; Biological process =protein ubiquitination
  Homolog annotation: Hit_ID=Q1SEL7; Match level="QueryCoverage=72%, HitCoverage=37%, E-value=1e-33, Identity=35%"; Hit description=Zinc finger, RING-type; U box
  Pfam annotation: Domain name=Arm; Domain location=117-158; Score=0.3; E_value=11; Accession=PF00514.13; Description=Armadillobeta-catenin -like repeat
  Pfam annotation: Domain name=Arm; Domain location=159-200; Score =19.8; E_value=0.0098; Accession=PF00514.13; Description =Armadillobeta-catenin-like repeat
  Pfam annotation: Domain name=Arm; Domain location=201-242; Score=7.2; E_value=1.5; Accession=PF00514.13; Description=Armadillobeta-catenin -like repeat
  Pfam annotation: Domain name=Arm; Domain location=34-74; Score=21.1; E_value=0.0041; Accession=PF00514.13; Description=Armadillobeta -catenin-like repeat
  Pfam annotation: Domain name=Arm; Domain location=75-116; Score=14.3; E_value=0.2; Accession=PF00514.13; Description=Armadillobeta-catenin -like repeat
  Pfam module annotation: Pfam domain module=Arm::Arm::Arm::Arm::Arm; Domain location=117-158::159-200::201-242::34-74::75-116
MQFLSWFLSRRLVFGTEEQKTKAAYEIRLLAKSSVFNRACLVEMGTVPPLLDLLAADDRNLQESAISALMKLSKHTSGQKLIIESRGLAPILKVLKRGLSLEARHVAAAVIFYLSSSKEYRKLIGENPDVIPALVEMVKEETTFGKNNSVVAIFGLLLRRKNHAIVLSAGAVPVLVNTLASSGNANLVTDSLAVLVALAESVEGAYALLRAEALPLVAKILQSATSRSGKEYCASILLALCVNVGAEVTGVLAKEASVMPSLYSLLTDGTPHAAKKARALINVILEFSDKRFSGTVGSSVSRQRVVLVWRLRNNCVFQGSDVNMEGMRDHMGLKLDVLRVESFMEKVETMDYGGFLASSINLVTGNPCIVSITFSITSEIN

SEQ ID NO: 212376 - protein, 69 aa, Glycine max
  Coding DNA Sequence Number=SeqID_95598
MAFLSMLHNADSHTPELHRTDWGVYHLRRVVDDVEEEPHLVSLFHVFGKKEEARGKGDVAKEEKKKEQK

SEQ ID NO: 212377 - protein, 153 aa, Glycine max
  Coding DNA Sequence Number=SeqID_95599
  Homolog annotation: Hit_ID=Q00M75; Match level="QueryCoverage=25%, HitCoverage=6%, E-value=1e-09, Identity=85%"; Hit description=PPR -repeat containing protein
  Pfam annotation: Domain name=DSS1_SEM1; Domain location=101-149; Score=38.4; E_value=2.4e-08; Accession=PF05160.4; Description =DSS1SEM1 family
MVLSFVVTSNRSNVRKMDWVGGLYCNLTVIVFKERASPGAAVKLCLGDLLVMGLNPETASLHMQGTLQGLYPKSHPFLWVLENAYSTFVWGLGVILMLLISVALFVLQLSEWDDKEEGKEVTQQWEDDWDDDDVSDDFSLQLRRELESNTEKN

SEQ ID NO: 212378 - protein, 150 aa, Glycine max
  Coding DNA Sequence Number=SeqID_95600
  Gene Ontology: Mol. function=metal ion binding; Cellular component =integral to membrane; Biological process=ubiquitin cycle
  Homolog annotation: Hit_ID=Q8GW38; Match level="QueryCoverage=80%, HitCoverage=37%, E-value=2e-13, Identity=33%"; Hit description=RING -H2 finger protein ATL1D
  Pfam annotation: Domain name=zf-C3HC4; Domain location=84-125; Score =34.1; E_value=4.8e-07; Accession=PF00097.15; Description=Zinc finger, C3HC4 type (RING finger)
  Pfam annotation: Domain name=zf-RING-like; Domain location=84-125; Score=4.8; E_value=0.041; Accession=PF08746.1; Description=RING-like domain
  Pfam module annotation: Pfam domain module=zf-C3HC4::zf-RING-like; Domain location=84-125::84-125
MEIVISLIILFMGIAILMVIHVCVVGRAFTGNNSNNEEEFTHRSISAMKRMFGGNKVGNLKNLPCFEYEEKACKEKGCCGLVDCAVCLENFKIGDVCRLLPNCGHSFHVQCIDSWILQTPVCPICRTWVHSPVVMREQSAVSENVEISTA

SEQ ID NO: 212379 - protein, 348 aa, Glycine max
  Coding DNA Sequence Number=SeqID_95601
  Gene Ontology: Mol. function=transporter activity; Cellular component= outer membrane; Biological process=transport
  Homolog annotation: Hit_ID=Q8KR76; Match level="QueryCoverage=96%, HitCoverage=52%, E-value=1e-100, Identity=51%"; Hit description =Putative photobactin outer membrane receptor PhuA
  Pfam annotation: Domain name=TonB_dep_Rec; Domain location=107-348; Score=85.9; E_value=1.2e-22; Accession=PF00593.14; Description=TonB dependent receptor
SDALTLENRVIYTDFNINRPTAYNIQYAEIDGQEVHVEPVDEFVNIFGGSTFKDKTDTHSAFAELTYALTPQVDVTAASRLEREHRRRDGGSQAVRIDFDETYTVFLPKLDVAWKPTDTQTYGAKIARGYNAGGGGITIGTPVVSYTYGSEYVWNYELYTRHHLKDANVVLTGNIFYNDYKDMQLPYSLGENSSVIRNADKVETYGAEIGATWQPRWDFELFGNLGLLKTDIKKFSGSGVEGHELARAPAYTANMGAKYQFLKGWELSSNVAFSDSYYSAYDNDSRGRIGSYWTANAQLAYTFDYGRATLYAKNLFDSDRREMVRSNDIYTATLQRGRLVGAAVELNF

SEQ ID NO: 212380 - protein, 479 aa, Glycine max
  Coding DNA Sequence Number=SeqID_95602
  Gene Ontology: Mol. function=DNA topoisomerase (ATP-hydrolyzing) activity; Cellular component=chromosome; Biological process=DNA unwinding during replication
  Homolog annotation: Hit_ID=Q1LKD0; Match level="QueryCoverage=99%, HitCoverage=62%, E-value=1e-163, Identity=64%"; Hit description=DNA topoisomerase IV, A subunit
  Pfam annotation: Domain name=DNA_gyraseA_C; Domain location=357-407; Score=14.5; E_value=0.048; Accession=PF03989.3; Description=DNA gyrase C-terminal domain, beta-propeller
  Pfam annotation: Domain name=DNA_gyraseA_C; Domain location=408-455; Score=15.0; E_value=0.042; Accession=PF03989.3; Description=DNA gyrase C-terminal domain, beta-propeller
  Pfam module annotation: Pfam domain module=DNA_gyraseA_C::DNA_gyraseA_ C; Domain location=357-407::408-455
PQLPDAELFGMIPGPDFAGGGPDHHAGRRHRADLRRRARLAQGAGALAVRGNGARPVAAGGHRAAARHLVPEGARRNRGNHQPQGQERQEEPDARADAGQGRDAEPAGRGARRIRQGRRRAPGVRTQDLARRPRRVRQHPAGADQHGKQRLGQPGLHWHRRPSAPEGPARHPGRMAGVPHQYRAAPHPLPSGQGHRPHPRAGRPHGGLPERGRSDPDHPRIGRAAGGIDGALQPVRPAGRGHPGNAPAPAGAPGRLQDRAGARGQAQGAGRAAGTAGQSQHPQALLIKEIEADAKQYGDDRPHPDRDRRARRARNQGAGRTGHRDRVAEGLAARPPGPRPRCLAGDDLYGAFECRTTDTLIAMGDNGRVYSVPVAGLLSARGDGQPVTTMIDLKSGTRIVHTIAAAADSRWLLATRGGYGFAAKLSDMTSRQRAGKQFITLEAGDELLRPVPLFDDATQLALLSQKGKFLVFGLDEVKS

SEQ ID NO: 212381 - protein, 270 aa, Glycine max
  Coding DNA Sequence Number=SeqID_95603
SEDRPPKQSKVRGHLVKIDAESLKIFLETPVVLAEGQTLPAYSRYCRLPTDYREIEAALCIPGRGFIFNSEDHPGKILRKDLTTLAQMWSVLSYSNLAPTSHTSDLTVDRAMLIFGLVSRMDMNIGALISGQMTSIAQSSTSRLEFPALITALCRDRGVVSDSLTFERLSPFINLAYIKKNYSNPEDLTVSIRGVRRARARPTELPSTSAAPTLASTSVAPSIPAQTDSQRFEAMLQSIHQGQIILLQSLQVAAPPVSIPLVEQFRELVV

SEQ ID NO: 212382 - protein, 283 aa, Glycine max
  Coding DNA Sequence Number=SeqID_95604
  Gene Ontology: Mol. function=peptidase activity; Cellular component =integral to membrane; Biological process=intracellular signaling cascade
  Homolog annotation: Hit_ID=UPI00003CCD10; Match level="QueryCoverage =94%, HitCoverage=20%, E-value=4e-35, Identity=31%"; Hit description =COG3164: Predicted membrane protein
ATLEDPHGDGAGQRLLEHPLGHEGAQADQRIDRQRRHHGCATGVEIGDHDRFQIPTLLHDVDAPRQHDGRDRAIDLVALGIQRTIGQLDLAAHGIERKAVAQQQLQQARRTRIHVHEAALVQADLGVAHQVGDVMGPWQVAPGRLALDAAGPAGHDPVKADTIHEAADVLELGGGVHRQATLRAFEAPGTGRIQGRGVIGDRQFIQAPLATTLQIRAQHLQFAQVLAIEAEFLGLQVDGGNVRQVVAGGKRLVGLVGVVGAAQRKILETGGDLAGDRAGRFAP

SEQ ID NO: 212383 - protein, 44 aa, Glycine max
  Coding DNA Sequence Number=SeqID_95605
MGVRVVASFKPKKSTSGETEETESTSVSASCSVAKVTRSRFYFF

SEQ ID NO: 212384 - protein, 87 aa, Glycine max
  Coding DNA Sequence Number=SeqID_95606
MDTNAYIHDKHNTYMGEQGSRFNKQIIYKKTVTPEKSKEKDSKGHNHVQSGDIRVIERVDNDECKKTSVSIVQLLKQQAHHQYQNSK

SEQ ID NO: 212385 - protein, 525 aa, Glycine max
  Coding DNA Sequence Number=SeqID_95607
  Gene Ontology: Mol. function=identical protein binding; Cellular component=nucleus; Biological process=DNA replication initiation
  Homolog annotation: Hit_ID=Q1SMU2; Match level="QueryCoverage=100%, HitCoverage=97%, E-value=0.0, Identity=73%"; Hit description=AAA ATPase
  Pfam annotation: Domain name=Arch_ATPase; Domain location=72-278; Score=-96.2; E_value=0.061; Accession=PF01637.9; Description =Archaeal ATPase
MGEDKTTQLPRRMTRSSASSSASTSNNVAAAKVTCLEPLTINDLLVGGDPISLNDIISSFPGRSSQILEVVRHLGPLNSPILPLFVYGSSSTGKTSIILQLFRHLNRPIVYSSCRTCYNQNILFESILNQLLLHRKNAANGYSNAKRCERPSDFVNFLREALTNVINNLKKSEKLISNEMTQGKIGNMIYLVFDNFQLVREWDKSSTILPLLFNLYDLLNMPEVGLIFISSTSPDTFYSNMGYVEPIPIYFPDYTEEDIRQILLRNQVNQKLYSSFLDVSLKSFCGITKQIDHLSAALKPLYEKYCEPLSDKGKGVAPNQEMKRRLLAHINPHIASSLNEIFKVSSLSSTEVEIRKEEKRKGNNRRLEQSEELGSLDFHVSTSAKYLLISAFLASRNPATLDASLFDSKGGSDNRKRKRKPSEKAQERKETLEQELLMKGPGTFPLERLLAIFQCLVSVAEEPSDEQEQNNDGLGVEGGNGGLMSDVLLQLSSLCNANFIFKGRSCPIEGSMRYRTTISEDLALK

SEQ ID NO: 212386 - protein, 449 aa, Glycine max
  Coding DNA Sequence Number=SeqID_95608
  Homolog annotation: Hit_ID=Q5VQ69; Match level="QueryCoverage=38%, HitCoverage=26%, E-value=2e-61, Identity=70%"; Hit description =Putative GTP-binding membrane protein LepA
  Pfam annotation: Domain name=GTP_EFTU; Domain location=299-449; Score= 92.6; E_value=1.2e-24; Accession=PF00009.17; Description=Elongation factor Tu GTP binding domain
  Pfam annotation: Domain name=HisKA_2; Domain location=248-317; Score=- 22.6; E_value=0.015; Accession=PF07568.3; Description=Histidine kinase
  Pfam annotation: Domain name=LRR_1; Domain location=210-232; Score =3.2; E_value=73; Accession=PF00560.23; Description=Leucine Rich Repeat
  Pfam annotation: Domain name=LRR_1; Domain location=234-256; Score =5.3; E_value=29; Accession=PF00560.23; Description=Leucine Rich Repeat
  Pfam annotation: Domain name=LRR_1; Domain location=258-279; Score =18.4; E_value=0.026; Accession=PF00560.23; Description=Leucine Rich Repeat
  Pfam annotation: Domain name=MMR_HSR1; Domain location=302-445; Score= -17.7; E_value=0.042; Accession=PF01926.13; Description=GTPase of unknown function
  Pfam module annotation: Pfam domain module=GTP_EFTU::HisKA_2::LRR _1::LRR_1::LRR_1::MMR_HSR1; Domain location=299-449::248-317::210 -232::234-256::258-279::302-445
MVRCLEYEPDEPPTMDEVEVELEHVLSLHEQADISNTNVAEAHHPGRLNEVNDWLDKVEAMQTAKGSPSYSAKSFSRHFDVVAQEVPHALVDEIPLEATVGLESTFDELSGCFDDNHVGVIGLYGIGEKHVIKDVYEGLLAEFGDDVYEARNQGEEIIASLKLTCLLEDRERENRIKMHDMIRDMALWLACDHGSNTSIQILSGKSDCSNLSTMIVRNSELTDLSDEIFLTANTLGVLDLSGNKRVKELHAIIGELVSLQHLDLSGTGIQELPRELQNLKKLSTTREKSTIDLSQYPTELVRNFSIIAYVDHGKFTLADRLLELTGTIKKGHGQPQYLDKLQVERERGITVKAQTATMFYKHSVNGNDCNDGKEGNESPKFLLNLIDTPGHVDFSYEVSRSLAACQGVLLVVDAAQGVQAQTVANFYLAFESNLTIVPVIKPEIDHAQD

SEQ ID NO: 212387 - protein, 125 aa, Glycine max
  Coding DNA Sequence Number=SeqID_95609
  Homolog annotation: Hit_ID=O82812; Match level="QueryCoverage=56%, HitCoverage=35%, E-value=6e-08, Identity=43%"; Hit description =Expressed protein
MESWARDNCLNENGNNVLTGVRRVPDRSLTNPITGPAWRFIISCWICEGSSLEISEGGKEGSGFLPHSRHASSSSSSNTSSNSSGMWTLRFPARAKWEFADARRRKRRRVGTGWKVMGKRGSKEE

SEQ ID NO: 212388 - protein, 338 aa, Glycine max
  Coding DNA Sequence Number=SeqID_95610
  Gene Ontology: Mol. function=hydrolase activity; Cellular component =vesicle membrane; Biological process=metabolic process
  Homolog annotation: Hit_ID=O82790; Match level="QueryCoverage=95%, HitCoverage=100%, E-value=6e-89, Identity=54%"; Hit description =Expressed protein
MADKFGNAERKDREMGHLYALDFDGVICDSCGETAISALKAAKLRWPPLFDGVDSTIEDWIVDQMITTNDANSKRENENSNQETINGNNLWTGCRCEVGMWDFVPFHYKEKDCGVRPVVETGYETLLLVRLLLETRVPSIRKSSVSEGLKVEDILENWFKLKPIIMEEWNENREELIDLFGKVRDDWLERDFTGWIGANRLYPGTADALRFASSKVYIVTTKQSRFADALLRELAGVTIAPERLYGLGTGLSQGGSAKEASENARTPGADTTVKILCFQSFVEDRLATLKNVIKEPELDNWNLYLVNWGFNTQKEREEAQANPRIQVIELSDFSSKLK

SEQ ID NO: 212389 - protein, 66 aa, Glycine max
  Coding DNA Sequence Number=SeqID_95611
MAPSEGKVKCNIGAAFFKESNSMGIGVCLRGHHVDSQRVYNGMKRRSLDPSEFGIIIMQCKECLFG

SEQ ID NO: 212390 - protein, 223 aa, Glycine max
  Coding DNA Sequence Number=SeqID_95612
  Gene Ontology: Mol. function=N-acetyltransferase activity; Cellular component=intracellular; Biological process=metabolic process
  Homolog annotation: Hit_ID=Q1SYS1; Match level="QueryCoverage=84%, HitCoverage=58%, E-value=2e-89, Identity=85%"; Hit description=SDL-1 protein
MEICVTTSTSAGLEQILPWMFYHKVIGVTNFFLFVEGKAASPEVSNVLESIPGVKVVYRTKQLEEQQAKSRIWNETWLAGFFYKPCNYELFVKQSLNMEMAIVMARDSGMNWILHLDTDELMHPAGAREYSLRQLLLDVPGHVDMVIFPNYESSIERDDIKEPFSELRYKPKPFSFSSKFEIIRQTGASGHCTLEGLKILEGCDVVMENIYCWVECHVGIFFS

SEQ ID NO: 212391 - protein, 121 aa, Glycine max
  Coding DNA Sequence Number=SeqID_95613
  Gene Ontology: Mol. function=GTPase activity; Cellular component =intracellular; Biological process=translational initiation
  Homolog annotation: Hit_ID=Q5VQ69; Match level="QueryCoverage=99%, HitCoverage=17%, E-value=1e-47, Identity=78%"; Hit description =Putative GTP-binding membrane protein LepA
  Pfam annotation: Domain name=LepA_C; Domain location=8-121; Score =243.3; E_value=5.3e-70; Accession=PF06421.3; Description=GTP-binding protein LepA C-terminus
MVKLDILLNGQPVDAMATIVHNTKAYRVGRELTEKLKGVLDRQMFEVNIQAAIGSKIIARDLSFCLKISAMRKNVLAKCYGGDVSRKRKLLEKQKEGKKRMKRVGSVDVPQEAFHELLKVS

SEQ ID NO: 212392 - protein, 129 aa, Glycine max
  Coding DNA Sequence Number=SeqID_95614
MRSFNSDFSPWRCSGRQRRRGEGRHHPLRNKPWKKELHHQECALDKKLEEDALIEEKKEREREREEHEIEGGKGGEKLNFELCLTRLSHSSKQRIKLNDLMMPRDHMLLKALFKTKKLKIFKMDDQDSL

SEQ ID NO: 212393 - protein, 169 aa, Glycine max
  Coding DNA Sequence Number=SeqID_95615
MSVYIKLAKTLLVVDVSKELLTVFHVHGLFKPQVTIIKEMETISKRCEELDVCGKVTLKSKLWEIAYPDLKSMCPPPKKVNTKDAQNKPMIKHQRSTKCDPYYWDKDSWSLVRNYLLKELAKWFDEYINFFGGIDRFEELNRSLLIDGLSMVIMDKWMDITDMGYVIAS

SEQ ID NO: 212394 - protein, 55 aa, Glycine max
  Coding DNA Sequence Number=SeqID_95616
MTEDSSKFTHISPKKSGHVTYGDNNKGRILGVGKIDDDPWLWHKRIAHINMGTLK

SEQ ID NO: 212395 - protein, 263 aa, Glycine max
  Coding DNA Sequence Number=SeqID_95617
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=82%, HitCoverage=14%, E-value=2e-30, Identity=54%"; Hit description=Chromo
MADNTRMKELTGDVKRILEMMENRNKEYAARFETLETTLEMTLKDKTRDPGSISLAMNNHPFKVVPWYQMMTRENSFKTWIAFMRALETEFGPSPCECPRSQLFKLTQIGSVQSYYVQFTALANRVQGITQEALLDCFVGGLKPNIRMDVIAQSPTSLLRTVSLAKLYEEKYTPKLKPFSSSFSSKTQTSNTNSNLNINQNSPQSLKSTSLPPLLPTPYTKPINVKKMTSAEMQLRRERGLSFTCDDKFSPSHRCPNKQHFVL

SEQ ID NO: 212396 - protein, 206 aa, Glycine max
  Coding DNA Sequence Number=SeqID_95618
  Gene Ontology: Mol. function=calpain activity; Cellular component =intracellular; Biological process=proteolysis
  Homolog annotation: Hit_ID=Q1S3Q9; Match level="QueryCoverage=96%, HitCoverage=39%, E-value=1e-26, Identity=35%"; Hit description =Cyclin-like F-box; F-box protein interaction domain
  Pfam annotation: Domain name=FBA_1; Domain location=60-206; Score= -37.0; E_value=0.0034; Accession=PF07734.3; Description=F-box associated
MFGFGYDPSSDKYKVVAIALTMLSLDVFEKTEMKVYGAGDSSWRNLKGFPVLWTLPKVGGVYLSGTLNWVVIKGKETIHSEIVIISIDLEKETCRSLFLPDDFCFFDTNIGVFRDSLCVWQDSNTHLGLWQMRKFGDDKSWIQLINFSYLHLNIRPNEEKSMILPLCMSNNGDFFMMKFTRNADDEYQTILYNQRDGKSQVSVVSS

SEQ ID NO: 212397 - protein, 105 aa, Glycine max
  Coding DNA Sequence Number=SeqID_95619
  Subcellular localization annotation: CTP_CleavageSite=34; ConfidenceScore=5.53e-01
MKVQISKLIWSTKFRALLSLSLHSSPSSSKLLSMASYGGELLLDSSSPCSGVSSLSSFSIPLPFIFQEAKESIDEEDPRPKSSNGACITDPLTALTPLDWWSLGS

SEQ ID NO: 212398 - protein, 46 aa, Glycine max
  Coding DNA Sequence Number=SeqID_95620
MARAQNPTAHHSAYLRKRALEAARGATLAEIPRFCLTLQEGFADEA

SEQ ID NO: 212399 - protein, 57 aa, Glycine max
  Coding DNA Sequence Number=SeqID_95621
VSRIDPLDLMMKYVQFQVKKRLSHEVPKVKKREISALSATGVFSQAQHKTGAKPEST

SEQ ID NO: 212400 - protein, 171 aa, Glycine max
  Coding DNA Sequence Number=SeqID_95622
MASNPSRAQKKAKYSKRKQVNGVEMVIDADVWKGVTGLDMGEVSKFEEFADGYKKMQTYRGMLLDPTMNLRNRLDVGGQTVEDIILVYLITYILTLRFIDYFNVNVSNEMADFTKASSEITKRHLKNLGMRFVEHEWIMAGKPPAVGNMDQMDEEAEAEAPQELAHQWSPF

SEQ ID NO: 212401 - protein, 46 aa, Glycine max
  Coding DNA Sequence Number=SeqID_95623
MDSGRFQISIPGDGFPRKPGPPRSLHGEVTSSPGRAQLARARVALE

SEQ ID NO: 212402 - protein, 104 aa, Glycine max
  Coding DNA Sequence Number=SeqID_95624
MTEDIVVFKSPTEDIVPSGVTNCRNLPFDGGAKRPKSWAKAFASKGENEWSRHQSLFEENVKKTIKDEGLCIFENEGSRVVYAWGRVLPSLLCILRYDEELRPM

SEQ ID NO: 212403 - protein, 66 aa, Glycine max
  Coding DNA Sequence Number=SeqID_95625
MVAITLAKVPQPPFFRGYNSNATCAYHGGVLGHSIEHCMTLKHKVMTKDNNGYLRALHWGNERHHA

SEQ ID NO: 212404 - protein, 201 aa, Glycine max
  Coding DNA Sequence Number=SeqID_95626
  Gene Ontology: Mol. function=RNA-directed DNA polymerase activity; Biological process=RNA-dependent DNA replication
MGAYSKDEKLLMHFFQERLIGAVVTWYTNLEPSQVHSWKDLMVAFIRQYQYNFNMAPNRMQLHNMCKKEHESFKEYTQRWRDLAAQVAPPMMEREMITMIVDTLLVFYYEKMVDYMPLSFADLVFVGEMIEVGLKRGKYDHPALMNRKPGANVENEEEGGTHVVIAVPTWPNFPLAQQYQYSANSPSHYPPPYQPRTLNHP

SEQ ID NO: 212405 - protein, 127 aa, Glycine max
  Coding DNA Sequence Number=SeqID_95627
MEKREKGEGEGEDVEEVGGREKGEEDGGEFWGGCMQSGGGAGGGPGRKPAGRAPSTSSAAASPSSSSSAASHLESLQQQQQQQQQQQQIVMASVVPGFAANSDFGTHGSVKKWVVVEFAINALGVGV

SEQ ID NO: 212406 - protein, 129 aa, Glycine max
  Coding DNA Sequence Number=SeqID_95628
  Homolog annotation: Hit_ID=Q1SMW2; Match level="QueryCoverage=98%, HitCoverage=5%, E-value=1e-36, Identity=64%"; Hit description=SNF2 -related; HMG-I and HMG-Y, DNA-binding; Bromodomain; ATP-requiring DNA helicase RecQ
MQSFQQQLLRKPEGSEAFLAYQAGLQGVFGSNNFPSSSMQLPQQSRKFVDLAQHGSNQVQGVEQQMLNPVQAAYFQYALQASQQKSALAMQSQQQPKVGMLGPSSVKDQEMRMGNLKMQDLMSMQAVNQ

SEQ ID NO: 212407 - protein, 204 aa, Glycine max
  Coding DNA Sequence Number=SeqID_95629
MGLNQAPTFKKRTADGSTPTSSFPQDIWKELGSGYDKVSVEAIASLTQYYDQSLRKHLEEKAKALAVQGEWASFIDILVLLVFGVVLFPNTDGLVDLVAIDAFLAYHYSKESPVVAVLADAYDIFDRRCEKRGARIVCCTTVPYIWLVSHLFHHESRPVCPLQGHRMCVEKGEANWEQLLAGMVEASINWFPRWKEGKAIVLSS

SEQ ID NO: 212408 - protein, 135 aa, Glycine max
  Coding DNA Sequence Number=SeqID_95630
MVVVVLLSTTNDGGSSCDNVGGDDKGGIGVSGGDNDDVNEGCGGSSGRGSSDSGESSISSSNGGVVTAKSAIFKYICLRRTRMMCPRWIANKSEITAIFRIDLPMTMSVDSSVLQVNHGPRPSKFDRCSSVVETR

SEQ ID NO: 212409 - protein, 1668 aa, Glycine max
  Coding DNA Sequence Number=SeqID_95631
  Gene Ontology: Mol. function=nucleic acid binding; Cellular component= brahma complex; Biological process=imaginal disc-derived wing vein specification
  Homolog annotation: Hit_ID=Q1SMW2; Match level="QueryCoverage=99%, HitCoverage=76%, E-value=0.0, Identity=73%"; Hit description=SNF2 -related; HMG-I and HMG-Y, DNA-binding; Bromodomain; ATP-requiring DNA helicase RecQ
  Pfam annotation: Domain name=DEAD; Domain location=758-896; Score= -32.3; E_value=0.003; Accession=PF00270.19; Description=DEADDEAH box helicase
  Pfam annotation: Domain name=Helicase_C; Domain location=1091-1170; Score=88.2; E_value=2.5e-23; Accession=PF00271.21; Description =Helicase conserved C-terminal domain
  Pfam annotation: Domain name=QLQ; Domain location=250-287; Score =44.2; E_value=4.4e-10; Accession=PF08880.1; Description=QLQ
  Pfam annotation: Domain name=ResIII; Domain location=754-890; Score= -26.2; E_value=0.0073; Accession=PF04851.6; Description=Type III restriction enzyme, res subunit
  Pfam annotation: Domain name=SNF2_N; Domain location=760-1039; Score =294.3; E_value=2.3e-85; Accession=PF00176.13; Description=SNF2 family N-terminal domain
  Pfam module annotation: Pfam domain module=DEAD::Helicase _C::QLQ::ResIII::SNF2_N; Domain location=758-896::1091-1170::250 -287::754-890::760-1039
GPAVGNLMPGNIIRPVQALATQQSIPNTMNNQIAMAAQLRAMQAWAHERNIDLSHPANANLMAQLIPLMQSRIVQQPKANDTNLGAMSSPVPVSNQQVTSPAVASESSAHANSSSDVSAQSGSAKARQTAPPSHLSPPISAGIASSSSDMAAQQFSLHGRDAQGSLKQSVLTINGMPSVHPQQSSANMNLGADHPLNVKTSSSGSEPAKMQYIRQLSQSTSQAGGLTNEGGSGNHPKTQGGPSQMPQQRNGFTKQQLHVLKAQILAFRRLKKAEGALPQELLRAIIPPPLDLQVQQPIHSEGAQNQEKSAGNIVAEHPRQNEVNAKDSQPISSINGKNSSKQEVFVRDENSTVTAVQVQGTPRVTKESAGKEEQQSVACSAKSDQESEHGIGRTPVRNELVLDKGKAVAAPQASVNDAMQLNKPAQASAVSQTKDVGSTRKYHGPLFDFPFFTRKHDSFGSSMMINNNNLSLAYDVKELLFEEGIEVLGKRRTESLKKIEGLLAVNLERKRIRPDLVLRLQIEEKKLRLLDLQARLRDEIDQQQQEIMAMPDRPYRKFVRLCERQRMELARQVQASQRALREKQLKSIFQWRKKLLETHWAIRDARTARNRGVAKYHERMLREFSKRKDDDRNKRMEALKNNDVDRYREMLLEQQTSIQGDAAERYAVLSTFLTQTEEYLHKLGSKITAAKNQQEGLSEEEVRAAAACAGEEVMIRNRFMEMNAPKDNSSVSKYYSLAHAVSEKVVCQPSMLRAGTLRDYQLVGLQWMLSLYNNKLNGILADEMGLGKTVQVMALIAYLMEFKGNYGPHLIIVPNAVMVNWKEIMAMKFNVLVTTYEFIMYDRARLSKIDWKYIIIDEAQRMKDRDSVLARDLDRYRCQRRLLLTGTPLQNDLKELWSLLNLLLPEVFDNKKAFNDWFSKPFQKEGPTQNTEDDWLETEKKVIIIHRLHQILEPFMLRRRVEDVEGSLPPKVSIVLRCKMSAVQSAIYDWVKSTGTLRLDPEGENSKIQKNPHYQAKEYKTLNNRCMELRKTCNHPSLNYPLLGELSTNSIVKSCGKLWILDRILIKLQRTGHRVLLFSTMTKLLDLLEDYLNWRRLVYRRIDGTTNLDDRESAIMDFNSPDSDCFIFLLSIRAAGRGLNLQSADTVVIYDPDPNPKNEEQAVARAHRIGQKREVRVIYMEAVVDKISSHQKEDELRSGGTVDMEDELVGKDRYIGSIESLIRNNIQQYKIDMADEVINAGRFDQRTTHEERRLTLETLLHDEERYQENVHDVPSLQEVNRMIARSEEEVELFDQMDEELDWPEDVMQHDEVPEWLRANTREVNAAIAALSKRPSKNTLLGGSIGMESSEVGSERRRGRPKGKKHPNYKELEDENGEYSEANSEDRNEDSAQEGENGEFEDDGYSGADGNRLEEDGLTSDAGYEIALSSENARNNHVVEEAGSSGSSSDSQRLTKTVSPSVSSKKFGSLSALDARPGSISKIMGDELEEGEIVVSGDSHMDHQQSGSWIHDRDEGEDEQVLQKPKIKRKRSLRVRPRHAMERPEDKSGSEMISLQRGESSVLADYKYQIQKRIDPESKSFGDSNASKHDKNEASLKNKQKLPSRKIANSSKLHGSPKSNRLNCTSAPSEDGNEHPTESWEGKHLNPNGSSAHGTKTTEIIQRGVCAIM

SEQ ID NO: 212410 - protein, 883 aa, Glycine max
  Coding DNA Sequence Number=SeqID_95632
  Gene Ontology: Mol. function=ubiquitin-protein ligase activity; Cellular component=ubiquitin ligase complex; Biological process =protein amino acid phosphorylation
  Homolog annotation: Hit_ID=Q2HTK4; Match level="QueryCoverage=99%, HitCoverage=100%, E-value=0.0, Identity=76%"; Hit description =Protein kinase; U box
  Pfam annotation: Domain name=Pkinase; Domain location=525-788; Score =154.8; E_value=2.3e-43; Accession=PF00069.15; Description=Protein kinase domain
  Pfam annotation: Domain name=Pkinase_Tyr; Domain location=525-789; Score=91.5; E_value=2.5e-24; Accession=PF07714.7; Description =Protein tyrosine kinase
  Pfam annotation: Domain name=U-box; Domain location=814-883; Score =59.9; E_value=8.2e-15; Accession=PF04564.6; Description=U-box domain
  Pfam module annotation: Pfam domain module=Pkinase::Pkinase_Tyr::U -box; Domain location=525-788::525-789::814-883
MAVVSPMPATTQRMGSVRSLSDAGGKFLEEPNPSVVDQPIYVAVTKEVKESRLNLIWAIQNSGGKRICILYVHVRATMVPLLGGKFPASALKEEQVQAYWEEERQGMHRILDDYLRICQRMGVRAEKLHIEMDSIEKGILELISQHGIQKLVMGAASDKYYNRRMMDLKSKKAISVCKQAPASCHIQFVCKGRLIHTRDRSSNEGNADVTSPLVQQVPNSVRSLRSQSVTLGQDRRANLTNPALELFRRVRSANDGHGASFMTVSSPEDTEGFSTPHDRMGTEVSSDESDRLSRMSPSGLSTCSDSAVELAFTPSLINESSENALELTLSRRIIEDLHYSSPPSTLDGGMDDTIYEQLEQARAEAENATLNAYQETVRRRKAEKDAFEAIRKVKASESLYTEELNLRKMTEEKLRKEKEELESMKSLRDKVKEELCLALDQKESLESQIASSELMVKELEQKILSAVDLLQSYKNERDELQMQRDNALREAEELRKKQGEASGTNVPQLFSEFSFSEIKEATSNFNPSSKIGEGGYGSIFKGVLRHTEVAIKMLNSDSMQGPLEFQQEVDVLSKLRHPNLITLIGACPDSWALVYEYLPNGSLEDRLACKNNTPPLSWQARIRIAAELCSALIFLHSSKPHSVVHGDLKPSNILLDANLISKLSDFGICRILSNCESSSSNTTEFWRTDPKGTFVYMDPEFLASGELTPKSDVYSFGIILLRLLTGRPALGITKEVKYALDTGKLKSLLDPLAGDWPFVQAEQLARLALRCCDMNRKSRPDLYSDVWRVLDAMRVSSGGANSFGLSSEGLLQPPSYFICPIFQEVMRDPHVAADGFTYEAEAIRGWLDGGHDNSPMTNSKLAHHNLVPNRALRSAIQDWLQNH

SEQ ID NO: 212411 - protein, 150 aa, Glycine max
  Coding DNA Sequence Number=SeqID_95633
MSRLMLGSEYASFRQGLLSSSALITELPSLLCHGFGFEENEEFVAYEIGVLIKSFPYLGALVWLIAELEIAQLLCQCWPHIFLVSPWVEAFGVALSGFHLVFFYRDNATMLVGELHCEMSNVLDNSPRPKVVISSTAPWVWTYPPVKVIK

SEQ ID NO: 212412 - protein, 205 aa, Glycine max
  Coding DNA Sequence Number=SeqID_95634
  Gene Ontology: Mol. function=RNA-directed DNA polymerase activity; Biological process=RNA-dependent DNA replication
  Pfam annotation: Domain name=rve; Domain location=7-158; Score=-4.2; E_value=0.013; Accession=PF00665.16; Description=Integrase core domain
MAAKVIHASYYCSTLRTNCAKPFPTPKEQVEFLLIVVDYFTKCIKVKPLTMITTHKVQKFTWKNIICRYDLPQAIVMDNGRLFIEKIYEEFLKQLSTKHLPSSIKHPQPMGKRNMRLSQHALLRASEARLTGALSKGGKCVESPPTFICGKRRKNRRKPVIKNIPSSGVVFTFEEGISTSHVDKSEALAPTYPPSKRKSDLRSSF

SEQ ID NO: 212413 - protein, 247 aa, Glycine max
  Coding DNA Sequence Number=SeqID_95635
  Gene Ontology: Mol. function=RNA-directed DNA polymerase activity; Cellular component=intracellular; Biological process=RNA-dependent DNA replication
MYPSHGKATFITENVNFCYKVMPFGLKNANTRYQRLLENVFKDLLWKIIKVYIDDMVVKSTDPSNHLKDLAEIFAELRKHMCLNPEKYIFGVEGESLGYSENRPPLQAGTQKARPHGRMSSSPLPRTTVKAGGRCMWTKPSIERATIGVTLEGPNNVIIEQLVNFDWKSSNNQEECKALIAGLKLAIEVGVKKLRCMSNSKLITEKVNKVFQARETCKSTTIWSSNSWSISSKWSTSTGNRTTELML

SEQ ID NO: 212414 - protein, 94 aa, Glycine max
  Coding DNA Sequence Number=SeqID_95636
MEGSQQNTHYPKEKLPKIITHKWKFGNLLEAPNTLPMKGLFVTKLASNEVLLSPIALKVVGPLLLDSNSSRDGTNPPSNSLYGNPQTRKQRDKQ

SEQ ID NO: 212415 - protein, 129 aa, Glycine max
  Coding DNA Sequence Number=SeqID_95637
MYVRTCFCDALIKEHLICLHSIPRLGLLSSVIPSVQSDINALKSLQRRKDSVDFSFSPFSSKLLSLSLFHSSEFLVPLYWSDFDPIDKVMRILKLAKYRLKAQVEKDEGPSGEGQSPRVEKDEGPSGEG

SEQ ID NO: 212416 - protein, 222 aa, Glycine max
  Coding DNA Sequence Number=SeqID_95638
  Homolog annotation: Hit_ID=UPI0000196DB9; Match level="QueryCoverage =74%, HitCoverage=15%, E-value=3e-23, Identity=40%"; Hit description =KLK/PIR/PIR121/PIRP/SRA1; transcriptional activator
MTPVTEPSLAASTIMVVVFAETMVEVEVEHEAVAVAVAMALAVESERREKSLELDFALLFPERHVLLRVLPVLVVLVASSEKDNESLYKRVKINRLINIFKNEAVIPPFLDLPWDELMNFEFLKHFVYAPRPGPKRGPYSCLQQLTQTHKDRDQAIFVFQNTLQSFSRFRILSAGKGKIPHLLSRCTARIWEQCAWKFSQPCKDASLSFSDYKKLISLKIYM

SEQ ID NO: 212417 - protein, 608 aa, Glycine max
  Coding DNA Sequence Number=SeqID_95639
  Gene Ontology: Mol. function=hydroxymethylglutaryl-CoA reductase (NADPH) activity; Cellular component=endoplasmic reticulum; Biological process=isoprenoid biosynthetic process
  Homolog annotation: Hit_ID=P29057; Match level="QueryCoverage=95%, HitCoverage=93%, E-value=0.0, Identity=67%"; Hit description=3 -hydroxy-3-methylglutaryl-coenzyme A reductase 1
  Pfam annotation: Domain name=HMG-CoA_red; Domain location=204-597; Score=1039.3; E_value=0; Accession=PF00368.9; Description =Hydroxymethylglutaryl-coenzyme A reductase
MELRRRSSAAAKASDALPLPLHVTNAFFFTLFFSLAYYLLQRWRDKIRSSSPLHLLSLSDIAAIFALLASVIYLLGFFGIHFVQSFVARPADEEPSQCASIDRADEDIANSIIEGDAQPSPLCRVDNDMKGKKVIQRPFECTKPILTELISSIDRVDSDNIIADPVINGKEAVQPSFQCTKPILTKLISSDDDIIIVDSVINGTVPSYSLESCLGDSRRAAAIRREVVQRETGRSLAGLPLEDFDYDAILGQCCEMPVGYVQLPVGVAGPLLLDGAEYTVPMATTEGCLVASTNRGCKAIYASGGASSVVFRDGMSRAPVVRFATVTRAAELMFYLEDPLNFDTLAVVFNRSSRFGRLQSIKCSIAGKNVYIRFTCSTGDAMGMNMVSKGVQNVLDFLQSDFPDMDVIGISGNYCSDKKPAAVNWIEGRGKSVVCEAIIKDDVVKKVLKTSVAALVELNMLKNLAGSAVAGALGGFNAHASNIVSAIFIATGQDPAQNVESSHCITMMEAVNDGRDLHISVTMPSIEVGTVGGGTQLPSQSACLNLLGVKGASKDSPGSNSRLLATIVAGSVLAGELSLMSAIAAGQLVKSHMKYNRSSKDMSKVSSS

SEQ ID NO: 212418 - protein, 271 aa, Glycine max
  Coding DNA Sequence Number=SeqID_95640
MAKTKTIAIKSPSICSSSESEAIHSRILKTQDKATMTLTPPSTNGIVIVSPRNKIFVKVEKTQKKRKEIRIQSSYSLKEKFNKSWDGKKVMNGRYIDFLEMVLKENVDNNNFTLRATLKVTKILIEQLLVDLLGAPIDSERLYADWLEDSSLDQHAFYAAKGTFQEVNDHDLLSRASRSPLSKSDEVKETLEEVVEKEIASSPIVESFAIEERFEKEEFPLRKEDVSKEDLFEEPLEYGSYHVDSEHHSEEEQKDKEDHFEHQNELYKVDA

SEQ ID NO: 212419 - protein, 52 aa, Glycine max
  Coding DNA Sequence Number=SeqID_95641
  Subcellular localization annotation: CTP_CleavageSite=23; ConfidenceScore=5.31e-01
MMKEVIHGHNSAAPWLHFSSSPSSSTFFSGLRLLKKPSSVGETRPGELLAKG

SEQ ID NO: 212420 - protein, 262 aa, Glycine max
  Coding DNA Sequence Number=SeqID_95642
  Gene Ontology: Mol. function=D-alanyl-D-alanine endopeptidase activity; Cellular component=integral to membrane; Biological process=cytochrome complex assembly
  Homolog annotation: Hit_ID=Q1SCK8; Match level="QueryCoverage=85%, HitCoverage=45%, E-value=1e-109, Identity=82%"; Hit description =Protease-associated PA; Peptidase A22B, minor histocompatibility antigen H13
  Pfam annotation: Domain name=PA; Domain location=56-152; Score=68.4; E_value=2.3e-17; Accession=PF02225.12; Description=PA domain
MLNALGLSKIGIGTSKLPCGMLLLSSKVKVPTWIDGVESCEYVGVGARFGPTLESKEKHANHTRVAIADPPDCCSKPKNKLTGEIILVHRGQCSFTTKANIAEEAGASAILIINYRTELFKMVCEANETDVDIGIPAVMLPQDAGENLKNHILNNSVEVFLWLMAVGTILCASYWSAWTARESAIEQEKLLKDASDEYINAENAGSSAYVEISTAAAISFVVIASCFLVMLYKLMAYWFVEVLVVLFCIGGVEAHAKSWVVT

SEQ ID NO: 212421 - protein, 114 aa, Glycine max
  Coding DNA Sequence Number=SeqID_95643
  Homolog annotation: Hit_ID=Q2HTK6; Match level="QueryCoverage=37%, HitCoverage=7%, E-value=1e-08, Identity=67%"; Hit description =Protease-associated PA; Peptidase A22B, minor histocompatibility antigen H13
MDEGQSRRKEACDYKIFMGSDNGTRTKLLSQPGLLGAILSGCTMSPAKLKVTNTMNIEQHRAQVAPSETMMVVRTEKPPDAKLRRETQRGGGVKVNGCLCTSNVGWDINKKHRV

SEQ ID NO: 212422 - protein, 76 aa, Glycine max
  Coding DNA Sequence Number=SeqID_95644
MVFWTLMSIANMGSNQVPSFKKRFYHVKVKILELASLRELGQRMDQVRYQAFHKAYGKIWDLAMIEVSVEAIASLA

SEQ ID NO: 212423 - protein, 226 aa, Glycine max
  Coding DNA Sequence Number=SeqID_95645
  Homolog annotation: Hit_ID=Q1SCK7; Match level="QueryCoverage=20%, HitCoverage=12%, E-value=1e-13, Identity=76%"; Hit description=SKP1 component
MVKNFVKDPKEVKTSKNKKKNRRKKEQQQKNSSLKEASEVNKEVNGQSIRHQSAEADRIAETSNSHTEDVFAHREFDDGDIDDGIDPALKEKIDSCTNLSAIETKLVHRWNCSWNRLRNRDTSRRISTILMTLRLGRPSLRWHAKREWTVTAEKSYVLGTIGHREVEDFARRLNSDWPERMQELLSSGQERKMMLFTPNGNSFLRRNACMFFPCVLSDFTYPLYAC

SEQ ID NO: 212424 - protein, 106 aa, Glycine max
  Coding DNA Sequence Number=SeqID_95646
  Gene Ontology: Mol. function=transporter activity; Cellular component= integral to membrane; Biological process=transport
  Homolog annotation: Hit_ID=Q1SCJ5; Match level="QueryCoverage=95%, HitCoverage=15%, E-value=5e-29, Identity=66%"; Hit description=Major facilitator superfamily MFS_1
  Subcellular localization annotation: CTP_CleavageSite=59; ConfidenceScore=5.14e-01
MSEVPAMAVLSMTGSQGSDAFSQSGLYSITKSLDHAMLIFMSFNVRVHLLGLLNTAGVLAAVFGTAATGFIIQQGSWNDVFKVAVALYIVGTLVWNIFSTGEKVLD

SEQ ID NO: 212425 - protein, 341 aa, Glycine max
  Coding DNA Sequence Number=SeqID_95647
  Homolog annotation: Hit_ID=Q1SLA4; Match level="QueryCoverage=38%, HitCoverage=24%, E-value=1e-23, Identity=46%"; Hit description=Zinc finger, CCHC-type; Lipocalin
MTISWFLSLMKRIKKKAMTEGLCLIYDHYLVVREWSPIHPSIEAIEKVVVWVHVFRLPIEYYDAKLLHAIRDRIGRTMRVDRTTLYQERGKCARLCVEVDLTQPLLALFELNNMYCKIEYEELHFLFLTCGRLGHYMEGCPDKDKPNTWNGEKPPQKDAIENIGDNEQVPNEGPWAGVKKLVDRGKERKKNKALLEMFILKPQERFVVLSHLKIILQKMRMRQLDPQITWLPWLRVFTKTIRRTKKVSKLSRMVVEGVTDIIIQPGQEHNNQRPHLENKGGDTRLMHETYENTTMGQNNMNHHVIEEDTGQDINIMEVGVTQKIDNTMHQLPKPPNPCGIG

SEQ ID NO: 212426 - protein, 188 aa, Glycine max
  Coding DNA Sequence Number=SeqID_95648
MFAVMETRIDPSKLEETFRLLGFHGYTFSPTRGFVGGIAVAWKTDKDQDTLGKVLCPMDIKVCLKGWTELYETLNGDFNNILLAQIVFRSTKKKKKILNSSNWRKPIVVALGNLQASLSWKSNLRIKIQVYDDEIKNAVLNMAPWKSPGPDGFLAGFYHHEWDVVGPTVCNSIKDLWNLPHMIEVQRN

SEQ ID NO: 212427 - protein, 195 aa, Glycine max
  Coding DNA Sequence Number=SeqID_95649
  Gene Ontology: Mol. function=calpain activity; Cellular component =intracellular; Biological process=proteolysis
  Homolog annotation: Hit_ID=Q1S671; Match level="QueryCoverage=82%, HitCoverage=42%, E-value=1e-20, Identity=40%"; Hit description =Cyclin-like F-box; F-box protein interaction domain
  Pfam annotation: Domain name=F-box; Domain location=7-54; Score=40.3; E_value=6.6e-09; Accession=PF00646.23; Description=F-box domain
MRSEKKPWSPLLCDELIEEILSRLPVKPLIQFKCVCKGWNSLMSDPYFIKLHLSKSAAKDDLEHLQLMKNVCLGSIPEIHMESCDVSSLFHSLQIETFLFNFANMPGYHLVGSCNGLHCGVSEIPEGYRVCFWNKATRVISRESPTLSFSPGIGRRTMFVFGYDPSSDKYKVVAIALTMLSLDVSEKTEMKVHGA

SEQ ID NO: 212428 - protein, 160 aa, Glycine max
  Coding DNA Sequence Number=SeqID_95650
MYIVPDFLLAMENSYGRELLHSPGQWNMELLTTLFPNDITQRILPILPPYDQMREDKMVWSGKNLGQCKPMSQQISYSRAQSRWKKIWKLKVLQHNGHNSCAEMWVVTCHRHWIWSNKHIHDSNFVRLGKPWEEGKSCCCSYNVALNIVDTTQVGQKVEI

SEQ ID NO: 212429 - protein, 99 aa, Glycine max
  Coding DNA Sequence Number=SeqID_95651
  Gene Ontology: Mol. function=RNA-directed DNA polymerase activity; Biological process=RNA-dependent DNA replication
  Homolog annotation: Hit_ID=Q2HVE2; Match level="QueryCoverage=89%, HitCoverage=11%, E-value=3e-11, Identity=39%"; Hit description =Ribonuclease H
MAFIWGDQGTTRKSHVVGWKTMMLPKHEEGMAICNLVEMNKAYLMKMGWTLCLKNYGLWGEVLIGKYGKRGSLNQMTLEAKGIDSHIGKSISKGLSWLS

SEQ ID NO: 212430 - protein, 137 aa, Glycine max
  Coding DNA Sequence Number=SeqID_95652
  Gene Ontology: Cellular component=chloroplast thylakoid membrane
  Homolog annotation: Hit_ID=Q2QYC9; Match level="QueryCoverage=66%, HitCoverage=33%, E-value=2e-26, Identity=62%"; Hit description=FHA domain containing protein, expressed
  Pfam annotation: Domain name=FHA; Domain location=64-131; Score=63.8; E_value=5.6e-16; Accession=PF00498.16; Description=FHA domain
MTTKNQNKIEYPGENLGMFKECVVFDLREVEFVIVIIGLGDGDTRHIGFKVEMPGPYEIASSEVTVGRVPDKADLVIPVATVSGVHARIQKKQGNLLVTDLDSTNGTFINDKRLRPGVVATISPGSCITFGTYLTNF

SEQ ID NO: 212431 - protein, 281 aa, Glycine max
  Coding DNA Sequence Number=SeqID_95653
MSCTDSLSTPLHLTKRTASVHPSFACLEILERKVQVPEIFERFCCVKICRDQSLKQEPMHALLGSFNSGNWSDSKFLDSAGLSCRTITRNWGQLSGPCLAKRPMASRKRKSIGSRPTTQYDTRRFHSLDAWNRYTYNVLGRNILPKRKVELYHTELDNFKTELERRNFHKRLINFVDGSIDLALVKEFYANLYSSEGPSPKQAIVRGYLMKIDADSLNTFLETPVVFPEGETLPTYSRYCRLPIDYREIEAALCILSRGFILNAKGHPGRILRKRFDYFSP

SEQ ID NO: 212432 - protein, 100 aa, Glycine max
  Coding DNA Sequence Number=SeqID_95654
MKDWGNFIHLILGEDSEHSAPITTFFLVWRFGGKRGEGENHVFHAEKCIYNLRISLSKLILLSGSSLFVLSVTIRAEHNSLCVNSRSVQFPLGLELCLAH

SEQ ID NO: 212433 - protein, 118 aa, Glycine max
  Coding DNA Sequence Number=SeqID_95655
  Gene Ontology: Mol. function=nucleic acid binding
MDYAIVPSLASGMLRNFTDCALTLPFNSRHVTEFHGLPNDCCQVPRSGQAKVAFHEKDEAKRWLHSFKGNSLKTWDKVVEKFLKKYFPESKTAEGKATISSFHQFPDESLSEALERFR

SEQ ID NO: 212434 - protein, 369 aa, Glycine max
  Coding DNA Sequence Number=SeqID_95656
  Pfam annotation: Domain name=RRM_1; Domain location=53-117; Score =8.2; E_value=0.025; Accession=PF00076.12; Description=RNA recognition motif. (a.k.a. RRM, R
RERRRVTDKDRRNERWSETDTARTSVKQYRNTARTSTNRRTPNGSPSRRWRNNDYANEELLWRHFKKWGDVRDVYIAKRLNKDGRRYRFMRFKGVSDAKGLEVRLDNIFINDCKLFVNLPRFDKPVRNTELQKKNPIGRKYTDEASKPCGVTTGALRRSYVDVMTKGGCQGDKRTDEAQTPTILINPDEGGEYWCNETWVGMLKKVMEVETLEDRITWELGYNVHKCRPNNRVVWLQLWGFPIQVWEMKNLRRAVAAIGDVIVRVGELEYRVWIVEETGFEGGSNRKGSSPSDGWSEMITSDDGGEVGDVLDDTNTNFSFSSELPNQKLSPSRTQRAEGGTDVHCCDLRPLGNIQADVTPKEKSKGTVE

SEQ ID NO: 212435 - protein, 94 aa, Glycine max
  Coding DNA Sequence Number=SeqID_95657
MAKFDLDIVLEFYANAWPTEEGVRDLRSWVRGQWIPFDADALSQFLGYPLVLEEGQECEYGQRRNRANGFDEEAIAQLLCIPGQDFARTAAGRR

SEQ ID NO: 212436 - protein, 81 aa, Glycine max
  Coding DNA Sequence Number=SeqID_95658
MASKDLEQLTQKIRDQLEESITEKHKGLYIEENPPRLVGIGRPYEGLTTVHNILLANDQVKVGVEEVRDANAHILVPIKEI

SEQ ID NO: 212437 - protein, 43 aa, Glycine max
  Coding DNA Sequence Number=SeqID_95659
MALGVRLLEPTQGCLAAAFSTCPELGRDDDLSVVTLASICVRS

SEQ ID NO: 212438 - protein, 188 aa, Glycine max
  Coding DNA Sequence Number=SeqID_95660
  Gene Ontology: Mol. function=nucleoside diphosphate kinase activity; Cellular component=mitochondrion; Biological process=pyrimidine ribonucleoside triphosphate biosynthetic process
  Homolog annotation: Hit_ID=Q7WHM7; Match level="QueryCoverage=74%, HitCoverage=99%, E-value=1e-69, Identity=95%"; Hit description =Nucleoside diphosphate kinase
  Pfam annotation: Domain name=NDK; Domain location=52-186; Score =256.1; E_value=7.5e-74; Accession=PF00334.9; Description=Nucleoside diphosphate kinase
MRSYRRVRIPARGQPRDHSEGLAVSNPRLGTGGRDGPERAVNAVVPILMSVQRTLSIIKPDAVAKNVIGQIVARFEQAGLKVIAARLAQLSRADAERFYAVHKERPFFKDLVDFMVSGPVFVQVLEGEDAIQKNRDLMGATDPKKAAPGTIRADFADSIDANAVHGSDAPETAAVEVAFFFPEINIHS

SEQ ID NO: 212439 - protein, 232 aa, Glycine max
  Coding DNA Sequence Number=SeqID_95661
  Gene Ontology: Mol. function=aminoacyl-tRNA ligase activity; Cellular component=intracellular; Biological process=tRNA aminoacylation for protein translation
  Homolog annotation: Hit_ID=Q7WHM6; Match level="QueryCoverage=93%, HitCoverage=22%, E-value=1e-106, Identity=84%"; Hit description =Valyl-tRNA synthetase
  Pfam annotation: Domain name=tRNA-synt_1; Domain location=31-232; Score=-253.2; E_value=1.7e-08; Accession=PF00133.12; Description =tRNA synthetases class I (I, L, M and V)
MTQAAPPNAASAATDSPELSKSFEPAELESRWYAEWEKRGYFAAGSHVKTGTEGQPYVIQFPPPNVTGTLHMGHAFNQTIMDGLIRYHRMLGDDTVFIPGTDHAGIATQIVVERQLDAQKVSRHDLGREKFVEKVWEWKEKSGNAITGQVRRLGASADWPREYFTMDDRMSRGVVETFVRLHKQGLIYRGKRLVNWDPKLLTAVSDLEVQSEETDGHMWHILYPFVDGPQTI

SEQ ID NO: 212440 - protein, 153 aa, Glycine max
  Coding DNA Sequence Number=SeqID_95662
FSHHAKHAVATLSGRCELSPQVPLSATAPCGSNVFQDYFDDAKESRVKQVPKNQESKSFKNQVSKNQDSRIIKFQDSIKFQESRFKNNQDQDSRLKIQESREDSIKISTKQGTSTWLFKENKGGYIPCGSLACKGFYRVERNLKNRWLLGDWM

SEQ ID NO: 212441 - protein, 67 aa, Glycine max
  Coding DNA Sequence Number=SeqID_95663
TYIHKETGFRCRSLKEIKNYEKYGSPPRRHKVKTQAKEESNDKTKNETEYWLKFTDNYKLMSRTESD

SEQ ID NO: 212442 - protein, 76 aa, Glycine max
  Coding DNA Sequence Number=SeqID_95664
MAATDFTYECLCIQYPDEDVPYVLKTGLIHLLPKFHGLAGLSNMERSMIDAASGGALGDMSPPEARNLIEKMDSNS

SEQ ID NO: 212443 - protein, 68 aa, Glycine max
  Coding DNA Sequence Number=SeqID_95665
MTYIHKETGFRCRSLKEIKNYEKYGSPPRRHKVKTQAKEESNDKTKNETEYWLKFTDNYKLMSRTESD

SEQ ID NO: 212444 - protein, 79 aa, Glycine max
  Coding DNA Sequence Number=SeqID_95666
MTYIQCRSLEEIKNYKKYGSRPRRHKVKTQDKEESNDKTKNEIDEMLVAQGKAKAEVMRTFVEEFLSEAYYNQLHMFNP

SEQ ID NO: 212445 - protein, 74 aa, Glycine max
  Coding DNA Sequence Number=SeqID_95667
MAIRFADDNNLSLHVIGLAASALQKVQNDHNLSLRATGLDRLWMAKRLNRLWMAKSCADYHNLSLHAIGLAASG

SEQ ID NO: 212446 - protein, 150 aa, Glycine max
  Coding DNA Sequence Number=SeqID_95668
  Gene Ontology: Mol. function=transmembrane receptor activity; Cellular component=membrane; Biological process=defense response
  Homolog annotation: Hit_ID=Q1SGR7; Match level="QueryCoverage=86%, HitCoverage=11%, E-value=2e-39, Identity=65%"; Hit description=TIR; Disease resistance protein; AAA ATPase
  Pfam annotation: Domain name=TIR; Domain location=21-148; Score =109.6; E_value=9.1e-30; Accession=PF01582.10; Description=TIR domain
MASNTIIQCNPSTHTKRKYDVFVSFRGEDSHNNSTGFLFEALRKKGIDVFRDDVSLNKGKSIAPKLLQAIEGSRLFIVVFSKNYASSTWCLRELAHICNCIEISPRHVLPIFYDVGPSEVRKQSGSYEKPLPNTKKDLVRIKRRWRNCKD

SEQ ID NO: 212447 - protein, 183 aa, Glycine max
  Coding DNA Sequence Number=SeqID_95669
  Gene Ontology: Mol. function=transmembrane receptor activity; Cellular component=membrane; Biological process=defense response
  Homolog annotation: Hit_ID=Q19PM8; Match level="QueryCoverage=98%, HitCoverage=19%, E-value=1e-33, Identity=37%"; Hit description=TIR -NBS-TIR type disease resistance protein
  Pfam annotation: Domain name=LRR_1; Domain location=133-154; Score =10.2; E_value=3.5; Accession=PF00560.23; Description=Leucine Rich Repeat
  Pfam annotation: Domain name=LRR_1; Domain location=156-178; Score =14.1; E_value=0.52; Accession=PF00560.23; Description=Leucine Rich Repeat
  Pfam annotation: Domain name=LRR_3; Domain location=110-129; Score =27.1; E_value=6.2e-05; Accession=PF07725.3; Description=Leucine Rich Repeat
  Pfam module annotation: Pfam domain module=LRR_1::LRR_1::LRR_3; Domain location=133-154::156-178::110-129
MDVLRISFDELNDKDKKIFLDIACFFADYDEDYVKEIIDFCRFHPENGLRVLVDKSLISIEFGKIYMHGLLRDLRRYIVREESPKEPRKWNRLWDYKDLHEVMLDNKPHKLVEMSLPDSNMKQLWEDTKPQHNLRHLDISHSKNLIKIPNLGEAINLEHLNLKGCTQLGKIDPSIGLLRKLAF

SEQ ID NO: 212448 - protein, 100 aa, Glycine max
  Coding DNA Sequence Number=SeqID_95670
MENWNANAASTTHPFLFDCCKLNLHPYSTMPPILHYDGSVAEIMLPVTTCFPQFSKTLAFEAMNLRGASLLSLIVVDPVRVSNDTHISSSHHENRGNPLF

SEQ ID NO: 212449 - protein, 364 aa, Glycine max
  Coding DNA Sequence Number=SeqID_95671
  Gene Ontology: Mol. function=transmembrane receptor activity; Cellular component=membrane; Biological process=defense response
  Homolog annotation: Hit_ID=Q1SGR7; Match level="QueryCoverage=68%, HitCoverage=20%, E-value=2e-50, Identity=46%"; Hit description=TIR; Disease resistance protein; AAA ATPase
  Pfam annotation: Domain name=LRR_1; Domain location=122-147; Score =1.1; E_value=1.8e+02; Accession=PF00560.23; Description=Leucine Rich Repeat
  Pfam annotation: Domain name=LRR_1; Domain location=165-186; Score =6.5; E_value=18; Accession=PF00560.23; Description=Leucine Rich Repeat
  Pfam annotation: Domain name=LRR_1; Domain location=188-209; Score =5.6; E_value=25; Accession=PF00560.23; Description=Leucine Rich Repeat
  Pfam annotation: Domain name=LRR_1; Domain location=211-233; Score =11.9; E_value=1.7; Accession=PF00560.23; Description=Leucine Rich Repeat
  Pfam annotation: Domain name=LRR_1; Domain location=235-257; Score =3.8; E_value=56; Accession=PF00560.23; Description=Leucine Rich Repeat
  Pfam annotation: Domain name=LRR_1; Domain location=258-280; Score =7.5; E_value=11; Accession=PF00560.23; Description=Leucine Rich Repeat
  Pfam annotation: Domain name=LRR_1; Domain location=282-305; Score =2.7; E_value=88; Accession=PF00560.23; Description=Leucine Rich Repeat
  Pfam annotation: Domain name=LRR_1; Domain location=343-364; Score =6.8; E_value=15; Accession=PF00560.23; Description=Leucine Rich Repeat
  Pfam annotation: Domain name=LRR_3; Domain location=165-184; Score =30.9; E_value=4.6e-06; Accession=PF07725.3; Description=Leucine Rich Repeat
  Pfam module annotation: Pfam domain module=LRR_1::LRR_1::LRR_1::LRR _1::LRR_1::LRR_1::LRR_1::LRR_1::LRR_3; Domain location=122-147::165 -186::188-209::211-233::235-257::258-280::282-305::343-364::165-184
MAAESKTYQDTADTRRGAKSALVPMAARKATSADTIDIVDTKQENLPKCSEEGGFSTRARPGWLCETPHDGSRTMAVQRVAFQGGSGAMAVTGAKVYLEAIVIEYHFPQTMMRVDALSKMSHLKLLTLQFVKFSGSLNYLSDELGYLNWFEYPFDCLPPSFQPDKLVELILRCNSIKQLWEGTKHLPNLRRLNLSHSKNLFEMGNLGESLNLESLYLEGCIQIKHIDPSIGILRKLIFVNLKDCKSLTKLPHFGEDFSLEILYLEGCMQLRWIDPSIDHLRKLSVLNLKDCINLLLDESRDVENLKKLEIGEAPIHSQSSSSYLKAHDDFVSCLFPSSPIFQSMHQLDLSLCNLLQIPDAIGNL

SEQ ID NO: 212450 - protein, 69 aa, Glycine max
  Coding DNA Sequence Number=SeqID_95672
MTKLGLCLSSGPPPLDDKKGANNHKGISAYHGVQNDQTWALACHRARRLGDDKRVRITIKVSPRIMGAE

SEQ ID NO: 212451 - protein, 75 aa, Glycine max
  Coding DNA Sequence Number=SeqID_95673
  Homolog annotation: Hit_ID=UPI00005F931B; Match level="QueryCoverage =69%, HitCoverage=43%, E-value=7e-09, Identity=56%"; Hit description =COG0346: Lactoylglutathione lyase and related lyases
YTVEPALSLPASAARSEIVFKTARKDDVDFLYHEWGVLREITIIQSPVRMDFGYTFTALDPDGHRLRVCYLQLDE

SEQ ID NO: 212452 - protein, 195 aa, Glycine max
  Coding DNA Sequence Number=SeqID_95674
  Gene Ontology: Mol. function=transporter activity; Cellular component= integral to membrane; Biological process=transport
  Homolog annotation: Hit_ID=UPI00005F7CB4; Match level="QueryCoverage =72%, HitCoverage=38%, E-value=7e-25, Identity=51%"; Hit description =COG0477: Permeases of the major facilitator superfamily
MTSNLLNLRQQRATRTLFFIAGLGMAAWAPLIPFAKAQLAINDGMLGLLLYALYRRADCPFWLSHAAAAVRCRTGPGSAAADAAELTAANSGRAVALRRDQRTDGCQHELSGGDRGARGRGQQDVGLSRLLQSWQHCWRRRGESAAVAAGCAPAGAAAAVCVDCIAAADEPYRPVAPSSHGCKTNARYAARPDAP

SEQ ID NO: 212453 - protein, 84 aa, Glycine max
  Coding DNA Sequence Number=SeqID_95675
MEEKSKCGHEEHSCTESPTLNVDPPCPVARHMKWKITSTKRHGQMTNKQHRGVLFHMGDRTYSTRPLADLSIQAVFASQGQVSQ

SEQ ID NO: 212454 - protein, 66 aa, Glycine max
  Coding DNA Sequence Number=SeqID_95676
  Subcellular localization annotation: CTP_CleavageSite=44; ConfidenceScore=5.78e-01
MVPFGGSNLARQASWVASFSFLSKPRRFRNASETFPWVIWRRFSAVLHRSSVFNRNPTVRSCRNHV

SEQ ID NO: 212455 - protein, 141 aa, Glycine max
  Coding DNA Sequence Number=SeqID_95677
MVIILKEGSRLAVWGSPCSSGNVANKVVVDIEDESFLENAYDDHKRWHQPHHGSPLLHELWQGGVWVIVGGVGLGKDGTMDWLMVHMIWCGGLDGTWDYRCLGGYGGHWVRIDILVGDGDTPVDGAVVMGEGGAVGEEEKK

SEQ ID NO: 212456 - protein, 501 aa, Glycine max
  Coding DNA Sequence Number=SeqID_95678
  Gene Ontology: Mol. function=oxidoreductase activity; Cellular component=membrane; Biological process=electron transport
  Homolog annotation: Hit_ID=O49859; Match level="QueryCoverage=99%, HitCoverage=99%, E-value=0.0, Identity=68%"; Hit description =Cytochrome P450 82A4
  Pfam annotation: Domain name=p450; Domain location=39-490; Score =275.3; E_value=1.2e-79; Accession=PF00067.12; Description=Cytochrome P450
MEFALNYLNATVTGVLSLTLFFLFLYNPFKFALGKKEAPKVAGAWPILGHLPLLSGSETPHKVLDALADKYGPIFTINNGVKKVLLLAIELMCYNQAMFGFAPYGPYWRELRKIVNLEILSNRRVEQLENVRVSEVQSLIKGLFNVWSSNKNNESGYALVELKQWFSHLTFNTVLRMVVGKRLFGARTMDDEKAQRCVKAVKEFMRLMGVFTVADAIPFLRWFDFGGYEKAMKETAKDLDEIFGEWLEEHKQNRAFGENNVDGIQDFMDVMLSLFDGKTIDGIDADTIIKSTLLSVISGGTETNITTLTWAVCLILRNPIVLEKVIAELDFQVGKERCITESDISKLTYLQAVVKETLRLYPAGPLSAPREFIEDCTLGGYNVKKGTRLITNLWKIHTDLSVWSNPLEFKPERFLTTHKDIDVRGHHFELLPFGGGRRVCPGISFSLQMVHLTLASLCHSFSFLNPSNEPIDMTETFGLTNTKATPLEILIKPRLSSSCYV

SEQ ID NO: 212457 - protein, 36 aa, Glycine max
  Coding DNA Sequence Number=SeqID_95679
MASLKRAKSMSSYGIIGGIDSLVDKHSFDSRTEKRN

SEQ ID NO: 212458 - protein, 280 aa, Glycine max
  Coding DNA Sequence Number=SeqID_95680
MSASTINQYGYTSTIDQSIQAKSIRGGDTGQCVKADVGLKRGMVFWRGAKRTFGGVFLAVQGESSFDCLEKSWPGSDESVPEHPLKPTESGSIEIHPNGSWPSNRGTSSLTDNRGGEGGWFVAGVVEVKPVVMCWYETNVRKKKKSLGSRSRSLLGPSRAFLSSCTFVVAGAFLSSYSFATAGLNQTCASYEEPSSITWWSSSDEVGAYVLYKPLEDREWSKRIESIFPGSELPSLFNNQRQGRKTVSEMGSPQKPNFTCYIPGVLNEDPITDESDHLWL

SEQ ID NO: 212459 - protein, 719 aa, Glycine max
  Coding DNA Sequence Number=SeqID_95681
  Gene Ontology: Mol. function=RNA-directed DNA polymerase activity; Cellular component=chromatin; Biological process=chromatin assembly or disassembly
MALRVMVGNGSFQHCEQLCPDTKVLIQGHTFTVKRMISTNSTSGLFHISLLPISQAEPTDPPHPIPTINELLLKYQSIFHQPSSLPPPQQHDHHINLLLTANLVNVRPYRYPHFQKTEIEKQVSELLDFGLIQPSRSPFSSLVLLVKKKDGTWRMCVDYRALNSITVRDRFPIPTIEELLNKLGNASWFSKLDLRQGFHQILMADEDISKTAFRTHHGHYEYRVMPFGLCNMLSTFQAAMNNLLRPFLRKFTARYYLKKFVKGYAAIMAPLTKLLCKDAFHWVSESQTAFEKLKTTMTAAPVLALLNFVIPFALETSASSTVMGPVLHQQGHPIAYFSKPFCFHLQQAYAYVMELHAIVAAGYDYDIQYKTRVSNTVVDSLLHRDTSPPSHYFVLLIPHLDFMTQLNGTLLASSEFQKQREAILSHPEAYPSFSISDDLIIFKGTIWLDSQNPFIPTLLHEYHVTPLGGHFGIKHITRKNAGLLQPILIPTGVWEDLSMDFVTQHPSSHGFTVVLILVDRFSKGVHLGALSTQFTAFKVANLFMDTGVVQDEWYDSTYEYRLPSISGWSDGEWSYNTSQHSSTELTPYEVIYGKPPPSIPSYLRGSSRNEVVDTMLSTREETYATLRRKLLKAQDTMKHFADKMRRDAQYEVGQLVYVRLRPYRQLSLYSQAPNKLAKMSYIAYNCPKGPRFTLYFTVHCCGLTMVPLIYKQPPSTKCT

SEQ ID NO: 212460 - protein, 107 aa, Glycine max
  Coding DNA Sequence Number=SeqID_95682
  Gene Ontology: Mol. function=RNA-directed DNA polymerase activity; Cellular component=intracellular; Biological process=RNA-dependent DNA replication
MGEEQSKVIREEVDKLLNENLIREVRYSTWLANVVMVKKANEKWLVNGASGFQVLSFLEAYFGYNQIKMHASYEDKMTFIIEDANFCYRLMPFDLKNASATYHWLMD

SEQ ID NO: 212461 - protein, 92 aa, Glycine max; identical to SEQ ID NO: 170005
  Coding DNA Sequence Number=SeqID_95683

SEQ ID NO: 212462 - protein, 92 aa, Glycine max
  Coding DNA Sequence Number=SeqID_95684
MKLLFWEGLLFFLLRVYGRRVEALAQKGLQKARHDLFLAIDFSQAKKGLKTACNSGTVGIRDYNLSSKGSFRQTIAKYIRQYARCDKITHTE

SEQ ID NO: 212463 - protein, 94 aa, Glycine max
  Coding DNA Sequence Number=SeqID_95685
  Gene Ontology: Mol. function=transferase activity; Biological process= biosynthetic process
  Homolog annotation: Hit_ID=Q4HGS7; Match level="QueryCoverage=98%, HitCoverage=27%, E-value=2e-15, Identity=37%"; Hit description =Glycosyl transferase, group 1 family protein
MTSYHEGLAMVLIEAQAFGIPALAYDVSGPAEVIVDGQTGYLVNDGDEEQFISKLSLLLDNESLREDMSDKCSDYLNRFKIEMIAEKWKRLFEA

SEQ ID NO: 212464 - protein, 86 aa, Glycine max
  Coding DNA Sequence Number=SeqID_95686
MIAWDSLGQAIRDATFWLEAGIEIRELEVATFRNKEDRGRQLFHGLVDDCRRLFVILIGISFSSPREINAGWRRSLANWTKSYLVM

SEQ ID NO: 212465 - protein, 76 aa, Glycine max
  Coding DNA Sequence Number=SeqID_95687
MWMETKIPLAKLEEDNKAQVRRWIMVDENSLLARVLKGKCFPKSMLGTVGKDINLASHGLVSWWPNGLLVKVVSGG

SEQ ID NO: 212466 - protein, 693 aa, Glycine max
  Coding DNA Sequence Number=SeqID_95688
  Gene Ontology: Mol. function=binding
  Homolog annotation: Hit_ID=Q9FGN7; Match level="QueryCoverage=96%, HitCoverage=95%, E-value=0.0, Identity=62%"; Hit description =Arabidopsis thaliana genomic DNA, chromosome 5, P1 clone:MFG13
  Pfam annotation: Domain name=TPR_2; Domain location=424-457; Score =5.2; E_value=8.1; Accession=PF07719.7; Description=Tetratricopeptide repeat
  Pfam annotation: Domain name=TPR_2; Domain location=5-38; Score=16.5; E_value=0.095; Accession=PF07719.7; Description=Tetratricopeptide repeat
  Pfam annotation: Domain name=TPR_2; Domain location=504-537; Score =17.8; E_value=0.04; Accession=PF07719.7; Description=Tetratricopeptid e repeat
  Pfam annotation: Domain name=TPR_2; Domain location=545-578; Score =7.3; E_value=4.7; Accession=PF07719.7; Description=Tetratricopeptide repeat
  Pfam annotation: Domain name=TPR_4; Domain location=5-30; Score=9.7; E_value=2.6; Accession=PF07721.5; Description=Tetratricopeptide repeat
  Pfam annotation: Domain name=TPR_4; Domain location=504-529; Score =7.2; E_value=5.1; Accession=PF07721.5; Description=Tetratricopeptide repeat
  Pfam annotation: Domain name=TPR_4; Domain location=545-570; Score =5.1; E_value=9.2; Accession=PF07721.5; Description=Tetratricopeptide repeat
  Pfam module annotation: Pfam domain module=TPR_2::TPR_2::TPR_2::TPR _2::TPR_4::TPR_4::TPR_4; Domain location=424-457::5-38::504-537::545 -578::5-30::504-529::545-570
MEAVAEGLWGLAEYHEKRGEIGKAVKCLEAICQSDASFFPIVEVKTRLRIATLLLQHSHNVNHAKSHLERSQLLLKSIPSCFELKCRAYSLLSQCYHLVGAIPPQKQVLHKGLELTASVGYEISMKLWFCNFNSQLANALSIEGDYQGSISALECGYACATEVCFPELQLFFATSILHVRLMQWDDDNLVEQAVNRCNQIWESIDPDKNAAPHVDNLDAAMKIDMQQTQRIQELVNELNALDQSLSRSDLHYRDRTALSKKQTMIQEQLKSMTGLCSIGQESLQPVYFGNVRRIIGDKLQLAPPPIDGEWLPKSAVYALVDLIVVVFGRPKGLFKECAKRIQSGMNIIQDELVKLGITDGVREVDLQHSSIWMAGVYLMLLIQFLENKVAIELTRAEFVEAQEALVQMKNWFMRFPTILQACECIIEMLRGQYAHSVGCYHEAAFHFIEAVKLTDSKSMQAMCQVYAAVSYICIGDAESSSQALDLIGPVYGVMDSFVGVREKTGVLFAYGLLLMKQQDLQEARNRLARGLQLTHTYLGNLQLVSQYLTILGSLALALRDTVQAREILRSSLTLAKKLYDIPTQIWVLSVLTALYKELGERGNEMENAEYQNKKLEDLQRRLTNAHASIYHIEIIDKVRLEVHQLNDLDIKRAVAGPTMGVNLDIPESIGKSIIVNYLLSIAPRSKWDEEFSR

SEQ ID NO: 212467 - protein, 254 aa, Glycine max
  Coding DNA Sequence Number=SeqID_95689
  Gene Ontology: Mol. function=ATPase activity, coupled to transmembrane movement of substances; Cellular component=integral to membrane; Biological process=transport
  Homolog annotation: Hit_ID=Q9LF78; Match level="QueryCoverage=68%, HitCoverage=22%, E-value=3e-34, Identity=51%"; Hit description =Mitochondrial half-ABC transporter
  Subcellular localization annotation: CTP_CleavageSite=75; ConfidenceScore=5.35e-01
MLAAAASASRHLLQRDATSIGACSGSGNRVRSLLTASAITTTYPIRFRKCYGISFNNPKHRTCPSLFLAVKGFLSDSSNSNSPHGRVTRPYLPNPVTSSTVDGRALFSTSTKTDDGSQSQKAAASSTIGKSSPPPPPGGQAADVKILRTLASYLWMKDNLEFRVRIVAALGLLVGAKILNVQVPFLFKLAVDSLTAATGSVGALASNSSGLAFFATPVAVLIGYGIARSGASAFNAGLPMRVTLAGFAILNSNS

SEQ ID NO: 212468 - protein, 170 aa, Glycine max
  Coding DNA Sequence Number=SeqID_95690
  Gene Ontology: Mol. function=prenyltransferase activity; Cellular component=integral to membrane; Biological process=biosynthetic process
  Homolog annotation: Hit_ID=Q9FJV7; Match level="QueryCoverage=66%, HitCoverage=38%, E-value=9e-18, Identity=41%"; Hit description =Arabidopsis thaliana genomic DNA, chromosome 5, P1 clone:MFO20
  Pfam annotation: Domain name=DUF607; Domain location=1-151; Score =180.5; E_value=4.1e-51; Accession=PF04678.4; Description=Protein of unknown function, DUF607
MALDLFDMEVVDLVRSAVPLALTAEDDPMREELKKLVEKKEEIDSLAHKQVRHILWSGLGFGVITVGLFFRLTFWEFSWDVMEPITYFTTSTGLVVGYAYFLFTSRDPTYQDFMKRLFFSRQRKLHMRYNFDVDRFKELQCKCKTPLNAKTILKNRKGLELDLEDALNKD

SEQ ID NO: 212469 - protein, 252 aa, Glycine max
  Coding DNA Sequence Number=SeqID_95691
  Gene Ontology: Mol. function=cytochrome-c oxidase activity; Cellular component=integral to membrane; Biological process=electron transport
  Homolog annotation: Hit_ID=Q75HA3; Match level="QueryCoverage=70%, HitCoverage=65%, E-value=2e-45, Identity=48%"; Hit description =Expressed protein
  Pfam annotation: Domain name=DUF887; Domain location=47-252; Score =203.0; E_value=7.2e-58; Accession=PF05967.2; Description=Eukaryotic protein of unknown function (DUF887)
MELTSSFGLTFFYDYATPSKVVLWLASIFSGIILCVLMKLLDEGFVLDVGEILRMVKCGIAGCDCIRMVYTSTAILSSLLFKGYGKLSSAEKIEWNNRGFSTFHALFVSSASFYLLILSDVFNVNSHGDVVINRSSTLSDAVLGISIGYFLTDLAMILWNFPALGGLEYVLHHGLSIGSITLCLLSGQVHIYILMVLFSESTTPFVNLRWYLDIAGLKSSKLYIWNGIALFFGWLVLSNILSLILTSTLIPL

SEQ ID NO: 212470 - protein, 186 aa, Glycine max
  Coding DNA Sequence Number=SeqID_95692
  Gene Ontology: Mol. function=ATPase activity, coupled to transmembrane movement of substances; Cellular component=integral to membrane; Biological process=transport
  Homolog annotation: Hit_ID=Q9LF78; Match level="QueryCoverage=90%, HitCoverage=23%, E-value=4e-66, Identity=75%"; Hit description =Mitochondrial half-ABC transporter
  Subcellular localization annotation: CTP_CleavageSite=41; ConfidenceScore=5.09e-01
MVAGILAYKFGAPFALITSLSVAAYVTFTLTITQWRTKFRKAMNKADNDASTRVIDSLINYETVKYFNNEVYEADNYDKYLKRYEDAALKTQRSLALLNFGQNVIFSTALSSAMVLCSHGIMDGTMTVGDLVMVNGLLFQLSLPLNFLGSVYRETIQSLVDMKSMFQLLEYVPYKIWIARIFGQHG

SEQ ID NO: 212471 - protein, 70 aa, Glycine max
  Coding DNA Sequence Number=SeqID_95693
MDESGSYHAAMLHSLIHNAKCFMFCNVKCTTVPGCSSSSSCYYNIQTKAIDHLAAAEILLILKFPLLALL

SEQ ID NO: 212472 - protein, 100 aa, Glycine max
  Coding DNA Sequence Number=SeqID_95694
  Gene Ontology: Mol. function=ATPase activity, coupled to transmembrane movement of substances; Cellular component=integral to membrane; Biological process=transport
  Homolog annotation: Hit_ID=Q9M0G9; Match level="QueryCoverage=98%, HitCoverage=14%, E-value=9e-25, Identity=60%"; Hit description=ABC transporter-like protein
MIKIDDQDIREVTFESLRKSIGVVPQDTVLFNDTIFHNIHYGRLSATEEEVYEAAQQAAIHNTIMKFPDKYSTVVGERGLKGKKGYGIANLNSLDETPAI

SEQ ID NO: 212473 - protein, 173 aa, Glycine max
  Coding DNA Sequence Number=SeqID_95695
MAGTTMPPLAAAGRGLSLTRRDEEVHTAIRTSGTRRDEGERPAIGTGGTCQRVPMAGLSPLLHLPRPAAANGGIAVPAIASGVTSFTPVTMATPTVPPLQVAGSFMHGSAIENGVKHPKGSAIGNGEIPHAINHPSSIIMAPSMHHLSASQTGEFDFAFVLILRDPLASFALY

SEQ ID NO: 212474 - protein, 199 aa, Glycine max
  Coding DNA Sequence Number=SeqID_95696
MVSHLEKQGEDIGTHSSALVEENTTQEQPAAAAKTTEARNQYQSLRELFNGESSTPCLASDVHDQTNDKGKEVHKKFPTIIVLEEECQNAEHGWADDAPVAAAETGFHQKNGEIDQKGKGKHSNAVLSFSYSDLQRGVGMQNPMGPFPKQQPLLLSAELLVPSGMEGRWMRNLDLNQPPPQDEELEEAQNEVDNHYLRD

SEQ ID NO: 212475 - protein, 124 aa, Glycine max
  Coding DNA Sequence Number=SeqID_95697
MVLFHIESCCPKRSESPPLGFYKRRYVRVIQIETGYGILQMSGDEKSKIKDADNSTASFMLLALQECKKLIICEKDLKRKTSSIQKGNEVEHYLQYAFLCTSRIRWSLFDLRVLRSSFMAVPSW

SEQ ID NO: 212476 - protein, 470 aa, Glycine max
  Coding DNA Sequence Number=SeqID_95698
  Gene Ontology: Mol. function=oxidoreductase activity; Cellular component=membrane; Biological process=electron transport
  Homolog annotation: Hit_ID=O49859; Match level="QueryCoverage=99%, HitCoverage=89%, E-value=0.0, Identity=71%"; Hit description =Cytochrome P450 82A4
  Pfam annotation: Domain name=p450; Domain location=39-470; Score =253.8; E_value=3.5e-73; Accession=PF00067.12; Description=Cytochrome P450
MDFVLNYLNANTIGVLSLILFCLFLYHPFKFARGKKEAPTVAGAWPILGHLPLLNGSHIPHRALGDLADKYGPIFTIKLGVKKALVISNWEIAKECFTTNDIFVSSRPKLVAVEYMGYNQAMLGFAPYGPYWRELRKVATLEILSNRRVEQLQDVRVSEVQHSIKDLFNVWCSKKNESGYALVELKQWFYHLTFNMVLQMVVGKRYFSATTVDDQEMAQRCVKAVKEFMRLIGVFTVGDAIPFLRRFDFGGHEKAMKETGKELDNILGEWLEEHRQNRSLGESIDRDFMDVMISLLDGKTIQGIDADTIIKSTVLAVILGATDTTSTTLTWAICLMLRNPFALENVKAELDIQVGKERCITESDISKLTYLQAVVKETLRLYPAGPLSVPREFTENCTLGGYNIEKGTRLITNLWKIHTDINVWSDPLEFKPERFLTTHKDVDVRGHHFELLPFGGGRRICPGISFGLQM

SEQ ID NO: 212477 - protein, 407 aa, Glycine max
  Coding DNA Sequence Number=SeqID_95699
  Gene Ontology: Mol. function=nucleic acid binding; Cellular component= chromatin; Biological process=DNA integration
  Homolog annotation: Hit_ID=Q1T010; Match level="QueryCoverage=99%, HitCoverage=34%, E-value=1e-140, Identity=52%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MKEELKAIEKNNTWQLVPLPAKKKPIAVKWVYKVKKNLKGEISKYKARLVAKGFLQKAGIDFKEVFAPVARMETVRIITAIASQKGWHMHHMDVKSAFLNGPLEEEVYVSQPPGFEIKGSEEKVYRLNKALYGLKQAPRAWNRRIDGFLMKLGFLKCTTEHGVYIKGSNTTNLTVVCLTDEGVIMHQGRYARDVLKKFKMVDCNSANTPIATGVNLVKDPNEEEVDATLYRQMVGSLRYMENPKLSHFRAAKRIMRYVKGTLDYGILFSSAAKKCNVLGYSDSDWCGDKSDRKSKVGYVFFYGDAPISWSSKKEQVVALSSCEAEYIAVAMAACQAQWLDNIFGELKMKEKGAITLMVDNKSAINLAKHPVAHGRSKHIETRFHFLREQVTKGKLSVKYCPTTVQVA

SEQ ID NO: 212478 - protein, 73 aa, Glycine max
  Coding DNA Sequence Number=SeqID_95700
MADVVIVMVAIEWCGGGDRSDQLIEDWREGTSWDFLDWDSLYKTHTYSCKSVEHNPSALTVDLYLETWSETPA

SEQ ID NO: 212479 - protein, 297 aa, Glycine max
  Coding DNA Sequence Number=SeqID_95701
  Gene Ontology: Mol. function=metalloendopeptidase activity; Cellular component=proteinaceous extracellular matrix; Biological process =peptidoglycan metabolic process
  Homolog annotation: Hit_ID=Q6Z7S6; Match level="QueryCoverage=92%, HitCoverage=79%, E-value=2e-40, Identity=36%"; Hit description =Putative zinc metalloproteinase
  Pfam annotation: Domain name=PG_binding_1; Domain location=51-113; Score=57.5; E_value=4.4e-14; Accession=PF01471.9; Description =Putative peptidoglycan binding domain
  Pfam annotation: Domain name=Peptidase_M10; Domain location=145-295; Score=233.3; E_value=5.4e-67; Accession=PF00413.14; Description =Matrixin
  Pfam module annotation: Pfam domain module=PG_binding_1::Peptidase _M10; Domain location=51-113::145-295
MALNLLNLSILFVLLNIINPFPFAEPRTLEASTTPFSKTLQNLRGVHRGQNAKGVGELRGYLQKYGYLTKGSSSNDNFDENVESALKHYQAFHHLRDTGVVDDDTIKKMSLPRCGMPDIITNPNPNPNGLVGAPENYTFFPGSPKWSKFFLTYRRTSGATVSINETAVRRAMRDAFQSWANVSPFTFNETTDRSADITYGFHRGLHLDLYPFDGPGRVLAHAFAPEDGRIHFDADELWRSNGSDIDFQTVGLHELGHSLGLGHSNDTDAVMQPNYDGQRRSLSQDDIDGIQALYGQN

SEQ ID NO: 212480 - protein, 337 aa, Glycine max
  Coding DNA Sequence Number=SeqID_95702
  Homolog annotation: Hit_ID=Q2HVB5; Match level="QueryCoverage=24%, HitCoverage=32%, E-value=3e-15, Identity=53%"; Hit description =Ribosomal protein L25
MDNITTRKTIIYDAVFKTVLKDRLRIGGDAYASEVSERASEVPQPLTHSAVIILRAPGPEPFTYLDDFPHPDPNHDETILAIPRAASDKNISTKERRARRLRSIVFEQEDGQHSGKKHLIYPPSPFVAKSVAREDDIRECATTVHAANSNVLSGIGFSRPVFHHDGSWLVAYFIDAFDLAGSKGGGGSGNISALLSGVPRDVNMQLLQVTSGMTFSSKTIGGNLNSKVKSAVMKGSTLMKPTTSLLAKQNQPHPIVSSRLLEVNLPPCLAGSMEVGDVKQQVNFVHKAPKKVRVVMQLISTSSLHCNDSDKIYMISDLQGTEVCWLQDLDLHFLDKC

SEQ ID NO: 212481 - protein, 222 aa, Glycine max
  Coding DNA Sequence Number=SeqID_95703
  Gene Ontology: Mol. function=nicotinate-nucleotide diphosphorylase (carboxylating) activity; Cellular component=chloroplast; Biological process=pyridine nucleotide biosynthetic process
  Homolog annotation: Hit_ID=Q9SMB7; Match level="QueryCoverage=94%, HitCoverage=51%, E-value=3e-72, Identity=71%"; Hit description =Quinolinate phosphoribosyltransferase
  Pfam annotation: Domain name=QRPTase_C; Domain location=2-206; Score =202.9; E_value=7.5e-58; Accession=PF01729.9; Description=Quinolinate phosphoribosyl transferase, C-t
MAMANAAYPAYMLETRKTAPGLRLVDKWAVLIGGGRNHRMGLFDMVMIKDNHISAAGGVADALKAVDLYLEQNNLQMEVEVISHLRTLLPFLPATFAVVTTEILVPTALVETRTLEEVEEVLHYSSQTKTSLTRIMLDNMVVPLPNGDVDISMLKEAVQLINGRYETEASGNVTLDTVHKIGQSGVTYISSGSLTHSVKALDISLKIDTELALKVGRRTGRA

SEQ ID NO: 212482 - protein, 681 aa, Glycine max
  Coding DNA Sequence Number=SeqID_95704
  Gene Ontology: Mol. function=transferase activity, transferring hexosyl groups; Biological process=carbohydrate biosynthetic process
  Homolog annotation: Hit_ID=Q5BMA4; Match level="QueryCoverage=92%, HitCoverage=96%, E-value=0.0, Identity=68%"; Hit description =Secondary cell wall-related glycosyltransferase family 8
  Pfam annotation: Domain name=Glyco_transf_8; Domain location=352-564; Score=205.5; E_value=1.2e-58; Accession=PF01501.10; Description =Glycosyl transferase family 8
MRGPSPSSVEPRHRSSSSFRFYIAVAIVVSSHFLTLRDAASIEVALRFREDTGKRRSQRIKDFKDVEKALHIPFQDRIITCRPNWKLVLVIIVLGTLVTIFHPPAVYNTDHLSNSLSRPTFINNWKGGFNGIDSRYASLLNIEWDQVSNVLENLKDKDTYQGVGLLNFNDSENDQWKELIPEAEHVVLHLNYTSSNITWDVLYPEWIDEEEEYEFPTCPTLPRIQVPGKPRLDLIAVKLPCNKSGCWSRDVARLHLQIEAARLAASSKGYHPVRLLLVTDCFPTPNLFTCKELIQREGNTWLYEPNLNTLREKLQLPIGSCELTVPLKAKETNCIPLTENFYSERPHREAYATILHSAQMYVCGAITAAQSIRMSGSTRDLVILVDETISEYHRGGLKAAGWKIHTIQRIRNPKAEPEAYNEWNYSKFRLWQLTDYDKIIFIDADLLILRNIDFLFEMPEISAIGNNATLFNSGVMVVEPSNCTFQLLMDHINEIVSYNGGDQGYLNELFTWWHRIPKHMNFLKHFWEGDEEEKKAMKTRLFRADPPILYVIHYLGNKPWLCFRDYDCNWNVDILQEFASNVAHARWWKVHDAMPENLQKFCLLRSKQKAALEWDRRQAEKGNYSDGHWKIKIKDPRLNTCFEDFCFWESMLWHWGEKNWTDNSTVNNSPLIVQTQSLSSL

SEQ ID NO: 212483 - protein, 134 aa, Glycine max
  Coding DNA Sequence Number=SeqID_95705
  Gene Ontology: Mol. function=protein kinase activity; Cellular component=plastoglobule; Biological process=protein amino acid phosphorylation
  Homolog annotation: Hit_ID=Q014Z3; Match level="QueryCoverage=84%, HitCoverage=16%, E-value=1e-27, Identity=55%"; Hit description=[R] KOG1235 Predicted unusual protein kinase
  Pfam annotation: Domain name=ABC1; Domain location=17-132; Score =91.0; E_value=3.7e-24; Accession=PF03109.7; Description=ABC1 family
DGLPTFPDEEAFACIERELGLSIDSIFSTISPTAVAAASLGQVYKGRLKYSGKLVAVKVQRPDIEEAIGMDFYLIRGLGSLINKYVDFITSDVVALIDEFARRVFQELNYVQPGMHHDSSISNFLHLLQSLMML

SEQ ID NO: 212484 - protein, 110 aa, Glycine max
  Coding DNA Sequence Number=SeqID_95706
  Homolog annotation: Hit_ID=Q84YF3; Match level="QueryCoverage=74%, HitCoverage=25%, E-value=3e-16, Identity=57%"; Hit description =Hypothetical protein 4B
MRVRASFFVLFSLSCLLCVLLSSAQQLPPDAVVSARLLDSHLQDSAFRALFSPITGVPYDAQVPTNLSGIKVSAMRLRSGSLRTRGVLSYKEFEIPIGVVEKPYVERLVL

SEQ ID NO: 212485 - protein, 71 aa, Glycine max
  Coding DNA Sequence Number=SeqID_95707
  Homolog annotation: Hit_ID=Q00M75; Match level="QueryCoverage=51%, HitCoverage=6%, E-value=4e-10, Identity=86%"; Hit description=PPR -repeat containing protein
MGEGCCTQPYPCICKEAVSGFEPMTNKSPRHNFTAAPGLALRRKKSMYIMETNYALKSHENVPTNLVQEPQ

SEQ ID NO: 212486 - protein, 97 aa, Glycine max
  Coding DNA Sequence Number=SeqID_95708
  Subcellular localization annotation: CTP_CleavageSite=60; ConfidenceScore=5.01e-01
MQQGHFSIVVESNAPSPAPSSGGEFQDASGKNNKKNNKFMLRILAPLRRHTKGTRMQQLECVAYSNEIMDMTSIGDIKVPLAFGTRTRPMIEHDYFP

SEQ ID NO: 212487 - protein, 61 aa, Glycine max
  Coding DNA Sequence Number=SeqID_95709
  Gene Ontology: Mol. function=ubiquinol-cytochrome-c reductase activity; Cellular component=mitochondrial respiratory chain; Biological process=electron transport
  Homolog annotation: Hit_ID=P46269; Match level="QueryCoverage=90%, HitCoverage=78%, E-value=6e-22, Identity=85%"; Hit description =Ubiquinol-cytochrome c reductase complex ubiquinone-binding protein QP-C
MGKQIVPVKSVIYALSPFQQKIMPGLWKDLPTKIHHKVSENWISATLLLGPLVGTYTGNIR

SEQ ID NO: 212488 - protein, 124 aa, Glycine max
  Coding DNA Sequence Number=SeqID_95710
  Gene Ontology: Mol. function=DNA binding; Biological process =regulation of transcription, DNA-dependent
  Homolog annotation: Hit_ID=Q9FHB2; Match level="QueryCoverage=55%, HitCoverage=25%, E-value=1e-13, Identity=50%"; Hit description =Arabidopsis thaliana genomic DNA, chromosome 5, P1 clone:MCK7
MNVDLEGECKNYSSTLSMLPLFKNWLLILSKVNIDLPPLRKRSRSSSSSWGSYIARPLDEIKEATKEERLCALEAAEAIQINLNSSNPSFIKSMVRSHVYSCFWLGLPSKFCEEHLPKTLHDMV

SEQ ID NO: 212489 - protein, 209 aa, Glycine max
  Coding DNA Sequence Number=SeqID_95711
MTHRGRGTISGGGNANDGNNDNVMKVAVLVVAGNGDNISGGDRGDISSEDGDGSDIIGGGGGDIKLQWCGVGVTKVLSLVVVVTMTVAVTSNGGSGNNAIDDDSDSDDDDDNSGSGSNVGGDNQVDNDGGDSENNDSGSTVLVVMVITTNYDNYNNGDGDNNMIVTMTEVTLMMTMVVMPTTMMVVTKIVGVVTTKNVIVKCEKYIFLN

SEQ ID NO: 212490 - protein, 400 aa, Glycine max
  Coding DNA Sequence Number=SeqID_95712
  Gene Ontology: Mol. function=cation transporter activity; Cellular component=membrane; Biological process=cation transport
  Homolog annotation: Hit_ID=Q1S6S2; Match level="QueryCoverage=95%, HitCoverage=98%, E-value=1e-139, Identity=64%"; Hit description =Cation efflux protein
  Pfam annotation: Domain name=Cation_efflux; Domain location=128-374; Score=92.9; E_value=9.4e-25; Accession=PF01545.11; Description =Cation efflux family
MDENCGSRPLLGNQNHDGNSFNSLRTAFLFKLPDNDRSGLDSESPFQFDHQVSSTNHLSQGLSLISLLKVKVALCVRACLHVLWLREKEYYERQFATLKSFEEVDSIVISDCTDVEDIGKQAEHERAMKISNYANAVLLALKIYVTIRSGSIAVAASTLDSLLDFMAGGILCFTHLAMKDINMYKYPIGKLRGQPVGIIIFAAVIATLGFQVLITAVQQLIENNPPEKMSFDQLVWLYSVMIFATVDHYFDVVTNVIGLIAAVLGDKFYWWIDPVGAILLSIYTITNWSGTVMENAVLQKLTYLVVMHAQIKRIDTVRAYTFGVLYFVEVDTELPEDLPLKEAHAIGESLQIKLEKLPEVERAFVHLDFECDHKPEHSISSYQTAGHSALNSSSSFYMDI

SEQ ID NO: 212491 - protein, 234 aa, Glycine max
  Coding DNA Sequence Number=SeqID_95713
  Gene Ontology: Mol. function=protein binding; Biological process =defense response
  Homolog annotation: Hit_ID=Q1SPY2; Match level="QueryCoverage=87%, HitCoverage=26%, E-value=1e-14, Identity=31%"; Hit description =Disease resistance protein; AAA ATPase; Zinc finger, C2H2-type
  Pfam annotation: Domain name=LRR_1; Domain location=106-127; Score =4.8; E_value=37; Accession=PF00560.23; Description=Leucine Rich Repeat
  Pfam annotation: Domain name=LRR_1; Domain location=131-155; Score =6.7; E_value=16; Accession=PF00560.23; Description=Leucine Rich Repeat
  Pfam annotation: Domain name=LRR_1; Domain location=196-215; Score =6.0; E_value=22; Accession=PF00560.23; Description=Leucine Rich Repeat
  Pfam annotation: Domain name=LRR_1; Domain location=47-70; Score=1.3; E_value=1.6e+02; Accession=PF00560.23; Description=Leucine Rich Repeat
  Pfam annotation: Domain name=LRR_1; Domain location=79-102; Score =2.6; E_value=92; Accession=PF00560.23; Description=Leucine Rich Repeat
  Pfam module annotation: Pfam domain module=LRR_1::LRR_1::LRR_1::LRR _1::LRR_1; Domain location=106-127::131-155::196-215::47-70::79-102
MVSMLLLNLLYHYQKDLILRAEYFHLMTLEGGCKNVIPSIDPQGMNQLIFLFLKSCPEIECLFGSTNANLLMTKVVFCNLVTLRLSRMHGLQEVFSDPSSQCFLKNLQELEVEECRQLHSISFPRNSKVCSFTELKINGCPMLTSLFMPSSVQTLELLEVLEIYDCSELKRIIEEVEEGNVEYVSNQSHISLALPKLRSLYVYGCHRLEYIFPVCFARGLGLNPEKTASVSLVS

SEQ ID NO: 212492 - protein, 337 aa, Glycine max
  Coding DNA Sequence Number=SeqID_95714
  Gene Ontology: Mol. function=protein serine/threonine kinase activity; Cellular component=integral to membrane; Biological process=protein amino acid phosphorylation
  Homolog annotation: Hit_ID=Q1S6S4; Match level="QueryCoverage=99%, HitCoverage=35%, E-value=1e-144, Identity=75%"; Hit description =Protein kinase; Adipokinetic hormone
  Pfam annotation: Domain name=Pkinase; Domain location=8-284; Score =141.3; E_value=2.6e-39; Accession=PF00069.15; Description=Protein kinase domain
  Pfam annotation: Domain name=Pkinase_Tyr; Domain location=8-277; Score=137.1; E_value=4.9e-38; Accession=PF07714.7; Description =Protein tyrosine kinase
  Pfam module annotation: Pfam domain module=Pkinase::Pkinase_Tyr; Domain location=8-284::8-277
MAAATNNFSDSAQIGQGGYGRVYKGVLPDGTVVAIKRAQEGSLQGEREFLTEIQLLSRLHHRNLVSLVGYCDEEGEQMLVYEYMPNGTLRDNLSAYSKKPLTFSMRLKIALGSAKGLLYLHTEVDSPIFHRDVKASNILLDSKFTAKVADFGLSRLAPVPDIEGNVPGHISTVVKGTPGYLDPEYFLTRKLTDKSDVYSLGVVFLELVTGRPPIFHGKNIIRQVNEEYQSGGVFSVVDKRIESYPSECADKFLTLALKCCKDEPDERPKMIDVARELESICSMLTETDAMEAEYVTSDSGRVFNPHSSSSTTRTPFVSADVSGSDLVSGKIPTIRPR

SEQ ID NO: 212493 - protein, 125 aa, Glycine max
  Coding DNA Sequence Number=SeqID_95715
MVKEECKEVSVSSERTLFSTATPLGLKVIPQVKELLDEGLTWVLIWDTLVIKRFPQTLREKGVEGRSPEFQEPMDLRSNPFQGRGDNAILPPRTLDRRSQEDWTRDAREGPTVLMSLNVDFGPMD

SEQ ID NO: 212494 - protein, 86 aa, Glycine max
  Coding DNA Sequence Number=SeqID_95716
  Gene Ontology: Mol. function=protein serine/threonine kinase activity; Cellular component=integral to membrane; Biological process=protein amino acid phosphorylation
  Homolog annotation: Hit_ID=Q1S6S4; Match level="QueryCoverage=79%, HitCoverage=9%, E-value=7e-22, Identity=87%"; Hit description =Protein kinase; Adipokinetic hormone
MLASLLKLDRGVMGRGGFVLQGEREFLTEIELLSRLHHRNLVSLIGYCDQEGEQMLVYEYMSNGALRNHLSGIFYALIFLIFRVVY

SEQ ID NO: 212495 - protein, 265 aa, Glycine max
  Coding DNA Sequence Number=SeqID_95717
  Gene Ontology: Mol. function=nucleic acid binding; Cellular component= intracellular; Biological process=DNA integration
MEEIEESIHVEIVDEQIVSETETVWDEDAREFESPTVCECLQSDYQRSGKAGCKIEDKYKTFIMLCSLLSSYEHLVTMYKKDSLNESGGNIGCTYVSLSMKTKCSGSSQGDGLYVKGKQEHGRTQGKGSVGRQRKKSKSRECKKTMECYKCNQKRAFLEGLPRDYYNEGHVLSSSCNWLTNAWIIDSRCSYHMTPNREWFHHIHVLIAMDDGGVRTLCDVQHIPELRKNLISLHTLQANGFINRTNGDQNNLRVYKGALIVMKAE

SEQ ID NO: 212496 - protein, 61 aa, Glycine max
  Coding DNA Sequence Number=SeqID_95718
MFMSLKNCMSCEKLLMETLNAIHVMQKRAILKKCQRSHRAKRAQWAQSASMPKPSTSALSE

SEQ ID NO: 212497 - protein, 83 aa, Glycine max
  Coding DNA Sequence Number=SeqID_95719
  Homolog annotation: Hit_ID=Q2PMM5; Match level="QueryCoverage=64%, HitCoverage=4%, E-value=2e-16, Identity=52%"; Hit description =Protein ycf2
  Subcellular localization annotation: CTP_CleavageSite=32; ConfidenceScore=5.34e-01
MNWDFPIGPGHFGTSGSFMMKRMSFKRMIQSSCKIDNSLQMKRCQGNFLLPKQIFEGETSIMSHSFSLFPLLFSSHVLNIALL

SEQ ID NO: 212498 - protein, 146 aa, Glycine max
  Coding DNA Sequence Number=SeqID_95720
MLSGEAEDWWKFSSQTLPSKEGVIVWAAFKESFLGNYFPRDLRKKKARELLELNKCRICETSVKGKQAEPKFGDLDARRSTIRYAFTIGNSLVKWKAALHPTVSLSTTKAEYMALAEVAKEGIWLKSLLSNLGFPQDKAIIFSGTV

SEQ ID NO: 212499 - protein, 116 aa, Glycine max
  Coding DNA Sequence Number=SeqID_95721
  Subcellular localization annotation: CTP_CleavageSite=100; ConfidenceScore=5.21e-01
MVISLSQGHPCCAQTTPLSCKVTLSCTDKYQGHPVMHRQLPPSSMVISLSLKGVPNRVTCPQVQVFLLMRNSNSLTDAILPRKGPVTRAMSKRLQDDWTRAAEEGPRILMNLRVDF

SEQ ID NO: 212500 - protein, 82 aa, Glycine max
  Coding DNA Sequence Number=SeqID_95722
MGDAEKQRSGTKQQTRRTIEESEFERSCKRKKSKREEAGEEEVTTNRTERNWVQDEIVEEEEELKEGEDEGDEFEDGLCLRR

SEQ ID NO: 212501 - protein, 654 aa, Glycine max
  Coding DNA Sequence Number=SeqID_95723
  Gene Ontology: Mol. function=protein kinase activity; Cellular component=integral to membrane; Biological process=protein amino acid phosphorylation
  Homolog annotation: Hit_ID=Q9LVM0; Match level="QueryCoverage=96%, HitCoverage=93%, E-value=0.0, Identity=61%"; Hit description =Receptor-like protein kinase
  Pfam annotation: Domain name=LRRNT_2; Domain location=26-64; Score =34.3; E_value=4.4e-07; Accession=PF08263.3; Description=Leucine rich repeat N-terminal domain
  Pfam annotation: Domain name=LRR_1; Domain location=118-137; Score =14.4; E_value=0.41; Accession=PF00560.23; Description=Leucine Rich Repeat
  Pfam annotation: Domain name=LRR_1; Domain location=140-162; Score =15.3; E_value=0.23; Accession=PF00560.23; Description=Leucine Rich Repeat
  Pfam annotation: Domain name=LRR_1; Domain location=164-185; Score =12.4; E_value=1.4; Accession=PF00560.23; Description=Leucine Rich Repeat
  Pfam annotation: Domain name=LRR_1; Domain location=186-208; Score =16.9; E_value=0.072; Accession=PF00560.23; Description=Leucine Rich Repeat
  Pfam annotation: Domain name=LRR_1; Domain location=94-116; Score =12.7; E_value=1.2; Accession=PF00560.23; Description=Leucine Rich Repeat
  Pfam annotation: Domain name=Pkinase; Domain location=337-626; Score =98.4; E_value=2.1e-26; Accession=PF00069.15; Description=Protein kinase domain
  Pfam annotation: Domain name=Pkinase_Tyr; Domain location=336-626; Score=86.8; E_value=6.5e-23; Accession=PF07714.7; Description =Protein tyrosine kinase
  Pfam module annotation: Pfam domain module=LRRNT_2::LRR_1::LRR_1::LRR_ 1::LRR_1::LRR_1::Pkinase::Pkinase_Tyr; Domain location=26-64::118 -137::140-162::164-185::186-208::94-116::337-626::336-626
MKFYSSQVHRFLFIIVILFPLAIADLSSDKQALLDFAAAVPHRRNLKWNPATPICSSWVGITCNPNGTRVVSVRLPGIGLVGTIPANTLGKIDSLRNISLRANLLSGSLPPDITSLPSLQYLYLQHNNLSGSVPTSLSTRLNVLDLSYNSFSGAIPKTLQNITQLIKLNLQNNSLSGQIPNLNVTKLRHLNLSYNHLNGSIPDALQIFPNSSFEGNSLCGLPLKSCSVVSSTPPSTPVSPSTPARHSSKSKLSKAAIIAIAVGGGVLLLLVALIIVLCCLKKKDDRSPSVTKGKGPSGGRSEKPKEEFGSGVQEPEKNKLVFFEGSSYNFDLEDLLRASAEVLGKGSYGTAYKAILEESTTVVVKRLKEVVVGKREFEQQMEIVGRVGHHPNVVPLRAYYYSKDEKLLVYDYIPSGNLSTLLHVYLLMGIYAPESAKSDPNLITGNRASGRTPLDWNSRIKISVGIARGIAHIHSVGGPKFTHGNVKSSNVLLNHDNDGCISDFGLTPLMNVPATPSRAAGYRAPEVIETRKHTHKSDVYSFGILLLEMLTGKAPQQSPGRDDMVDLPRWVQSVVREEWTAEVFDVELMRYQNIEEEMVQMLQIAMACVAKVPDMRPSMDEVVRMIEEIRLSDSENRPSSEENRSKEESAAQTP

SEQ ID NO: 212502 - protein, 73 aa, Glycine max
  Coding DNA Sequence Number=SeqID_95724
MSNHPKGSKDEARGFMEQLRALNHRPRCILGEEAKQVGALTVLQILNFRLEHGSSTAKRNCMKLKGIFGWVEE

SEQ ID NO: 212503 - protein, 196 aa, Glycine max
  Coding DNA Sequence Number=SeqID_95725
MKFSRLSLGNVAPKIEGIDLYNPLHFSPAKFNTIPYIRPSVPVFLYIFQMMLTRKIGWVLLNSMSKKMFEFDSNIGEGVDKAILELLPASLDVWAILSLSSTGNPITILDADEDEVIEVTPKVSPPVLAKRKHNEWVGGSYQRKKSRAPFCLRALKQANILMSSLSPPSLASARDPPSTPLTVQAIVATATVFNPL

SEQ ID NO: 212504 - protein, 107 aa, Glycine max
  Coding DNA Sequence Number=SeqID_95726
  Gene Ontology: Mol. function=small conjugating protein ligase activity; Cellular component=proteasome complex (sensu Eukaryota); Biological process=protein modification process
  Homolog annotation: Hit_ID=Q5YJR0; Match level="QueryCoverage=81%, HitCoverage=58%, E-value=1e-38, Identity=89%"; Hit description =Ubiquitin-conjugating enzyme 9
  Pfam annotation: Domain name=UQ_con; Domain location=6-101; Score =63.1; E_value=9.4e-16; Accession=PF00179.16; Description=Ubiquitin -conjugating enzyme
MKGQKRKENMKRKEIFSGLVAFRTKVFHPNINSNGSICLDILKEQWSPALTISKVAFRTKVLLSICSLLTDPNPDDPLVPEIAHMYKTDRAKYEATARSWTQKYAMG

SEQ ID NO: 212505 - protein, 152 aa, Glycine max
  Coding DNA Sequence Number=SeqID_95727
  Gene Ontology: Mol. function=transcription corepressor activity; Cellular component=nucleus; Biological process=regulation of transcription, DNA-dependent
  Homolog annotation: Hit_ID=Q1EPA1; Match level="QueryCoverage=92%, HitCoverage=10%, E-value=3e-34, Identity=49%"; Hit description =Paired amphipathic helix repeat-containing protein / transcription regulator-related
  Pfam annotation: Domain name=PAH; Domain location=18-64; Score=55.2; E_value=2.2e-13; Accession=PF02671.11; Description=Paired amphipathic helix repeat
  Pfam annotation: Domain name=PAH; Domain location=97-143; Score=29.2; E_value=1.4e-05; Accession=PF02671.11; Description=Paired amphipathic helix repeat
  Pfam module annotation: Pfam domain module=PAH::PAH; Domain location =18-64::97-143
MDALQYIKEVQCAFHDSREKFDKFMDVMKDYKFHRIDVGIVVEKVEEILKDHGDLILGFNKFLSKGYKILLLDEGEDGFGNVSKYLKKIQDRFENKDHVYKSFLNILLKYKNNGVTLYDTYHEAATLFEGHRDLVRDFTKFLPSVHLRGKST

SEQ ID NO: 212506 - protein, 146 aa, Glycine max
  Coding DNA Sequence Number=SeqID_95728
  Gene Ontology: Cellular component=nucleus; Biological process =regulation of transcription, DNA-dependent
  Homolog annotation: Hit_ID=Q1EPA1; Match level="QueryCoverage=92%, HitCoverage=10%, E-value=5e-29, Identity=45%"; Hit description =Paired amphipathic helix repeat-containing protein / transcription regulator-related
  Pfam annotation: Domain name=PAH; Domain location=18-56; Score=24.6; E_value=0.00034; Accession=PF02671.11; Description=Paired amphipathic helix repeat
  Pfam annotation: Domain name=PAH; Domain location=91-137; Score=37.8; E_value=3.7e-08; Accession=PF02671.11; Description=Paired amphipathic helix repeat
  Pfam module annotation: Pfam domain module=PAH::PAH; Domain location =18-56::91-137
MDALQYIKEVQCAFHKSREKFDKFMDVMKDYKFHRKLEEILNDHGYLILGFNKFLPKGYEILLLDEGEGEDGFGNALKYLKKIQDRFENKDHVYKSFLNILLKYKNIGVTLYDAYHEVATLFEGHRDLVRDFTKFLPSIHLRGKST

SEQ ID NO: 212507 - protein, 282 aa, Glycine max
  Coding DNA Sequence Number=SeqID_95729
  Gene Ontology: Mol. function=transcription factor activity; Cellular component=nucleus; Biological process=regulation of transcription, DNA-dependent
  Homolog annotation: Hit_ID=Q1SIN7; Match level="QueryCoverage=95%, HitCoverage=98%, E-value=2e-67, Identity=50%"; Hit description =Pathogenesis-related transcriptional factor and ERF
  Pfam annotation: Domain name=AP2; Domain location=124-188; Score =137.6; E_value=3.4e-38; Accession=PF00847.10; Description=AP2 domain
MSVHSKLKHHPMNLATPSSHFDNDPPCKTKTKTQRRLLRIIVTDHDATDSDSDEEEEQQQQTTRVKREITQINMQLPLSYNSSFPSSSSYYSSASACTSSEQNLKCKRPNKKPPPFSAVVRRRNNKFRGVRQRPWGRWAAEIRDPTRRKRLWLGTFDTAEEAATEYDRAAVKLKGPNAVTNFPLTPEAAAEAPVVSVDNLSSDGGASYSDLVASPTSVLAYECDSTPFDGFRYLDVEAFEFHIDAPLSLPDVNVALTCHHGKKEEEVAFDEFDIDEFMTWPY

SEQ ID NO: 212508 - protein, 152 aa, Glycine max
  Coding DNA Sequence Number=SeqID_95730
  Gene Ontology: Mol. function=transcription corepressor activity; Cellular component=nucleus; Biological process=regulation of transcription, DNA-dependent
  Homolog annotation: Hit_ID=Q1EPA1; Match level="QueryCoverage=92%, HitCoverage=10%, E-value=3e-36, Identity=51%"; Hit description =Paired amphipathic helix repeat-containing protein / transcription regulator-related
  Pfam annotation: Domain name=PAH; Domain location=18-64; Score=56.6; E_value=8.3e-14; Accession=PF02671.11; Description=Paired amphipathic helix repeat
  Pfam annotation: Domain name=PAH; Domain location=97-143; Score=35.1; E_value=2.4e-07; Accession=PF02671.11; Description=Paired amphipathic helix repeat
  Pfam module annotation: Pfam domain module=PAH::PAH; Domain location =18-64::97-143
MDALQYIKEVQCAFHDSREKFDKFMDVMKDYKFHRIDVGIVVEKMEEILKDHGDLILGFNKFLPKGYEILLLDEGEDGFGNASKYLKKIQDRFENKDHVYKSFLNILLKYKNNGVTLYDTYHEVATLFEGHRDLVRDFTKFLPSVHLRGKST

SEQ ID NO: 212509 - protein, 95 aa, Glycine max
  Coding DNA Sequence Number=SeqID_95731
  Gene Ontology: Mol. function=translation initiation factor activity; Biological process=translational initiation
  Homolog annotation: Hit_ID=Q1SIP1; Match level="QueryCoverage=91%, HitCoverage=34%, E-value=8e-21, Identity=58%"; Hit description =Translation initiation factor IF5
MADETPNEMKEEVPEIVPFDPTKKKKKKKITIVDPADDPVEKLAEKTENLSVSEGVETAFAGLKKKKKKPVEMSNLNDESGDANEDLDGEQHIPV

SEQ ID NO: 212510 - protein, 117 aa, Glycine max
  Coding DNA Sequence Number=SeqID_95732
MSDEAAAPPLFLRPLRRHQLLLHTPQPQANRAALGWHWRTAPQWRACRSPFSGTVPEKLEKACNAIRLATRIKVAAFVANMQGVEESCHAFATEANRPSTANMANLEGEKRETRKFF

SEQ ID NO: 212511 - protein, 50 aa, Glycine max
  Coding DNA Sequence Number=SeqID_95733
MRFLLPLKILPLSLRFLLLLLMRFPPLKGTIPMPWTTMLREILFYHEVVC

SEQ ID NO: 212512 - protein, 53 aa, Glycine max
  Coding DNA Sequence Number=SeqID_95734
  Homolog annotation: Hit_ID=Q1SIP3; Match level="QueryCoverage=77%, HitCoverage=6%, E-value=9e-17, Identity=92%"; Hit description=TRNA -binding arm
MAASGVHSSKQMRRLESRKSHSWWWDSHISPKNSKWLSENLEGFIVKKIVLLL

SEQ ID NO: 212513 - protein, 56 aa, Glycine max
  Coding DNA Sequence Number=SeqID_95735
MENRLTINSWGSGLDGGGCMNDNQFMGLRIRFDCGRCTNRTWQSIVGTPDSMVEDA

SEQ ID NO: 212514 - protein, 308 aa, Glycine max
  Coding DNA Sequence Number=SeqID_95736
  Gene Ontology: Mol. function=catalytic activity; Cellular component =nucleus; Biological process=metabolic process
  Homolog annotation: Hit_ID=Q8KR71; Match level="QueryCoverage=81%, HitCoverage=24%, E-value=5e-99, Identity=67%"; Hit description =Nonribosomal peptide synthetase PhbF
MAAQHIFDFRQRDAHAADLHIPVHPGGEHDVAVRTVVALIAGAESAQRLPVRPFKGDEVMLLQLPLLQIAQRQVDPGGMNAADHAGRAVAAVVMADEVAVGRQRAAVRHGAALLRGDRVPDAPDGGFGRPAEREQREIRAQGAQGLHRRRLDVVAALRHQAQRTQAVGRFAGEQHLQNGGHRTPQGDPVLFHQLVPADGVLFLMRRRQYQRGAGAQRTEQIEHRHVMVRRRDGNEDVVGSDRPALLSLVDDVGGSSSRPGWRCVPPTSVHPAAQARDPSAPAGPPALRRSASPDRRRAPPASAGIFQQ

SEQ ID NO: 212515 - protein, 110 aa, Glycine max
  Coding DNA Sequence Number=SeqID_95737
  Gene Ontology: Mol. function=catalytic activity; Cellular component =nucleus; Biological process=regulation of transcription
  Homolog annotation: Hit_ID=Q6YUX6; Match level="QueryCoverage=88%, HitCoverage=30%, E-value=2e-30, Identity=57%"; Hit description =Putative TCP-domain protein
  Pfam annotation: Domain name=TCP; Domain location=30-109; Score=57.5; E_value=4.5e-14; Accession=PF03634.4; Description=TCP family transcription factor
MEEECVHQQNVAGNKSNFPLQLLKKKDEGPPPSPPPSAAKAKRPPTKDRHTKVEGRGRRIRMPAACAARVFQLTRELGHKSDGETIEWLLREAEPAVIAATGTGTIPANF

SEQ ID NO: 212516 - protein, 188 aa, Glycine max
  Coding DNA Sequence Number=SeqID_95738
MTTLTQIWMTLLLSNIPPDDHNVDLPPTEVSVGLYRRDIGEDHAHETPNGPGEVQQGPGVSSSGYGPLSVLQGAHPPQQGVAPTRHPVDPEEPNRALGFPALVTGHCQSYRAPVPPASSCHRDIGITPVRHSVDPDKSNRVLGFPALIMGLCQFYGVPVTPSKVIKPPTNRAFIKKYCAPRKAQGETL

SEQ ID NO: 212517 - protein, 165 aa, Glycine max
  Coding DNA Sequence Number=SeqID_95739
MVGAGLKKDLRVSRVVPGGSLNAFLFLLIGVISQRLAMESIDSLPIGWTVGAMIYFTGEVSAQLVELRSCNWVVAITEDRNMPLKDSTETKTGCQERRGGRMGSWSDLGFSFGILGKDQAGPCEQLDALFLQPFERNVAKGKDPWTDPSSPPRRIRDHPRRFASR

SEQ ID NO: 212518 - protein, 71 aa, Glycine max
  Coding DNA Sequence Number=SeqID_95740
MVQVEAREHNMAGLCGVSKGILKREIDKKLKKAETLIWVDFVECPKVEVVYGSSWKSGDLKMEDLDIDLME

SEQ ID NO: 212519 - protein, 151 aa, Glycine max
  Coding DNA Sequence Number=SeqID_95741
  Homolog annotation: Hit_ID=Q1QTB4; Match level="QueryCoverage=62%, HitCoverage=86%, E-value=2e-15, Identity=44%"; Hit description =Histidine triad (HIT) protein
  Subcellular localization annotation: CTP_CleavageSite=27; ConfidenceScore=5.45e-01
MPTPTNATGHQVSSSLDRFRCVQPRLLASMNRPIRISRTAATRRHAGPAHPARSGARGRCPRPGPATRGRRHGGRSHGNAAGARSCPAARRPARSTRSPRPSAVPAPARGIVRRSSVRTCDNGPSATSTLSVARRESSSKSLIQDAPRRSP

SEQ ID NO: 212520 - protein, 66 aa, Glycine max
  Coding DNA Sequence Number=SeqID_95742
MEKSDKKNFKDKKEKKAYITWENNDMDSSSDSENEIINLGLMAKDYESREEMHLMTCIKNLSNLPN

SEQ ID NO: 212521 - protein, 95 aa, Glycine max
  Coding DNA Sequence Number=SeqID_95743
MWVQAIGLFAQATCAPEFGLPRPFNQRLLVLHVGGGAVKQRGQPFPCIQESSTTRDPQSLNPFSEIRRREEEISLKRDSLYNEDQSKFLIEYASG

SEQ ID NO: 212522 - protein, 423 aa, Glycine max
  Coding DNA Sequence Number=SeqID_95744
  Homolog annotation: Hit_ID=Q4UVX8; Match level="QueryCoverage=43%, HitCoverage=53%, E-value=2e-42, Identity=50%"; Hit description =Putative phytase
  Pfam annotation: Domain name=fn3; Domain location=237-328; Score=1.9; E_value=0.099; Accession=PF00041.11; Description=Fibronectin type III domain
RRADGYSVYVTDSWDNGEDAQGRDILPPLAELDKRVRQYHVSRDDAKVEAKLVASIGDTSEAGALRVVESIWGDPENDRLLIAEEDESYASEFKVYTLSGRRRDPAHLWQGRLVDHYRTGQAAQRVPPVRPAYAEAGRCVPGQYRGQHRWYLDDAATQRALPARCAVCRARRPGRGCVRLGEHRQAVGAAAGVWRMSGHCVMRTLALSLLLALPSLSFAAAEPNTQVPAGSRHYAATTVPDRIVASPAVDPSHGFAVAWRTDGSVQAPLLEIALAGDSPAIEGIRQVRATTRSLQTENGLSHHHRADISGLQPDTQYVYRVQGNGSWSAWNQLRTLAAADQPLTLLYFGDTQNKNVSHVSRVVRAAQKAAPQARMSLFAGDLVSGGDNMDDRNPGGPGHRQPRVFRGVRGHPAGTPRAGQALA

SEQ ID NO: 212523 - protein, 491 aa, Glycine max
  Coding DNA Sequence Number=SeqID_95745
  Gene Ontology: Mol. function=hydrolase activity; Cellular component =integral to membrane; Biological process=proteolysis
  Homolog annotation: Hit_ID=Q6D4V2; Match level="QueryCoverage=70%, HitCoverage=99%, E-value=1e-113, Identity=61%"; Hit description =Protease
  Pfam annotation: Domain name=Peptidase_S49; Domain location=302-453; Score=208.8; E_value=1.2e-59; Accession=PF01343.9; Description =Peptidase family S49
  Pfam annotation: Domain name=Peptidase_S49_N; Domain location=144 -300; Score=316.1; E_value=6.2e-92; Accession=PF08496.1; Description =Peptidase family S49 N-terminal
  Pfam module annotation: Pfam domain module=Peptidase_S49::Peptidase _S49_N; Domain location=302-453::144-300
MQHAIQPRHQRGNLLCQLLAAFRCGVRQIQQQRSGGLFIELINRLSGLLQRGGVAAEQNHARTVARIGQGGFAADAVGSTGHKNDAIVQQVAFRLIMHSDVLCRSEGFLALCLNLAQGAIAATRILCRLPAFQATNGIKAGGRMDLLSSYGLFLAKAVTVVVAIAAIVLIVLNAALRKRHSGGQLRLTHLDEAYREMKEDLQLAKMKPQAQKVWLKQHKKEEKQKAKAEKRNAKAGVTDAAKPTLYVLEFKGSMDAGEVSSLREEISAVLAVAQPGDEVLLRLESPGGVVHGYGLAASQLQRLRDAGLQLTAVVDKVAASGGYMMACVADRIVAAPFSIIGSIGVVAQIPNFNRLLKRNDIDVELHTAGQYKRTLTLFGENTEEGREKFQEDLNETHQLFKDFVHQMRPALDLDKVATGEHWYGRQALDLGLIDEIGTSDALIIARMDRFSVLGVHFARKKKMIDRVTHSASVAAERLILKIWQRGDKPLL

SEQ ID NO: 212524 - protein, 165 aa, Glycine max
  Coding DNA Sequence Number=SeqID_95746
  Gene Ontology: Mol. function=cob(I)yrinic acid a,c-diamide adenosyltransferase activity; Cellular component=outer membrane; Biological process=cobalamin biosynthetic process
  Homolog annotation: Hit_ID=P0A9H5; Match level="QueryCoverage=99%, HitCoverage=84%, E-value=7e-73, Identity=77%"; Hit description =Cob(I)yrinic acid a,c-diamide adenosyltransferase (EC 2.5.1.17) (Cob(I)alamin adenosyltransferase)
  Pfam annotation: Domain name=CobA_CobO_BtuR; Domain location=1-165; Score=353.5; E_value=3.4e-103; Accession=PF02572.6; Description =ATP:corrinoid adenosyltransferase BtuRCobOCobP
MVFTGNGKGKTTAAFGTALRACGHGKNVAAVQFIKGEWPNGERNLLAQHGVEFQVMATGFTWETQNRASDTAACQQVWQHARRMLQDASLDLVILDEITYMVSMDYLDLDELIAALQQRPPQQSVIITGRGCHRTLLELADTVSEMRPVKHAFDAGIQAQQGIDW

SEQ ID NO: 212525 - protein, 62 aa, Glycine max
  Coding DNA Sequence Number=SeqID_95747
  Homolog annotation: Hit_ID=Q8TGM5; Match level="QueryCoverage=65%, HitCoverage=61%, E-value=5e-08, Identity=70%"; Hit description =Uncharacterized protein ART3
MASGATCVQRLDGSRDSAIHTKYRISLRSSSMQEPRYPLPRVIDEEAGRTGRRGHPLPPDGR

SEQ ID NO: 212526 - protein, 56 aa, Glycine max
  Coding DNA Sequence Number=SeqID_95748
MDILILGQGFMRFGGKGDVPHYFHDTHATMMIRKFYAKLVMYAPMWTLKHQVFTVM

SEQ ID NO: 212527 - protein, 330 aa, Glycine max
  Coding DNA Sequence Number=SeqID_95749
  Homolog annotation: Hit_ID=Q1T213; Match level="QueryCoverage=77%, HitCoverage=20%, E-value=1e-98, Identity=70%"; Hit description=IMP dehydrogenase/GMP reductase
MPLDIILSHDHNQIVALLDSRMVGLVQLLLKSNASNSLIEDYAACLELRSEELQNLENNNDDPGILIMQLLIDNISRPAPNITHLLLKFDLDTPIERTVLQPKFYYSCMKVILDILEKLLKPGVNALLHEFGFQLLYELCVDPLTSGPTMDLLSNKKYLFFVKHLDTIGIAPLPKRNSNQSLRNSSLHQRAWLLKLLAVELHAGDVRSSNHREACQTILSYLFAHGLNDIGGGQAMPPFLLHDTSENAAIRTVSKSKEGIVDEYGRVWNATHIPPIAHNQYMGQFLGAQKEEIRELITSGTFAVQSNQSQQGGGNKAPKPGDISEKEQSP

SEQ ID NO: 212528 - protein, 284 aa, Glycine max
  Coding DNA Sequence Number=SeqID_95750
  Subcellular localization annotation: CTP_CleavageSite=80; ConfidenceScore=5.61e-01
MGNGGKARAISSAISAISASTPSTKLPSDMITNSRILGPCPTTNSSCLPDSRAPYHVTAIRTIFANFALLKVQTKFTLVMDKATKEVLLRGIVDHDGLYQFPSLHLQPQSKLFFPAHCLVSNSSFQTPVITNSNVQKKRMRGERNSRERDCRWERVRNRWERREKGPRLIIDRKRNEDYHSYQRVNWREHKDVTSFYFSRFPEETTEKDLWRHFKQVEKKLDSMVFGGLKMFVNTTKFGRPKRENSQTAARGRNEGKHHPEGSRDTYLRMMPETKVNKGRMRRQ

SEQ ID NO: 212529 - protein, 222 aa, Glycine max
  Coding DNA Sequence Number=SeqID_95751
  Homolog annotation: Hit_ID=Q1T213; Match level="QueryCoverage=74%, HitCoverage=11%, E-value=1e-73, Identity=85%"; Hit description=IMP dehydrogenase/GMP reductase
MCLAAFKAFACVMTFSFVISYQKEPELLSGNDVLWTFVNFAGEDHTNFQTLVAFLNMLSTLACSQEGASKVYELLQGKAFRSIGWSTLFECLTIYDEKFKQSLQTAGAMLPEIQEGDAKALVAYLNILKKVVENGNPTERKTWFPDIEPLFKLLSYENVPPYLKGALRNAIATFIKVSPVLKDSIWTYLEQYDLPVVVGLDIPNSPQSMGTQVGKEPTLLEA

SEQ ID NO: 212530 - protein, 189 aa, Glycine max
  Coding DNA Sequence Number=SeqID_95752
  Homolog annotation: Hit_ID=Q1T213; Match level="QueryCoverage=95%, HitCoverage=13%, E-value=1e-81, Identity=80%"; Hit description=IMP dehydrogenase/GMP reductase
MQFELNEIEARREQYPSTISFLNLINALIAEERDLSDRGRRFIYDHVFGPFPQRAYADPCEKWQLVGACLKHFHMVLSMYDIKDEDYEGVVDQSRLSATKESSPLQTQLPVLELLKDFMSGKTAFRNIMSILLPGVNSVIAERSSQLYGQLLENAVQLSLEIIILVLDKDLLLSDYWRPLYQCVADKKM

SEQ ID NO: 212531 - protein, 161 aa, Glycine max
  Coding DNA Sequence Number=SeqID_95753
  Homolog annotation: Hit_ID=Q1T213; Match level="QueryCoverage=97%, HitCoverage=11%, E-value=3e-74, Identity=86%"; Hit description=IMP dehydrogenase/GMP reductase
MTTGNDPHVEGFVGGIRLAWVVHLMLIQDGVPARETISSGSSNELGYLSQCLEAIFSNNVFQFLLDKVLRTASFQTEDEDMIYMYNAYLHKLITCFLSNPLARDKIKESKERIMSVLSPYRVVGSHDFAQDSNSSSLHGTEMGPLPFNSILDFVSEIYQQR

SEQ ID NO: 212532 - protein, 227 aa, Glycine max
  Coding DNA Sequence Number=SeqID_95754
  Gene Ontology: Mol. function=nucleic acid binding; Biological process= DNA integration
  Homolog annotation: Hit_ID=Q1S7C5; Match level="QueryCoverage=73%, HitCoverage=17%, E-value=5e-27, Identity=36%"; Hit description =Integrase, catalytic region
MAESPPPPSATPFPSSLAFSYSISEKLIDSNFLFWKQQVEPVIKAHQLHHYLVCPNIPLRYANETDQNSGTMNHEKIHDHFHKLTQARARQLRAELRTTTLDSKHVSEFLLRIKARADALASVGDPITPEQHVDVILEGLPFDYNFVISVIESKSQPMQIEEVEALLAHEMQLEKSQKKLASKTASLNLMEIASLKVQQQQSSSVQANVASENANSNYNSYSGYRSY

SEQ ID NO: 212533 - protein, 81 aa, Glycine max
  Coding DNA Sequence Number=SeqID_95755
  Homolog annotation: Hit_ID=Q1T213; Match level="QueryCoverage=39%, HitCoverage=2%, E-value=1e-07, Identity=93%"; Hit description=IMP dehydrogenase/GMP reductase
EVLEERTDALSGTVLKPSETKAITRAKRRQKRIREAKPEKNMLIINNRGKAQGKQEKDKKNPRAPPMAEEESKSFKSVRRR

SEQ ID NO: 212534 - protein, 174 aa, Glycine max
  Coding DNA Sequence Number=SeqID_95756
MKVRLQRLFKHELKALKWKKDHTSQDWYSLKEHHEVGRHYETLNHTFFIAETPFNRVCPWKRDFAIESDCNFSFMVQLPHSRFAFTHLVQPIIEEVNYNAEVDANLNTLAVKVYDPPPSGEYVRCVEEAFLITREALGSLDFHAPINLSSGDEFGDEFLRKFDEEVAKQKGEKM

SEQ ID NO: 212535 - protein, 272 aa, Glycine max
  Coding DNA Sequence Number=SeqID_95757
  Homolog annotation: Hit_ID=Q1T213; Match level="QueryCoverage=42%, HitCoverage=9%, E-value=2e-41, Identity=69%"; Hit description=IMP dehydrogenase/GMP reductase
MVSPKQLLGTIESALLGTSPPMAAHRVELLHALRTSRTSLQSLLSYPPPKPSDRSQVQSKSVRLPDSPPISLDDQDVHIALKLSDDLHLNEVDCVRLLVSANKEAVVLDQGLQDDILVDIQKYLEDLISSGLRQRLISLIKELNREEPSGLGGPQCESYVLDSRGSLVERQAVVSRERLILGHCLVLSILDSASEVSESNATVKHQDSMIFQPNRVQNRLWYCFAASLSYSQSLLLASSLALCHDMMGSASSHLRLTLLKLLLSSSAIGGAL

SEQ ID NO: 212536 - protein, 144 aa, Glycine max
  Coding DNA Sequence Number=SeqID_95758
MAPTRHPLDPDKSNRALGFPALITGLCQSYGVPVTPSKYCTPRQAQGDAHQAADAPPPPRQADPARSLGVERYLQHLVRQQAANHHGRCRYMSVSTGSASVSRGRVLPLLHALLRSSLGLRSHGLETGPMPRQGADKSHVWMRI

SEQ ID NO: 212537 - protein, 78 aa, Glycine max
  Coding DNA Sequence Number=SeqID_95759
MLKLINQRMQIHIYPCFQGSLSKLDWLSEAYPLSEEACSLSENKTLENVEPESSMLGAQPARLARTLSFLALSASKPS

SEQ ID NO: 212538 - protein, 72 aa, Glycine max
  Coding DNA Sequence Number=SeqID_95760
MQDCAHEELLADVGERRDAVVHCELDFADKVEVMEKEEIKMREEEDEGEKAYTLRWFLVITILVTLMALRLY

SEQ ID NO: 212539 - protein, 112 aa, Glycine max
  Coding DNA Sequence Number=SeqID_95761
MELYGSTLWGSSTWPLVLIYVIAMGALQSILFPLGHKFSLAPHPTILQRKAEGAKREEEEVEERILGRIQLSWVPCPLTNRNSNSLKKFKTNNNDNNNNNNNNNNNNNKIKT

SEQ ID NO: 212540 - protein, 156 aa, Glycine max
  Coding DNA Sequence Number=SeqID_95762
MAEYSGYPQQALQDVVLKVLHKADISITEVVNFGRVQCLNEIPLLGSRHMRRVGRAGSLGIHAGNCCRQSELGCLLKWLSSSGGTIRAIIALGVVQHIQKMEYEHTRTTSIEGLQFLLHVDPSIENLDVLIGNRGFLVYISGGMNGYGVGAGIASL

SEQ ID NO: 212541 - protein, 121 aa, Glycine max
  Coding DNA Sequence Number=SeqID_95763
MVKEECKEVSVSSKRLAKKESHFTIKTNIKETSLLRQPPHLLLCKRTLVSTVIPLELEVIPQVKEFLDEGVINMKIQKKWRLKSPFLLLHSVSIDLQEAKDSIGEEDSRSTSSTWSYIMMN

SEQ ID NO: 212542 - protein, 145 aa, Glycine max
  Coding DNA Sequence Number=SeqID_95764
MVEITPVTIVMEPRPKANDAPTESTSYEATCKDSTAVIIHTTSSGPNPINFAPSNVLTKIEVKEMIGLAMDNFVEKQKVGNEEFRRTMQQAIATQFSSLSESLILNLEQAQMRLFSVVVVPMSLPPTQALPPASVPPTLPTLNSN

SEQ ID NO: 212543 - protein, 113 aa, Glycine max
  Coding DNA Sequence Number=SeqID_95765
MADEEVEAILSKIILMMPKTQVKNQESSKVHPLWYKWSLHPLGYNTENKRGILQGYWKSQEPMVAWGLDVGTGKVQTKKQAQQEEEEEEEEEIVSKEQWTKKRHKESKPFHPI

SEQ ID NO: 212544 - protein, 126 aa, Glycine max
  Coding DNA Sequence Number=SeqID_95766
MALIGFLPVFLVHAFFPNAPNDLCDGVHGQHCLFSENFGHNGLPVLHLNIPPEHSDKLSVYHLRIDEVTTDSAKKQSTLYVEAKTFQHDDAKVVFNVSSWFSITMNGGGVSGDNGGGRSLTCGYHY

SEQ ID NO: 212545 - protein, 87 aa, Glycine max
  Coding DNA Sequence Number=SeqID_95767
  Subcellular localization annotation: CTP_CleavageSite=57; ConfidenceScore=5.17e-01
MERQLERKHSYKKTYHYDSSNGKVKSKKEGSSPPKQQSSKSQSHKHDPNPSTSSTSRSSSIKCLGKGHISRNLSHDRTTKENKIGAF

SEQ ID NO: 212546 - protein, 149 aa, Glycine max
  Coding DNA Sequence Number=SeqID_95768
  Gene Ontology: Mol. function=RNA-directed DNA polymerase activity; Biological process=RNA-dependent DNA replication
MKVGGQRIRKGGEREIHPKNHKEGRGWVASPSIVHAGGLLCMWDVNCFHLSSEFRGSGYLRVEGSLLGTNQMEEQEANLIKCWHQESGTTCGRDAHNIFLIGMSQIIDQFSSRIVLWTGDLNPSRFLIVASWIAISQKNLKKLGKILDV

SEQ ID NO: 212547 - protein, 178 aa, Glycine max
  Coding DNA Sequence Number=SeqID_95769
  Homolog annotation: Hit_ID=Q1SLB1; Match level="QueryCoverage=41%, HitCoverage=12%, E-value=5e-12, Identity=48%"; Hit description=RNA -directed DNA polymerase
MDNMDQRMFGELQSFGLGKRKPNKEFLVAKGLRQGNPLAPFLFNVIAKGLSGMMREAIKRGLFKSFFVGNKKVEVDAERFQRELRDIHLQKAIWTHGGGYMINPARNNIVFRGGLFDKEKIMQEVVFHMWTWLKNLDSSFGYSYDQCYVCPEWYPYTKYMVQRLYYWVSTEGGIETAT

SEQ ID NO: 212548 - protein, 116 aa, Glycine max
  Coding DNA Sequence Number=SeqID_95770
MKILKRKKLGKRENYKGTFGKRKKNGLKGLNIEGEWVEDPCRLKVEVENFFQLRFKVEKDRSKLDGVKLNRISREDYQMLLVEFEEKEVKEEIWECGDSKSLGPDEYTFKFIKNFW

SEQ ID NO: 212549 - protein, 93 aa, Glycine max
  Coding DNA Sequence Number=SeqID_95771
  Homolog annotation: Hit_ID=Q9ATG0; Match level="QueryCoverage=82%, HitCoverage=58%, E-value=1e-13, Identity=48%"; Hit description =Putative chaperon P13.9
  Subcellular localization annotation: CTP_CleavageSite=25; ConfidenceScore=5.43e-01
MAHPLSFAPICSFKSSSTPGALTVTGNSVVSAFIRINEACHDSKARNFQSLKVKAADDNPSTKTKSIVCSDCEGNGSEGNVLKFYSPDNLLLK

SEQ ID NO: 212550 - protein, 407 aa, Glycine max
  Coding DNA Sequence Number=SeqID_95772
  Homolog annotation: Hit_ID=Q1T213; Match level="QueryCoverage=95%, HitCoverage=27%, E-value=1e-168, Identity=77%"; Hit description=IMP dehydrogenase/GMP reductase
MSLYTVAVGGTSIVTKKRVLELLEIIQFRCPDSTTQLSNIVAGMKYDLPAEDILGNPGNSGKGGVYYYSERGDRLIDLASFHDKLWQKYNSAYAQASNLGSEVELNNVRETIQQLLRWGWKYNKNLEEQAAQLHMLTAWSQIVEVSASRRLTMLEDRSEILFQVLDVSLSASASPDCSLRMAFILSQVALTCMAKLRDERFLFPGSLSSDNITCLDLIVVKQLSNGACLTILFKLIMAILRNESSEALRRRYVTHSELRRQYALLLSYFQYCQNVVDPDVPTTVLQFLLLSEQDNEYIDLPKIKSSLHLLLHFAQIDKEQAELARANFSTLRKEAQSILNLVVKDATHGSEPGKTISLYVLDALINIDHERFFLSQLQSRGFLRSCFTAISNVCNQSWTVHSIAQGI

SEQ ID NO: 212551 - protein, 189 aa, Glycine max
  Coding DNA Sequence Number=SeqID_95773
MGPEPDIESMGFCLSLDSLQRACTFEAELALLLRISHKYGKSGAQILFSMGILEHLASGRAINLQGSLRWVETRLRRDMAVDVDRQRMIITPVLRLVFSLTSLVDTSDFLEVKNKIVREVIDFIKGHQSLFDQVLRLDIAEADELRTEQVNLVVGILSKMWDLADLIDSEKRERERENESEIVLIKSTQ

SEQ ID NO: 212552 - protein, 222 aa, Glycine max
  Coding DNA Sequence Number=SeqID_95774
  Subcellular localization annotation: CTP_CleavageSite=15; ConfidenceScore=5.21e-01
MASTSSLPPPPPLSPAVTPSPITLFGIMKFSWSSKEYLNWENQILNYRSSSSCWMQHFMAALGETPCAFLLYCSHEEKAALIIDYLLHIQTLVDSLTSIGDSVSQSEHVNIILEGHPTKYESTIAFIYNKSKLMPIVSYINSGNYNNFGRGGGGWNNFYHGGHEGGCGRGAHGGGNTDENPETSQIQAKGPSGEGQSPRVEKDEGPKAKTLSRLLIVAEGPD

SEQ ID NO: 212553 - protein, 238 aa, Glycine max
  Coding DNA Sequence Number=SeqID_95775
MVTYFQVWPYEESNEYGFVQGLFGLMHALFSRDSKIPSFAQSRVSPEPSDASSSYAASVELQQPTLSLLNSLLFSVTTAFERAAEEKSLLLNKIRDINELSRQEVDEIINMCVRQDSVSSSDNIHKRRYIAMVEMCRVVASRDQLIILLLPLSEHVLNIILIHLQESSVALDSTLSTKTIAYGAKYDAQQDVAMLYGKLVPTLERLELLSEEKVGHNLKVFRRLATSAKDLAIQKLIV

SEQ ID NO: 212554 - protein, 106 aa, Glycine max
  Coding DNA Sequence Number=SeqID_95776
MGGGRSVWLNQEVDGWGVYVLKDKLKGVNVKKKFTIKTILRMLELAFKLKVNFFKSCFWALDVGGEYLGIGINPRRVEMLKPNINKFFRKLALWKHKNVLFGIGFA

SEQ ID NO: 212555 - protein, 126 aa, Glycine max
  Coding DNA Sequence Number=SeqID_95777
  Subcellular localization annotation: CTP_CleavageSite=33; ConfidenceScore=5.44e-01
MASIIVAICSFMASMSAFIFSCTSSTSPIILALAQVKLEVTRISTILNVFGSRRSNDMVTYLLQLDSMNLFVKARAWFNPVTQGMAILIANTSTTFHRDERLRNTHAMHGKCNYEIEMPEETSFLS

SEQ ID NO: 212556 - protein, 98 aa, Glycine max
  Coding DNA Sequence Number=SeqID_95778
MSLATLFGKLQKHKMELLKLNQHEENDKKKKGIALKALSSIQEESDKEDLNETEEDDDFSFFVKSFNKFLRSKGNQRRTNFNPKKKGEDSSYVPQCYE

SEQ ID NO: 212557 - protein, 282 aa, Glycine max
  Coding DNA Sequence Number=SeqID_95779
  Gene Ontology: Mol. function=ribonuclease activity; Cellular component=membrane; Biological process=RNA metabolic process
  Homolog annotation: Hit_ID=Q66FA8; Match level="QueryCoverage=74%, HitCoverage=24%, E-value=1e-109, Identity=89%"; Hit description =Ribonuclease R
  Pfam annotation: Domain name=S1; Domain location=99-184; Score=68.2; E_value=2.6e-17; Accession=PF00575.13; Description=S1 RNA binding domain
MKQAIYDPENRGHFGLALASYGHFTSPIRRYPDLALHRAIKYQLAKEHGEPKERWTPTGGWHSEFEEMLQLGEHCSMTERRADEATRNVADWLKCDFMQDHVGEVFSGIISSVTGFGFFVRLNDLFIDGLVHVSTLDNDYYRYDNIGQRLIGESSGTVYRLGDTVEIRVDAVHMDERKIDFALVSSTRKARGEGKTERDRAKKGGQRTLRDNGNAGRGKRRGGKPPANFEPDSAFRKQDDAKPADNVKKAKKKAKKASDKTRKIAAATKAKRAAKKKGAEQA

SEQ ID NO: 212558 - protein, 54 aa, Glycine max
  Coding DNA Sequence Number=SeqID_95780
MAIFKALLASILISLVIVNLVESDTMVIKNTVEGSSPSPSPPTIGRNSFSKPSS

SEQ ID NO: 212559 - protein, 74 aa, Glycine max
  Coding DNA Sequence Number=SeqID_95781
CNRQKGSTECGYYVMHWMSTIILGTFRNNWEAYFNDPRPLEPKRLKALRIQWVQFYLQCPQPKSKAPARWIVVK

SEQ ID NO: 212560 - protein, 485 aa, Glycine max
  Coding DNA Sequence Number=SeqID_95782
  Gene Ontology: Mol. function=RNA-directed DNA polymerase activity; Cellular component=exocyst; Biological process=RNA-dependent DNA replication
MHELEAIEEYGNLGKGDRRRKMEVQEKLWWVIRCSDLLTKQKAKVRWLVEDDKNSKYFYSSLKWRRRNGTLKGLLMGGVWVAEPGRVKQEVQNFIENKFCEIEFGRPKLDEVQFKKLSSLENSGLSTQFLKEVKKAIWDYEDLKSPGPDGYNFRFIKAFWRLMRNDVMRFLGEFHANVVLPKGGNSSFISLIPKITTKVLSNRLKLVLRSVIDERQSAFLGGLRLGQLGLPALHDEEIRIDGCLQSSRIFVLVNGNLPKEFSVSKGLRQGDPLAPFLFNIAAEGLIGIMREAISKNFIPASWWVRKRCQSISYSMRMTLSSSGKHRYNVLSLSRACYPVLNWFLALKLTSTKAALALLGFMSGGGNLWRKRKVSSEILESKFGGCLVREELEISGLNPWLCEKLVMGTKLFLGDTWVGNEPLAFKYPRLYATSCQREKKVCEMGVWSWNLEWRILNFLWEQEQLNQLLYDVNNYNLRQSQGDSWI

SEQ ID NO: 212561 - protein, 62 aa, Glycine max
  Coding DNA Sequence Number=SeqID_95783
MKPKVAVRLVHMGEGFRGASGRYGSLFMAGSSGASADPIQHYLQHDFCKQFASVDGRPRTLS

SEQ ID NO: 212562 - protein, 126 aa, Glycine max
  Coding DNA Sequence Number=SeqID_95784
VHPLWYKYRVHLLGLLTESKRGYISCGSVLVEGTSTRLFKENKGGIVWNIGKVGPFNRGYGKSELCKDVSEGGFATTCNDEDGFSTMLGGNIISLDSENESQSIGGVLSQRGDVWRPWDQREESLR

SEQ ID NO: 212563 - protein, 102 aa, Glycine max
  Coding DNA Sequence Number=SeqID_95785
MGRCPSSFNTTIMVPFLAAPRFICGGKQEKRWATVWLFPAWSIWNHRNGVIQKGSTMSTGGYGLVSSILMVLFKGQIYNILCFFLGMEYSTMTMLLIKFAPM

SEQ ID NO: 212564 - protein, 120 aa, Glycine max
  Coding DNA Sequence Number=SeqID_95786
MELNIQRSNLDRLNNCWVGHLIDLSLVDRLEDVYVNENAKKIKFNYLGDDMVLILGCTKEWFNESTKSCHHKKGGDCRSKLHDESRLIQRSFDDNKDDDKKLKSQEHFMITKMMISRIKE

SEQ ID NO: 212565 - protein, 385 aa, Glycine max
  Coding DNA Sequence Number=SeqID_95787
  Gene Ontology: Biological process=regulation of transcription
  Homolog annotation: Hit_ID=Q9FME3; Match level="QueryCoverage=51%, HitCoverage=56%, E-value=2e-47, Identity=54%"; Hit description =Arabidopsis thaliana genomic DNA, chromosome 5, P1 clone:MSL3
  Pfam annotation: Domain name=TCP; Domain location=35-177; Score =113.7; E_value=5.3e-31; Accession=PF03634.4; Description=TCP family transcription factor
  Subcellular localization annotation: CTP_CleavageSite=44; ConfidenceScore=5.28e-01
MASSREGYQAKQEGDTTTNIDKFSKASSTTSRQWSAFRNPRIVRVSRSFGGKDRHSKVCTIRGLRDRRIRLSVPTAIQLYDLQDKLGLSQPSKVIDWLLEATKFDIDKLPPLQFPQGFGQFHHHPQTLFPFHESSAASHQLSLGPFSDASSTFVRDGGIQNLMAKSRYWENINSMSRLRGNKEAEKGKWIKTSEEENHDQDGVVGGYNNLQVSTQRLFPMGSSTTTTTHSLLPGLLNNSMPYNAYSSEPSSLSLSQFGSHGLFPSQQVDPNPSSGNNGVQFQSSLSLPSSGSQLLFGSSSATPSMFTTYAPFIAPSVDPDPRQFNHIHQFLNSGSQILPPHPLIPSLHHPFNSQIRPFPAALFSSKLLDSDSSNHSQQDHKGSTS

SEQ ID NO: 212566 - protein, 147 aa, Glycine max
  Coding DNA Sequence Number=SeqID_95788
MVVQGRKFSMTDYSDGAAFDVTGMPPVNQEMPIISGIDQDNVRMTTPPPSPTEPDIPFDGMSRKSRQSMWLRRLTARSLDQPRPTVNINPTTGRGSGPHKEKFHSYLGVVARDKIPIVHSSWNDVPETLKNMIWGDILASPFCRSHH

SEQ ID NO: 212567 - protein, 151 aa, Glycine max
  Coding DNA Sequence Number=SeqID_95789
  Homolog annotation: Hit_ID=O48946; Match level="QueryCoverage=37%, HitCoverage=6%, E-value=1e-17, Identity=64%"; Hit description =Cellulose synthase A catalytic subunit 1 [UDP-forming]
MEKNFKCKPLMAFSVMTENEAFKVRMNALIAKAQKMPEEGWTMQAGTRVFLGHIGGLDTDGNELPRLVYVSRARLRIQCILGQSHSHDHRRLRCILRWVCPGGHVHMPDVKFCAFYDGPFQPSLIWSQLFTTSETTTIVNQRKMPSITDVE

SEQ ID NO: 212568 - protein, 170 aa, Glycine max
  Coding DNA Sequence Number=SeqID_95790
  Gene Ontology: Mol. function=DNA binding
  Homolog annotation: Hit_ID=O49350; Match level="QueryCoverage=91%, HitCoverage=37%, E-value=1e-23, Identity=43%"; Hit description=AT -hook protein 2
  Pfam annotation: Domain name=DUF296; Domain location=1-84; Score =21.6; E_value=7.8e-06; Accession=PF03479.5; Description=Domain of unknown function (DUF296)
MLFHKGVSVSWEALTSLWNGRFEIISLSGSLQQSENNSERSRTCTLNVTLAGSDGRVLGGGVAGTLIAASTVQVIVGSFIADAKKSSSNALKSGSSSAPPPQMLTFGSSMTPNSPTSQGPSTESSEEQDHSPFCRGPGPGSGHGLYNNASQPVHNMPMYHHPLWAGQSHQ

SEQ ID NO: 212569 - protein, 76 aa, Glycine max
  Coding DNA Sequence Number=SeqID_95791
MGVCVCVALTFLEPTVLETEGRGLGVAMDLTSIGDEKEAEDFCVMAREEEKMKLLLQMYAETSITIKFLSLSLLLG

SEQ ID NO: 212570 - protein, 131 aa, Glycine max
  Coding DNA Sequence Number=SeqID_95792
  Homolog annotation: Hit_ID=Q2QN86; Match level="QueryCoverage=75%, HitCoverage=54%, E-value=1e-19, Identity=56%"; Hit description =Expressed protein
  Pfam annotation: Domain name=DUF1118; Domain location=1-129; Score =97.2; E_value=5e-26; Accession=PF06549.3; Description=Protein of unknown function (DUF1118)
MQNSTVFPLGEQPRSSPATATPPIKLLTRMEQLKLLSKAEKAGLLSAAEKFGFSLSTIERLGLLSKAEELGVLSAATDPGTPRTLLTLSLGLLILGPLFVYFVPEDNLGLVGLQVVVALSRRHEYAVMLNI

SEQ ID NO: 212571 - protein, 80 aa, Glycine max
  Coding DNA Sequence Number=SeqID_95793
MYLNRQAPGSQQIKGTKTTKQGGLCGGWPAVNLCDIWDMGSGNRLPREARRASGNRLPRGCNRLPGLEMKIVMAAQLIHD

SEQ ID NO: 212572 - protein, 112 aa, Glycine max
  Coding DNA Sequence Number=SeqID_95794
MDSFEPQSIQRSEQSQFEAKSLHKELDVEFKTRCLPWSLPEWMVVILPKEHLVVWFCSLHNRPDNYLKGIINNALKGLDDAPQPKSKAAARWIVVKYFNDPRPLELERLKAL

SEQ ID NO: 212573 - protein, 149 aa, Glycine max
  Coding DNA Sequence Number=SeqID_95795
  Gene Ontology: Mol. function=protein binding; Cellular component =clathrin vesicle coat; Biological process=intracellular protein transport
  Homolog annotation: Hit_ID=Q6ZGX8; Match level="QueryCoverage=79%, HitCoverage=27%, E-value=5e-50, Identity=83%"; Hit description =Putative Clathrin coat assembly protein AP50
MVDAFRTHIMQTKELGTCPVRQIGGCSFFYMRISNVYIVIVVSNNANVACAFKFVVEAVALFRSYFGGAFDEDAIRNNFVLIYELLDEIMDFGYPQNLSPEILKLYITQEGVRSPFSSKLPRSKGIDRDMIGENMEILTLPKKKSQNTT

SEQ ID NO: 212574 - protein, 86 aa, Glycine max
  Coding DNA Sequence Number=SeqID_95796
  Homolog annotation: Hit_ID=Q6ZGX8; Match level="QueryCoverage=32%, HitCoverage=6%, E-value=5e-08, Identity=100%"; Hit description =Putative Clathrin coat assembly protein AP50
MRERKKEETGLPDIVAIEAVDENVAAEVEEVNGGSGNRHLRSTLPEDQSEIVGDGGSAADLWFRDRAEASPPIWWIGFVRTREKVA

SEQ ID NO: 212575 - protein, 180 aa, Glycine max
  Coding DNA Sequence Number=SeqID_95797
  Gene Ontology: Biological process=embryonic development
  Homolog annotation: Hit_ID=Q9XES9; Match level="QueryCoverage=72%, HitCoverage=100%, E-value=3e-51, Identity=76%"; Hit description=Seed maturation protein PM29
  Pfam annotation: Domain name=LEA_1; Domain location=50-122; Score =142.0; E_value=1.6e-39; Accession=PF03760.6; Description=Late embryogenesis abundant (LEA) group 1
MVFCERGSILMGIALHVEQVARYLACLALLLSRLGLKETERERQTRRTKMQSSKEKLKNMTSAAKEQVDIYKAKIDEKTEKATARTEEERVITHERAKAKEAEAKMELHEAKARHAAEKLSTNQSHYGLHHGHNPPLVGTTETHYQQGHHQPLGAVPMPGAIYPSYPLGANPNPPRNKHI

SEQ ID NO: 212576 - protein, 99 aa, Glycine max
  Coding DNA Sequence Number=SeqID_95798
  Gene Ontology: Mol. function=2 iron, 2 sulfur cluster binding; Biological process=electron transport
  Homolog annotation: Hit_ID=Q9C7Y4; Match level="QueryCoverage=84%, HitCoverage=76%, E-value=2e-13, Identity=39%"; Hit description =Ferredoxin, putative; 13117-10969
  Subcellular localization annotation: CTP_CleavageSite=39; ConfidenceScore=5.33e-01
MALPLLRIPGMPLTNQHQSFPSNTRRKATTAKAELGTAVARTGGAGYQSPSVDVPTHKVTVHDRQRGIVHEFVVPEGYALLCVGFPTSDVEVETQDEDE

SEQ ID NO: 212577 - protein, 317 aa, Glycine max
  Coding DNA Sequence Number=SeqID_95799
  Gene Ontology: Mol. function=protein serine/threonine kinase activity; Cellular component=clathrin vesicle coat; Biological process=intracellular protein transport
  Homolog annotation: Hit_ID=Q6ZGX8; Match level="QueryCoverage=99%, HitCoverage=65%, E-value=1e-148, Identity=84%"; Hit description =Putative Clathrin coat assembly protein AP50
  Pfam annotation: Domain name=Adap_comp_sub; Domain location=17-317; Score=413.5; E_value=3e-121; Accession=PF00928.11; Description =Adaptor complexes medium subunit family
PTDRPVPNATLQVTGAVGWRREGLVYKKNEVFLDIVESVNLLMSSKGCLPANWFGNLGSVLRCDVTGKILMKCFLSGMPDLKLGLNDKIGLEKEAQLKSRPTKSGKSIELDDVTFHQCVNLTRFNSEKTVSFVPPDGEFELMKYRITEGVNLPFKVLPTIKELGRSRIEVNVKVKSVFGAKMFALGVVVKIPVPKQTAKTNFTVTSGRAKYNASIDCLVWKIRKFPGQTESTLSAEVELISTITEKKSWTRPPIQMEFQIEKLKCNYCYLESKVDMVPMFTASGLRVRFLKVWEKSGYNTVEWVRYITKAGSYEIRC

SEQ ID NO: 212578 - protein, 157 aa, Glycine max
  Coding DNA Sequence Number=SeqID_95800
  Gene Ontology: Mol. function=monooxygenase activity; Cellular component=integral to membrane; Biological process=electron transport
  Homolog annotation: Hit_ID=Q1SJ90; Match level="QueryCoverage=69%, HitCoverage=19%, E-value=2e-20, Identity=55%"; Hit description=E -class P450, group I
IQSTGMILLSLGLKGFLAMIMRVEKWVKLGSGDTIINFFLGSGRRGCPGASLALKVAHTTLAAMIQCFELKAEEKGGYCGCVDMEEGPSFILSSVEPLICVRKSRLMSFPLYHAKYYFLVSLKLRPSMKPRSKVRLLVDVVNKVRLFWSLRLKSNFF

SEQ ID NO: 212579 - protein, 51 aa, Glycine max
  Coding DNA Sequence Number=SeqID_95801
MERGKKERPKEVKSYFSPLSRKSKCTGDKFLQRKVQVFHGERFQDPVVSYH

SEQ ID NO: 212580 - protein, 225 aa, Glycine max
  Coding DNA Sequence Number=SeqID_95802
  Gene Ontology: Mol. function=DNA binding; Cellular component =mitochondrion; Biological process=DNA integration
  Homolog annotation: Hit_ID=Q1S1X7; Match level="QueryCoverage=53%, HitCoverage=8%, E-value=2e-16, Identity=36%"; Hit description =Integrase, catalytic region; Zinc finger, CCHC-type; Peptidase aspartic, catalytic
MVEEKKESSSLKTREKMQKKKEKRKVESRRYRVVIVDHFLCYFSFTNFAKRQKKKCKGGKKSKVDPKYIFNYYKEPSHWTRDCLKKAKKDSFVALVQNDSSSVEGGVMQIRRKWKSMVMQGTKQGNLYILQGFTMICSIFDVSQSGSHASNGSFDNSLWHLCLGHVSEKGLDILNKQGLLGNQKVEPLMFGEHCIYGKQHQTKLPKVAHTTKIMLHCVHFDSWDL

SEQ ID NO: 212581 - protein, 80 aa, Glycine max
  Coding DNA Sequence Number=SeqID_95803
  Subcellular localization annotation: CTP_CleavageSite=23; ConfidenceScore=5.06e-01
MALCSANMHNSSFFQILPRTQPRSVALSGWLAKPTDKGQLQNMREKVMFGCEISDRENPWKVGSLEIVSLRWYPEKARVK

SEQ ID NO: 212582 - protein, 173 aa, Glycine max
  Coding DNA Sequence Number=SeqID_95804
  Gene Ontology: Mol. function=zinc ion binding
  Homolog annotation: Hit_ID=Q8W195; Match level="QueryCoverage=79%, HitCoverage=66%, E-value=3e-29, Identity=48%"; Hit description=Zinc finger protein LSD1
  Pfam annotation: Domain name=zf-LSD1; Domain location=133-157; Score =54.1; E_value=4.7e-13; Accession=PF06943.3; Description=LSD1 zinc finger
  Pfam annotation: Domain name=zf-LSD1; Domain location=28-52; Score =40.3; E_value=6.7e-09; Accession=PF06943.3; Description=LSD1 zinc finger
  Pfam annotation: Domain name=zf-LSD1; Domain location=95-119; Score =54.8; E_value=2.8e-13; Accession=PF06943.3; Description=LSD1 zinc finger
  Pfam module annotation: Pfam domain module=zf-LSD1::zf-LSD1::zf-LSD1; Domain location=133-157::28-52::95-119
  Subcellular localization annotation: CTP_CleavageSite=48; ConfidenceScore=5.57e-01
MPVPLAPYPTPPAPYTPPANGVQSQLVCSGCRNLLVFPVGATSVCCAVCNAVTAVPPPGYLKVQFLPVISNQLIMRQINQKHSCVTGTEMAQLVCGGCHTLLMYIRGATSVQCSCCHTVNLALEANQVAHVNCGNCRMLLAYQYGARSVKCAVCNFVTSVGATASTTEQKFST

SEQ ID NO: 212583 - protein, 87 aa, Glycine max
  Coding DNA Sequence Number=SeqID_95805
MRRNFGALMEASMEKKEEERKATWKPLGPVFESRQYIYQNAQNETLSVVQRTTNNMLSSNIIDLQKGSLVEHQNQLSLVVVGKILKG

SEQ ID NO: 212584 - protein, 120 aa, Glycine max
  Coding DNA Sequence Number=SeqID_95806
MVRAFEVLCPFFNIRSSVLVFLYFFQIKLMGNIGWVSLNSVSKKLFKFESKGQQAYLRASVVAFSEVVKSNHHLSSKVGSVLAKFLCTQLDGDELFKHCRGLQGEKNELVEKVESNGGRE

SEQ ID NO: 212585 - protein, 103 aa, Glycine max
  Coding DNA Sequence Number=SeqID_95807
  Subcellular localization annotation: CTP_CleavageSite=57; ConfidenceScore=5.53e-01
MLQKGAPITNRACKQHSQKPNASSFSRTISYKQPSALLKLLVVLAPLLVLSPSLGVGVMEDFAEALKREEDGRKKRWNSDDVEFGDTEGVEVELREGGVIVEV

SEQ ID NO: 212586 - protein, 54 aa, Glycine max
  Coding DNA Sequence Number=SeqID_95808
MHNSNNNLGNTDQHPAKEREPKEELEPPTTSTMQMVACRRLFVRRKMHLVFGNV

SEQ ID NO: 212587 - protein, 91 aa, Glycine max
  Coding DNA Sequence Number=SeqID_95809
  Homolog annotation: Hit_ID=Q8S8G6; Match level="QueryCoverage=98%, HitCoverage=27%, E-value=2e-08, Identity=43%"; Hit description =Expressed protein
MFLPIVFLVKHPRNEVASKERDSSLEHVAEVKSKKLLDIDDEVLGSLILATSTAPPWPHSLCLRKTQCLGSQKLGSKGRRHQQLGSERERG

SEQ ID NO: 212588 - protein, 90 aa, Glycine max
  Coding DNA Sequence Number=SeqID_95810
YIYLGLTENKRGYISCGSVLVEGTSTRFKENKGGSRGGTPGGRGRSRGVATYAATASPLGFWLERGWQHRLSQRRWQWFGVWVPITEGFM

SEQ ID NO: 212589 - protein, 59 aa, Glycine max
  Coding DNA Sequence Number=SeqID_95811
LSKKLRKLTDCATTPPFGFRHNTEFHGSRNPPSSRLTYRATKGAKYLEAANQRLHVIKQ

SEQ ID NO: 212590 - protein, 131 aa, Glycine max
  Coding DNA Sequence Number=SeqID_95812
  Subcellular localization annotation: CTP_CleavageSite=31; ConfidenceScore=5.61e-01
APPPPPRRSLLAASFLLPVCFFFSARPASPAASSPRTTRFAFEWNLRVDDAGKNGKRSGYGGVFRKNREGFFRNFQKKVFRKLSGRRVPPEVTKGHPEEHVFRKSSGTPSSGNFPEEVFLPENFRKKNSSG

SEQ ID NO: 212591 - protein, 114 aa, Glycine max
  Coding DNA Sequence Number=SeqID_95813
DWILTNITDWRFNSHHAGSFRCCIGSDSPIESPSASVSTRMLQKDSINLSSKWETNKHRKAYGFISIPFLILFKYLATDRASFVALQLGPAVSQMMPVVEATPFYSIARNASAS

SEQ ID NO: 212592 - protein, 111 aa, Glycine max
  Coding DNA Sequence Number=SeqID_95814
  Subcellular localization annotation: CTP_CleavageSite=39; ConfidenceScore=5.15e-01
MCTLTLPVPRPTTILFTLLHSQLVGFCFFVHGTKKTKTKASTKKSPDSIGREQQANLRRGRYKINKRPHPDPLQIWQEHLHIDSLRGEHDEESPRGKGGKLIFDVLDQGSI

SEQ ID NO: 212593 - protein, 51 aa, Glycine max
  Coding DNA Sequence Number=SeqID_95815
MIDRASMLDEAIEYLKQLQLQVQSINSTLNLVHNNNNKKTSQTNNKHQIPT

SEQ ID NO: 212594 - protein, 166 aa, Glycine max
  Coding DNA Sequence Number=SeqID_95816
  Gene Ontology: Mol. function=unfolded protein binding; Cellular component=cytoplasm; Biological process=cellular protein metabolic process
  Homolog annotation: Hit_ID=Q70EL6; Match level="QueryCoverage=84%, HitCoverage=27%, E-value=3e-49, Identity=73%"; Hit description =Cytosolic chaperonin delta-subunit
MHSVAGNMFLKKMQHCNVSFGRQNLELDDDDLGVLHAGGYLSGVVDFLVKNETFHELGVVELLHNLDIAEINHVGLGGIHDEESGVDDEGSEEHGVLDDDLAIEGSAGRLHKGVAIRELDGDGHGGENIDNLEGSFVEGVGDDGVVDVVGEEEETLLSGKYSKIVL

SEQ ID NO: 212595 - protein, 111 aa, Glycine max
  Coding DNA Sequence Number=SeqID_95817
  Gene Ontology: Mol. function=nucleoside-triphosphatase activity; Cellular component=membrane
  Homolog annotation: Hit_ID=Q1RST0; Match level="QueryCoverage=83%, HitCoverage=17%, E-value=3e-16, Identity=84%"; Hit description =Peptidase S1 and S6, chymotrypsin/Hap; Immunoglobulin/major histocompatibility complex; ...
  Homolog annotation: Hit description=AAA ATPase, central region
MAPGAKFCLLLKIIGLQKLGLGLINQFQMAMILEAFVRMIVGSFVLMTLKQLGHLFPNKVTIQLPQDEALLSDWKQQLERDIETMKVQSNIVSVCTCDLPLEYVESHALAL

SEQ ID NO: 212596 - protein, 206 aa, Glycine max
  Coding DNA Sequence Number=SeqID_95818
  Gene Ontology: Mol. function=nucleic acid binding; Biological process= RNA-dependent DNA replication
  Homolog annotation: Hit_ID=Q1T6D0; Match level="QueryCoverage=74%, HitCoverage=43%, E-value=4e-13, Identity=29%"; Hit description=Zinc finger, CCHC-type; Lipocalin
  Pfam annotation: Domain name=zf-CCHC; Domain location=29-46; Score =7.9; E_value=0.049; Accession=PF00098.13; Description=Zinc knuckle
MELGVGTPIKVDSNTLKVEHGHFAHGLYIICVGCGYYGHLERNCVKCTAQHESPNKNRPSPSSTKDPPMTSPSKTNVKGQEDVKVINVGDNVHGDWLVLPRRKKPRNKGVNEKVYDHINPFKVMGSIHARSKDIQRKNITIIEGKGSIPMKSQRNPNPIVVVQKRRRYCHNNMSRASKLPPTKVEAKSSPPKSPNSQLRNGKGMQC

SEQ ID NO: 212597 - protein, 94 aa, Glycine max
  Coding DNA Sequence Number=SeqID_95819
MQQTSLHAEQNPNNNWSVILKDMEMLNCGWTLNTKQRPSWRQTHRARQGQEEQHRTEAEVATEPWGRGPERWRRPCTCRRGSRGALKRRGAQEP

SEQ ID NO: 212598 - protein, 101 aa, Glycine max
  Coding DNA Sequence Number=SeqID_95820
MANRGVLCGNDINDSNNADSGVFGNNNGDTDSNSSGDSSYGRGDNVNTNGCVGSGGGVGDNDGSGGGKNDDGGNNAGGGNGGDETINKNDHLLDVIKESVF

SEQ ID NO: 212599 - protein, 47 aa, Glycine max
  Coding DNA Sequence Number=SeqID_95821
MFGNSIGAVGGETGGILGNCSRCCYRCRKTRVGPESGGRGLTDFFGV

SEQ ID NO: 212600 - protein, 297 aa, Glycine max
  Coding DNA Sequence Number=SeqID_95822
  Homolog annotation: Hit_ID=Q5W7C9; Match level="QueryCoverage=24%, HitCoverage=47%, E-value=2e-09, Identity=42%"; Hit description =Unknow protein
  Subcellular localization annotation: CTP_CleavageSite=27; ConfidenceScore=5.01e-01
RLPCYDFTPVTSPAFGFPLLAVKVTTSGMASSHSVTGGELQPTIRTEDGFLGLAHPRGIAILCPVHWSTGVALVAGLNPNTFTARADDSHAPPVSAFPKAPLSFKRIRGMSSPGKVLRFASNLNHMLHRLVRAPRQFPLSFILANVLPRAGYFNALVYSIARVGYAQRPRVLSPLVFFPISTHFHRSTGNSLCPYHALRPIIPDNACILCLTAAAGTELADAYSPDTVIASSPGKEVHDPPSVADHPLGPATDHRLGKLLPHQLANQTRAPPRADSSFCSSAYGVLAAVSSCCSPPK

SEQ ID NO: 212601 - protein, 63 aa, Glycine max
  Coding DNA Sequence Number=SeqID_95823
MDSTMHASSSFRRLSFRHGQRWWQLTAVVVWRGQRWWRNDGGFHWRNGRRRAMREKVSLRCYF

SEQ ID NO: 212602 - protein, 66 aa, Glycine max
  Coding DNA Sequence Number=SeqID_95824
MFFSIWVSIGWRIRRRVGGGGGRSLGWRGGGRVAREGGSKHVLPYWGGKGWVKVWKKFHDDGVTIQ

SEQ ID NO: 212603 - protein, 70 aa, Glycine max
  Coding DNA Sequence Number=SeqID_95825
MRFKSQGTVVEIKGEPKLSRTLVSAQTFLKLPEIEEASWLWVLEPDQSAEGDQWQGSEEEQQQLAEVLQD

SEQ ID NO: 212604 - protein, 217 aa, Glycine max
  Coding DNA Sequence Number=SeqID_95826
  Gene Ontology: Mol. function=phosphoglycolate phosphatase activity; Biological process=methionine biosynthetic process
  Homolog annotation: Hit_ID=Q9FN41; Match level="QueryCoverage=83%, HitCoverage=33%, E-value=4e-68, Identity=71%"; Hit description =Similarity to enolase-phosphatase
  Pfam annotation: Domain name=Aldolase_II; Domain location=1-117; Score=-44.4; E_value=0.012; Accession=PF00596.11; Description=Class II Aldolase and Adducin N-terminal domain
MVPSHLLLCSLRNLAKITHMEMIKGIKGHGYYDELVIPIIENTAYEYELTESLAKAIEAYPKTTAVLVRNHGIYIWGDSWISAKTQAECYHYLFDAAIKLHQLGLDWSTPNHGPIKSLRSLMIAGESKASDKTRKASGEIDPFPRCIVLDIEGTTTPISFVTEVLFPYARQNVGRHLSVTYDTPDTEADIKLLCSQLIVPATLSAIAAMHHAPVAEL

SEQ ID NO: 212605 - protein, 320 aa, Glycine max
  Coding DNA Sequence Number=SeqID_95827
  Gene Ontology: Mol. function=RNA-directed DNA polymerase activity; Biological process=RNA-dependent DNA replication
  Subcellular localization annotation: CTP_CleavageSite=51; ConfidenceScore=5.43e-01
MQSPSSLYLNKNFFTTHHHHLGFHHTLSSTHNSLTSLGFSPKPSCSTRLITAQAYRPNNHKRNGSPKEGARVRGSKDNMWSIDNELAKASSSQKEKRRRQRGRSVVRRKGPKGGRVIVSGAMLLEVETVLQTLNVDDTIFMGEATLSNVVAIKWVPLVDTERYAHLLKCKILSLPFVYLGIPIGANPRWELMRELGGLWCEVLESIYGGWRVRKVEKGDKVLFWCNRWVGQQSLANEFPRLYLNSLQKEECIINMGEWAEGVWRWNFRWHRDWFVWEREVVERLSLMLSEATLVEGGEDSWIWKQDRTRNYLVKSSYLAL

SEQ ID NO: 212606 - protein, 294 aa, Glycine max
  Coding DNA Sequence Number=SeqID_95828
  Gene Ontology: Mol. function=RNA-directed DNA polymerase activity; Cellular component=chromatin; Biological process=chromatin assembly or disassembly
  Pfam annotation: Domain name=rve; Domain location=34-160; Score=66.4; E_value=9e-17; Accession=PF00665.16; Description=Integrase core domain
MKQYVTETIAACHICQKGKYLTSSPVGLLQPLPIPNAVWEDISMDFIIGLPKSKGFDSILEIVRLHGIPASIVSDRDSIFLSKFWQELFNMQGTVLKMSTAYHPQSDGQTEFLNRILETYLRCFSFEQPKAWADFIPWAEYWYNTTYQGAAKCTPFETVYGRVLPFARFIPGEDHMMRHANAHRIPSRIKAGDWVYLKIRPHTQVSMPSRLHPKLAARFYGPYLVVKQIGTVGFQLQLPAEAQIHPGQSAEDATWVDKVFIQEQFPLFNLEDKGGGQSVTVPKPWLVYSRKNRK

SEQ ID NO: 212607 - protein, 109 aa, Glycine max
  Coding DNA Sequence Number=SeqID_95829
MHLLDTSCCTIQRFLNISVKNAKNTQKEKKGSHFGAFSDPWLAQASLWLAWATIRLMGEVTSSPGQARLLQVEATARLGELLFNLLPSFPINKREGAEVMGVQTLKDLV

SEQ ID NO: 212608 - protein, 328 aa, Glycine max
  Coding DNA Sequence Number=SeqID_95830
MEPMEIGSKNEHLYDCYTLSRIEVVPSVSGEHTSQIQRKVNWVTLNPYGEIPQHIKGSNVAKDGQHKSSVNVINHVLPTFESFDFKRSDVMEEDVMGCEPGLVYFEDGSYSRGPIDIPVGEYNDTKYYISPTFKFEQCLVKGCHKRIRIVHTIEFINGGSDIQILRVAVYEEEWASPASIDYQSDMEFDAKPFSQRKRTKPSELTGSWKVFEVSATPVYDEESTAEEGNAAPYMYFCMENLKKRSLPKNTDYFGEEERLDMQDVTMLWLPGGVTCYVDINKHGIGVGWYSDEGINLVMERDYGLDGKLKEVRWKSEVKRRWSSPPPIE

SEQ ID NO: 212609 - protein, 546 aa, Glycine max
  Coding DNA Sequence Number=SeqID_95831
  Homolog annotation: Hit_ID=Q1STP5; Match level="QueryCoverage=69%, HitCoverage=71%, E-value=1e-30, Identity=27%"; Hit description=IMP dehydrogenase/GMP reductase
  Pfam annotation: Domain name=DUF1723; Domain location=186-232; Score =5.8; E_value=0.1; Accession=PF08330.1; Description=Protein of unknown function (DUF1723)
MVKTRGLGHALGRVIAIGLRRRDGDDSDGVPQRRRPTASAHKRRVPVIVDDVVPVVPADSRAVSEAEAAVAGNEPMVDVDAQDTGPETNTQDIGAQDVADEPEGFLGGPRDRSVLTEYADHVTASVWSGQVFIIFKSVNTSIQEHPELKLSSHGRKVHNLGRPIPTIKDMVAGTGLSALIACSIDTDDQGLISSFVERWHRETSSFHFQPLHTNEVVLLLVELLMVSAEVAMAEIGQCGGPYVCLQWLRDVYHHRCQTQHWIATARAYVLHLLGCTLFANKSATHVHVVHLQALRDLTFARQYAWGAIGLIHMYDQLNDASLSTSRQLAGYITLLQIYEHFSSVAECNADSDYDAVSPHACRWIATKKIVKKLRWGPAVVRYISERVMRQFGYVQCIPAHPVHSWVSYDDMDDTWTHYSNHLAAAGDLCVVSGQCAPDYIDWFFIISHPFMTTPQTDPPRDAYVTPPSHIPHEAAPTSTHADPDADEPRHAVACHAIKEALEQHLNALGTSTHEEVIQKCLRIARGVTEDRNVYVRSRRRRCTNQQ

SEQ ID NO: 212610 - protein, 108 aa, Glycine max
  Coding DNA Sequence Number=SeqID_95832
MWTIIDQYKEKLDLAASHELRLEDEHAKVSTLQAKREARERVINSLHGEAMMWTDRFTFTLNGSQELPRLLAKAKAMANVNSAPKAITFTLRHLYLCFDFDKINNIVS

SEQ ID NO: 212611 - protein, 129 aa, Glycine max
  Coding DNA Sequence Number=SeqID_95833
  Gene Ontology: Mol. function=transferase activity
MQQYSQWQHINSTHHPHQPGPTTTMDTIWSPPPQSFIKCNIDASIFKDLTSFGAGMYLRDASGNFLKAKSINAVGLQEPKEAQAWALLQAMIWTQHVTNSNVIFELDCKMVVDILLTASPKALLIFMSL

SEQ ID NO: 212612 - protein, 101 aa, Glycine max
  Coding DNA Sequence Number=SeqID_95834
MSTLSNEGVHQTKKRIATTAVCGWNGMKELDLIICSYGDDEERAKESVASSQKENIVGRVSRSFGKEISIVGKRDLDPMKYGSDIVKFWEDNGRDNTIKDL

SEQ ID NO: 212613 - protein, 138 aa, Glycine max
  Coding DNA Sequence Number=SeqID_95835
MEWFYMISHPFMSPPQVGEPPKHPPMVHNPIVVMPHPTVLPDDITTMPHPPATTPIDVEMPRNAVVVCQNIAERLQHMLDMTMMTAGTDAYTITDQYIRLARTISWWLTSEREKHHALLERKRNKDDVIPSALTSTMF

SEQ ID NO: 212614 - protein, 116 aa, Glycine max
  Coding DNA Sequence Number=SeqID_95836
MIALSGFIVAVEQNDADTKRACALSINSILRLRWLLGKERHPLHLPKPNLIEPNSLSKRLGRDTPILWCLFDEFKEELERRHWDEELTDFLDSNINVAMVKEFYGNLYDPEDKSPK

SEQ ID NO: 212615 - protein, 128 aa, Glycine max
  Coding DNA Sequence Number=SeqID_95837
  Gene Ontology: Mol. function=nucleic acid binding
  Homolog annotation: Hit_ID=Q1SLA4; Match level="QueryCoverage=59%, HitCoverage=14%, E-value=8e-15, Identity=50%"; Hit description=Zinc finger, CCHC-type; Lipocalin
MALATIVGRPIWVDATTRDIRRGKFMKVCMETDLNKLVTDVFCFVTIGIELNMKACIEYAHHVAAMATCQGSFQQNQFQQRWRNNNRRAKRRYLMQLAKEEPQVLAGMKVVVSDLIETTTLATSLAST

SEQ ID NO: 212616 - protein, 129 aa, Glycine max
  Coding DNA Sequence Number=SeqID_95838
MIVQTKGLDKLTSLILFRVTTLDTGQPLMPTSGLRAWGVYVLFGVLKIDVASNVPPCVFLTEGTYSTTCEIVELIQATSTLASINSRFWVVCPVGRYFSCEASRQKGNGYSMVKFDVEDDRTRVMEDGP

SEQ ID NO: 212617 - protein, 163 aa, Glycine max
  Coding DNA Sequence Number=SeqID_95839
  Gene Ontology: Mol. function=phosphoprotein phosphatase activity; Cellular component=nucleus; Biological process=multicellular organismal development
  Homolog annotation: Hit_ID=Q9SSX1; Match level="QueryCoverage=73%, HitCoverage=43%, E-value=3e-42, Identity=63%"; Hit description=OSEYA1
MAAASGMPEEETAMFPDKSVHPRLDVYVWDMDETLVLLNSLLKSSYAEAFNGLKDVQKGVEIGRTWENLILQICDDYFFYEQIENYNKPFLDALAQYDDGRDLSDYDFNEDELVSPHDDANKRKLAYRHRVIAQKYLQHMGKALYMLSYVLLSAYRGKFVQTV

SEQ ID NO: 212618 - protein, 292 aa, Glycine max
  Coding DNA Sequence Number=SeqID_95840
MAMKITMGPSWLIGLMPLKSLSVNVIGVDIDILDGMEMTLSRLTTKPFVDICVFAGYAFVDFSPLFYPFFDPHLGFCDDHLGDPRGPTIFSVVPWLWWYWQCLVLSNLGMGGGTGGSCIGIFALKASSRMVSNLCESVLPLARSRNSSMLLGGFLHKLSANLPGCRAINIECNATLGLREDSTHDCIVSGVEINLGDEHVKVLVWIGSSIITLQGVIPAEYILELFERSARPLGSITHKPPSYHGRPSFFGVPPYGVVPSPQYGLVAAGLCAPLVKKGHGESFTMAPQWMPN

SEQ ID NO: 212619 - protein, 422 aa, Glycine max
  Coding DNA Sequence Number=SeqID_95841
  Gene Ontology: Mol. function=RNA-directed DNA polymerase activity; Cellular component=chromatin; Biological process=RNA-dependent DNA replication
MILSTKAQNQSKNLLSYNSNGPKPGQCTQLNRDLTSHEYRHIAEVPQKNVAYSHGNHLICQVEELLKAQFIRKVRYSTWLANIVMVKKANGKWCMCTNYIDPNKACSKDVYPLPNIDKLVDNASGFQFLSFLNTYSGYNQIKMHLPNKEKIAFITKDTNFYYREVYGLHDHPFGIEENSDKCTTILEIHSPTNIGEVQKLNGRLALQSRFLPRLAEKAKPFYKLLWKTESFLWDEACMQAFLAFKKTITTPTILSQPQSQGTFAPLLLVAKEAINSALDQEEGKHQIPIYFISRILHDAEKRMVAWSIELSEFDLQYEPCSPMKTQFMPDFLEKFTGNALKFNFKASNNQVEYKALIVSLKLTKEVRARKLRCYNDVQLVQGHVTNKYQALDDFDYFEMYHTLQAPTIDTKEVMAGEEEEPD

SEQ ID NO: 212620 - protein, 110 aa, Glycine max
  Coding DNA Sequence Number=SeqID_95842
MSQQSQPQYVKDGAPIEEVGPFSEDNKEINLNNDSEDYIDEDENQNLNMELPSAIEHAYSMPAHMRDMSSNNPSKDHQFDYFMDCPEEPSMNQECSFKECSFLAKLMSNI

SEQ ID NO: 212621 - protein, 297 aa, Glycine max
  Coding DNA Sequence Number=SeqID_95843
  Gene Ontology: Mol. function=RNA-directed DNA polymerase activity; Biological process=RNA-dependent DNA replication
  Homolog annotation: Hit_ID=Q1SFJ7; Match level="QueryCoverage=53%, HitCoverage=20%, E-value=4e-09, Identity=27%"; Hit description=RNA -directed DNA polymerase
MGIHNDMGWEWKFSWRRLVFDNEIDATIFLREVEGQSIQQQQQQNDIWEWLGDPSGNYSTRSAYNLMWEEIAGGQKEDWSVELWKTKIPSKIMGQIAYKRAMEDMLCPFCNGAVEDKSHLFIHCTKIQPIWWESMSWMNIKGAFPFSLKQHFIQHISIQIEGLRAKRWRYWWLADYVTRNALVKHLRTHGIGGSPGTSFRIPDSEILLYTGIENSCDDNYDQASVESNSWSIEINNYDSANSPCNSKSSSVNYGARHLKFLLQSSRRRDTKEAASDLEDDVSVNSFSSRNNLKELCL

SEQ ID NO: 212622 - protein, 168 aa, Glycine max
  Coding DNA Sequence Number=SeqID_95844
MTIKIDLEKAYDKIKLDFFQETLNDFGRPSNILDLIWSCISTTRMRMLWNGEVLEEFNPRKGKYLGVPVFHKRTTKQDFDFLLEKSLWSELCTLKKARGSGLRSTRATNKAFMMKAGSRPSTRKDSWMRGSQIINFKKKLPYVPCPIRSCKLKWQIASILMGIGIWID

SEQ ID NO: 212623 - protein, 69 aa, Glycine max
  Coding DNA Sequence Number=SeqID_95845
MDMQAYLEEQYVARRVNSQKGTMTQGCGGAANNTRRRGSGAATMYPSFCGVDGGATESDLNRRRRLIAQ

SEQ ID NO: 212624 - protein, 52 aa, Glycine max
  Coding DNA Sequence Number=SeqID_95846
  Homolog annotation: Hit_ID=Q9LRE5; Match level="QueryCoverage=67%, HitCoverage=8%, E-value=3e-09, Identity=75%"; Hit description=DNA polymerase delta small subunit
MSDDFEKYSEAKDKLEFMEWTLRWRHVAPTVPNTLGMYIIYASMLLHFLGYQ

SEQ ID NO: 212625 - protein, 146 aa, Glycine max
  Coding DNA Sequence Number=SeqID_95847
MNMLKIEISQAARARKPCPPSSLCHREIALLFLLPPEKLPETAPSTPTLSSLKPTQPPTLPEKPTLSSLEPTEPPTLFLEVWLEENPTYTVATRVLKQSWVLKAQSFLREVHNKLLTLLAIILEFGALVWYATNIPNAFHINLFDI

SEQ ID NO: 212626 - protein, 139 aa, Glycine max
  Coding DNA Sequence Number=SeqID_95848
MAKQAKHVFYVQHSCDENWLVVLHGKTIGVNLEDDDSIPNTCHTHFSTHMPTINGKYEVDDVATPSSFLSLESTHSPSRSKRTRKTTRFISLSAKPMSLERPLVHVDSNTRKDIGPYTKKLRTYLVVITRNKVNFMYIN

SEQ ID NO: 212627 - protein, 229 aa, Glycine max
  Coding DNA Sequence Number=SeqID_95849
MSPRNHSVSGATLPAKELKLIWAGYRSTVSGGLGCRLSPSETIASQWVGKGDWVREAKVGVGLHEEVEEVRAVTIGHMALGGVKGWCAWTSRRISGVKPETEQLSKKGGGRLMMRLARSSKSDRYCATVPFCVNLNKAPVGSSYWEGVGDGDGVGEDVAGTESSGGFWWDRPWKGDQSTKLIGKAQGKGLVSRTNASRRKEEERILELVMLVPPTINIIPARSSDVILK

SEQ ID NO: 212628 - protein, 72 aa, Glycine max
  Coding DNA Sequence Number=SeqID_95850
MVLAAGVCTVLGGWMEVRHGGISNNGWGSDNKRNGDNGILVVQEMNHSGDDNGSDDIDCSNGYGNDNDHDDD

SEQ ID NO: 212629 - protein, 445 aa, Glycine max
  Coding DNA Sequence Number=SeqID_95851
  Gene Ontology: Mol. function=protein transporter activity; Cellular component=nuclear pore; Biological process=intracellular protein transport
  Homolog annotation: Hit_ID=Q94KB0; Match level="QueryCoverage=93%, HitCoverage=78%, E-value=3e-91, Identity=47%"; Hit description =Importin alpha 1
  Pfam annotation: Domain name=Arm; Domain location=134-175; Score =49.8; E_value=9.3e-12; Accession=PF00514.13; Description =Armadillobeta-catenin-like repeat
  Pfam annotation: Domain name=Arm; Domain location=177-219; Score =27.9; E_value=3.5e-05; Accession=PF00514.13; Description =Armadillobeta-catenin-like repeat
  Pfam annotation: Domain name=Arm; Domain location=221-260; Score =11.0; E_value=0.52; Accession=PF00514.13; Description=Armadillobeta -catenin-like repeat
  Pfam annotation: Domain name=Arm; Domain location=262-302; Score =28.5; E_value=2.4e-05; Accession=PF00514.13; Description =Armadillobeta-catenin-like repeat
  Pfam annotation: Domain name=Arm; Domain location=304-347; Score =26.2; E_value=0.00012; Accession=PF00514.13; Description =Armadillobeta-catenin-like repeat
  Pfam annotation: Domain name=Arm; Domain location=349-393; Score =28.5; E_value=2.4e-05; Accession=PF00514.13; Description =Armadillobeta-catenin-like repeat
  Pfam annotation: Domain name=Arm; Domain location=396-436; Score =21.7; E_value=0.0027; Accession=PF00514.13; Description =Armadillobeta-catenin-like repeat
  Pfam annotation: Domain name=Arm; Domain location=91-132; Score=43.6; E_value=6.8e-10; Accession=PF00514.13; Description=Armadillobeta -catenin-like repeat
  Pfam annotation: Domain name=HEAT; Domain location=140-177; Score =5.7; E_value=8.7; Accession=PF02985.12; Description=HEAT repeat
  Pfam annotation: Domain name=HEAT; Domain location=227-262; Score =12.5; E_value=1.3; Accession=PF02985.12; Description=HEAT repeat
  Pfam annotation: Domain name=HEAT; Domain location=268-304; Score =12.7; E_value=1.2; Accession=PF02985.12; Description=HEAT repeat
  Pfam annotation: Domain name=HEAT; Domain location=359-395; Score =2.3; E_value=23; Accession=PF02985.12; Description=HEAT repeat
  Pfam annotation: Domain name=HEAT; Domain location=402-438; Score =7.1; E_value=5.8; Accession=PF02985.12; Description=HEAT repeat
  Pfam annotation: Domain name=HEAT; Domain location=97-134; Score=5.3; E_value=9.7; Accession=PF02985.12; Description=HEAT repeat
  Pfam module annotation: Pfam domain module=Arm::Arm::Arm::Arm::Arm::Ar m::Arm::Arm::HEAT::HEAT::HEAT::HEAT::HEAT::HEAT; Domain location=134 -175::177-219::221-260::262-302::304-347::349-393::396-436::91 -132::140-177::...
  Pfam module annotation: Domain location=227-262::268-304::359 -395::402-438::97-134
MSLQPGSGSGSGSDSGSGSEKRKKSYDSEINLVDDTPLKKGRREELSSEIPSKEKLLEAIPEMKQRIWSECPDEQMDAMMHFTNLLGSIEPPRPIDEVIEAEVVPRFVQFLDMYDKPDLQFEAVWSLTNIASGKSHHTRVVVEHGAVPLLVKLLILSNNEDVIEQVVWAISNIAGESPKYRDLVLEEGVLLPLISLLGPPLPTMSMLLTTTWTLSNLVRGKPHVQFKQVEPLMPVLKTLIDMDNEEVLLNACSALYFLSNVSAGATQAIIEAEVCPKLVELLLYSSDSVSLLALQTLGNIAAGNDAQTQHVIDNQFLPPVRLLLFLTRERNEIIFRKACWAISNITAGNRTQIQAVIDAEIFPILVGFFCHHHADSDFDIKKEVVWAITNATRRGSADQIMDLADQGCAKPLSELLTHPNPEIVSICVEGLQKILMARISQQQRR

SEQ ID NO: 212630 - protein, 52 aa, Glycine max
  Coding DNA Sequence Number=SeqID_95852
MEEENVGKCLCNGLKQIEGSGCVSLCKGEKQKKVKLDYMKLSTSGLGQQGHE

SEQ ID NO: 212631 - protein, 143 aa, Glycine max
  Coding DNA Sequence Number=SeqID_95853
  Gene Ontology: Mol. function=nucleic acid binding; Cellular component= ribonucleoprotein complex; Biological process=mRNA processing
  Homolog annotation: Hit_ID=Q9FGS0; Match level="QueryCoverage=46%, HitCoverage=53%, E-value=5e-25, Identity=67%"; Hit description=RNA -binding protein-like
  Pfam annotation: Domain name=RRM_1; Domain location=59-125; Score =68.8; E_value=1.8e-17; Accession=PF00076.12; Description=RNA recognition motif. (a.k.a. RRM, R
  Subcellular localization annotation: CTP_CleavageSite=32; ConfidenceScore=5.41e-01
MAESCLLSSPSSLFHTKSKPSLFTSPSHSNFHASTPPSPHELATPAKIALLNHQKEAKLFVGNLPYDVDNQKLAMLFEQVGTVEIAEVIYNRKTDQSRGFRFVTMSTVEEAESAVEKFNRYIMKIGTSYAVNPCYEFVTVEKG

SEQ ID NO: 212632 - protein, 110 aa, Glycine max
  Coding DNA Sequence Number=SeqID_95854
  Gene Ontology: Mol. function=protein dimerization activity; Cellular component=nucleus; Biological process=regulation of transcription, DNA-dependent
  Homolog annotation: Hit_ID=Q9FGV1; Match level="QueryCoverage=79%, HitCoverage=10%, E-value=2e-44, Identity=92%"; Hit description=Auxin response factor 8
EEKKCLNSELWHACTGPLVSLPTSGTRVVYFPQGHSEQVAATTNREIDGHIPNYPSLPPQLICQLHNVTMHADVETDEVYAQMTLQPLTLIIVKNYKYAQQNAPRYNEMT

SEQ ID NO: 212633 - protein, 90 aa, Glycine max
  Coding DNA Sequence Number=SeqID_95855
  Gene Ontology: Mol. function=oxidoreductase activity
  Homolog annotation: Hit_ID=Q5QET8; Match level="QueryCoverage=68%, HitCoverage=71%, E-value=9e-12, Identity=58%"; Hit description=Auxin- induced putative aldo/keto reductase family protein
METNLLVCVCVCVCVCVCVCFLWTFTRTTKIKNLNQNMEALTVKLSEKDPREISEAVPTGDVAGGRYYNGLDHFSWKYANTPPKDSKIST

SEQ ID NO: 212634 - protein, 139 aa, Glycine max
  Coding DNA Sequence Number=SeqID_95856
  Gene Ontology: Mol. function=succinate-semialdehyde dehydrogenase [NAD(P)+] activity; Cellular component=cytoplasm; Biological process= metabolic process
  Homolog annotation: Hit_ID=Q8ZJZ3; Match level="QueryCoverage=97%, HitCoverage=30%, E-value=3e-42, Identity=60%"; Hit description =Putative NAD-dependent aldehyde dehydrogenase
  Pfam annotation: Domain name=Aldedh; Domain location=1-135; Score= -275.7; E_value=0.00073; Accession=PF00171.12; Description=Aldehyde dehydrogenase family
VDEAVAHGARVECGGRVIDGVGCYYQPTILTGLTPDNPAYYQEFFGPVAQLYVVADDRAAVALANDSHYGLGGSVWTRDIARGRNMASQIETGMVFINSQSDTAAELPFGGVKRSGYGRELSDLGLKEFANQKLVVVAG

SEQ ID NO: 212635 - protein, 232 aa, Glycine max
  Coding DNA Sequence Number=SeqID_95857
  Homolog annotation: Hit_ID=P19926; Match level="QueryCoverage=45%, HitCoverage=25%, E-value=6e-35, Identity=62%"; Hit description =Glucose-1-phosphatase precursor
MVGHDSNIASLLSALQVKPYELPGNDEKTPIGGQVVFERWHDAKNNKDLLKVEYVYQTADQLRNADVLSLKNPPKRVTLQLAGCDTDANGYCSWDQFTSALNNALQGTPLQPAAPAPAAQPPAAPAASDDAQAKADQASADKAAADKAAADKAAAQKAADAKAAEEKVKADKAAAQKAADDKAKAEKASAQKAAEEKAKADAAAAQKAQAEAAPAKPEADAKPAQQPAAASN

SEQ ID NO: 212636 - protein, 73 aa, Glycine max
  Coding DNA Sequence Number=SeqID_95858
MSVDEFLAQVAWPGVQPSPSGGEEPVPDSEDEPIHPEPFIFETDPIAQEEAATQEPTSPIRERLVSHRVIVRC

SEQ ID NO: 212637 - protein, 138 aa, Glycine max
  Coding DNA Sequence Number=SeqID_95859
MVCVSSSGIRNESGKEGAINNKGKKTHHDMIDNKAKQEAVAPTFPHSTKTIFAVRVKRHQNMGSKWKKAKVALGLNLCMFVPRTLDDDSPPHTVVSERLSDATLLSPANWSTSSSRPTTPVSSFHGLKLSKSSSKSSK

SEQ ID NO: 212638 - protein, 520 aa, Glycine max
  Coding DNA Sequence Number=SeqID_95860
  Gene Ontology: Mol. function=kinase activity; Cellular component =integral to membrane; Biological process=transport
  Homolog annotation: Hit_ID=Q7XA06; Match level="QueryCoverage=99%, HitCoverage=99%, E-value=1e-171, Identity=56%"; Hit description =Synaptotagmin C
  Pfam annotation: Domain name=C2; Domain location=238-322; Score =117.2; E_value=4.7e-32; Accession=PF00168.20; Description=C2 domain
  Pfam annotation: Domain name=C2; Domain location=403-485; Score=60.0; E_value=8e-15; Accession=PF00168.20; Description=C2 domain
  Pfam module annotation: Pfam domain module=C2::C2; Domain location =238-322::403-485
MGLVSSFLGILGFAVGIPLGLFVGFFLFVYSETKHVKDPVVRPISELGPNALQELLPEIPLWVKTPDYERVDWLNKFLLDTWPFLDTAICKIIRSRAQPIFFEYIGKYQIKAIEFDKLSLGTLPPTVCGIKVLETNGKELVMEQVIKWAGNPEIVLSVYVASLKITVQLVDLQIFAAPRVTLRPLVPTFPCFANIVVSLMEKETIKKQVANLYLWPQTLEIPILDESSVAIKKPVGILHVNVVRAQKLLKMDLLGTSDPYVKLSLTGDKLPAKKTTVKRKNLNPEWNEKFKLVVKDPQSQVLQLQVYDWDKVGGHDKLGMQLVPLKVLKAYENKEFTLDLLKDTNLNETPRKKPRGKIVVDLTFVPFKEDSSKFGGPSEGYSRKESGIDIVSDDEVQEGAGLLSIVIQEAEEVEGDHHNNPFAVLTFRGEKKRTKMMKKTRHPRWNEEFQFMLEEPPQHEKIHIEVMSKRKNFSFLPKKSLGHVEINLRDVVHNGHINDKYHLINSRNGVMHVEIRWKVV

SEQ ID NO: 212639 - protein, 62 aa, Glycine max
  Coding DNA Sequence Number=SeqID_95861
MEDNLYCKDLHEPIIYKDKVEDAIHPSCPCILALGIPCIESLSGGESRQRVSQMKRRCKYHK

SEQ ID NO: 212640 - protein, 151 aa, Glycine max
  Coding DNA Sequence Number=SeqID_95862
  Gene Ontology: Mol. function=transferase activity
  Homolog annotation: Hit_ID=Q1SE38; Match level="QueryCoverage=97%, HitCoverage=33%, E-value=2e-63, Identity=74%"; Hit description =Transferase
MESDSTRPAVAIHIVDMRKRIGEPFSRYTIGNILWPMMVFCEKVNADTSVRYLVSIAREKFGKLSRELFLIVKSDPNILGSTQCMDLPQGIETRSPIPMTSWCGLNFSGLDFGFGKPLWVGVRGGDQETLPNVAVIMETDEGMEAWLTMEM

SEQ ID NO: 212641 - protein, 144 aa, Glycine max
  Coding DNA Sequence Number=SeqID_95863
MRLNPLKCIFGVRAGKFLGYMLTKKGIEVLYLAVANEAISVALVQKKGELQRSIYFVSNTLQGVELQRSLEKSIRQILHRLDLARRMVSWAIEVGGGVGAEKVKQGYVFAEIHEGSYDHHLDGKALAKKAFREGYYFFQLSQMQ

SEQ ID NO: 212642 - protein, 203 aa, Glycine max
  Coding DNA Sequence Number=SeqID_95864
MAKKKNKRIKTIGHRPTAPRTKKEKEPTNGGPSGRGKWISHSPSPPTTPKATLWFFEEHYEALYKFSYPKKEMIQPKLKKLVEKKGTYYIDLVKFFYTTDHIDGDTGCLCIEVKEQRIVMTLEVWLDITRLSSEGVMVNQLGLKEAGFVFNKVEKYKSMMKHPSAYVAIVTKAKRKEHFGTGPLMLEHGFLAYVVAWIITPRG

SEQ ID NO: 212643 - protein, 165 aa, Glycine max
  Coding DNA Sequence Number=SeqID_95865
  Gene Ontology: Mol. function=helicase activity; Biological process =viral genome replication
  Homolog annotation: Hit_ID=Q9ZQ61; Match level="QueryCoverage=87%, HitCoverage=15%, E-value=2e-25, Identity=31%"; Hit description =Putative helicase
MMLGSYKGPTSFEDIWTVANIQYPTYREACFAMGFLQDDREYVEAIKEAKDWGTTNYLRKLFVLILLTGAMSKPEEVWNQCWHWLADDIAYQYTKSTINSYEQKTIYHRIIQAVNNNEGGMFFLYGFGGTGKTFIWRTLASSLRAENQIVIIVASSRIASLLLIS

SEQ ID NO: 212644 - protein, 194 aa, Glycine max
  Coding DNA Sequence Number=SeqID_95866
MTLLFPEEQKVQKTVSAPACYQAFCLTDGKRRGANNRKVSPRIMGISAYHGCRMTKLGLCLSSGPLPLDDKRGANNHKVSPRIMGISAYHGCRMTKLGSCVPSDTTVSEWQRGADNRKVSPRIMGISAYHGCRMTKLGFCVPSDTTVSEWQRGVRHMTSGLEKSPSENADISGKGQMTTLASAHQSHLGSLNDE

SEQ ID NO: 212645 - protein, 141 aa, Glycine max
  Coding DNA Sequence Number=SeqID_95867
  Homolog annotation: Hit_ID=Q1SAV4; Match level="QueryCoverage=32%, HitCoverage=13%, E-value=3e-07, Identity=50%"; Hit description =Integrase, catalytic region
MLEPIALPMLVVDNKPEKVLTQWTGLAPEDTSCEDWFDLKATYHLEDKVWSDTHENVKAKTKESFVEFGLFLVVEGVHSGRGSFHFFNRRSRDLSMFDQLEDVFMLQGEGEVKLNYVGDDTAMIRGITKEAITTICKEETE

SEQ ID NO: 212646 - protein, 243 aa, Glycine max
  Coding DNA Sequence Number=SeqID_95868
  Gene Ontology: Mol. function=RNA-directed DNA polymerase activity; Cellular component=chromatin; Biological process=chromatin assembly or disassembly
MKTRDGSWRFCVDYQALNAITIKDRFLISTVVEFLDELGGAKWFSKLDLLQGYHQILMKDDDVSKTAFRMHQGHYEFRFTEWRISPQVVQMLFCLDPNRIPGSLGFGNRSRTSTKKGEGYPTMATTAFISGLARFKWPPEADLAFQALKDAISAAPVLALPNFAIPFVVETDASEVGMGAMLSQEGHPIAFFSKQFCPKLTGASTYIRELAAITMVVKKWRQYLLGHCFIVLTEHQSLKELMA

SEQ ID NO: 212647 - protein, 122 aa, Glycine max
  Coding DNA Sequence Number=SeqID_95869
MVSELSSGTPGECGSVLATGVYRQLFGFNLPPEMLRLAGVVSISPSLNHEFETPYPSYVHLLPSSCNFELSTVSCLGKKIPSLDLGACDVLWGIRRFATKGRAHAELRATQGEQLPLESTNE

SEQ ID NO: 212648 - protein, 173 aa, Glycine max
  Coding DNA Sequence Number=SeqID_95870
  Gene Ontology: Mol. function=protein binding; Cellular component =intracellular; Biological process=small GTPase mediated signal transduction
  Homolog annotation: Hit_ID=Q8S7M7; Match level="QueryCoverage=84%, HitCoverage=51%, E-value=3e-47, Identity=45%"; Hit description =Putative leucine-rich repeat protein
  Pfam annotation: Domain name=LRR_1; Domain location=104-125; Score =12.5; E_value=1.3; Accession=PF00560.23; Description=Leucine Rich Repeat
  Pfam annotation: Domain name=LRR_1; Domain location=127-148; Score =13.7; E_value=0.68; Accession=PF00560.23; Description=Leucine Rich Repeat
  Pfam annotation: Domain name=LRR_1; Domain location=150-171; Score =10.1; E_value=3.7; Accession=PF00560.23; Description=Leucine Rich Repeat
  Pfam annotation: Domain name=LRR_1; Domain location=81-102; Score =6.1; E_value=20; Accession=PF00560.23; Description=Leucine Rich Repeat
  Pfam module annotation: Pfam domain module=LRR_1::LRR_1::LRR_1::LRR _1; Domain location=104-125::127-148::150-171::81-102
MVINEKSETLVKEEEEPLKNDLQVVKPSLSAGDERTEKLSRMKVATVIESCAGSGATTLELRGKLVDQMEWLQVSIGKLSDVTEMDLSENRLMALPTTIGGLKALTMLDLHSNQLINLPHSFGELINLVDLDLHANRLKSLPATFGNLTNIIDLDLSSNGFMDLPETIGNLRS

SEQ ID NO: 212649 - protein, 168 aa, Glycine max
  Coding DNA Sequence Number=SeqID_95871
  Gene Ontology: Mol. function=protein dimerization activity; Biological process=transposition, DNA-mediated
  Homolog annotation: Hit_ID=Q1SCU4; Match level="QueryCoverage=57%, HitCoverage=25%, E-value=8e-22, Identity=49%"; Hit description=Zinc finger, BED-type predicted; HAT dimerisation
MADQENAHEEITHGPGYTPSYSPLGITPSPSTTHAPLATPNESIVAHEVEETTDNLEGTTEKRTSRLKNNTRKELAKKIIMNEYPLSIVEHVGFNRYSTSLHPVFQVPWRNTIKREIFTIYQEERSIALNLLDSPQGRVAITLDMWTVSNKKRAAHYIDRSWTLKSQI

SEQ ID NO: 212650 - protein, 120 aa, Glycine max
  Coding DNA Sequence Number=SeqID_95872
MEEEVLEKSSLWWRDLCRTCGGMNEGDKFMFWRDKWLRDQLLAYKYPRVFLNSNHKDDIIANGELEEARLCKDITDSWSWRLNYFASYSIKKGDVLCPLYGSVEESLMHGLFLCQSSDEI

SEQ ID NO: 212651 - protein, 38 aa, Glycine max
  Coding DNA Sequence Number=SeqID_95873
MEAAWKSRLRKKGHKVLALALQSRASEVSGVDISSKYP

SEQ ID NO: 212652 - protein, 116 aa, Glycine max
  Coding DNA Sequence Number=SeqID_95874
  Gene Ontology: Mol. function=transferase activity
  Homolog annotation: Hit_ID=Q111J0; Match level="QueryCoverage=58%, HitCoverage=23%, E-value=9e-09, Identity=44%"; Hit description =Glutathione S-transferase-like
MAMKRQKVRRSSSGGYSCPVSKFHFSSTIPSPGSFHLYVGLECPWAHYTLIIHTLKGLEDAMPVSIASSDLNGSWEFKRPLCVSRVDRGDMIERKGVRVIVYWCVGMNPDKMKCFN

SEQ ID NO: 212653 - protein, 562 aa, Glycine max
  Coding DNA Sequence Number=SeqID_95875
  Gene Ontology: Mol. function=metal ion binding
  Homolog annotation: Hit_ID=Q9ZT97; Match level="QueryCoverage=85%, HitCoverage=63%, E-value=2e-30, Identity=36%"; Hit description =Putative inhibitor of apoptosis
MGCTMREKHIRANRRPRSVKPDSDSCDKDAISKSIAESGLKPFKYHLDLNDSSQSPNSNPNVEETGWGYCTEEQLEEILLKNLEFIYNEAVSKLVALGYDGDVAVKAILRNGHCYGGMDVLTNILHNSLAFLNTNSDGDGGGYSSNGGNLHESEPVFSDLRQLEEYSLAGMVCLLQQVRPHLSKGDAMWCLLMSDLHVGRASAMEIPVPDNGSTVPATGEGGANSAGVMAPALCRFHGGWGFGNGGGLEFPVNGIFSCGAEMNLQLQRDIEFPKRLNLSPSMKSLLKRNVAMFAAGFRANSKQLQAQVKAFPGRSTAPNLDSLDVSGTEVLAEQSGGDSENLDNQDAVNSVLSKFRDLNLDENLDLVAEDQKDEVIVSLFHQIRDLEKQVNERKDWAHQKAMQAARKLSSDLTELKMLRMEREETQKLKKGKPELEDTTMKRLSEMENALRKASGQLDLANAAVRRLETENAEMKAEMEASKLSASESVTACLEVAKREKKCLKKLLAWEKQKAKLQQDISDEKEKILKTQEILVQIRQCQKEAETTKKKRKRGFEHLPMFA

SEQ ID NO: 212654 - protein, 115 aa, Glycine max
  Coding DNA Sequence Number=SeqID_95876
MDAVEWGPKLHTSSWKCAFDKRGDLQKKGLRHSRDVVAFTDNSQIIDNSLELIDNVRDKHLLIDKRMPLVFCKSWIVHKPPSSKPLASERGFLVPKEFVPCRGSLSDLQGSSLDK

SEQ ID NO: 212655 - protein, 157 aa, Glycine max
  Coding DNA Sequence Number=SeqID_95877
MTTLTQIGMTLLLSNVLLSGPQLRPPSAYVLVGVCHPDTDERSCGPRMAPTGHPLDPENSKRALGFPALITCLCQYYRVHVTPSKDAGAPSPPRQADSAGPPSTERYLQHLVRQQAANHRGQVQIHEFLYRFSLSQQGQGSALFVCPTPEQFGAEVA

SEQ ID NO: 212656 - protein, 139 aa, Glycine max
  Coding DNA Sequence Number=SeqID_95878
  Subcellular localization annotation: CTP_CleavageSite=38; ConfidenceScore=5.01e-01
MASGMCARAPYQASSTCHPRHMRSSILLSLQCMPPTVSDMSHEHNTASPYVSPAVNDMYARAWYPKPKSDNPLVHTSKDLQNPWSALGESYRFTPPCLQYMPPTMSAMYARAQHLHYTRDLSNPSSALADPYKSKACPW

SEQ ID NO: 212657 - protein, 393 aa, Glycine max
  Coding DNA Sequence Number=SeqID_95879
VVRAIFVKLSVMDMFFGMSGKAYVMHAQYTCVCVTHRVGTYWSGGSYVLPFTIMSSFLSDFAIGLGDIDSRGSIKQPIMDREVISIGSSSFEDPCRCASDIESSSSERERYNDEDVRASPRVRHSQSVGSLSSTLTIVKLVNPEDSCKLFDPTRFKLYDEDLLILVERINKAIMSLHLASDPLAALDGKAPNLALIYATREAGQTYKWNCVTVTPNVPSSILAKRKRDDDVFSVPSTVKTPAINATAPTTLASSPPPFFVVQEVTHVTFEAIVSATQADIVVVLSSTFATPILPRGATYKLEQKTPIGFVSTFDKNLIRSNGVQNAIGFAKVFLQRSLEILEENRQRHQEIMQMLASLEAEVAKWRAIAHTLWSNRELSFKVGGVLTKLLHTD

SEQ ID NO: 212658 - protein, 40 aa, Glycine max
  Coding DNA Sequence Number=SeqID_95880
MAWSWKRYFKRFKEKIVHITWERQHIECKFFDWRKTAWEE

SEQ ID NO: 212659 - protein, 141 aa, Glycine max
  Coding DNA Sequence Number=SeqID_95881
MCSTHDEWHVCKSTMFKTQVRQFSGQSFDGCEENTGLSKTQGLPLVQKYKVCPWCTLLQNQSQGSKSSNKRTTTPLFGQDDLPPDCMTRPSIRCSSRLLLITIRGGKQQVKRTIPILVRKDLQLGAIQTQPFTTIKGEAPQ

SEQ ID NO: 212660 - protein, 256 aa, Glycine max
  Coding DNA Sequence Number=SeqID_95882
MKKSHVIVTDSGCTREQQWNNIGDGGGGTREWLVMIAREHTGGSVIAQGSDICGSTGSGEGWLQNEEKEETKGIKNESREENGKGSKRNEKMKKNEVGTLGKGKEDFGVGMIFFVFNYGRWWVRGAISTPLLCKNTPSLFFFSKNTQVNTLPFLTLHDKGFSITAFDNSTRTGSEETRRWHTAPTTLPGLVVAAMGRRTSQLTKATEFCEGSDSSRAIPIACVEVMLLRSQLQNGESSTEVSSHLFTIFFLKYPRN

SEQ ID NO: 212661 - protein, 80 aa, Glycine max
  Coding DNA Sequence Number=SeqID_95883
  Subcellular localization annotation: CTP_CleavageSite=33; ConfidenceScore=5.57e-01
MSRASSTKDSSTFGEIMLFRVRSHSTSKLGYTRMQGTTSRRMTTTMIMDTRSLRKTTTRIGEDGIASYFSFRLGIWRLAR

SEQ ID NO: 212662 - protein, 82 aa, Glycine max
  Coding DNA Sequence Number=SeqID_95884
  Homolog annotation: Hit_ID=Q6ETP2; Match level="QueryCoverage=40%, HitCoverage=3%, E-value=1e-09, Identity=97%"; Hit description =Putative calcium-transporting ATPase
MESDDGGKRGAPLASMAVLWKPCQRRRLRQKAKSWRALYADIGLAMGIQGIEVAKESSDIIILDDNFASVVKVSPHFLFGRF

SEQ ID NO: 212663 - protein, 197 aa, Glycine max
  Coding DNA Sequence Number=SeqID_95885
MEIDCSGNQNPNWEGFEEEITSQQAGYRAGAHCESPHDCARCAFGSTTTKSPATIATPTTPAPPPSPPTIVQEAESIMVSSSTVSAPLLSINVATTSTPMVLPSSSSVLMILPIAALQKTPTSFMSAFDKNLIRSAGVQNAIDFAKHPKVANATIAFAEAIRANSQLASKVSGALAKLLRAQLDGDDLFGCCKDLQA

SEQ ID NO: 212664 - protein, 125 aa, Glycine max
  Coding DNA Sequence Number=SeqID_95886
MEGVGMHTAEEKNPIENFDDYLDTLEDILAISHTDVTPFDHVTPATSMDNKMKCCKKKFSSFLAVDFLSLAKGNIKEVDKLLTDLEEKKLKVSSLKNEYIELKDKVTQREAKMDGLVLNIQEIDD

SEQ ID NO: 212665 - protein, 497 aa, Glycine max
  Coding DNA Sequence Number=SeqID_95887
  Homolog annotation: Hit_ID=Q94F64; Match level="QueryCoverage=96%, HitCoverage=92%, E-value=1e-105, Identity=43%"; Hit description=CDPK adapter protein 1
  Pfam annotation: Domain name=DUF1423; Domain location=88-472; Score= -247.9; E_value=0.02; Accession=PF07227.2; Description=Protein of unknown function (DUF1423)
MEMEMEMEMEENNGLLNLQAVAPEMSGEGFPYAPENWPEEGDIWGWRTGRRIVANRSRFQDRYLYLPNRLIRALKEEKEKENPGSGADSGPSSSSIRRQQHIFASKLAVERYIKTHFPDADIDAFFASFSWKIPALRSNGNAVPVAAVPLQQIAQEAYDSDSEGVVKCKARNKKCTSLVLEEIEKYSPAMPCDICCSEPGFCRDCCCILCCKTVSSAYGGYNYIKCQVNVGGGICGHVAHMECALRCLLAGKVGGSIGLDAQYHCRRCDGRTDMISHVNNLIQTCRAADLDAEIRKKILNLGACLLRGSQKPVAKELLCRIELAISKAYDQFDSLYQLKCGTNLEDIWKEDYSFVAHSADNGNDVMEVMVYDDPFEVRTGLESYDFLPRSLKLESEVDQVLQALRKSQELEYKVAEETLQDQKTYLKRLYQQLDREKYELACQNSSTSDVSSSAVRERKKQIRREVAKFEIMKKVANGFGRTSNDIVKEHFGLKVID

SEQ ID NO: 212666 - protein, 260 aa, Glycine max
  Coding DNA Sequence Number=SeqID_95888
  Gene Ontology: Mol. function=nucleoside-triphosphatase activity; Cellular component=membrane; Biological process=transport
  Homolog annotation: Hit_ID=UPI00005F7936; Match level="QueryCoverage =90%, HitCoverage=100%, E-value=2e-67, Identity=54%"; Hit description= COG0410: ABC-type branched-chain amino acid transport systems, ATPase component
  Pfam annotation: Domain name=ABC_tran; Domain location=49-237; Score =122.4; E_value=1.2e-33; Accession=PF00005.17; Description=ABC transporter
MTVCQTTQSGSIQANNLEGECQMLSLRSVNQFYGQNHILWDVDLDLPPGTCTGVLGSPGMGKTTLVNCIMGRLPINSGSMTWQEDGAPPENLLLQPAEQRARMGIGYVPQGRHIFSQMSVEDNLLIALMAAQDDRSRAIPEMVFDLFPALYSLRHQRSGELPMDQQQQLALARALVLQPKLLILDEPTEGMSPWLEEEMGNLIRRLNRDYGLTILLLEQHVSFIRRVADYFLLLHRGRNVAQGSVAQLDDVTVSKWLTAT

SEQ ID NO: 212667 - protein, 196 aa, Glycine max
  Coding DNA Sequence Number=SeqID_95889
  Gene Ontology: Mol. function=cobyrinic acid a,c-diamide synthase activity; Cellular component=integral to membrane; Biological process=cobalamin biosynthetic process
  Homolog annotation: Hit_ID=P13000; Match level="QueryCoverage=98%, HitCoverage=86%, E-value=5e-78, Identity=73%"; Hit description =Dethiobiotin synthetase
  Pfam annotation: Domain name=CbiA; Domain location=1-196; Score=26.8; E_value=4.4e-07; Accession=PF01656.13; Description=Cobyrinic acid a,c- diamide synthase
AAGLRTAGYKPVASGCEVTPDGVRNSDALALQRYSSLALSYEQVNPLAFIEPTSPHIVSAEEGRPIEFAQLSAGLRALEQQAEWVLVEGAGGWFTPLSATQTYADWVAAEQLPVILVVGVKLGCINHAMLTAEAVKARGLRLAGWIANDVQPPGKRHAEYLATLQQRIAAPFLGEIPWLSSAAQQADCGRYLTLPQ

SEQ ID NO: 212668 - protein, 284 aa, Glycine max
  Coding DNA Sequence Number=SeqID_95890
  Gene Ontology: Mol. function=DNA binding
  Homolog annotation: Hit_ID=Q1SFS3; Match level="QueryCoverage=56%, HitCoverage=30%, E-value=7e-21, Identity=35%"; Hit description =Lambda repressor-like, DNA-binding
EVFTEAVVSLAQYYDQPLRCFTFGDFQMVPTIEEFEEILGCPLGGRKPYLFSDFLPSLSKVAAVIGDSAKELDRIKQIRNGVVGLPRKYLEDKARDMASQEKWGAFADVLALLIFGVVLFPNVDGLVDLAAIDAFLAYHHSKESPVMAILADLFDTFDRRKSRLGPTFGWDRGQHDQLVPRWKEGKEGSSFLVGAPTEESLSPFLVRDLGAQGLKGLGWLSKLKFVDEENFEAPEEDEEVRALKLELGKARLAKEKFKSAATHIRKECTELQEENAATARTLEQ

SEQ ID NO: 212669 - protein, 93 aa, Glycine max
  Coding DNA Sequence Number=SeqID_95891
  Homolog annotation: Hit_ID=Q9LS22; Match level="QueryCoverage=98%, HitCoverage=16%, E-value=4e-13, Identity=44%"; Hit description =Arabidopsis thaliana genomic DNA, chromosome 5, BAC clone:F10E10
MAMADNESGRSTGNWRKKMVVLVDQLRGFPSLACKNMWKMGRDDPRRLIHAFKVGFSLTLVSLLYLLEPSFQGIGENVMWAVMTVVLVFEFTA

SEQ ID NO: 212670 - protein, 215 aa, Glycine max
  Coding DNA Sequence Number=SeqID_95892
METMSIIDVSSIVLIYGAIISMTISKVTIKKIKTPLQNREGTYKRGPNAQTQALGCLIKKVPDFDLFDHSYSSSEEVPRKVSNSGSSYFERLMDFNNMGEGSFGLHVGMEPPMALTEDQPSPLMAIMPPPPRENPVTTEAVERGNNGEVRVSPRNRCRHHGKTPSSPLCIIDFKWVRDDVLKFHSLITFPLCVGALWHQPELAKPGDARKMTLVA

SEQ ID NO: 212671 - protein, 56 aa, Glycine max
  Coding DNA Sequence Number=SeqID_95893
MMKKLTGSGESDDITMVRVVSDNNDNGDNRESQWWECSNALVKGRSGRVSLRLCRL

SEQ ID NO: 212672 - protein, 751 aa, Glycine max
  Coding DNA Sequence Number=SeqID_95894
  Gene Ontology: Mol. function=RNA-directed DNA polymerase activity; Biological process=RNA-dependent DNA replication
  Pfam annotation: Domain name=Ribosomal_S19; Domain location=695-750; Score=-16.7; E_value=0.09; Accession=PF00203.11; Description =Ribosomal protein S19
  Pfam annotation: Domain name=rve; Domain location=526-650; Score= -14.0; E_value=0.088; Accession=PF00665.16; Description=Integrase core domain
  Pfam module annotation: Pfam domain module=Ribosomal_S19::rve; Domain location=695-750::526-650
  Subcellular localization annotation: CTP_CleavageSite=42; ConfidenceScore=5.04e-01
MDDSTTSFHRSNLKGSRIDSLDTLVGRFSSQYATSQSHHMTSAALASLCQAEDEPLRKFMDIFGWLVVQIRDLNSKAGQNHEKGESSPRIDPYKYDKRHKLDKRQPLQRGPRYERYTPLTTNRANILKPAFSAEVPIQLPPRTSPRPDKIKELIQAGYLARLLKKPNNNKTGGLPGGSGKNDDHHKRRDNEQDRRDEPAQQIRGMNTITSGFSHGGLSKPSRKRHFHAIKGLDVNYVNVKPLRSLPFITFTDRYFKGINPINEDDPMVALSLEMSPTMIQPHYGPNLGFAGESRNQRLRGLDDQLPKTFNELGAIVTTPYLKMKFPTLTGKFFTIKAYWNQVMSIVEEFTIRTLTLYETIIGNHSDTFDVDPQDDTIDKGPKPMEELVKLQLAPKFGQCTQLNKDLISHEHRPIAEAKPVSQKKRKMGEELHKVASGEIDKLLKSQFPDAYLGYNKIKMHPLDKEKIAFIVEDADFYYRVMPFGLKNTRATFQRIMNQVFKHQIGQNVKEFADVPHIPADNLHNLGFPWPFAMWEMDILRPLPKAPGQKSLHGSMSYVGMDSPMPLSLTLKFKAQTYEEFLSRLGVKYLVTSVEHPQTNGQAEASNKVIFKALRTRLNKFKGLWKEELPIILRAYKRNMFLVKSPEACQTQGPPLVSLAKPKINMFLVKSPKAHQTQGSPMVSLAKPKIDVFLVESPKARQTQDPSLFLKEKTEAPTGEKLEPVCTHIRNMIIVSEMSGSITELYNEKTFK

SEQ ID NO: 212673 - protein, 52 aa, Glycine max
  Coding DNA Sequence Number=SeqID_95895
MGEGITKRDLPRTLLESWFDDGIPLDMKTIKKICKQWTTHLIEVKNMRFRKV

SEQ ID NO: 212674 - protein, 248 aa, Glycine max
  Coding DNA Sequence Number=SeqID_95896
MDDFACRPLVKHLGPIDGYAPPPSVNVNKPSRGEGDLIESIDETSIATTNIFYPLTPPPSSTLVVFASPPTTPGTFALAPTVLAPISSMALRLLSAGLTMASVVTSMAPSSFVVPPSDSTVIYFGMPFCSSCPNISLDQHPRLANATIAFIEAVKLNQQLSSRVDDVFAKLGSIRLDNDEVFGRYKDTLRANDDLACEGECFAKEREALDATMTESVRVAKKEFKEELIMFKKEVMEQYEKEFFKAVK

SEQ ID NO: 212675 - protein, 70 aa, Glycine max
  Coding DNA Sequence Number=SeqID_95897
MAGDVDSRKSTSGYLTTFAGEDIQDMLEEKFLQLEKVHSNDNWLDMMTKVIPTQKFEDCCQGVGVVVPPN

SEQ ID NO: 212676 - protein, 177 aa, Glycine max
  Coding DNA Sequence Number=SeqID_95898
  Gene Ontology: Mol. function=electron carrier activity; Biological process=electron transport
  Homolog annotation: Hit_ID=Q9LS22; Match level="QueryCoverage=99%, HitCoverage=32%, E-value=5e-62, Identity=65%"; Hit description =Arabidopsis thaliana genomic DNA, chromosome 5, BAC clone:F10E10
  Pfam annotation: Domain name=UPF0005; Domain location=1-177; Score =68.7; E_value=1.9e-17; Accession=PF01027.11; Description =Uncharacterised protein family UPF0005
  Subcellular localization annotation: CTP_CleavageSite=46; ConfidenceScore=5.04e-01
ATLCKGLNRGLGTVFAGALAFVVKYVANGSGRAFHAFFIGTTVCIVGAATSYMRFFPYIKKNYDYGVLIFLLTFNLITVSSYRTENLFKMIYQRFYTIAIGCAICLLMSLLVFPNWSGEALHNSTAFKLEGLAKSIEACVNEYFNGEMEASNDKISAEDIYKGYKAVLDSKTTDETL

SEQ ID NO: 212677 - protein, 135 aa, Glycine max
  Coding DNA Sequence Number=SeqID_95899
  Gene Ontology: Cellular component=chloroplast
  Homolog annotation: Hit_ID=P03938; Match level="QueryCoverage=62%, HitCoverage=61%, E-value=3e-20, Identity=83%"; Hit description =Hypothetical 14 kDa protein ycf68
MSPHGGDMDGGEKRKERDGVSLAFGIAGPGGRPARRAISSVVERAPDNCVGRIDGAIQVRSNVDPTFSSLVGSRAIRGGTTTAPLFLENSYIPYQYMDSYLSSTGLGLASMEKNGAPNNVSSQTKNYEIAPFILG

SEQ ID NO: 212678 - protein, 141 aa, Glycine max
  Coding DNA Sequence Number=SeqID_95900
  Homolog annotation: Hit_ID=Q9LS22; Match level="QueryCoverage=59%, HitCoverage=14%, E-value=4e-12, Identity=45%"; Hit description =Arabidopsis thaliana genomic DNA, chromosome 5, BAC clone:F10E10
MIPRVHADLEMVMASNESRRMITGNLRKHVLAFGDKLRMLPSLAWESVWKMGRDDPRRVIHAFKVGFSLIIIVSLLYLLEPIFNGIGENVIWAVMTVVVVFQFTAGTINQVINLCASIYTHKLISHQQIIGPNNTELKIFK

SEQ ID NO: 212679 - protein, 252 aa, Glycine max
  Coding DNA Sequence Number=SeqID_95901
  Homolog annotation: Hit_ID=Q9LS22; Match level="QueryCoverage=88%, HitCoverage=45%, E-value=1e-64, Identity=59%"; Hit description =Arabidopsis thaliana genomic DNA, chromosome 5, BAC clone:F10E10
  Pfam annotation: Domain name=UPF0005; Domain location=1-216; Score= -22.0; E_value=8.3e-05; Accession=PF01027.11; Description =Uncharacterised protein family UPF0005
ALHASWEPRHSCHKFPWQQYVKVGTVLRQFGYTVVALHGCLKTEIQTPPSVRVLFKNPCTKLASEVSKVLIELANSIRNRRRCSQEILSNNLQEALQDLNTAIKSQPRLFLGTSNDSQDTDILAIAAAHAAGLRNQGNGSLSSVKIDTSTLQECKAQCTEQPKEAAERKMLRHQLSIIAITSLEFSEALPFAAFASLLVETVAKLDLVIEEVEELGRLARFKDYRHDDKIVISCETPRVDVLEDHIPTRGAE

SEQ ID NO: 212680 - protein, 250 aa, Glycine max
  Coding DNA Sequence Number=SeqID_95902
  Homolog annotation: Hit_ID=Q9AVH2; Match level="QueryCoverage=57%, HitCoverage=63%, E-value=3e-50, Identity=60%"; Hit description =Putative senescence-associated protein
RQNEREPTNGSLFWPNIVEEERDTGLIGEGRIKATRAESQWIVAARPLCHLQYPVAYLSRLQRILPAARWELRFKASRRANPPHEGHQRHVPLGGRGPLLLVGKRTAGARVASSPDSDLEAFSHNPTHGSFAPLAFQPSAMTNSHVPYWWVNNPTLGEFCFTMIGRADIEGSKSNVAMNAWLPQASYPCGNFSDTSSFKFRRTKGSIGHAFTVRIRTGNQNQTSFYPFVPHEISVLVELILGHLRYLLTD

SEQ ID NO: 212681 - protein, 119 aa, Glycine max
  Coding DNA Sequence Number=SeqID_95903
  Subcellular localization annotation: CTP_CleavageSite=44; ConfidenceScore=5.41e-01
MVRMFRNEFQTWCSNFTMIQRCPLRRHLRNLPSTCVRPSSPLLSCGISSSFCHALRSERFVHCFIFCLSSHEVLKENNVADITWLANFTFWEKLHLSLNNVTSLESLIVAGNLEPQLLF

SEQ ID NO: 212682 - protein, 217 aa, Glycine max
  Coding DNA Sequence Number=SeqID_95904
MVDDVLLVYAIVASELCSAAFVASRLCSAALGTNSGGCLASEVEELGRLACFKECITDVKIIVSCETQQVDVLKDHNKPSRDGNENDMKDSKFAGIVFSLSSVDGILHSKLTITPGLERQAHVAYSVGTIGKNRANDKPQLLWATIDGLSATNFHECCDFKGPYNETTKPIILPKVGGSVMGGFAGPDTNSGIGDLRQAKSRSGLSYAERMGRNYFW

SEQ ID NO: 212683 - protein, 277 aa, Glycine max
  Coding DNA Sequence Number=SeqID_95905
  Gene Ontology: Mol. function=DNA binding; Cellular component=nucleus; Biological process=regulation of transcription
  Homolog annotation: Hit_ID=Q8LRL4; Match level="QueryCoverage=99%, HitCoverage=79%, E-value=1e-78, Identity=55%"; Hit description=Nam -like protein 11
  Pfam annotation: Domain name=NAM; Domain location=1-68; Score=70.9; E_ value=4e-18; Accession=PF02365.6; Description=No apical meristem (NAM) protein
MRDRKYPNGSRTNRATKAGYWKATGKDRKVVCQSNPSTVGYRKTLVFYLGRAPMGDRTDWVMHEYRLCDDLGQATPCFQGGFALCRVIKKNVKASVSQGEHKGKRAGSSSINGSDTSVKFSSEPFSNSGDASSQASHLNKESRYSSPITSPYNVAPMGEYNQASVETNPSNFWISPDMILDSSKDYPPLQNAVAECFPRYDLPSVMAPWQSLEHPETSSSLSYSNFNVEVDFADSLSQIGCMSPYSRQWNSMDFYGNGNVPYDGYDQTNSISYPELF

SEQ ID NO: 212684 - protein, 52 aa, Glycine max
  Coding DNA Sequence Number=SeqID_95906
  Gene Ontology: Mol. function=DNA binding; Cellular component=nucleus; Biological process=regulation of transcription
  Homolog annotation: Hit_ID=Q8LRL4; Match level="QueryCoverage=99%, HitCoverage=15%, E-value=9e-23, Identity=92%"; Hit description=Nam -like protein 11
  Pfam annotation: Domain name=NAM; Domain location=6-52; Score=-19.3; E_value=1.1e-05; Accession=PF02365.6; Description=No apical meristem (NAM) protein
MGGATLPPGFRFHPTDEELVGYYLKRKVEGLEIELEVIPVIDFYKFDPWELP

SEQ ID NO: 212685 - protein, 220 aa, Glycine max
  Coding DNA Sequence Number=SeqID_95907
MATDVSGGDGHTSRTIRDLEFAAQGWQRRGKGMLLGLRACLSIHFFYRVHGKNGAAGRATATTTALINLTRPSHSSKHRHFSSNNAPFSIQPFHSGFYHNRRLKPIITNCHGKLNSSGGGYAMDEAGFDEYDGVEDESDDEDDAESSVDLLIRFLQSMFKKVSKRAKKASRSVLPTVISPQLVSFAVDGTLLLASLSVVKALLEVLLLITEWLKWEFMAS

SEQ ID NO: 212686 - protein, 105 aa, Glycine max
  Coding DNA Sequence Number=SeqID_95908
MNERRRHQQEFLRHTLYRQSLLKQQYRSKWLKECDSNSKFSEEDWRRPCLDGVMFKRITCVDNIMLIGSFGEMEIRQTNWECGSAKSSGPDTVTFLDSLKSFGRL

SEQ ID NO: 212687 - protein, 101 aa, Glycine max
  Coding DNA Sequence Number=SeqID_95909
  Subcellular localization annotation: CTP_CleavageSite=32; ConfidenceScore=5.41e-01
MGGSSSSGSSSSFPPSFFKALLVVGLVCLLVLGSLGSGEGTRHPTTQWSQERVKHERVVGRDKPVDSAELDFNYMSKRRVPNGPDPIHNRNSSVKEKECAN

SEQ ID NO: 212688 - protein, 68 aa, Glycine max
  Coding DNA Sequence Number=SeqID_95910
MEMQKRNYFLRENKWTRNNYDNLVCSHYGLGSKHIKRTSSTLINSGRSWDLARQKFEDTSHPCFGIIN

SEQ ID NO: 212689 - protein, 89 aa, Glycine max
  Coding DNA Sequence Number=SeqID_95911
MVVEFERLLEGVAIRRQVEDCWCWVEDSSSMYMVRSTYTVLYNLRHKNAKLIILFPQQVLGSNNKMSNRIRILADKDLLPPMTGCQLSA

SEQ ID NO: 212690 - protein, 261 aa, Glycine max
  Coding DNA Sequence Number=SeqID_95912
MDEVKEVQERMKVNMEALKEQMATMMEAMMSMKKIMEVNTAAIVASSVIAEVDPIPPFGLNQINHPILDMVGQKGKELGSTGGLYFVQVQNKHAFLPYGLPPNYTPPNVAHTPNENVNNSTPILIENQQPQSDHAPIPQPMGGTHEIPHHNLANFEPCLEYAIEGQVVGGVPLPNTLEGPQFFPQTQPLHFAVGRALSAMPEKEKLDQIEERLRVVEGGKDYSLANMEDFCLVPDVVIPLKFKPAPSTLIWNLSESILGRT

SEQ ID NO: 212691 - protein, 85 aa, Glycine max
  Coding DNA Sequence Number=SeqID_95913
MSNTTTSSGKFPEEVFRESSGRSVLPEDVWLLPEEHFFRKLSGKGSFETSGRTPNGSSGRLRRQPFSPFFPASPALVFYPKVPLT

SEQ ID NO: 212692 - protein, 196 aa, Glycine max
  Coding DNA Sequence Number=SeqID_95914
MGKMADGGVFRKTLTKRLPEEHFFQKTPGTPLPETFRKKWFFRKNSGRTFKFSEELSGRSVSSGMIPEEPLLPESIMARTRGLGRAIGRVVGRDRPADEDAADVPERRRPTASVRRLRVHQMTTEGRDMAEDVADMTDDVPEQPTEAPEMRADAQGADSGEGQMVMMLLRDSLVVHVTRQCSHNLPSMLHMPFGVD

SEQ ID NO: 212693 - protein, 76 aa, Glycine max
  Coding DNA Sequence Number=SeqID_95915
  Gene Ontology: Mol. function=nucleic acid binding
  Homolog annotation: Hit_ID=Q1SIY6; Match level="QueryCoverage=71%, HitCoverage=4%, E-value=7e-09, Identity=45%"; Hit description =Integrase, catalytic region; Zinc finger, CCHC-type
MSTFAANVEPIIETYLEAIGFWKAAQENYPVVPLPDNPTVAQIRNGKESKARNVQAKARIFFAIEQQNSLGSALGI

SEQ ID NO: 212694 - protein, 118 aa, Glycine max
  Coding DNA Sequence Number=SeqID_95916
  Gene Ontology: Mol. function=hydrolase activity, hydrolyzing O -glycosyl compounds; Cellular component=cell wall; Biological process= carbohydrate metabolic process
  Homolog annotation: Hit_ID=Q38909; Match level="QueryCoverage=68%, HitCoverage=22%, E-value=5e-21, Identity=55%"; Hit description =Probable xyloglucan endotransglucosylase/hydrolase protein 28 precursor
MSFWGTLEAKTGGFRPMFMVMEASILVERKDMAYGLILLRISISTIFFGQILRSCMYDAIYLNPTCHIWLLQHFQPHGEKLQNIGHLANTCLKDIEAPLNFDNSMVTEDESNLVMTFD

SEQ ID NO: 212695 - protein, 130 aa, Glycine max
  Coding DNA Sequence Number=SeqID_95917
EEFEARLSQARSNATSSVGESQVTPLDPTEEQRLRSWCWVAAVGPKHKGRLYGIGDLVDTYKCRNDSFMQHTQGSSSCAEDATEINRPREELHQSKEDMRVFQSVVLQLLPLEAQNIIHYQQQSHQQHQH

SEQ ID NO: 212696 - protein, 147 aa, Glycine max
  Coding DNA Sequence Number=SeqID_95918
MQKTGGQMKTCDVKNRIFSRRRVPFMGLCTYGDKNRHFVEIKIKALVCCSTFSAKEITCNISLSKGTSERFVGDQYKRNRTSKNSKIEALVCSSSFSVKRKSCKKRNIAALVCASTFSAKQRTQEAKWQKTKRKNAEDEWANEEMSC

SEQ ID NO: 212697 - protein, 67 aa, Glycine max
  Coding DNA Sequence Number=SeqID_95919
VGRGNSKIAPFTHDTHTVCTHFEILGPIPGDAILPRKGPITRTMNKRLQEDWARAAEEGPRVLMNLR

SEQ ID NO: 212698 - protein, 101 aa, Glycine max
  Coding DNA Sequence Number=SeqID_95920
  Subcellular localization annotation: CTP_CleavageSite=42; ConfidenceScore=5.07e-01
RHPYLSQSSHAGVHNPHPPPRSGPGKVFPRYAQQLGDGLLVKAGGLVPPLAEFAPMVLLQDQWVAQELAEGICAKGNPLTPYPRAHISNSLLRGPGISVEL

SEQ ID NO: 212699 - protein, 57 aa, Glycine max
  Coding DNA Sequence Number=SeqID_95921
MCNIVSKCPSRMFFSRHFRLLKDRNRHCFFYKFFESIDPKGLDLLKKLYLTYMEQSN

SEQ ID NO: 212700 - protein, 97 aa, Glycine max
  Coding DNA Sequence Number=SeqID_95922
MTRDQVQKMIGQAMDFFFQRQRLENDQFRISMQNTITTQFSNLDGVLLQNLQVQMTMLGVIAALAPLALVHQPPPPKPTPPYVEPTPPPLSPAPPQV

SEQ ID NO: 212701 - protein, 136 aa, Glycine max
  Coding DNA Sequence Number=SeqID_95923
MQFESQQNLNFQIGNKRSKERVIDKENQKSGSQVTQPLQTSLKIVTGIQFKASKRPTTTMPNQNTKLKMGIKGGIDSRLSPPGSSKERVIDKENQKSGSQVTQPLQTSLKIVTGIQFKASKRPTTTMPNQNAELKM

SEQ ID NO: 212702 - protein, 113 aa, Glycine max
  Coding DNA Sequence Number=SeqID_95924
MAYTHIPVKVENPGESLETSNNSFQNCPMCGISCQCHDSTSDSPQISASPYQLDFTLYASGSYNAQWNAPGLLHDKHTLRSSRILRKMEVEEPWLGFMATVELLSGYGIKFSI

SEQ ID NO: 212703 - protein, 178 aa, Glycine max
  Coding DNA Sequence Number=SeqID_95925
  Gene Ontology: Mol. function=sequence-specific DNA binding; Cellular component=nucleus; Biological process=regulation of transcription, DNA-dependent
  Homolog annotation: Hit_ID=Q1SD46; Match level="QueryCoverage=91%, HitCoverage=69%, E-value=1e-40, Identity=51%"; Hit description =Transcription factor, MADS-box
  Pfam annotation: Domain name=SRF-TF; Domain location=25-75; Score =76.9; E_value=6.5e-20; Accession=PF00319.9; Description=SRF-type transcription factor (DNA-binding and dimerisation domain)
  Subcellular localization annotation: CTP_CleavageSite=47; ConfidenceScore=5.03e-01
MESNNMPDLNGVAKKTKGRQKIEMKKMRNESNLRVTFSKRRTGVFKKASELATLCGVDVAVIMFSPGNRVFSFGSPSVDSVVQRYKTQGPPPLLTLDLNKVHSTADEVELHTHLHCLSNQIAIEKKRTKDLNHLAKAAEDQFWWARPIESMTDSQLDKYKKMLEEFKRQLKEKCGNLN

SEQ ID NO: 212704 - protein, 98 aa, Glycine max
  Coding DNA Sequence Number=SeqID_95926
MKPPVGPTVPDNISRRSRKSLARQTLWWGHVETGTRVEGTEEEARVKKVGSRIWLVLERKKCQKYKREEGWDRVSERAYPMLKNCSDMTPHRFPAKTD

SEQ ID NO: 212705 - protein, 455 aa, Glycine max
  Coding DNA Sequence Number=SeqID_95927
MGHFEKPIIIKVEPLDEPINPTKVTEDTEVDIVSLTNKGDFASNKVEDPDATDYSSSFSGTTSDAENGSRLSDAEVESEFLGDNGLADTFDGSAFPKRKRKLTDHWRNFIRPLMWRCKWTELRIREINSQALKYSKELAGYDKGKHTAPDEFTLEEFGSKSLPFLGEQLRKNKKSDPDGYLADDFGNPVITEPHVNSTDRFGIGEDRPLLDFNETDVSFKQLLLTIDNTHTRIHKLKSNVDGIVSKKASKFSSSENLSFLLHHGDVQQTSSVESPTISAGNGDTASIGVIYNSTQHEPDFDIGDFVMQDSAISSYGGVPMIPDIIESTVGLLSAADVTLHSAFVVDSCEDVMVDNVLIHEVAETDEHTFASHYPMERLQDVEKDEEGEESPNPVPIPLSDINTATTNPAVSEEQSTIKSCMYRDGNIPKNKRKRGERKACSGGWSKKCSGDSENP

SEQ ID NO: 212706 - protein, 268 aa, Glycine max
  Coding DNA Sequence Number=SeqID_95928
MGMRDCMNYNPMLAIRQLGCPMRGFNETNAKILQRICKVWNIVDRKDKELRGSSNCVIDDYHKWLKTRTQEINWPPKLKSLNGKEDEIPEESEEVQVLKAELKKTRVVKEKLKMAVARVRKQCDELKDINMTMVEALEQETKRSRKEEWSRNKFREALWGSSNELKLRRAKRDELRIENMVLKDKLKACQMAKKSLMEQLSRTKENMLITINQYKKNVNLAASHGQRLEDEHAMVSTLQIEMEARERVIESLHVDAMKWMDRFALTLK

SEQ ID NO: 212707 - protein, 45 aa, Glycine max
  Coding DNA Sequence Number=SeqID_95929
MDEVFLSDLKITVEDQNVGKVAIMRKGVHISLPIEVKLVEVVHIE

SEQ ID NO: 212708 - protein, 190 aa, Glycine max
  Coding DNA Sequence Number=SeqID_95930
  Gene Ontology: Mol. function=nucleic acid binding; Cellular component= beta-galactosidase complex; Biological process=DNA integration
  Homolog annotation: Hit_ID=Q1S1G2; Match level="QueryCoverage=89%, HitCoverage=13%, E-value=2e-52, Identity=51%"; Hit description =Integrase, catalytic region; Zinc finger, CCHC-type; Peptidase aspartic, catalytic
MERHKARLLAKGYTQVEGQDYLDTFSPIAKLTTVYMMLPQGMQVPKTEQVCKLQRSLYGLKQASRQWYARLSSFLISHGYRQCASDHSLFLKHGFNIITALLVYMDDIVLSDNDLIEIQGITQLLDNAFKIKDFGDLRYFLSFEVGRKPTGINLCQRKYALDILNDAGMLGCILREPLYLEAHQKSNIEH

SEQ ID NO: 212709 - protein, 303 aa, Glycine max
  Coding DNA Sequence Number=SeqID_95931
  Gene Ontology: Mol. function=oxidoreductase activity; Cellular component=cytosol; Biological process=metabolic process
  Homolog annotation: Hit_ID=Q6RZU3; Match level="QueryCoverage=80%, HitCoverage=82%, E-value=5e-73, Identity=56%"; Hit description =Putative short-chain hydrogenase/reductase
  Pfam annotation: Domain name=Epimerase; Domain location=24-291; Score= -50.1; E_value=0.007; Accession=PF01370.11; Description=NAD dependent epimerasedehydratase family
  Pfam annotation: Domain name=KR; Domain location=22-169; Score=-59.2; E_value=0.00063; Accession=PF08659.1; Description=KR domain
  Pfam annotation: Domain name=adh_short; Domain location=22-175; Score= 17.5; E_value=3.9e-07; Accession=PF00106.15; Description=short chain dehydrogenase
  Pfam module annotation: Pfam domain module=Epimerase::KR::adh_short; Domain location=24-291::22-169::22-175
MEPEHYFPSPSLCLTRWWSRETVAVVTGGNKGIGFALVKRLAELGVSVVLTARDKQRGEAAVENLRKQGLGDYVHLLLLDVSDPLSVSTFASSFRAKFGATLDILVNNAGVSYNELDENSVEHAESVIKTNFYGSKSLIEALLPLFRFSSSSITRVLNVSSRLGSLNKVRNAEIRAMLEREDLMEEHIDGVVRAFLGDVRNGTWKSHGWPSYWTEYAVSKLALNAYSRMLAKRYSYEGSGLSVNCFCPGFTQTAMTKGKGTHTADDAAALAATLALLPPHLLPTGKFFSLGKKATFLNATSKL

SEQ ID NO: 212710 - protein, 205 aa, Glycine max
  Coding DNA Sequence Number=SeqID_95932
  Gene Ontology: Mol. function=chitin binding; Cellular component =extracellular region; Biological process=chitin metabolic process
  Homolog annotation: Hit_ID=UPI00006A17C9; Match level="QueryCoverage =80%, HitCoverage=100%, E-value=5e-20, Identity=31%"; Hit description= UPI00006A17C9 related cluster
MDPWVLVPSPLETSSSSEGCTPSPLEDYTSSPSEGCTPSPQRTACPRHQRITKGCMPSPSEGGMSSPSEDYTLSTLEDQTSSSSEDFTSSSSKDYTSSPSSGYTPSPFEGCMSLPLEDYTSSISEHYTSSPSEGYTLSSLEGFTPTPSKDYTSSTSEDYTFSTSNDYMSSTSEDYTSSPSEGYTLSLAFSGLHIRTLREFKVLCP

SEQ ID NO: 212711 - protein, 184 aa, Glycine max
  Coding DNA Sequence Number=SeqID_95933
MWGGGEGEVFNFSVDELPVQINVTIYDWYKCRENAVLGSVTVLVESEGQTGPVWHTLDSPSGKSLINWTDRIHCCGGATVVHQKPGPLQTIFDLPPDEVVIPFEDIDEIQRSELALINPAITIILRKGAGGHGVPPSSPLASADGRVGYMFASFWDRNKALENLQRVSKNFNEMLEAEKVTALA

SEQ ID NO: 212712 - protein, 56 aa, Glycine max
  Coding DNA Sequence Number=SeqID_95934
MGAGGHGVPPLGSPDGRVRYMFASFWNRNHAFRNLQRAAKNFHEMLEAEKKVTALA

SEQ ID NO: 212713 - protein, 104 aa, Glycine max
  Coding DNA Sequence Number=SeqID_95935
QINVTIYDWDIIWKSAVLGSVTVPVESEGQTGAVWHTLDSPSGQVCLLIKTIKLSGNASRINGYGGANPRRRMPPLERQWPTVVHQKPGPLQTIFDLHPDEVTD

SEQ ID NO: 212714 - protein, 153 aa, Glycine max
  Coding DNA Sequence Number=SeqID_95936
MKARWQSKSIGNDENNLVLIVGGGTVGERRIGVSGPCGEEAVGEDDEDGGGDGDFDLPQRGEEKREERGINKGDVHGVATETERVTKNQKLSGEGIALGFRECGVEAMGRRRRKSQSWTVGRERKRAQRSVKQNNRTRLLYLPSFFSCLKRPR

SEQ ID NO: 212715 - protein, 75 aa, Glycine max
  Coding DNA Sequence Number=SeqID_95937
  Pfam annotation: Domain name=C2; Domain location=16-75; Score=30.2; E_ value=7.1e-06; Accession=PF00168.20; Description=C2 domain
MGQSKVDSQASSAYLIKLELLAAKNLVGANLNGTSDPYAIITCGNEKRFSSMVPGSRNPMWGEEFNFSVDELPVQ

SEQ ID NO: 212716 - protein, 59 aa, Glycine max
  Coding DNA Sequence Number=SeqID_95938
MEFQEEVARRHWTQLAEPMTKYDPEGVMDKCSRVWGQWIPYDIDAINQFLGHPLILEEG

SEQ ID NO: 212717 - protein, 220 aa, Glycine max
  Coding DNA Sequence Number=SeqID_95939
MLAIRQLGYPMRGAPLEEIIAPFVARGFNEANVRILQRIHKAWNTVERKDKELRGSSNGVISGYHKWLRFRRQGITWLPKLKGPSGKEAEVLEESEEVQALKAELERMIMVKEKLKTTVTRVKKECDELRDVNMTMVEALKQETKRARKEEWSRNKFRGALWGSSNELKLRRAERDKSRVENMVLEDKLKACQRSKRSLTEQLSKTEENMLTIIDQYKEK

SEQ ID NO: 212718 - protein, 113 aa, Glycine max
  Coding DNA Sequence Number=SeqID_95940
MEKCIHVNSKMDKFDIFVPHPFTNISLLIQLSLEYGYKPLVCLLKRPALLSVDFQDRSIRDYLSCTLVGNQTAYFILPCYKVVKNKTTMVTSEPYTGAMKGTMHEPQVNLGAD

SEQ ID NO: 212719 - protein, 45 aa, Glycine max
  Coding DNA Sequence Number=SeqID_95941
GRLRQDDIKFLWMEETLTACLFEHRSESSIDKVSCDGGVDWKLVA

SEQ ID NO: 212720 - protein, 72 aa, Glycine max
  Coding DNA Sequence Number=SeqID_95942
MSKLIGKPFALYPFNSRRNPKLSWEKKESHEDSTSGGFNLFSISLTFGNSIGAVGRITDGISGNTRDAVIAG

SEQ ID NO: 212721 - protein, 106 aa, Glycine max
  Coding DNA Sequence Number=SeqID_95943
MESRKGKKQKGTGRTNINKEDEHKQRDSTHVHRSEQSTGQVATHENEERRSIKHDNEQKKAYNWTGVNRTEKKDKLWSFRTFSPFGDDRVRWHAETNYGHPAPFVI

SEQ ID NO: 212722 - protein, 191 aa, Glycine max
  Coding DNA Sequence Number=SeqID_95944
  Homolog annotation: Hit_ID=Q1SL03; Match level="QueryCoverage=63%, HitCoverage=40%, E-value=2e-09, Identity=28%"; Hit description =Ribosomal protein S2; Nucleic acid-binding, OB-fold
  Pfam annotation: Domain name=DUF223; Domain location=93-186; Score= -11.9; E_value=0.037; Accession=PF02721.5; Description=Domain of unknown function DUF223
MRELCLILIYIATVYALLFVLMPTTVSILFFLNRFLFSSNFFCQIAPVCHCLQNQKVMSRKENLISELHTRKGTWKIAVRITDLWQAREQNSKQTIEMGSKIGATLWQELFTELRDKLQCGSSYLIQNLRIVDNQSEYRVNPAPYLVYFLKTTSVKEIHRPEIPSNVYLITPFTDIISGLAPRHTLVGEFV

SEQ ID NO: 212723 - protein, 75 aa, Glycine max
  Coding DNA Sequence Number=SeqID_95945
MELHGLPNDGCQVPRSGQAKGSKDKTLISFEQNIIRPVNIPASGTCKNFENDQHRTTNIILILPNSFLSVDERHR

SEQ ID NO: 212724 - protein, 315 aa, Glycine max
  Coding DNA Sequence Number=SeqID_95946
MYLHDQAMIYPPGLHIFRATNVKMVANRVCFHLLVWDASKKKGFKLYYKAQMPSRTFWSQIVWIDSQKTSTSGYDGSDTIVYHDIVQVLQHTRKYHFDDVYVCFIRDDDNYSFIQCLLMLPIIQYEGTYKLKKMTEAQMIAYVTQLYEAQQKQRAEDATAMIAKQEAAEKELTKNGVMDETGKASNAAMIDEIELIILDPTSKQPTILNEAISRDKGDHDAVIVYSTSFSPTPLNYAQPATIIHDQVQDMIGQNIQQAQMSMVGAIVVPAPALVSQLPSLLASLQPPPQALAPIPPPPPSSPPPSQPLQLPPFQD

SEQ ID NO: 212725 - protein, 79 aa, Glycine max
  Coding DNA Sequence Number=SeqID_95947
MENHRFISKSDSAKARSNKKRIRQQKVHLDVQHSVHASFNPASSHTEDDYNQPKTPPHSVHATANRAPHDAEDHSHISK

SEQ ID NO: 212726 - protein, 300 aa, Glycine max
  Coding DNA Sequence Number=SeqID_95948
  Homolog annotation: Hit_ID=Q68AN0; Match level="QueryCoverage=39%, HitCoverage=15%, E-value=3e-07, Identity=31%"; Hit description=ABI-3 homolog
  Subcellular localization annotation: CTP_CleavageSite=22; ConfidenceScore=5.16e-01
MASVCTHLTLGMCSCTPSFACSSSTKKRKLCNKANVGSRNKKLKNEDDEVWKIKKVLKESDVGSMSRLILTREMAEKFVLPVLGDDADQIDSGVSVQIWDADTNSMHSLVFKRWVSSRSYVFIGNWIKDFVARRGLRKGDEIGFQWNPFKNGFEFSVLQDGVFSDENSMLVAFSVNLVSVNLCLWVLSPRNKLYYLLSYKSSEFLHGMPTIQIAVPGKVSLTCGEAHSHQTQSFERYLRNFRALRVYKIFDNHFSGPIPGSIFSPGKLEVRILTQNNSSGDLPEEIRNWQTLFCVQISSS

SEQ ID NO: 212727 - protein, 36 aa, Glycine max
  Coding DNA Sequence Number=SeqID_95949
MKSKKQERLKLKQSHNKMEGSVKCWLANICDVRRGK

SEQ ID NO: 212728 - protein, 102 aa, Glycine max
  Coding DNA Sequence Number=SeqID_95950
MASESWNFNLLGQPLALNFVASMANSLAMELSQKDCIEPVMLIKVIWSPSLSLPPLKSPNLSLHAWAMGHSQLSYKGCNCLPAIRENLRKFQCAILVFIFQP

SEQ ID NO: 212729 - protein, 218 aa, Glycine max
  Coding DNA Sequence Number=SeqID_95951
  Homolog annotation: Hit_ID=Q2L357; Match level="QueryCoverage=49%, HitCoverage=14%, E-value=2e-15, Identity=43%"; Hit description =Putative cyclin-related protein
MPVNYEAIAHTYNLVLLYSRAKVDPFLDVIDDHKLQAVSFAPDNLIAYGSKEDTDRALETLSELSTFNHQDQELFVSEIVRSLPELSSMREALLKEFSPDDMCPLGSQLTMDIPEKVSDTPNEARRISISITYDMPYKDMMHNCEESNFSLMRILLWIQSNQLVILFHCYVQPFRIILICSNFQEQVPMINFSKLLVVDSDENHETDQIQAKGPSGEG

SEQ ID NO: 212730 - protein, 338 aa, Glycine max
  Coding DNA Sequence Number=SeqID_95952
  Gene Ontology: Mol. function=nucleic acid binding; Cellular component= intracellular
  Homolog annotation: Hit_ID=Q5NDD4; Match level="QueryCoverage=72%, HitCoverage=88%, E-value=1e-100, Identity=68%"; Hit description =Putative zinc finger protein
  Pfam annotation: Domain name=AT_hook; Domain location=66-78; Score =14.9; E_value=0.061; Accession=PF02178.9; Description=AT hook motif
  Pfam annotation: Domain name=zf-AN1; Domain location=161-205; Score =8.6; E_value=0.0062; Accession=PF01428.7; Description=AN1-like Zinc finger
  Pfam annotation: Domain name=zf-C2H2; Domain location=272-295; Score =14.7; E_value=0.27; Accession=PF00096.16; Description=Zinc finger, C2H2 type
  Pfam annotation: Domain name=zf-C2H2; Domain location=309-332; Score =19.8; E_value=0.0098; Accession=PF00096.16; Description=Zinc finger, C2H2 type
  Pfam module annotation: Pfam domain module=AT_hook::zf-AN1::zf -C2H2::zf-C2H2; Domain location=66-78::161-205::272-295::309-332
MRMLRWMCGKTRQDKIKNEAIRGRVGVAPIVEKMVENRLRWFGHVERRPVDSVVRRVDQMERRQTIRGRGRPKKTIREVIKKDLEINGLDRSMVYCLDHRSYNKHQCTKADKQDVTVVICPLCAKGVRLVPDQDPNITWENHVNTECDPSNYEKVTKKKKCPVPGCRVILVFSNTIKCRDCTVEHCLKHRFGPDHKCPGPTKVESSFSFMNLLNGSKKQESKPKSSATSWSTSFLNAASNVRASAEAGVSKLSSWQTARGGVGQSHSSGQVEQCPQCGAKFSSVTTLVDHVQKVHERSRNRSGAKVTIDVCPKCSRGFRDPVALVEHVERDHGGSSRS

SEQ ID NO: 212731 - protein, 215 aa, Glycine max
  Coding DNA Sequence Number=SeqID_95953
  Gene Ontology: Mol. function=nucleic acid binding; Biological process= DNA integration
MKLVIQYGFEELAKLVAFDFLTSVGDPSTFQEAMNNQEKDKWMGAMEEEMKPCKRIKHDKQTYMEQPKGFSKGGFICSLEDNGTNSLINTCFRLTIDDDLSLAKKILGMEIHMDMKSKQLWLSEQSYVEKVLDKFNISNEKLVSTPLAKHFKLYVDQCSKTNAKVEYMSIYVSEIGCLMYVMVCTRPNLTHDRLTRKLWLAGPVKESGIEQGGVQ

SEQ ID NO: 212732 - protein, 626 aa, Glycine max
  Coding DNA Sequence Number=SeqID_95954
  Gene Ontology: Mol. function=protein dimerization activity; Cellular component=chromatin; Biological process=DNA integration
  Homolog annotation: Hit_ID=Q2R1C3; Match level="QueryCoverage=89%, HitCoverage=81%, E-value=1e-149, Identity=47%"; Hit description=HAT family dimerisation domain containing protein
  Pfam annotation: Domain name=DUF659; Domain location=129-275; Score =48.4; E_value=2.4e-11; Accession=PF04937.6; Description=Protein of unknown function (DUF 659)
  Pfam annotation: Domain name=hATC; Domain location=470-559; Score =47.7; E_value=3.8e-11; Accession=PF05699.5; Description=hAT family dimerisation domain
  Pfam module annotation: Pfam domain module=DUF659::hATC; Domain location=129-275::470-559
  Subcellular localization annotation: CTP_CleavageSite=53; ConfidenceScore=5.50e-01
MVLQAIFNGAFLTMSSSSTTLFIGSSASTLVVVDSRHHQFPSLLFLVCGGIATCSKVTDAYLVDLRRVCEEAENILKSKNVPLPTDKRTPTPPTLPPKRRKSSNIESAFNIEDKNHLRAEIVKIGFLPPSYNALRTSLLQQERSHIERLLQPIKSLWSLKGVTLVADGWIDAQRRPLINFMAISEEGPMFLKAIDGSKEYKDKHYMFDLLKDVIKELGYLIEAEFPNIFWTPCVVHTLNLGVKNICAAKNVNVNENVFNECGWIAEVIGDASFIKVFIMTHSMRLAIFNEFSSLKLLSIAETRFASMIVMLKRLKLLKRCLQNMVISDQWNSYREDDVRKATHVKELILNDIWWDKVDYILSFKDPIYSMIRICDTDASNLHLVYEMWDSMIEKVKTTIYRHDEVLENEVSSFFEVIHEILNSRYYSDNWLNEVPNSVPPHRDDELSSQRNKCLKRYFPHVNVRSKVYEEFSKFSSCAGDFDSFDSIEDRWALDPKTWWVMHGSSTPILQKVALKLLVQPCSSSCCERNWSTYSFIHSLKRNKMDPKRAEDLVVVHFNLRLLSRKEEGYKKGETILWDINGDVHDPLDDNAGVLEMANLSLDEPDLEAMLFLDDGNGREENETIRV

SEQ ID NO: 212733 - protein, 274 aa, Glycine max
  Coding DNA Sequence Number=SeqID_95955
  Homolog annotation: Hit_ID=UPI0000D9B3B9; Match level="QueryCoverage =91%, HitCoverage=77%, E-value=5e-10, Identity=24%"; Hit description =PREDICTED: similar to splicing factor 3a, subunit 2
  Subcellular localization annotation: CTP_CleavageSite=45; ConfidenceScore=5.50e-01
MNLLPSAVHASSTQESGAPRIYCLALFANSPFSTFLRSPMNLLPSAVHASSTHESGAPRIYCLALFANSPFSSFFAAPQIYCLALFANSTFPTFIRSPMNLLPSAVHESSTHEPGAQRIYYLALFANSPFSTFIWSPMNILPSAVHASSTHESGAPRIYCLALFANSPFSTFFGAPRIYCLALFANSPFSTFIRSPVNLLPSAVHASSTHESGAPQIYCLAPFANSPFSTFIRSPMNLLPSAVHASSNHESGAPQIYCLALLANFPFSTFFGAP

SEQ ID NO: 212734 - protein, 48 aa, Glycine max
  Coding DNA Sequence Number=SeqID_95956
MCSSPSSAEPPRKKKERRRSSWTNCGKGEGGRNQRLIFAFLLSPIKGK

SEQ ID NO: 212735 - protein, 156 aa, Glycine max
  Coding DNA Sequence Number=SeqID_95957
MSGLQRRESKICAPGVSSASLAKGGVRSLALIRRPLPSCYAYRGMAPMRHLVDLEKSNRTLGFPALIMGLCQFYRVPVTPSKAANHRGQVRLNESFYQYTLCQQGQDSSPYAWPTPEQFEAAVAWPGDWPDFETQAGPAGTSEGGEEAQEDEDMAT

SEQ ID NO: 212736 - protein, 279 aa, Glycine max
  Coding DNA Sequence Number=SeqID_95958
  Gene Ontology: Mol. function=DNA binding
  Homolog annotation: Hit_ID=Q1S0F5; Match level="QueryCoverage=47%, HitCoverage=25%, E-value=6e-16, Identity=35%"; Hit description=IMP dehydrogenase/GMP reductase
MDDFTVYGSSFDAFIAYHHSKEISVVAILADLYDTFDRRCVKNGTRILCCMPALYVWLVSHLFRQESRPTCPLHRHRLCTEKGKANWEQLLASVVGASINWFPRWKEGKVGVLSSCEGFSNVPLMGTRGCINYNHVLTIRQLGYPMRGAPSKESITPFITRGVRKAWDAAQRKDKELRGSSNGIIGGYHKWLRVRTQGLDWLPKLRAARKEEAETPEESEEVQALKAELEQARAVKEKFKSTAIKVRKEYDELKDINMATTEALEQETKKALKEEHDRN

SEQ ID NO: 212737 - protein, 53 aa, Glycine max
  Coding DNA Sequence Number=SeqID_95959
MGGIYRRVGDIECRWVSEVKKGRARARGEERKRGVGGHKTRTLSKDVSVEAFY

SEQ ID NO: 212738 - protein, 388 aa, Glycine max
  Coding DNA Sequence Number=SeqID_95960
  Gene Ontology: Mol. function=nucleic acid binding; Cellular component= intracellular; Biological process=chromatin modification
  Homolog annotation: Hit_ID=Q1SE31; Match level="QueryCoverage=99%, HitCoverage=25%, E-value=1e-155, Identity=69%"; Hit description =Transcription factor jumonji, jmjC; Transcription factor jumonji, JmjN; Zinc finger, C2H2-type
  Pfam annotation: Domain name=JmjC; Domain location=326-383; Score =15.4; E_value=2.9e-05; Accession=PF02373.13; Description=JmjC domain
  Pfam annotation: Domain name=JmjN; Domain location=17-58; Score=38.0; E_value=3.4e-08; Accession=PF02375.7; Description=jmjN domain
  Pfam module annotation: Pfam domain module=JmjC::JmjN; Domain location=326-383::17-58
MGSVEIPNWLKGLPLAPEFRPTDTEFADPIAYISKIEKEAANFGICKIIPPLPKPSKKYVFSNLNRSLLKCPDLGPDNSSLGVCNSSKTGYGDGSSDGVSRAVFTTRHQELGRSQNVKKAKGTVQNPLSGVHKQVWQSGEVYTLEQFESKSKSFAKSVLGSVKDVSPLVIESLFWKATLEKPIYVEYANDVPGSAFEESKGQFHYSHRRQRKKTYYKSRLDSSDCKQTEMGCVRDTQTDETKVASVQSHAGTCLQMNKSATTVSTFSSNDDSQSSKEKSSDASNEVQGTAGWKLSNSPWNLQVIARSSGSLTRFMPDDIPGVTSPMVYIGMLFSWFAWHVEDHELHSMNFLHTGSSKTWYAVPGDYAFAFEEVIRTEGYSGNIDHLGM

SEQ ID NO: 212739 - protein, 1175 aa, Glycine max
  Coding DNA Sequence Number=SeqID_95961
  Gene Ontology: Mol. function=nucleic acid binding; Cellular component= intracellular; Biological process=chromatin modification
  Homolog annotation: Hit_ID=Q1SE31; Match level="QueryCoverage=97%, HitCoverage=68%, E-value=0.0, Identity=59%"; Hit description =Transcription factor jumonji, jmjC; Transcription factor jumonji, JmjN; Zinc finger, C2H2-type
  Pfam annotation: Domain name=FYVE; Domain location=313-370; Score= -10.5; E_value=0.013; Accession=PF01363.12; Description=FYVE zinc finger
  Pfam annotation: Domain name=zf-C2H2; Domain location=1060-1085; Score=20.7; E_value=0.0053; Accession=PF00096.16; Description=Zinc finger, C2H2 type
  Pfam annotation: Domain name=zf-C2H2; Domain location=1086-1107; Score=6.4; E_value=2.1; Accession=PF00096.16; Description=Zinc finger, C2H2 type
  Pfam annotation: Domain name=zf-C2H2; Domain location=1113-1137; Score=21.0; E_value=0.0044; Accession=PF00096.16; Description=Zinc finger, C2H2 type
  Pfam annotation: Domain name=zf-C2H2; Domain location=1143-1169; Score=21.6; E_value=0.0027; Accession=PF00096.16; Description=Zinc finger, C2H2 type
  Pfam module annotation: Pfam domain module=FYVE::zf-C2H2::zf-C2H2::zf- C2H2::zf-C2H2; Domain location=313-370::1060-1085::1086-1107::1113 -1137::1143-1169
MASIVKEKPLICPWDLRNTLLFLSTLYCLGFNCGEAANFGTPQWLRVAKEAAVRRAAMNYLPMLSHQQLLYLLSMSFISRVPRTLLPGVHSSRLRDRQKEEREFLVKQAFIEDMLQENKLLSILLGKEATKKAVLWNADLLPDSSKDFQLPDLTSTTGTSMADMSNIISAEKSSHYLLDEMSLYMENLTNLDLGGDDLPCHFQTDSGALACVGCGILGFPFMTVIQPTKKLIMELLPDNHHLVQVSSPDSTACVNSSISSRKVITSRVIMMLLLVELFEVVLYFANQMTLNVEMSYYVICSSGDLSVSELSSVKELPDQSLNKCNKCWNTSSKFLRPRIFCLEHAVQISEMLQSKGGANVLIICHSDYQKIKAHARAVAEEIHSAFDYNEVPLDTASPENLTLIDLAIDGEEHDECEDWTSKLGINLRNCVHARNNSPSKQVPWILGTLLYDQCLASKSLALNWQSRRSRSKRSSCLAQTKPCDNIERKEDQLYGRIDDFPAEKKLLQYSRRKFKSKQRCFPVASMVCEFQEKSKNLSATLSGDHNNCVSKTELETENFRIDCSLLCVSASAEMSPMHPEIQIAEVPASTRLNDAKSQPSNSIPDRTLMIEEVGAEIEKQNMQESDVDRNNDLTLRHSKMHCNSSVSEICGKEGQDCLDKKCSSSLTNTTDRHIEMIRNSEITEAVIIDSKCDSLTLNGEGHQEYQSTCKSNNVEAALSPASLVNHSTLASVVGSFESPNNNYTAEKISSLIFLEKATEEEIDSLSERDKEPLIDDRQISEHTPKEVCEVRRELYASADLHSTVVLDSEMQHETQGGKDSRKEINQSTHVSAITRGEYAEGLNDEVIPKSVEQCQFENMNKITMEPVSSYVAKGENKCVTSSELGGSEVLVETCPKEDSCIQLISDKEKETEIHSVSRIDEEFCSGTDTSIDDSSSIQECSKIEQESCVTENINGIKTNLSQDNRELESCEFSTAVPRSNAGKNRKRKVKHTTKNKSNCDNFIRSPCEGLRPRAGKIAADKSGVEINQVDKENQVAKRARRSSEALVPRKNKKDDVKKPHKCDLDGCRMSFKTKAELQLHKRNLCPHEGCGKKFSSHKYALLHQRVHNDDRPLKCPWKGCSMSFKWAWARTEHMRVHTGEKPYHCKVEGCGLSFRFVSDFSRHRRKTGHHVKPPA

SEQ ID NO: 212740 - protein, 370 aa, Glycine max
  Coding DNA Sequence Number=SeqID_95962
  Gene Ontology: Mol. function=ATP binding; Cellular component =membrane; Biological process=anion transport
  Homolog annotation: Hit_ID=Q1SE25; Match level="QueryCoverage=99%, HitCoverage=99%, E-value=1e-158, Identity=75%"; Hit description =Anion-transporting ATPase
  Pfam annotation: Domain name=ArsA_ATPase; Domain location=79-370; Score=160.3; E_value=5e-45; Accession=PF02374.6; Description=Anion -transporting ATPase
  Pfam annotation: Domain name=CbiA; Domain location=81-346; Score= -25.9; E_value=0.011; Accession=PF01656.13; Description=Cobyrinic acid a,c-diamide synthase
  Pfam module annotation: Pfam domain module=ArsA_ATPase::CbiA; Domain location=79-370::81-346
  Subcellular localization annotation: CTP_CleavageSite=45; ConfidenceScore=5.70e-01
MACGSVLSSFLHITNSMAIKGVLSFAPNPPLLLRLPKAVTFLSFSASTKSPTKSFQVRSIAGTTEAASGFDEMVSGTKRKYYMLGGKGGVGKTSCAASLAVKFANNGHPTLVVSTDPAHSLSDSFAQDLTGGALVPVEGPDYPLFALEINPEKSREEFRNAAQKNGGTGVKDFMDGMGLGMIADQGHTLRLLSLPDFLDASIGKILKLRQKIASATSAIKSVFGQEETRQNAADKLEKLRERMIKVRELFRDTDSTEFVIVTIPTYHQPYRDELKDFGFKVMAISESSRLSASLKKENVPVKRLIVNQILPPSTSDCKFCAMKRKDQMRALDIVQNDPELSSLLMIQAPLIDVEIRGVPALKFLGDIIWK

SEQ ID NO: 212741 - protein, 166 aa, Glycine max
  Coding DNA Sequence Number=SeqID_95963
  Gene Ontology: Cellular component=mitochondrion
  Homolog annotation: Hit_ID=Q1SE29; Match level="QueryCoverage=97%, HitCoverage=92%, E-value=1e-48, Identity=58%"; Hit description=Zinc finger, Zim17-type
  Pfam annotation: Domain name=zf-DNL; Domain location=82-146; Score =99.0; E_value=1.4e-26; Accession=PF05180.3; Description=DNL zinc finger
MAARMLQKRLISIFSRQTHHPITQGMSLPSLFADFSAKNNEADTLKSSPNPDEVATSISVNETSSIKFSAKSSLKTSSRHDLAMVFTCKVCETRSIKTVCRESYEKGVVVARCGGCNNLHLIADHLGWFGEPGSIEDFLASRGEEVKRGSVDTLNLTLEDLAGRKP

SEQ ID NO: 212742 - protein, 291 aa, Glycine max
  Coding DNA Sequence Number=SeqID_95964
MATHEMDPDVVRWGLHLLDVCTLSHHGSPSIVTQYDPDLSRVEYVTEGFCQHEYVDNDEAVARAYQEELSQLDSMGASGISNFENEGMQGSVYTQDWPQSSNGNYNFGNESCQNSVDESYNMKEVENYGPTPSERENGMHENDVYGSSSGSVEVPVISDDFWDSLEISDESSLDGEVGKRLNQMVPIPTRVINHVLSRHNSGVAEQSAPSLLRHLLHSSWMLWPSLQKITAICSFAAAPLFAPSLDRLCDLCHHRTAFCSATFLELPVRQIGWVKRRGTADGKEARFFFLG

SEQ ID NO: 212743 - protein, 782 aa, Glycine max
  Coding DNA Sequence Number=SeqID_95965
  Gene Ontology: Mol. function=nucleoside-triphosphatase activity; Cellular component=integral to membrane; Biological process=transport
  Homolog annotation: Hit_ID=Q1SE23; Match level="QueryCoverage=97%, HitCoverage=68%, E-value=0.0, Identity=77%"; Hit description =Lipocalin; AAA ATPase
  Pfam annotation: Domain name=ABC2_membrane; Domain location=583-780; Score=-2.0; E_value=0.0024; Accession=PF01061.14; Description=ABC-2 type transporter
  Pfam annotation: Domain name=ABC_tran; Domain location=253-443; Score= 128.2; E_value=2.3e-35; Accession=PF00005.17; Description=ABC transporter
  Pfam annotation: Domain name=DUF258; Domain location=45-353; Score= -182.2; E_value=0.093; Accession=PF03193.7; Description=Protein of unknown function, DUF258
  Pfam module annotation: Pfam domain module=ABC2_membrane::ABC _tran::DUF258; Domain location=583-780::253-443::45-353
MALHSCSIIAGWAPHLRKAALSTLLLIIYNCSDQVLTTRERRVAKSREAAARSARKTANARQRWQFAKDATKKGAMGLQAQLSRTFKKDVANLEKVKILNQATSEADIELLSHSGPTTSSMVASSSLAPKEKGKEPNGLMQIIHEIENDPDINDHLHTEIETRDTGVRANAPKGKQPHTHSQIFKYAYSQLEKEKAEQQENKKLTFSGVIKMATNTEKRKRPLMEISFKDLTLTLKAQNKHILRYVTGKIKPGRITAVMGPSGAGKTTFLSALAGKALGCSVTGSIFINGKNESIHSFKKITGFVPQDDVVHGNLTVEENLWFSAQCRLSADLSKPEKVLVVERVIEFLGLQSVRNALVGTVEKRGISGGQRKRVNVGLEMVMEPSLLILDEPTSGLDSASSQLLLRALRREALEGVNICMVVHQPSYALFKMFDDLILLGKGGLTVYHGSAKKVEEYFSGLGINIPERINPPDYFIDILEGITTPGGSSGLSYKELPVRWMLHNGYPIPLDMRQNAVQFDMSQSVNSANEIDPNGSGHVGKTFAGELWQDMRNNVELKREKIRLNFFKSKDLSNRKTPGVFKQYKYFLIRVGKQRLREARIQAIDYLILLLAGACLGSLTKSGDQTFGAAGYTYTVIAVSLLCKIAALRSFSLDKLHYWRESDSGMSSLAYFLSKDTIDLFNTLIKPVVYLSMFYFFTNPISTFADNYVVLLCLVYCVTGIAYALSIFFEPGAAQLWSVLLPVVLTLIATQPKDSKVLKNIANLCYSKWALQALVVANAER

SEQ ID NO: 212744 - protein, 160 aa, Glycine max
  Coding DNA Sequence Number=SeqID_95966
  Gene Ontology: Mol. function=peptidase activity
  Homolog annotation: Hit_ID=Q1SE21; Match level="QueryCoverage=52%, HitCoverage=41%, E-value=5e-36, Identity=83%"; Hit description =Ovarian tumour, otubain
  Pfam annotation: Domain name=OTU; Domain location=34-137; Score=79.7; E_value=9.4e-21; Accession=PF02338.9; Description=OTU-like cysteine protease
MSYLCLFVIEHSSKFKNLVFLRLQLYDLIECKVQGDGNCQFRSLSDQLYRSPDHHKFVRQQIVQQLKSYPDLYAGYVPMAYIDYLKNMSKSGEWGDHVTLQAAADWIYSKNKLTPMPEGSSLFKGMGECHCMQPCLYPNAYAKRLFPDSNFTVVPGLALK

SEQ ID NO: 212745 - protein, 355 aa, Glycine max
  Coding DNA Sequence Number=SeqID_95967
  Gene Ontology: Mol. function=RNA binding; Cellular component=voltage -gated potassium channel complex; Biological process=potassium ion transport
  Homolog annotation: Hit_ID=Q1SE18; Match level="QueryCoverage=86%, HitCoverage=32%, E-value=1e-159, Identity=60%"; Hit description =Nucleic acid binding NABP
  Pfam annotation: Domain name=PUF; Domain location=132-167; Score =42.1; E_value=2e-09; Accession=PF00806.9; Description=Pumilio-family RNA binding repeat
  Pfam annotation: Domain name=PUF; Domain location=169-203; Score =31.4; E_value=3.1e-06; Accession=PF00806.9; Description=Pumilio -family RNA binding repeat
  Pfam annotation: Domain name=PUF; Domain location=205-239; Score =33.1; E_value=9.4e-07; Accession=PF00806.9; Description=Pumilio -family RNA binding repeat
  Pfam annotation: Domain name=PUF; Domain location=24-58; Score=40.6; E_value=5.3e-09; Accession=PF00806.9; Description=Pumilio-family RNA binding repeat
  Pfam annotation: Domain name=PUF; Domain location=247-281; Score =27.4; E_value=5e-05; Accession=PF00806.9; Description=Pumilio-family RNA binding repeat
  Pfam annotation: Domain name=PUF; Domain location=60-94; Score=36.3; E_value=1.1e-07; Accession=PF00806.9; Description=Pumilio-family RNA binding repeat
  Pfam annotation: Domain name=PUF; Domain location=96-130; Score=35.4; E_value=2e-07; Accession=PF00806.9; Description=Pumilio-family RNA binding repeat
  Pfam module annotation: Pfam domain module=PUF::PUF::PUF::PUF::PUF::PU F::PUF; Domain location=132-167::169-203::205-239::24-58::247-281::60- 94::96-130
MVAAFPPQKLETASVEEKTKIFPEIIPHARALMTDVFGNYVIQKFFEHGTDSQRKELASQLTGHVLPLSLQMYGCRVIQKALEVVDADQQGQLVSELNGAIMKCVRDQNGNHVIQKCIECVPQDKIQFIVSSFYGQVVLLSTHPYGCRVIQRVLEHCDDLNTQQIIMDEIMQSVGTLAQDQYGNYVIQHIVEHGKPHERTAIISKLAGQIVKMSQQKFASNVIEKCLAFGSPEERQILVNEMLGTSDENEPLQAMMKDPFGNYVVQKVLETCDDRSLELILSRIKVHLNALKRYTYGKHIVSRVEKLITTGGEKCKDLGVFDFYFKNCLVFKIQLNKAVQTAGGKYCKEQNKVLN

SEQ ID NO: 212746 - protein, 437 aa, Glycine max
  Coding DNA Sequence Number=SeqID_95968
  Gene Ontology: Mol. function=RNA binding
  Homolog annotation: Hit_ID=Q1SE18; Match level="QueryCoverage=97%, HitCoverage=42%, E-value=1e-163, Identity=71%"; Hit description =Nucleic acid binding NABP
  Pfam annotation: Domain name=NABP; Domain location=72-414; Score =108.6; E_value=1.8e-29; Accession=PF07990.3; Description=Nucleic acid binding protein NABP
  Subcellular localization annotation: CTP_CleavageSite=74; ConfidenceScore=5.02e-01
MSRPASHNAFGDIMGSTGIVDRESFEGLRSSASTPGLVGLQNHSLNLSHSFAPAVGTSPSRVKTPEAQVIGRPVASAASQMGNKVFSVENIGMGLGTQHGHSSNMTDLTDVVSSLAGLNLSGARHAEQDSLLKSKLQMEVDNHADVLLSTQSNVNLPRRNDIATNLNTFSSNEHVNLLKKTASSANLRSKLHSTGNASSFPNADFTGHVPSAYLVNSKLNSVYNNNLETALRLRRDGQSLDAQGNHVGPELHSSTLNPHLIQCLQQSSDYSMQGMSSSGYPLQMRNFPDASHGDLEGLRKAYLETLLTQQKQQYELPLLSKSGLTNGFYGSQPYGLGMPYSGKQIANSTLPSLGSGNPLFENERISRLNSMMRSSVGGSGGSWHADIGNNIEGRFASSLLDEFKNKKTRPFELPDIIDHVVQFTYQSCTSNVFSSDM

SEQ ID NO: 212747 - protein, 262 aa, Glycine max
  Coding DNA Sequence Number=SeqID_95969
  Gene Ontology: Mol. function=RNA binding
  Homolog annotation: Hit_ID=Q1SE18; Match level="QueryCoverage=84%, HitCoverage=22%, E-value=6e-92, Identity=78%"; Hit description =Nucleic acid binding NABP
MGFSILLAERIGLRVTSSLDMQMGGGSKIDLQTLDEGMQPLANGTIEDTLQSELEKILQEQRNQQFINRERDFNISRSGSAPPTVEGSFSAFGSLRNSDFGSINDRSNNNGLLTEDDIRSHPAYLSYYYSHESINPRLPPPLLSKEDWRVAQRFHGGGSSSIEGFGDWRKNVATNGDSSSLFSMQPGFSVQQAENDLMELRKSSGWNVSRQGSSQMLDRHMDGLTRMSGAGLGGRRTGFNDILQFWLNSVQHSRTYRRCLCC

SEQ ID NO: 212748 - protein, 165 aa, Glycine max
  Coding DNA Sequence Number=SeqID_95970
  Homolog annotation: Hit_ID=Q9SK32; Match level="QueryCoverage=96%, HitCoverage=47%, E-value=5e-25, Identity=58%"; Hit description =Expressed protein
MELNEDPGPIDNYVLYDQDNHVSSAVWVGLERGVLRCHEHTSMLDQWKLTPKQIKLVEKAEYQRTCRMVKVTWLKEFFSKCPEDASQEEIERCTRAYLLYLLGSTIFSTTTGNKVPVMYLSLFEDFDKAGKFAGGAGALAFLYRELGNSSLESQSTTSGCLTLVQ

SEQ ID NO: 212749 - protein, 249 aa, Glycine max
  Coding DNA Sequence Number=SeqID_95971
  Pfam annotation: Domain name=DUF1442; Domain location=32-214; Score =53.0; E_value=1e-12; Accession=PF07279.2; Description=Protein of unknown function (DUF1442)
MSKFKTTQKLKVKITKHVHKRERRLSRTQHTMKLVWSPELALKSYMDTIRSCEKFKEAGVPKLLSAMAIGWNTKFILESWSCGGSVAESVGLAIVACNMWARHVCLVPDQPSTVQYITALAKMRVSPRVDTPSFNPVPLPLLPLRLLPPLHRRRRLHRRLPLAPRLCHLCPRALLRPRRHEEVLPTPQGQAPVHCGPRLRLFGRLRGYLQCFQRGCGAWWGRLWSFHQNYGGRVPCGAFDERVEDHGPA

SEQ ID NO: 212750 - protein, 86 aa, Glycine max
  Coding DNA Sequence Number=SeqID_95972
  Homolog annotation: Hit_ID=Q1SE17; Match level="QueryCoverage=98%, HitCoverage=100%, E-value=9e-31, Identity=71%"; Hit description =Amino acid/polyamine transporter II
MSLEELIPSNHAKSYLYSIFIRTGLVLSTLVIGLSVPFFGLVMSLIGSLLTMLVAALCITIITVGVVCSAFGSYSALAEIVKSLRG

SEQ ID NO: 212751 - protein, 314 aa, Glycine max
  Coding DNA Sequence Number=SeqID_95973
  Gene Ontology: Mol. function=L-isoleucine transporter activity; Cellular component=integral to membrane; Biological process=amino acid transport
  Homolog annotation: Hit_ID=Q1SE16; Match level="QueryCoverage=88%, HitCoverage=58%, E-value=1e-124, Identity=79%"; Hit description =Amino acid/polyamine transporter II
  Pfam annotation: Domain name=Aa_trans; Domain location=14-313; Score=- 27.6; E_value=2e-06; Accession=PF01490.8; Description=Transmembrane amino acid transporter protein
MAGTLPVPLVIRFELGSDLTQLVNCEVRIGINVLCGVGILSTPYAAKVGGWLGLSILVIFAIISFYTGLLLRSCLDSEPELETYPDIGQAAFGTTGRIAISIVLYVELYVSTDAFTQQSAASIPFVVSPIACCIEYIILEGDNLSSLFPSAHLNLGGIELNSHTLFAVITTLAVLPTVWLRDLSILSYISAGGVVASILVVLCLLWVGIEDVGFHSKGTTLNLATLPVAVGLYGYCYSGHAVFPNIYTSMANPNQFPGVLLACFGICTLLYAGAAVLGYTMFGEAILSQFTLNMPKELVATKIAVWTTCYPVAL

SEQ ID NO: 212752 - protein, 237 aa, Glycine max
  Coding DNA Sequence Number=SeqID_95974
MKFPNSQLFLPFLLLLFFAITPFRGSGQQTDWNSEETQHGNGVRRRVLLSFKEKPSGSNVTFECTPSGPCVPCLYSEKDYFNIRHLRRLYMFGDEKYRCSETGYRIPFKCLEIKDSTKDAKKTKSQKGRLSLEISDGIAESHKVSHDAGEINPSQSHRRLVDDSSSSDNSSQAYITYRSCITPVNEEKLSVLNFEHVCGINQRRVECLRLSPCGVLTGLMYAALSLQVVRLFLGLNL

SEQ ID NO: 212753 - protein, 145 aa, Glycine max
  Coding DNA Sequence Number=SeqID_95975
MDVGQDMKVSSIIDPINHCWDINTISHILSPQDVQVIVRTPLLPMVEGDSRIRALNQNVSKHFSTAANIYGVMEYVETKERSEPSHYSMVQHSQVLHWIPPEPGCVRDERGRQMMARAETKMPCMDAQLGEAWGLLEVINFPPAK

SEQ ID NO: 212754 - protein, 97 aa, Glycine max
  Coding DNA Sequence Number=SeqID_95976
  Subcellular localization annotation: CTP_CleavageSite=52; ConfidenceScore=5.10e-01
MEIKIGFDTSDSGLQSLSALGCYVPSLRRRSRIMGCHVQHDFMPHMENSASKCSRVFSFHSSATTEDPHFDTIFNNATNVNREEKKKKIISIIKFII

SEQ ID NO: 212755 - protein, 151 aa, Glycine max
  Coding DNA Sequence Number=SeqID_95977
MKIFDLELEEITYIRTHINIFLCDMFDQGQLQTDFDESKWSNIPLILDTIDPQEQSGLPNEELDSFIEDEDDVLCNQPQEDDEEEDELVSPIKTAPPYYIPPHMHNFKDSEYGHSLDYEEVEHSVWTHFEGMRFLTKKEVQHALQLYHVSK

SEQ ID NO: 212756 - protein, 157 aa, Glycine max
  Coding DNA Sequence Number=SeqID_95978
  Gene Ontology: Mol. function=peptidase activity
  Homolog annotation: Hit_ID=Q60D39; Match level="QueryCoverage=99%, HitCoverage=40%, E-value=4e-30, Identity=56%"; Hit description=CAAX amino terminal protease family protein, putative
LTEAIALPYLGIKPDVLSLDDKAEILLLDQSITTAVVLGIIYSVANTFQPLPEDFFKYDLREPFNLQKGWLLWAGVGLAGAILAISLTGVAVSFFNGETPQRETDALVRLLPLIGSSNLSLLSMDFFFFLKFPSRFCIPDSQHCLLGGHHRCSCSTP

SEQ ID NO: 212757 - protein, 185 aa, Glycine max
  Coding DNA Sequence Number=SeqID_95979
  Homolog annotation: Hit_ID=Q1RW37; Match level="QueryCoverage=77%, HitCoverage=68%, E-value=3e-30, Identity=40%"; Hit description=Tumor- related protein, putative
MSIVSGTHTTEKYNYESFQEFFECWMFEQNQHLKELLAAESTHLTDEQVQALNGRVIEHYEHYYTAKLSCAKQDARFDELIRGLRTHDLGDISASQLAQLDETQRRTIIEEREVTDLMETHQESLVDAPMVELSHVVAEMIRANETGENKEIEDKVESTLCQWWKHTLASRAITCCTIMTTSIDK

SEQ ID NO: 212758 - protein, 85 aa, Glycine max
  Coding DNA Sequence Number=SeqID_95980
MDIDYAIRKEEPSTITKTITPDVVDLYEKWERSNRLSVTFIKTNISTTIDEQFVTYDKSLVSTRIMQFSSMKLTGIRGVHITSCT

SEQ ID NO: 212759 - protein, 214 aa, Glycine max
  Coding DNA Sequence Number=SeqID_95981
  Gene Ontology: Mol. function=zinc ion binding
  Homolog annotation: Hit_ID=Q1SE15; Match level="QueryCoverage=62%, HitCoverage=37%, E-value=3e-25, Identity=63%"; Hit description=Zinc finger, DHHC-type
  Subcellular localization annotation: CTP_CleavageSite=85; ConfidenceScore=5.02e-01
MKGKRFVSVPVLAVILLMVFVYYCSMFVFLQDWLGLQSSPGTLNAFLFSLFASLSLFSFFSCVLTDPGHVPSSYAPDVEFSKDCVASCVPYVNQRFKCFASTLSEVADVFMSYDRLRMQNRRNVTSALHTSLPGPIIVEFAEGVTVGSGVAEIDGCNTGKIARPWRLMVLVQRLCDRNPEVGAGPEGSIALRQTIPYSIDTHPNSQVQDIYLIV

SEQ ID NO: 212760 - protein, 104 aa, Glycine max
  Coding DNA Sequence Number=SeqID_95982
MTVLHIQTLSYSLKSLATSLTNINLMIEAEDAQLLVSRTRFVGAFGVELGYWRANASHFRLHNPEGNLVAWLLVWAFLICRVLLWGRVLRGWVLRGWVLLWGLL

SEQ ID NO: 212761 - protein, 667 aa, Glycine max
  Coding DNA Sequence Number=SeqID_95983
  Gene Ontology: Mol. function=binding; Cellular component=plastid chromosome; Biological process=transport
  Homolog annotation: Hit_ID=Q9LS25; Match level="QueryCoverage=99%, HitCoverage=96%, E-value=0.0, Identity=61%"; Hit description =Similarity to salt-inducible protein
  Pfam annotation: Domain name=PPR; Domain location=190-224; Score=2.9; E_value=3.3; Accession=PF01535.11; Description=PPR repeat
  Pfam annotation: Domain name=PPR; Domain location=225-259; Score =27.6; E_value=4.5e-05; Accession=PF01535.11; Description=PPR repeat
  Pfam annotation: Domain name=PPR; Domain location=260-294; Score =31.3; E_value=3.4e-06; Accession=PF01535.11; Description=PPR repeat
  Pfam annotation: Domain name=PPR; Domain location=295-329; Score =22.7; E_value=0.0014; Accession=PF01535.11; Description=PPR repeat
  Pfam annotation: Domain name=PPR; Domain location=330-364; Score =44.2; E_value=4.4e-10; Accession=PF01535.11; Description=PPR repeat
  Pfam annotation: Domain name=PPR; Domain location=365-399; Score =25.9; E_value=0.00015; Accession=PF01535.11; Description=PPR repeat
  Pfam annotation: Domain name=PPR; Domain location=400-434; Score =25.7; E_value=0.00016; Accession=PF01535.11; Description=PPR repeat
  Pfam annotation: Domain name=PPR; Domain location=436-470; Score =46.5; E_value=9e-11; Accession=PF01535.11; Description=PPR repeat
  Pfam annotation: Domain name=PPR; Domain location=471-505; Score =19.7; E_value=0.01; Accession=PF01535.11; Description=PPR repeat
  Pfam annotation: Domain name=PPR; Domain location=573-607; Score=0.8; E_value=6.1; Accession=PF01535.11; Description=PPR repeat
  Pfam module annotation: Pfam domain module=PPR::PPR::PPR::PPR::PPR::PP R::PPR::PPR::PPR::PPR; Domain location=190-224::225-259::260-294::295- 329::330-364::365-399::400-434::436-470::471-505::573-607
  Subcellular localization annotation: CTP_CleavageSite=38; ConfidenceScore=5.33e-01
MATPLPTVVDVYFTDTKRTRFSITTPCRQKTNRKFFIHCATSNSTPEAPPTPTSDNNNNNKKNTSLSDQLAPLANKTLSSATRDQSYALSKPKSTWVNPTKAKRSVLSSERQKRATYSYSPQLRDLKRFAQKLNESGSSEDEFLACLEEIPRPISRENALLILNTLKPWQKTNLFLNWIRTQNLLPMETIFYNVTMKSLRFGKQFGLIEDIAHQMIDNGVPLDNITYSTIISCAKKCNLYDKAVHWFERMYKTGLMPDEVTYSAILDVYARLGKVEEVISLYERGRATGWKPDPITFSVLGKMFGEAGDYDGIRYVFQEMESVGVQPNLVVYNTLLEAMGKAGKPGFARGLFEEMIESGIVPNEKTLTAVIKIYGKARWSRDALELWQRMKENGWPMDFILYNTLLNMCADVGLVEEAETLFRDMKQSVHCKPDSWSYTAMLNIYGSQGDVDKAMKLFDEMCKLGVELNVMGFTCLIQCLGRAMEFDDLVRVFDISVERGIKPDDRLCGCLLSVVSLSQGSNDEEKVLACLQQANPKLVAFIHLIEDEKTSFETVKEEFKGIMSNAAVEVRRPFCNCLIDICRNKDLLERAHELLYLGTLYGLYPALTALEEWMWTLTKIVKREETLPELFLAQTGTGAHKFAQGLNISFASHLRKLAAPFKQSEEK

SEQ ID NO: 212762 - protein, 73 aa, Glycine max
  Coding DNA Sequence Number=SeqID_95984
MVSRHFQRDGGQGGRRSATKSRWKHRTEGATPVEEEERMKGQKQWRHHRRKKREGGGRCKKQKRDVQKGIDQT

SEQ ID NO: 212763 - protein, 75 aa, Glycine max
  Coding DNA Sequence Number=SeqID_95985
MIPEKGSASEGSAVFCGEAPQSPRIPFLFHSPELLFHWFCQDEKDSKEVNYKCFGGKLMQKEKALKKKLKMRQLA

SEQ ID NO: 212764 - protein, 92 aa, Glycine max
  Coding DNA Sequence Number=SeqID_95986
MWTLYKIDGPSRWNLAAQGSTRGLLYSRPCGQEKISHKNRDEKFPAANSGTGTMLPTPQDPCHPRGTGVRVWIRDKKYSHHETRAGVMPNYS

SEQ ID NO: 212765 - protein, 401 aa, Glycine max
  Coding DNA Sequence Number=SeqID_95987
  Gene Ontology: Mol. function=DNA binding; Cellular component=nucleus; Biological process=regulation of transcription, DNA-dependent
  Homolog annotation: Hit_ID=Q9ZVH0; Match level="QueryCoverage=64%, HitCoverage=64%, E-value=8e-94, Identity=63%"; Hit description =Putative NAC domain-containing protein 9
  Pfam annotation: Domain name=NAM; Domain location=15-143; Score =289.3; E_value=7.2e-84; Accession=PF02365.6; Description=No apical meristem (NAM) protein
MEERNHDGEKLDEVMLPGFRFHPTDEELVGFYLKRKIQQRPLSIELIKQLDIYKYDPWDLSKMATTGEKEWYFFCPRDRKYRNSARPNRVTGAGFWKATGTDRPIYSSEGSKCIGLKKSLVFYKGRAAKGIKTDWMMHEFRLPSLTHPSSDPKKYMDKTIPANESWAICRIFKKTNATAQRALSHSWVSPLPETTTTSDHRDGNQLCQANMPFTKKTSLASQFYTFNHNESQHSTTTSTTPCPLDVVASYNKPLINPLMLYKPSDRLPFSNGDLISSGVIFSSLETSTTSAKSSTDASSLLLSTSSSVLGDFSKTSEGTITTNFGGLQEHGNGYQIPLLRDNMQGNFGNHDDNALGKIPNVNVVPRVGDQQLETVRSIGFPFNIGDAWKPNMLWDTSSLSL

SEQ ID NO: 212766 - protein, 265 aa, Glycine max
  Coding DNA Sequence Number=SeqID_95988
MADVEPLDASLDRLEAAMTNLAIVDSDLHASHLHLDALRTSMLFKIDLISLKLDTMISRQRPLFPSSIQPPPPLPPTFPPSAQPPPPPPPPPFPPSPQPPSPPPAPLPRSHVPPPMDGQRDSPVIGIDSSTIDFPVSVWQHHHADLNRHFLSIQLCPLPLCTNTRSYRTIPYNNDIFLLRDAAVAHQIRPHWIWILFATETPLCSVRHQRQRPPPHPLPPPKPPPPPSSPPRSLTPPLIAPRRGSHTHSSPWPFHSVARVTHTLY

SEQ ID NO: 212767 - protein, 109 aa, Glycine max
  Coding DNA Sequence Number=SeqID_95989
MSTKKEKAYWDIKATKGFIITCLEQVYKGERLNTKTGFGWDNAKNIVDENPLYEKFRIKGLPFAQKLIELFKDVVANGEFQWVLLFGILLAGVEVDLKMGIIQVLRVLD

SEQ ID NO: 212768 - protein, 80 aa, Glycine max
  Coding DNA Sequence Number=SeqID_95990
MDNKSPSKESKEETRESLIAISNSLPDKTLESKSALESKKSDGVAMQNRDQDDKFSYRATLCKYFHRLHAWVICCNDRDN

SEQ ID NO: 212769 - protein, 413 aa, Glycine max
  Coding DNA Sequence Number=SeqID_95991
  Gene Ontology: Mol. function=protein serine/threonine kinase activity; Cellular component=membrane; Biological process=protein amino acid phosphorylation
  Homolog annotation: Hit_ID=Q5NJB1; Match level="QueryCoverage=68%, HitCoverage=51%, E-value=5e-51, Identity=36%"; Hit description=S -receptor kinase-like protein 1
  Pfam annotation: Domain name=PAN_2; Domain location=162-224; Score =4.2; E_value=0.00049; Accession=PF08276.2; Description=PAN-like domain
  Pfam annotation: Domain name=Pkinase_Tyr; Domain location=292-408; Score=-140.7; E_value=0.00077; Accession=PF07714.7; Description =Protein tyrosine kinase
  Pfam module annotation: Pfam domain module=PAN_2::Pkinase_Tyr; Domain location=162-224::292-408
MSNTTKLYSKNSKTNPENLANLVIRSTKYDFLVWIANRDQPVDLNSAVLSLNHSGVLKIESQIAKPIILYSPPQNTNNTGHVRDPTLNGDTTKIKYISEIQSLFKELGLNPKSNNIVLDTVYTLDVTGNWASSNEGDIARADMCYGYNTDGGCRRWEAISTCRQFGDVFEKMMGYPNNDNVIIESNVTYGSSDCMASCWTNCSCTGFKNLYHNGTGCIFFLFNSMEGVALDSTQAIFYMLVKKTQRNEKKRKRTETEMLDLAVSNESLGIKDLEEDLKLFSYTSVVVAANDFSLENKLGEGGFGPVYKGTLPTGEEVAIKRLSKGSGKGIVEFRNELTLICELQHMNLVQLIGCCIHEEERILMYEYMLTKSLDFYIFGKEYAKVYLIICSMQAHTQGFNIIEGKSFMLGNVA

SEQ ID NO: 212770 - protein, 75 aa, Glycine max
  Coding DNA Sequence Number=SeqID_95992
  Gene Ontology: Mol. function=DNA binding; Cellular component =mitochondrion; Biological process=DNA integration
  Homolog annotation: Hit_ID=Q1S7S0; Match level="QueryCoverage=94%, HitCoverage=5%, E-value=2e-18, Identity=59%"; Hit description =Integrase, catalytic region; Peptidase aspartic, catalytic
MVEFKRLVSRLIYLTTIRPDIAFATQQLSQFMAHPTKSHLGAARRVLRYLKGSPSKGLQFKRDTPIHLIGFNDAD

SEQ ID NO: 212771 - protein, 63 aa, Glycine max
  Coding DNA Sequence Number=SeqID_95993
MRSEYKGYKLENITGFVVSKEERKEKKIPLLLCQKMYKPYEMVNCVVLIWSLGLLHMSNVLGT

SEQ ID NO: 212772 - protein, 283 aa, Glycine max
  Coding DNA Sequence Number=SeqID_95994
  Gene Ontology: Mol. function=chitin binding; Cellular component =extracellular region; Biological process=chitin metabolic process
  Homolog annotation: Hit_ID=UPI000044A8F0; Match level="QueryCoverage =83%, HitCoverage=100%, E-value=1e-28, Identity=25%"; Hit description= PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MTGPLDELIPCFLIRVDPWVLVPIALRGLHALTFRGLHVLALRNTRPHLQRATCPHLQRTTRPRLEDYTSSPSEDYTSSPSEDNTSSPLEGYMPSPSEGYTPSPSVDYTGLHALTFRGLHVLALRTTHLRLEDYTSSPSEDYISSPSKGYTPSPSEGCTSSPSEGYTPSPSEDYTSSSSEGYMPSPSEDYKSLPSEDYTSSPSEDCMSSPSEDSTSSPSEDYTSSPLRGYTVSPLEDYTSSPSKGCTPSPSEECISSPSEGYAPSPSEGCTPSPLEDYTSSPP

SEQ ID NO: 212773 - protein, 106 aa, Glycine max
  Coding DNA Sequence Number=SeqID_95995
MSRGMFPVEQGDLHKRWKLVSMKLRNFHKCVVLPIGSLSSGLCRHRAILFKLSYLSKNIVELSNYIVECAWVYDENPEIGQIQVKGPSGEGRRPKWRRIKPPSGEG

SEQ ID NO: 212774 - protein, 143 aa, Glycine max
  Coding DNA Sequence Number=SeqID_95996
EGLCGDLGASFYVLGDAYGNVFMDEDGEDKVEDDDNDNKEDEESIEYKVEEDYDFDSIRCGRSGGFYAEDAITEYKVGRGLILGKRKRHSKNVTRKVGIRPPHMCASFLNLDGDITSLGELKWEQNQNQNGLSRVSADSDELT

SEQ ID NO: 212775 - protein, 147 aa, Glycine max
  Coding DNA Sequence Number=SeqID_95997
MTLIVGHAFNMNLLPDTDARVGGRWRKCLCFGVPALLLALQNPWKAESAWFAQFAESWYHTRLTSGFGYSQNQSQGIELDVHKEVCAEIEGIMGSTEVITDGWLYGEDATGRGGLVWSGMVREEGQAVIGGRSDQFVSNITKLLYAN

SEQ ID NO: 212776 - protein, 61 aa, Glycine max
  Coding DNA Sequence Number=SeqID_95998
MSRSRAPSSRWTNLSEELEQLLADVPKLTIEEHREWRELANMMQNVMAPLEAFFQIVHTRD

SEQ ID NO: 212777 - protein, 123 aa, Glycine max
  Coding DNA Sequence Number=SeqID_95999
  Homolog annotation: Hit_ID=Q8VXZ8; Match level="QueryCoverage=47%, HitCoverage=13%, E-value=1e-20, Identity=77%"; Hit description =Putative aminotransferase
MTKNCYTVEMRKRDNTPFELENHVAFSEYLVNEVGVVAIPTSVFYLNPEEGKNLVRFTFCKDEETIRSAVDRGAKTGHINYTSSRWNTDHGTGDLTMRTHCASSTAHTLARQRGFEGASASGV

SEQ ID NO: 212778 - protein, 57 aa, Glycine max
  Coding DNA Sequence Number=SeqID_96000
MIIGKFPKFPVHTPIEVHRSFFLKIAQIHFSMSVTHVAKKVTEVWMTPLPVKENKSG

SEQ ID NO: 212779 - protein, 80 aa, Glycine max
  Coding DNA Sequence Number=SeqID_96001
  Gene Ontology: Mol. function=nucleotide binding; Cellular component =chloroplast; Biological process=response to heat
  Homolog annotation: Hit_ID=P29357; Match level="QueryCoverage=85%, HitCoverage=10%, E-value=9e-15, Identity=60%"; Hit description =Chloroplast envelope membrane 70 kDa heat shock-related protein
MKEIAKAYPGATIRNAVVPVSVYFNDPQRQTIKDVSVISRLNVMRIIHVSTTTAYGLGKKTSSYAKKNIFVFFPVVKFMV

SEQ ID NO: 212780 - protein, 149 aa, Glycine max
  Coding DNA Sequence Number=SeqID_96002
MMMVRQCVRSMVLAKKSGTKFVNALEILHGSYKIPLEEQCVQGSFVAHGCQDQPHLVELDLAPSGAFVSTNGSYVDPSWQDINTDISDRDGLYVDYIPPYMVSLGRVYEGSSTIHHVPLANYMVNVGLEEVGDVDARVPVPTEEVQLVG

SEQ ID NO: 212781 - protein, 272 aa, Glycine max
  Coding DNA Sequence Number=SeqID_96003
  Gene Ontology: Mol. function=amino acid binding; Cellular component =chloroplast thylakoid membrane; Biological process=metabolic process
  Homolog annotation: Hit_ID=Q2QXL3; Match level="QueryCoverage=69%, HitCoverage=65%, E-value=2e-60, Identity=60%"; Hit description=ACT domain-containing protein, putative, expressed
  Pfam annotation: Domain name=ACT; Domain location=214-272; Score=0.2; E_value=4.1; Accession=PF01842.15; Description=ACT domain
  Pfam annotation: Domain name=ACT; Domain location=96-160; Score=12.6; E_value=0.094; Accession=PF01842.15; Description=ACT domain
  Pfam module annotation: Pfam domain module=ACT::ACT; Domain location =214-272::96-160
MAVAMAACSLGLHLSADNTLRPFEKTTILKALSISDATKPCYISHKTRLSSSSSGITMIPRATTVIGTVEDGNQGEADTIPTPVVIIDQDSDPDATVVEITFGDRLGALLDTMNALKNLGLNVVKANVFLDSSGKHNKFSITKADSGRKVEDPELLEAIRLTILNNMIQYHPESSAQLALGAAFGLVPPKEQAFQVDVEIATQITISDDGPKRSLLYVETADRPGLLVDLVKTITDINIAVESGEFDTEGLLAKAKFHVNYKDKALIKPLQL

SEQ ID NO: 212782 - protein, 395 aa, Glycine max
  Coding DNA Sequence Number=SeqID_96004
RRLGGRRRRTGRRGGLYAGASVGPASGRAGRLSAGGAADWVAAYRDAHAGGKFPADLNRRPRHRRVVIGGDAVVDHMLQQRDEQIGAEQRIVVNREQHISLAVEQADAALRMVFHRADLLERHVAPLRGQQGGAQPQRFGRRALPLAEQQLPQPARVALNGVKRHRLPLIERIQRQRPALLQLLVDDHVCQPPRMGDIAENRTPGLIHAGAERRDVKQPAKSLAAAKAIDIADLLKRDEALFVMVAVKDPHAVLVQAIGQRRTQIMPQRQQRTTDTNSAAPALNSSAAAARMPQLTFEKSCRLSICPLSIIMHLPINVRRYAVHALSIRGAVVAYMGFFLKEDGAGVWRPRITGKPWVQAVSSALTSVFTRRGALDSGARRPNPFTVALGPCGFL

SEQ ID NO: 212783 - protein, 265 aa, Glycine max
  Coding DNA Sequence Number=SeqID_96005
  Gene Ontology: Mol. function=methyltransferase activity; Biological process=methylation
  Homolog annotation: Hit_ID=Q74SR9; Match level="QueryCoverage=80%, HitCoverage=84%, E-value=3e-65, Identity=57%"; Hit description=SAM -dependent methyltransferases
GRAYRAQRHGAQREPRPALHAGLPGSAAGSAADHIAALNAATGRLIGALFFSVEKIEVSDQMAEIVGVAAVGLLDRQRLLPQRRFPPRQRQQHPVQRRIGPIADVHFRRRVPAALLRQAFEFGADIVRQHHAERPLFRQQLRRTGQQRLVRQGFGVARVVARLVAAGHRRLEIRRIADDQIILSGMPLRIMVNILRMHADALQPRRCRRVFARLAGGGFVQLHRVNGHFVAAALRQHQRDQPAAAANVQHPARLPQRRPGAEQHP

SEQ ID NO: 212784 - protein, 288 aa, Glycine max
  Coding DNA Sequence Number=SeqID_96006
  Gene Ontology: Mol. function=transferase activity, transferring phosphorus-containing groups; Cellular component=membrane; Biological process=peptidyl-histidine phosphorylation
  Homolog annotation: Hit_ID=Q0LBD6; Match level="QueryCoverage=89%, HitCoverage=54%, E-value=6e-32, Identity=35%"; Hit description=ATP -binding region, ATPase-like
  Pfam annotation: Domain name=HAMP; Domain location=155-225; Score =52.2; E_value=1.7e-12; Accession=PF00672.15; Description=HAMP domain
  Pfam annotation: Domain name=HisKA; Domain location=229-288; Score =34.1; E_value=4.7e-07; Accession=PF00512.15; Description=His Kinase A (phosphoacceptor) domain
  Pfam module annotation: Pfam domain module=HAMP::HisKA; Domain location=155-225::229-288
  Subcellular localization annotation: CTP_CleavageSite=42; ConfidenceScore=5.24e-01
VPLIAVLVSLGSVAAWSASRSIQQSFYSQQLGDLGYFVTSARQALRSGSPAVIDAEVRRFQQVYGIEVTVFDLAGGAWASGDHGGAVLSEDDAERVRLALSGRRAEQPAASLPWVVPDAALAEPVFDDGDVIGAVLVAGDVDGPRTAILQQTLLLVAIVVVLSALGVLLVSGLARWVLSPVRRLDEAMVAIERGEMDARVAEDTGPPELRRMTRVFNGMADEIERVMTRQQEFALNASHELRNPLNALLLRVEHLATGLGREWDGAVEETREEGRRMTRILETLLGLA

SEQ ID NO: 212785 - protein, 57 aa, Glycine max
  Coding DNA Sequence Number=SeqID_96007
MQHLMKLLERDQYIHWHRLKDEDVIVPTKQTGMTFSAGFAYLEGEHVSHRQECQGKM

SEQ ID NO: 212786 - protein, 64 aa, Glycine max
  Coding DNA Sequence Number=SeqID_96008
MAFVDNWVVGKEKEWQSQHGFLPHSHPLHLPQFFLNLSKHDDQICLFLDLTSIISPAKTESRKA

SEQ ID NO: 212787 - protein, 85 aa, Glycine max
  Coding DNA Sequence Number=SeqID_96009
MEATKVLINYHVLLAFNLGAHYNGKPNIYSYEGATVNDLNCIKLLLMGSVDDQIDFIMGDFFLLTPKLKGLIIRLRKNKKVPRRV

SEQ ID NO: 212788 - protein, 47 aa, Glycine max
  Coding DNA Sequence Number=SeqID_96010
MGTVCGAYLAQNYQVPNVTKLADTALFMAEVVEEKYRKPKKRDDDDD

SEQ ID NO: 212789 - protein, 632 aa, Glycine max
  Coding DNA Sequence Number=SeqID_96011
  Gene Ontology: Mol. function=protein serine/threonine kinase activity; Cellular component=integral to plasma membrane; Biological process=protein amino acid phosphorylation
  Homolog annotation: Hit_ID=Q10P10; Match level="QueryCoverage=93%, HitCoverage=81%, E-value=6e-84, Identity=35%"; Hit description =Protein kinase domain containing protein, expressed
  Pfam annotation: Domain name=Pkinase; Domain location=29-598; Score =50.8; E_value=4.4e-12; Accession=PF00069.15; Description=Protein kinase domain
  Pfam annotation: Domain name=Pkinase_Tyr; Domain location=29-598; Score=-23.3; E_value=4.9e-11; Accession=PF07714.7; Description =Protein tyrosine kinase
  Pfam module annotation: Pfam domain module=Pkinase::Pkinase_Tyr; Domain location=29-598::29-598
AKTIPFDASAPLKLQRFSYKDLKQATNGFDTANVIGKGGSGTVFRGILKDGKLIAIKRLDALSLQSEREFQNELQILGGLRSPFLVTLLGYCVEKNRRVLVYEYIPNRSLQESLFGDEGMSLSWESRLCIILDVARALEFLHLGCDPPVIHGDIKPSNVLIDSEWRGKISDFGLSRIKVEETPAIGTPIESVSEVDFALALQASSSSKNSRTCFNVKALNLNSLNYNANIASETEIRSVNAKGKEISALDRDDWNGKFFPCDDELSSIDYSKELTVSASPLVDDEKANGKQWGKDWWWRQDGSGELCSKDYVMEWIGSQICPSNADWDDGKNNVHAKVELENSSPKDKDHDAIAPQSQVFGIGHNTTDNGVEKKESRGKKYHKKKHRKMQEWWKEEHLAELSKKTSKLKNLHTKWKKGLKVPHFDLGRRFYLCRRKKFGQEGENKCDQNGEFSFRRGWKKKSTRSIGSDMWSGDLFSRELSSTTSMRGTLCYVAPEYGGCGFLMEKADIYSFGVLILVIVSGRRPLHVLASPMKLEKANLISWCRHLAQDGNILELVDERLKEDYNKEQASLCINLALICLQKIPELRPDIGDIVKILKGEMELPPFPFEFSPSPPSKLYSRSRRKPKGTTE

SEQ ID NO: 212790 - protein, 110 aa, Glycine max
  Coding DNA Sequence Number=SeqID_96012
  Gene Ontology: Mol. function=CTP synthase activity; Biological process=pyrimidine nucleotide biosynthetic process
  Homolog annotation: Hit_ID=Q1T4Z9; Match level="QueryCoverage=46%, HitCoverage=11%, E-value=8e-16, Identity=69%"; Hit description=CTP synthase
MELFFLYGMIIITWPQTSPHKSSVFLGQKKEMNLSAVVENENLTVLEGRHGASVDVQATSFEHDAYAAGGDALVEATDHSATDDLKNLRGKKASLNASLNLFDFEQRERE

SEQ ID NO: 212791 - protein, 108 aa, Glycine max
  Coding DNA Sequence Number=SeqID_96013
  Subcellular localization annotation: CTP_CleavageSite=76; ConfidenceScore=5.34e-01
MDIHQHKVDHKDLKIPAATMKLSIYLITTTFLKSSSRRGNNPVLTCFGRRLSSIGHCPPPPPPPTAVKFSGETRVVCTSRSVTHPYKSREQHHHHVPPRATTAMHHFG

SEQ ID NO: 212792 - protein, 120 aa, Glycine max
  Coding DNA Sequence Number=SeqID_96014
  Homolog annotation: Hit_ID=Q9LTV5; Match level="QueryCoverage=33%, HitCoverage=1%, E-value=5e-07, Identity=60%"; Hit description =Helicase-like protein
MELDKKKKKVLDKQLEFLLGQTERYTTMLAENFVDPYKSAENNSVEHYMSIQCKDVHYVINEPNEADVGRVVVVCRCASLSQGGGRVLMCVAFAGVVHAGHAAVFCVVHPPAALSYFNFG

SEQ ID NO: 212793 - protein, 278 aa, Glycine max
  Coding DNA Sequence Number=SeqID_96015
  Gene Ontology: Mol. function=metal ion transporter activity; Cellular component=membrane; Biological process=metal ion transport
  Homolog annotation: Hit_ID=Q67UQ7; Match level="QueryCoverage=89%, HitCoverage=57%, E-value=6e-91, Identity=72%"; Hit description =Magnesium transporter CorA-like
  Pfam annotation: Domain name=CorA; Domain location=1-276; Score =221.9; E_value=1.4e-63; Accession=PF01544.9; Description=CorA-like Mg2+ transporter protein
MEILHQVHFMPGSSHRGYIAVESYDEKLLKTTAAELEIEAYPLLDELTSKISTLNLERVRRLKSRLVALTRRVQKVRDEIEQLMDDDGDMAEMYLTEKKRRMELSFYGDQSMVGYKSVDGASISAPVSPVSSPPDSRKLEKSFSIARSRHESMRSSESTTESIEELEMLLEAYFVVIDSTLNKLTSLKEYIDDTEDFINIQLDNVRNQLIQFELLLTTATFVVAIFGVVAGIFGMNFEIQLFDVPSAFQWVLIITGICGVFIFSAFVWFFKYRRLMPL

SEQ ID NO: 212794 - protein, 251 aa, Glycine max
  Coding DNA Sequence Number=SeqID_96016
  Gene Ontology: Mol. function=structural constituent of ribosome; Cellular component=intracellular; Biological process=translation
  Homolog annotation: Hit_ID=Q6YWZ1; Match level="QueryCoverage=94%, HitCoverage=45%, E-value=4e-63, Identity=47%"; Hit description =Pentatricopeptide (PPR) repeat-containing protein-like
  Pfam annotation: Domain name=PPR; Domain location=11-45; Score=33.0; E_value=1.1e-06; Accession=PF01535.11; Description=PPR repeat
  Pfam annotation: Domain name=PPR; Domain location=147-181; Score=9.2; E_value=0.6; Accession=PF01535.11; Description=PPR repeat
  Pfam annotation: Domain name=PPR; Domain location=182-216; Score =24.9; E_value=0.00028; Accession=PF01535.11; Description=PPR repeat
  Pfam annotation: Domain name=PPR; Domain location=46-80; Score=22.4; E_value=0.0016; Accession=PF01535.11; Description=PPR repeat
  Pfam annotation: Domain name=PPR; Domain location=81-115; Score=39.1; E_value=1.5e-08; Accession=PF01535.11; Description=PPR repeat
  Pfam module annotation: Pfam domain module=PPR::PPR::PPR::PPR::PPR; Domain location=11-45::147-181::182-216::46-80::81-115
MSKYCITPDATSYSYMISCFSKEGNLFDSLRLYDQMKKRGWIPGIEIYNSLVYVLTHENCLKEALRTIDKLKEQGLQPGSVTFNSMILSLCEAGKLAEARIIFNSMVEENVSPTTETYHAFFEGTDYQGTLEFLTRMKDSGLGPSKDSFVIILAKFLKLKQPVNAPKFWTEMKTYDVLPSCVHYRIMVEGLVTCRWFIKARGFYEEMISNGCSADPMLNRLFQEEVLGSGDKGKQNVKKAHSNKSVKYSEK

SEQ ID NO: 212795 - protein, 139 aa, Glycine max
  Coding DNA Sequence Number=SeqID_96017
MAPKLQEEEIKLLEVGIMNQEAEEFFKKTIEIDCLIDVLREANPRERELILASMRMISLLIQDQVQDSLRGHETFHGPKIYPKADENPRAFSCISGLIFLESSIQCLWRVGLHHSLPLEEDLTSNQDVLETLGFFPQHL

SEQ ID NO: 212796 - protein, 114 aa, Glycine max
  Coding DNA Sequence Number=SeqID_96018
MVPLCFMYSSHFKFRTDTCKCKPLQLQDSLNCRYPPQQIIILFEFPTADKYGIITEDTKVENKHDLSHGSRTQRGKGAYGGQDVNHNSATSFLPCISTLSVALPLMRVLPFYLL

SEQ ID NO: 212797 - protein, 197 aa, Glycine max
  Coding DNA Sequence Number=SeqID_96019
  Gene Ontology: Mol. function=transferase activity; Cellular component= nucleus; Biological process=flavonoid biosynthetic process
  Homolog annotation: Hit_ID=Q2Z1Y0; Match level="QueryCoverage=99%, HitCoverage=43%, E-value=8e-84, Identity=76%"; Hit description =Alcohol acyl-transferase
MLKVTYFKCGGVSLGVGMQHHVADGASGLHFINAWSDVARGLDISLPPFIDRTLLRARDPPHPVFDHIEYKPPPAMKTPLQQQLQSSKPVGSDSAVAVSTVKLTRDQLSTLKGKSREDGNRISYSSYEMLAGHVWRSVCKARALPDDQETKLYIATDGRARLQPPLTPGYFGNVIFTTTPIAVAGDLMSKPTWFAAS

SEQ ID NO: 212798 - protein, 125 aa, Glycine max
  Coding DNA Sequence Number=SeqID_96020
MKPLLDFGIAFLLLLHSFLTSDIPYPKAIFDLKDTIVKGFGFTAENDVKLTGFDPRDATVGHSVEYQFDLEINHKVIPFKLLEDVKHWDYMDLPIFQAEAPIGFVQKQASADGLPVLASFVLAMM

SEQ ID NO: 212799 - protein, 113 aa, Glycine max
  Coding DNA Sequence Number=SeqID_96021
MGFFLVGNLALSVFGLFLFCFCLARDIVWSKDLSVYFFLSQRALHGRARARLSGALSKGGKMRGVATNVYLGKRRENRRKLVKRKILSSRVVFTLEEGISTSHVCLQGQQPIF

SEQ ID NO: 212800 - protein, 135 aa, Glycine max
  Coding DNA Sequence Number=SeqID_96022
  Homolog annotation: Hit_ID=Q1RTJ9; Match level="QueryCoverage=88%, HitCoverage=35%, E-value=1e-11, Identity=38%"; Hit description =Cyclin-like F-box; F-box protein interaction domain
MSGYHLVGSCNGLHCGVSEIPEGYCVCFLNKATRVISRESPMLSFSPGIGRRTMFGFGYDPSSDKYKVVAIALTMLSLDVSEKTEKKVYGAGDSSWRNLKGFPVLWTLPKVGGVYLSGTLNWVVIMGKETIHSEI

SEQ ID NO: 212801 - protein, 200 aa, Glycine max
  Coding DNA Sequence Number=SeqID_96023
  Gene Ontology: Mol. function=protein kinase activity; Biological process=protein amino acid phosphorylation
  Homolog annotation: Hit_ID=Q2QZ78; Match level="QueryCoverage=95%, HitCoverage=34%, E-value=3e-55, Identity=56%"; Hit description=AT hook motif-containing protein, putative
  Pfam annotation: Domain name=DUF889; Domain location=123-200; Score= -82.4; E_value=6.6e-06; Accession=PF05970.5; Description=Eukaryotic protein of unknown function (DUF889)
MFFLYGFVGTGKTFIWRTLANSLRAENQIVIIVASSGIASLLLPGGRTAHSRFKIPIPIFEDSTCNIHQGTELAELLNQTSLIIWDEAPMAHKFCFEALDQSLRDIITDKSKSSQIFGGKVIVFGGDFRQILPVIPRGTRSDIVNAAINSSYLWDSCEILTLTKNMHLHNNLESVDEQETATFAKWILDVGDGIIDDEND

SEQ ID NO: 212802 - protein, 251 aa, Glycine max
  Coding DNA Sequence Number=SeqID_96024
  Homolog annotation: Hit_ID=Q47522; Match level="QueryCoverage=24%, HitCoverage=82%, E-value=1e-21, Identity=76%"; Hit description=LacZ protein
VLQWLLFLSAVPPVQLLTGWCVTAKAPPDISAGKCSGHAARRVPFAIQAAQLLGRAIGAGLFAITPAGERGMCCKAIKLGNARVFPVTTLPLGPPIQTPQVACGQPGSPSKSLPARPGNTHRRVQGLASGAERTQRHLGSRPGSAPGLAPPRFPSLKPGPHQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 212803 - protein, 111 aa, Glycine max
  Coding DNA Sequence Number=SeqID_96025
PCLGYAAEGQAVGGIPMPNTLEGPQFRPQPQPLHFAVGRAPPAMAEKGKLDHIEERLKDIEGGDDYAFANLEELFLMGAYTKDVEILMHFFQESFTGYQYNSDMASDRMQL

SEQ ID NO: 212804 - protein, 290 aa, Glycine max
  Coding DNA Sequence Number=SeqID_96026
  Gene Ontology: Mol. function=two-component response regulator activity; Cellular component=chloroplast; Biological process=two -component signal transduction system (phosphorelay)
  Homolog annotation: Hit_ID=Q4URK7; Match level="QueryCoverage=78%, HitCoverage=100%, E-value=1e-120, Identity=92%"; Hit description=Two- component system regulatory protein
DSGSSGEAVAGAAHGLHHVFGVERFQRLAQAADVHVDGALLHVHAAAPDMVQQLGAGVDALGVGHEEVQQAVFGGADRHRLVVGEHAMGGTVDADRADGHAAVLVIFAGAAHHRTDAGQQFARRERLDHIVVDASFKATDAIVLFAAGSQHDDRHFAGQGFLAPAAGQVQAAGAGQHPVQQDQVGDAVGDGGLGLTGVAGVDRFVIALAQGEGDHFTDRGLVIDDQDAFLHEDTVGLGYWSGASRLRFDDMCVTGWPEPAWIAIGRSCSAQRRSRSGSCTPWRRSSSTVG

SEQ ID NO: 212805 - protein, 82 aa, Glycine max
  Coding DNA Sequence Number=SeqID_96027
MRPTGGVLHTESFDEGVEAIYGSWKASKCSSGSVVSSYRSRLSDFHPKGMSTSIMWSIKGCQWTVCVVGRCMRETQIVCSVA

SEQ ID NO: 212806 - protein, 78 aa, Glycine max
  Coding DNA Sequence Number=SeqID_96028
MVKEECKEVSVSSNSLAKKESHFAIKTNIKETSSRRQLPLLNIKEKGIMRHQIPMIGGMMNMLGGATLFCKITMHPTS

SEQ ID NO: 212807 - protein, 80 aa, Glycine max
  Coding DNA Sequence Number=SeqID_96029
MAGEQHQGITLEDYSSCSVPQFFTSITRPEVQAHNINYPHSLIRLIHGNLFQGLPNEDPYAHLATFIEICNTVKIAGVLD

SEQ ID NO: 212808 - protein, 114 aa, Glycine max
  Coding DNA Sequence Number=SeqID_96030
MEGVTLAHGKGICHKNMPRTSYPEMCQKSKGSRLAQSVKFRNVAEIEKRSFLQKAVASGGSILARLGELGGKLLPYFAINRGRSEEEKGLAFLALLPLSKLLRKIISVKKIQVE

SEQ ID NO: 212809 - protein, 45 aa, Glycine max
  Coding DNA Sequence Number=SeqID_96031
MEIEYMQLAEQKHDETSLSSSELETQHDHKLTSTPYGSHRPGYRA

SEQ ID NO: 212810 - protein, 57 aa, Glycine max
  Coding DNA Sequence Number=SeqID_96032
MARLARISGFWLNASLLTQYGGLQVQVDNFYTSPILPISPEIDTKGSLSAQNWDTEY

SEQ ID NO: 212811 - protein, 263 aa, Glycine max
  Coding DNA Sequence Number=SeqID_96033
  Gene Ontology: Mol. function=nucleic acid binding; Cellular component= intracellular; Biological process=DNA integration
MKKGLEILSKQGLHRNHKVEPLQFCEHSKQHKTKFPKAVHTTKAILDYIHSNCQGPLRVSSLGGARLNRSFWTKVISIACYLVNQSQSITIDFKTPIEIWSNKPANYSMLKVFGCSANYHVNEGKLILSINVTFDELSILHFKFVKNSNKIIDITKQVEFKNPTIRNFSYQEHYEAPDDTEQNHQMQPQQHQSKQVDESNQMSQNLTRKPKTNAFRKSQRQIKALEIYGFDDIVLYALQVAEEVDLFEPTTYHEAITCSEADK

SEQ ID NO: 212812 - protein, 297 aa, Glycine max
  Coding DNA Sequence Number=SeqID_96034
  Gene Ontology: Mol. function=iron-sulfur cluster binding; Cellular component=integral to membrane; Biological process=electron transport
  Homolog annotation: Hit_ID=Q1SPP3; Match level="QueryCoverage=85%, HitCoverage=95%, E-value=1e-103, Identity=61%"; Hit description=4Fe -4S ferredoxin, iron-sulfur binding; Heat shock protein DnaJ
  Pfam annotation: Domain name=DnaJ; Domain location=71-133; Score =92.6; E_value=1.2e-24; Accession=PF00226.21; Description=DnaJ domain
  Pfam annotation: Domain name=Fer4; Domain location=156-179; Score =4.0; E_value=0.087; Accession=PF00037.17; Description=4Fe-4S binding domain
  Pfam module annotation: Pfam domain module=DnaJ::Fer4; Domain location=71-133::156-179
  Subcellular localization annotation: CTP_CleavageSite=55; ConfidenceScore=5.21e-01
MAQLLSPVCMEALKIHNPSLNLCSRSSWRMLVKGASPCTFVTHSGWKRRGCGRVRVTAEDSVSPSETIADDYYEVLGLLPDATPEQIKKAYYNCMKSCHPDLSGNDPETTNFCIFINEVYTVLSDPVQRRIYDEIHGYSLTSINPFLDDSSPRDHAFVDEFSCIGCKNCANVAPGVFAIEEDFGRARAYNQSGNPELVQQAIDSWHVALMLSGMGTASIDVFRMAKAKLRMMREEGADKKNSYWDNLWGKQKDYQSSVEERAKRAASAARRWREYSRRGVDKPPTFKLPEASLGKDK

SEQ ID NO: 212813 - protein, 248 aa, Glycine max
  Coding DNA Sequence Number=SeqID_96035
  Pfam annotation: Domain name=DUF1685; Domain location=106-195; Score=- 13.9; E_value=0.007; Accession=PF07939.2; Description=Protein of unknown function (DUF1685)
MDAEQVLRLLDANWFETTIFTNKTSPPFHSAVDSASESHVKEVFPLDSKLLRAPTLQVRSLSDQNLSSSVGVFSDFPSPNSVLTPQRLRPILSGKEVEDFPLAKGNGNHENEEEEVATKKKLSHAHRRRRRFRKGKATRSLSDLEFKELKGFMDLGFVFSEEDKDSRLVSLIPGLQRLGKEDASRGNSEQNIDETVVCRPYLSEAWGVLDQRKVVNPLLNWRVPVVGNEIDMKDNLRFWAHTVASIVR

SEQ ID NO: 212814 - protein, 98 aa, Glycine max
  Coding DNA Sequence Number=SeqID_96036
MHMRIKRSLKVVMGPRTRLKQELGNIQIHQAWPKIISSNETYPPHLFPAYSKNNSKAPKFLKGKEVSTRIKPRLLCKQSMGQNTPKDYDDGRLKFSQR

SEQ ID NO: 212815 - protein, 129 aa, Glycine max
  Coding DNA Sequence Number=SeqID_96037
MTKKFRISVTYNTHRCEMKNLLNMVKDKPNGWLQLLDNNGSFAIKSAYATIQDLRMGGIAEELFIQLWKVDAPRKALHMLWRLLFLNRLPVRENLFKRNIQLSSSGSMCGFSYAKYSFHYMEMVDWSTL

SEQ ID NO: 212816 - protein, 61 aa, Glycine max
  Coding DNA Sequence Number=SeqID_96038
MDICGAERTMTVVGEKRVIIKNEKETKQRKLQWTTIMMFAKALLAGSTLSFIPHLTMSFPR

SEQ ID NO: 212817 - protein, 204 aa, Glycine max
  Coding DNA Sequence Number=SeqID_96039
  Gene Ontology: Mol. function=RNA binding
  Homolog annotation: Hit_ID=Q9ZVI3; Match level="QueryCoverage=100%, HitCoverage=52%, E-value=2e-47, Identity=55%"; Hit description =Putative RNA-binding protein
MSGLYNSNFSPVRAASPQIRTNPEVDSQYLTELLAEHQKLGPFMQALPICSRLLNQEILRVSGMLSNQGFGDFDRLRHRSPSPMASSNLMSSVTGTGLGGWNSLQQENAKKVNPVRGKSKTCWLYVSQAKPPPLRLQLRQPLKRPQPQLRGWLGVIAIKVAFQQNRLRGTPGMAMDWQVAPASPSSYTVKRILRLEIPVDAYPN

SEQ ID NO: 212818 - protein, 75 aa, Glycine max
  Coding DNA Sequence Number=SeqID_96040
MMRESGGRDGDLYGVLNDWKSRTCKWQKEDTCSSSRMVMRRIKITTTTNLDVARMEGRGNERSKGASASQKCCIM

SEQ ID NO: 212819 - protein, 50 aa, Glycine max
  Coding DNA Sequence Number=SeqID_96041
MATVFDQPRDVHSGKQSWNFKASVIQSRHMFPLNDPKKYYAFEIVLLDSH

SEQ ID NO: 212820 - protein, 417 aa, Glycine max
  Coding DNA Sequence Number=SeqID_96042
  Homolog annotation: Hit_ID=O04342; Match level="QueryCoverage=31%, HitCoverage=33%, E-value=5e-33, Identity=58%"; Hit description =Expressed protein
MNDGKGRGGNWWYESYVQGGMEAPATLAVVVVTAAMAYRRRHGISRASTFKEEVHPDYDDANDPTPLPSLSSSFSFTPSSSNSSSSLAAQAIKASAARRDPSLSFTFAKSEQHDQHQRSKSFEAYGDVSKSGVWGVLAQKAKEILEDDKSSSPQHNDVINIMPPVVDIDKLKSHSFNTFAPPPQENNKTTRPDQSNQTAAAGTWNPWQPQPAAQTGGGASQTIHQTQLKASRDVAMATAAKAKLLLRELKTVKADLAFSKARCAQLEEENKMLRDRQGTDKGQNVTRADDDLIRLQLETLLAEKGRLASENEVYARENRFLREIVEYHQLTMQDVVYLDEGMEEVTELYPLDATGTAVVPRLSPKSPRSPLSRGGSQTKSFFSVPQIQEEEKNVTSESSLDEAPPSIIDSKDHPHAK

SEQ ID NO: 212821 - protein, 200 aa, Glycine max
  Coding DNA Sequence Number=SeqID_96043
MGVLSLLSMLMLEMLRLLQSSRCRFSEIDRRCTYRSLSLEEDKSIFSTVYGKLILLEHVSEHDIGYKDSLMLFAKDLGPTAQNIAKRKLLGCEIRTVSTSAPCRPDTSNGREKGVIKSSQTRVYVLIHPIRKLVLKILLTQIKGPKKLIEQHRFLQLQQDSSDKMRPFSAPVSYQGVLIRNPPTNLHTTICSHNQPNTSH

SEQ ID NO: 212822 - protein, 824 aa, Glycine max
  Coding DNA Sequence Number=SeqID_96044
  Gene Ontology: Mol. function=hydrolase activity, acting on acid anhydrides, in phosphorus-containing anhydrides; Cellular component =nucleus; Biological process=regulation of transcription, DNA -dependent
  Homolog annotation: Hit_ID=O49289; Match level="QueryCoverage=95%, HitCoverage=87%, E-value=0.0, Identity=69%"; Hit description =Putative DEAD-box ATP-dependent RNA helicase 29
  Pfam annotation: Domain name=DBP10CT; Domain location=671-733; Score =95.8; E_value=1.3e-25; Accession=PF08147.3; Description=DBP10CT (NUC160) domain
  Pfam annotation: Domain name=DEAD; Domain location=42-211; Score =245.0; E_value=1.6e-70; Accession=PF00270.19; Description=DEADDEAH box helicase
  Pfam annotation: Domain name=Helicase_C; Domain location=280-356; Score=93.4; E_value=6.6e-25; Accession=PF00271.21; Description =Helicase conserved C-terminal domain
  Pfam annotation: Domain name=ResIII; Domain location=38-206; Score= -28.5; E_value=0.011; Accession=PF04851.6; Description=Type III restriction enzyme, res subunit
  Pfam module annotation: Pfam domain module=DBP10CT::DEAD::Helicase _C::ResIII; Domain location=671-733::42-211::280-356::38-206
MGREATKKKKMNKNAKSGGFESLGLNPNVFKGIKRKGYKVPTPIQRKTMPLILSGSDVVAMARTGSGKTAAFLVPMLHRLNQHIPQSGVRALILSPTRDLALQTLKFTKELGHFTDLRVSLLVGGDSMEIQFEELAQSPDIIIATPGRLMHHLSEVDDMSLRSVEYVVFDEADCLFGMGFAEQLHQILAQLGENRQTLLFSATLPSALAEFAKAGLRDPQLVRLDLETRISPDLKLAFFTLRQEEKYSALLYLVREHIGSDQQTLIFVSTKHHVEFLNVLFREEGIEPSVCYGDMDQDARKIHVSRFRARKTMLLIVTDVAARGIDIPLLDNVINWDFPPKPKIFVHRVGRAARAGRTGTAYSFVTPEDMAYLLDLHLFLSKPIKPAPTEEEFLQDMDGVMSRCEQAMANRETIYGRFPQKVIDLVSDRVREIIDTSAELELLQRTCKNAFRLYSKTKPLPAKESIRRVKDLPHEGLHPMFMNVLETGELTALAFSEHLKKFRPKQTILEAEGEAAKSKHQQGPSGQWVDVMKRKRAIHENIINLVREQQQSKSNKEKEEIQSEISPSMEKGRKVCKVNGFHHKVFYTLDLTARGSKRKPQSFKDEDHYISSIPKNQHMEAGLTVKANEDFASNSDFEHTIPYFLMVLAFACSALVLMMFNIFRLEAAVLDLVADDGTGIKKQRSMYHWDKRGKKYIKLNNGDRVAANGKIKTESGAKTKANKTGIYKKWKERSHGRISLKGTNNDGDSQESTSLAGSYQRGRRNFKGSKKQHSMPNAHVRSEIKDMDQIRKERQTKANRVSYIKSKSTKGKKFGKNGKKRKGK

SEQ ID NO: 212823 - protein, 47 aa, Glycine max
  Coding DNA Sequence Number=SeqID_96045
MVVVDMVASATQPGSEREEKRQRVLANKFSADEAVRLLHSDTAISNL

SEQ ID NO: 212824 - protein, 645 aa, Glycine max
  Coding DNA Sequence Number=SeqID_96046
  Gene Ontology: Mol. function=transcription regulator activity; Cellular component=nucleus; Biological process=regulation of transcription
  Homolog annotation: Hit_ID=Q1RWB4; Match level="QueryCoverage=73%, HitCoverage=95%, E-value=0.0, Identity=67%"; Hit description =Tetratricopeptide-like helical
  Pfam annotation: Domain name=PPR; Domain location=173-207; Score=9.4; E_value=0.57; Accession=PF01535.11; Description=PPR repeat
  Pfam annotation: Domain name=PPR; Domain location=235-269; Score =24.4; E_value=0.00041; Accession=PF01535.11; Description=PPR repeat
  Pfam annotation: Domain name=PPR; Domain location=340-374; Score =38.1; E_value=3.1e-08; Accession=PF01535.11; Description=PPR repeat
  Pfam annotation: Domain name=PPR; Domain location=375-409; Score =17.5; E_value=0.047; Accession=PF01535.11; Description=PPR repeat
  Pfam module annotation: Pfam domain module=PPR::PPR::PPR::PPR; Domain location=173-207::235-269::340-374::375-409
  Subcellular localization annotation: CTP_CleavageSite=30; ConfidenceScore=5.39e-01
MAVSLWRSRTASSALNLFANTLCRFSSGCVAEATISTTTISPRFPYASSSPKPKHPQHLLSLLLRDPSQRQPLQQVHSHIITSGLFYNPFHNTLTCLLLFNNVIRCYSFGPYPHEALHFFTYTQHCHTFLTYPSLDTFSFAFLCHASANPNYTHFGTQLHALVFKVGFQFHVYVKTGLLQMYSSSGLLVEAAQVFYEMQHRNLVSWNVFITGLIKWGEVELACSVFNQMPARSVVSWTLVIDGYTRRNQPIKALTLFRKMIEVDGIEPTEVTLLTIFPAIANIGCIKICQSVHVYVEKRGFNAFDVRITNALLDLYAKCGCIASMSRFFQEIPDQRRNLVSWTSTISGFAMNGMGREALESFESMEKTGLRPNHVTFLGVLSACSHGGLVEEGINFFVKMVKDWCLVPDIKHYGCVIDMLGRAGRLEEAEKVALQVPHEVANAVMWRTLLGACSVHNNVEIGQRVTNKILEMERGHGGDYVLMSNILVGVGRFKDAERLRERMFMVPVRDIGSDNGVPQKRIVQSLKRRDCIEHLASVREKVKVGLNGYELGGQEEQTMRRGENQLRVKLESLLESETILKKSAEGVIKFIIVGDMWTWERSGAALSINEAFITLSVVVLEIKYFEGGVSWESEDLKQNGKDEIM

SEQ ID NO: 212825 - protein, 47 aa, Glycine max
  Coding DNA Sequence Number=SeqID_96047
MEFCLADRSDVPSKPQRLVTLVSWHPCEDVVKLKTDGSSFRNPDPSG

SEQ ID NO: 212826 - protein, 99 aa, Glycine max
  Coding DNA Sequence Number=SeqID_96048
MDYKDCDPPDKLMFLPIFVVGLKDLENLSGTKILYGLCIGISNALSDSIFPVTSFSNSRQNTTLEWHWQFRRPRSILSRKQPDTNSQCRNELVKKVVFF

SEQ ID NO: 212827 - protein, 225 aa, Glycine max
  Coding DNA Sequence Number=SeqID_96049
  Gene Ontology: Cellular component=intracellular; Biological process =ribosomal large subunit biogenesis and assembly
  Homolog annotation: Hit_ID=Q9FNH2; Match level="QueryCoverage=99%, HitCoverage=100%, E-value=1e-112, Identity=78%"; Hit description =Arabidopsis thaliana genomic DNA, chromosome 5, P1 clone:MHF15
  Pfam annotation: Domain name=Ribosomal_S8e; Domain location=1-202; Score=288.2; E_value=1.6e-83; Accession=PF01201.12; Description =Ribosomal protein S8e
MPQGDYIERHRRDYGYRLDHFERKRKKEARQVHKRSAIAQKALGIKGKMIAKKNYAEKAQMKKTLVLSNTIKQKRKEKAGKWDVPLPKVRPVAEDEMFKVVRTGKRKTKQWKRMVTKATFVGPGFTRKPPKYERFIRPTGLRFTKAHVTHPELKCTFNLELIGVKKNPNGPMYTSLGVITRGTIIEVNVSELGLVTPAGKVVWGKYAQVTNNPENDGCINAVLLV

SEQ ID NO: 212828 - protein, 44 aa, Glycine max
  Coding DNA Sequence Number=SeqID_96050
MIWSAEEVIDRWSATERFVKGVAAHGDEDLIRYESEIKIGVVGD

SEQ ID NO: 212829 - protein, 102 aa, Glycine max
  Coding DNA Sequence Number=SeqID_96051
MSRVPPTNTTSSRKAWQLAACVNDELETSVEAASTTTHEDPTHEHDELKRSLAACCLCQPRAQEKPGSREYHEPQPRPTRCLLHLKYLFQDHTERFIPYCEN

SEQ ID NO: 212830 - protein, 162 aa, Glycine max
  Coding DNA Sequence Number=SeqID_96052
MKQEQIREIEENVMLPAFVEGKSRKLRLGRRGSIGGGDHDIGQYLEPNVIKIESLHRLVRAPKTRLEESTQTHGANTSWVVVVVRAHRVRGWDPEIDISDGANTSWVVVLAASTLVSSSSLTQAASCQAFLELVVFVGIDPALALVHIVGARVGALPRHDDQ

SEQ ID NO: 212831 - protein, 230 aa, Glycine max
  Coding DNA Sequence Number=SeqID_96053
  Homolog annotation: Hit_ID=Q2RB98; Match level="QueryCoverage=55%, HitCoverage=35%, E-value=5e-13, Identity=33%"; Hit description =Expressed protein
MRFRVQGLGFRIKDSWLSGQGSGVRSGFKLLASVDLCKDSMKDTPTDCVVPITPEAVIENGDLQSQSPLTLSVVRKQLKRACIDCDSDRISVDNNNDNGSPRTPKDGVFDPFAPGPDNMALAPNSNKYLDEYRTTVARRLDFHPSFDVVAQAVTDTLSDEEMVESVYENLLQVIVSKQAEGVLAQMSDDCETPPSVLHFSGIADTCPGAPIKPAAKPRNIDLGLCKKLEF

SEQ ID NO: 212832 - protein, 124 aa, Glycine max
  Coding DNA Sequence Number=SeqID_96054
  Subcellular localization annotation: CTP_CleavageSite=18; ConfidenceScore=5.21e-01
MTTLSFKLGKTKVGVSVRQHAATSKRFSRSSQDLAWMLKRYRGRKVLACDEEDGERSDEFEMCVPIDESSDVQVQAGYNSESDAMQWSSCLHFILQNWSNVLSAPLHAQREKPNWKPVLLSMGA

SEQ ID NO: 212833 - protein, 92 aa, Glycine max
  Coding DNA Sequence Number=SeqID_96055
MDCMVEIESSINANANFHIIALEAPPTSTFVSDSCKEFYREGFILSLVLEEGSVGYELEFIALIQDMDSGVERLPQKNEIVDSEMIAILIFS

SEQ ID NO: 212834 - protein, 247 aa, Glycine max
  Coding DNA Sequence Number=SeqID_96056
  Gene Ontology: Mol. function=chromatin binding; Cellular component =chromatin; Biological process=chromatin assembly or disassembly
  Homolog annotation: Hit_ID=Q1SAV4; Match level="QueryCoverage=90%, HitCoverage=88%, E-value=1e-56, Identity=59%"; Hit description =Integrase, catalytic region
  Pfam annotation: Domain name=rve; Domain location=1-147; Score=54.5; E_value=3.6e-13; Accession=PF00665.16; Description=Integrase core domain
  Subcellular localization annotation: CTP_CleavageSite=67; ConfidenceScore=5.09e-01
MDFITRLLPSHGFTVILVVVDRYSKGVHFGALSTSFSTFKVTSLFLDLVCKHHGFPRSIVFDRDPIIVSSFWQELFRLSGTRLCMSTAYHPQTDDQTEVMNHILEQYLRSFVHSHPVSWFRYLALAEWSYNTSLHSSLNLTLFKVKYGKPPPAMPHYLQGMTNNEAVDSLCRNPSAFWTRSLMLQHLHQLNWFLFNGWDSLWKILPRSHGSRYAMLTTLRTRWCLERGVLIAILRRNLNSQQRDPRG

SEQ ID NO: 212835 - protein, 410 aa, Glycine max
  Coding DNA Sequence Number=SeqID_96057
  Gene Ontology: Mol. function=nucleic acid binding; Biological process= RNA-dependent DNA replication
  Homolog annotation: Hit_ID=Q53PR8; Match level="QueryCoverage=47%, HitCoverage=37%, E-value=2e-12, Identity=28%"; Hit description =Transposable element protein, putative
MAVGGEQEHTLQDYLTPCVIITTHIQLPNLGDQNCKLRHVLINMIERIQFHGLPSEDPIVHLRMFSRLIDTVKSLANAPDYIRLTTFPFSLRGRAEDWLSDLSKSFSKAWEHFKGLQRNYLDVVVRENLMHKMTNVEVEIIEVVASNAYNDTILVVTPTLIPTTKAQEIIQTSLGKSREIRGQDKKERRPTFQDMVMEHITKNDERFKSLESTMSNLEWKVYGRTEEERKGHSNTRKKRLTEESHKTEKMGEKKVLTTLQKLHVNIPFDEAIDEMVKYAKFLKEIISNKKKLKDFTIVSLNKECFAIVLKKLPPKLKTLVPLVGKYIFPTDFMILDIEENEDTPIILGQLFLNTRGTLIDVKERKLTWWLGDEEEVFKATNKIKVTVAKSDLSMGKKDPLRNKVIPKDPR

SEQ ID NO: 212836 - protein, 142 aa, Glycine max
  Coding DNA Sequence Number=SeqID_96058
  Gene Ontology: Mol. function=nucleotidyltransferase activity; Cellular component=mitochondrion; Biological process=tRNA processing
  Homolog annotation: Hit_ID=Q6L5J0; Match level="QueryCoverage=69%, HitCoverage=69%, E-value=2e-20, Identity=42%"; Hit description =Putative tRNA His guanylyltransferase
  Pfam annotation: Domain name=Thg1; Domain location=1-140; Score= -43.2; E_value=6.5e-10; Accession=PF04446.3; Description=tRNAHis guanylyltransferase
MANNKYEYVKCFEVEDEAMFPNIILVWIKASKLHKPHDSNALKLMNSCAVEVLEEYADIILAYGFSDEYTFIFKKTSKFYERRASKVLSIITSFFSSVFNHGQPRRSWSIMRALVISQYLKFQCQYFDNNNGGYHHDHSELN

SEQ ID NO: 212837 - protein, 485 aa, Glycine max
  Coding DNA Sequence Number=SeqID_96059
  Gene Ontology: Mol. function=RNA-directed DNA polymerase activity; Cellular component=chromatin; Biological process=chromatin assembly or disassembly
MECQGCPCSTRCALGIISGHYGCDIQGRLKDWREPRKEEHLAETGQNAREHVYDGVSGASLVLNVVIKPEQLREVVVLLWGLDNLRHEFPKALMVCHNAWINRGPKSLLKNAIRCPCCISTTLMAVADASVSTTKGSAKLGRAKTGALVISSLSWSNAVSPRNMRRSLAEVGVGHRTMAWTLEGSGSTPLPETTCPKYSNCFCANKHLACFNDKMAQEGVEQVVYGGLKGGGSVTQPKGHNEILIMPVVCPECRLFDVELTHRNLMKPLPEANGEKFGNLLFDLDFLEVWITVGSYFHGHSGGEKINAMSYFSRRREGKRHKWNKAEVDPVRTRRLTWGAKAGSGPISTSACNSISRPRGGLGVKGECLDTAGYNRKRSRYLLALNGEMWTGWEGGGIARKVSDDGRPDKAWRLISAVGSGTPEFASSLTVGISGSSWMMVAESCWSGTSTIVDPTTCLLKASQVRLPEEEKLVEVPRLPIESPV

SEQ ID NO: 212838 - protein, 46 aa, Glycine max
  Coding DNA Sequence Number=SeqID_96060
GNTGSNKDRRKSLKVYQSHTGQGLTFSPWVKVYDKLGFWLKACRTA

SEQ ID NO: 212839 - protein, 143 aa, Glycine max
  Coding DNA Sequence Number=SeqID_96061
MKMLGVRVILQKRVAPLKTFIIPPILGTWCLIIPILGTNKAQGFKLVATCPFAGERGEAHGCAFQGRKDARSRHQRLFVKNVKKIEGNRSTKAGLLLLRTLQRRGNQTYVVLFKGESSDSFYLEGDHLRRWTLKMIHLLGKEN

SEQ ID NO: 212840 - protein, 47 aa, Glycine max
  Coding DNA Sequence Number=SeqID_96062
MTTRVRAFKAELEQEKRILARKISHADPSQNHLAREDRRISEGKLPN

SEQ ID NO: 212841 - protein, 273 aa, Glycine max
  Coding DNA Sequence Number=SeqID_96063
MRIYWHHCHVLDLMKVTSLYLAKQLLSCNASSQKVKQRLSRWGDHVRHATRARVIDEVATILEEVVDGIGGGGEGEFAAVGEGNEVDQEDEERVNVISGYDYKSLRDLVIDDQADLVLQLSKQKKKRKRVKDSSKTELGGVSKPLGGSDFVGYDVGGGGKLPEMEKRKEIELEKDEEQGKRKKKSDSRSNQSGPTLVTQHNDHTNKAILHYHQGKLHRLDHVLVAQNIISLWNAELTGPQFVQSFVFLSQNDRDMMNYVGPVESLDATEIFLG

SEQ ID NO: 212842 - protein, 1172 aa, Glycine max
  Coding DNA Sequence Number=SeqID_96064
  Gene Ontology: Mol. function=transmembrane receptor activity; Cellular component=membrane; Biological process=defense response
  Homolog annotation: Hit_ID=Q1SPN6; Match level="QueryCoverage=51%, HitCoverage=91%, E-value=0.0, Identity=65%"; Hit description=TIR; Disease resistance protein; AAA ATPase
  Pfam annotation: Domain name=LRR_1; Domain location=654-675; Score =0.8; E_value=2e+02; Accession=PF00560.23; Description=Leucine Rich Repeat
  Pfam annotation: Domain name=LRR_1; Domain location=677-699; Score =11.3; E_value=2.2; Accession=PF00560.23; Description=Leucine Rich Repeat
  Pfam annotation: Domain name=LRR_1; Domain location=701-724; Score =6.6; E_value=17; Accession=PF00560.23; Description=Leucine Rich Repeat
  Pfam annotation: Domain name=LRR_1; Domain location=726-747; Score =7.6; E_value=11; Accession=PF00560.23; Description=Leucine Rich Repeat
  Pfam annotation: Domain name=LRR_1; Domain location=749-771; Score =14.0; E_value=0.56; Accession=PF00560.23; Description=Leucine Rich Repeat
  Pfam annotation: Domain name=LRR_1; Domain location=773-792; Score =8.8; E_value=6.3; Accession=PF00560.23; Description=Leucine Rich Repeat
  Pfam annotation: Domain name=LRR_1; Domain location=797-818; Score =5.8; E_value=23; Accession=PF00560.23; Description=Leucine Rich Repeat
  Pfam annotation: Domain name=LRR_1; Domain location=826-847; Score =8.2; E_value=8.5; Accession=PF00560.23; Description=Leucine Rich Repeat
  Pfam annotation: Domain name=LRR_1; Domain location=849-871; Score =15.6; E_value=0.18; Accession=PF00560.23; Description=Leucine Rich Repeat
  Pfam annotation: Domain name=LRR_1; Domain location=873-894; Score =9.4; E_value=4.9; Accession=PF00560.23; Description=Leucine Rich Repeat
  Pfam annotation: Domain name=LRR_3; Domain location=631-650; Score =23.0; E_value=0.0011; Accession=PF07725.3; Description=Leucine Rich Repeat
  Pfam annotation: Domain name=NB-ARC; Domain location=205-500; Score =77.1; E_value=5.3e-20; Accession=PF00931.13; Description=NB-ARC domain
  Pfam annotation: Domain name=TIR; Domain location=47-180; Score =163.7; E_value=4.6e-46; Accession=PF01582.10; Description=TIR domain
  Pfam module annotation: Pfam domain module=LRR_1::LRR_1::LRR_1::LRR _1::LRR_1::LRR_1::LRR_1::LRR_1::LRR_1::LRR_1::LRR_3::NB-ARC::TIR; Domain location=654-675::677-699::701-724::726-747::749-771::773 -792::797-818::826-847:...
  Pfam module annotation: Domain location=:849-871::873-894::631 -650::205-500::47-180
  Subcellular localization annotation: CTP_CleavageSite=24; ConfidenceScore=5.38e-01
MMKNVSWFWTRFGRGSSSNFSTVSIASSSSNDSVDSSIQNQNYRYDVFISFRGPDTRNTFVDHLYAHLLRKGIFVFKDDKKLQKGESISAQLLQAIQDSRLSIIVFSKQYASSTWCLDEMAAIADCKQQSNQTVFPVFYDVDPSHVRHQNGAYEVAFVSHRSRFREDPDKVDRWARAMTDLANSAGWDVMNKPEFREIENIVQEVIKTLGHKFSGFVDDLIGIQSRVQELEGSLKLSSNNDNVRVLGICGMGGIGKTTQAVVLYDRISYKFDACCFVENVNKIYRDGGATAIQKQIVRQTLDEKNLEIYSPFEISGIVRNRLHNIKVLIFLDNVDQIEQLQELAINPNFLFEGSRMIIITRDEHILKVYGAHVIHKVSLMNDNDARKLFYSKAFKSEDQSSSCVELIPEVLKYVQCLPLAIKVIGSFLCTRNATQWKDALDRFQNSPDNGIMDVLQISIDGLQYEEKEIFLHIACFFKEEMEDYAKRILNCCGLHTHIGIPRLIEKSLITLRDQEIHMHDMLQELGKKIVRNQFPEQPGSWSRIWLYEDFFRVMTTQTGTNNVTAVVLNKKDQDMSECSVAELSKMKNLRLLILYQKSFSGSLDFLSTQLRYLLWHDYPFTSLPSCFAAFDLEELNMPSSSINCLWEGRKNFPCLKRMDLSNSKFLVETPDFSGAPYLERLDLSGCTDLTFVHPSMGRLENLVFLSFRNCNNLISIKIGRGFNLISLRVLHFSGCTKLENTPDFTRTTNLEYLDFDGCTSLSSVHESIGALAKLTFLSFRDCKNLVSIPNNMNTMTSLQTLDLWGCLELMDLPLGRAFSPSSHLKSLVFLDMGFCNLVKVPDAIGELRCLERLNLQGNNFVSIPYDSFCGLHCLAYLNLSHCHKLEALPDLPSERASLGGWYFKTVSGSRDHTSGLYVFDCPKLAHMLVSPSRDLELAWLVRLIKEPCNFRCGFDIVVPLGLEVILPRWLLNQGFKGDSVIRIMQFNVDDNWIGFVFCVTFERNIIRPAVSSSSPHCSFSSSHPFRLSFESEYTEEYFDMPLNLELNKIYGSKHLWVIYISREHCHFVKTGAHITFKAHSSVKINAWGMKSIFRQDIDDLERMQQGESLPLHPNDVVHHVDFDSVEKSNNNSGPKFQLPYNWLVTKEDEVENMNTKAKETNLSNAGLSDDTR

SEQ ID NO: 212843 - protein, 45 aa, Glycine max
  Coding DNA Sequence Number=SeqID_96065
MIGGSTCVYLYLMPAVHFLGAGLESLTRFVGRGADEKYLKWKWRD

SEQ ID NO: 212844 - protein, 85 aa, Glycine max
  Coding DNA Sequence Number=SeqID_96066
  Gene Ontology: Mol. function=nucleotide binding; Cellular component =membrane; Biological process=small GTPase mediated signal transduction
  Homolog annotation: Hit_ID=Q40195; Match level="QueryCoverage=86%, HitCoverage=33%, E-value=4e-34, Identity=97%"; Hit description=Ras -related protein Rab11E
  Pfam annotation: Domain name=Ras; Domain location=15-84; Score=-15.9; E_value=4.4e-08; Accession=PF00071.12; Description=Ras family
MAGYKGDDEYDYLFKLVLIGDSGVGKSNLLSRFTRNEFNLESKSTIGVEFATKSLNIDAKVIKAQIWDTAGQERVETGGMFFVRV

SEQ ID NO: 212845 - protein, 245 aa, Glycine max
  Coding DNA Sequence Number=SeqID_96067
  Homolog annotation: Hit_ID=Q1SC45; Match level="QueryCoverage=54%, HitCoverage=24%, E-value=1e-23, Identity=50%"; Hit description =Probable homeotic protein [imported]-Arabidopsis thaliana- related
MAMGNEGVHDSQIRVDDLDVMYMNDISQNNNIGSGSLAFSSEQSADANATLWDCCSTDEILSAGFNMQRASDLIFGFSIFAEPMKTEIIEHARLAMDELVKLGTAGHPLWQPQPKDRFDILNQIEYLRQFGEVDTALREIVKLIEVGEPQNLPSFDTYQTEQPASKETPTVALQTEASRDMAFINMSPISIVELLMDVERVLLLQSPILTLQHIPVPISDGLKFVILSPYMSGIGYSGPVPDLDL

SEQ ID NO: 212846 - protein, 340 aa, Glycine max
  Coding DNA Sequence Number=SeqID_96068
  Gene Ontology: Mol. function=transferase activity, transferring groups other than amino-acyl groups; Cellular component=integral to membrane
  Homolog annotation: Hit_ID=P75955; Match level="QueryCoverage=95%, HitCoverage=97%, E-value=7e-32, Identity=29%"; Hit description=Inner membrane protein ycfT
  Pfam annotation: Domain name=Acyl_transf_3; Domain location=9-319; Score=8.0; E_value=1.6e-05; Accession=PF01757.12; Description =Acyltransferase family
MNNARKEDIAWVNTLKGVCILLVVLYHTVLPGFEGTVKYLSAGWIPAEIWVQFNTVLSPLRMPAFFFVSGLLATNGILNRPWKQWWSIVGISTEITGQRISQNLNAAYAGSLLEFLKLTFLAMSTSWYLYGLAIYFLCAKIFRQHKVALLVAAVVLNYLAVEKIIPYWGPQSVAQYFLFFLLGAFWSPLMLRLSQLRRENLLPWAALAALSGMHVIFGLDKSLFMCIIAVLVSVAACRWLNAHFSMRYFNWIGRNTLQIYVIHRIFIEFFGMSAILFAQRHHLFEQAWFALLWACFYPLAIVGICSLCSVAVWSLTNRGLGQSLFVFPTLIGLKRSKSVA

SEQ ID NO: 212847 - protein, 295 aa, Glycine max
  Coding DNA Sequence Number=SeqID_96069
  Gene Ontology: Mol. function=metalloendopeptidase activity; Cellular component=membrane; Biological process=proteolysis
  Homolog annotation: Hit_ID=Q66F03; Match level="QueryCoverage=78%, HitCoverage=66%, E-value=1e-78, Identity=64%"; Hit description=M48 peptidase family protein
MAISVMPHLMQHHRRQSIVVFRQGDQPIAEHQRAVRQHKGVRRTGRRHQLQRQRRTLLAHLGRHHLPEQLLQRLLTLGRQCGGFKAALAQKRLRMFAQRLFHRGRDAHGDLAARPRQHDVNVGYDRQQRHQQRHGDAAFVALQAMHPARRTALIEPAAEGRIVIRHKARAVLEGQRQRNIAQRRRDGDVRQGDVTLLILPLQRHALAAFVHQQASRLTRGPPRQLIGALEDHRRLRSCRPDPAPATLLRPPRCWRFPDAPRCPAMPDRLRPPCTPPDNGRGALPPPARRNRARTG

SEQ ID NO: 212848 - protein, 242 aa, Glycine max
  Coding DNA Sequence Number=SeqID_96070
  Gene Ontology: Mol. function=metalloendopeptidase activity; Cellular component=membrane; Biological process=proteolysis
  Homolog annotation: Hit_ID=Q66F03; Match level="QueryCoverage=92%, HitCoverage=65%, E-value=1e-79, Identity=68%"; Hit description=M48 peptidase family protein
  Pfam annotation: Domain name=Peptidase_M48; Domain location=67-240; Score=76.8; E_value=6.8e-20; Accession=PF01435.8; Description =Peptidase family M48
MTLLAVVAYVNVVLPWASSEIAMRIPTSVEQTLGEHTQTFLSQSGFEPSALPAERQQALQQLFRQVMPAEMRQERTPLSLKLMAAPGAPNAFMLPDGTLVLSDGLVALSKNDDALAAVMLHEMGHHAYRHPMRMLVRSSLVALTLMWMTGDVSGIGDTLLQSASFVNEMQFSRGMEREADAFAIAEMQRQGRSLAQMAAIYRALAQAPERETADGWALPAWLSTHPAMQERLDAVNEAMAQQ

SEQ ID NO: 212849 - protein, 205 aa, Glycine max
  Coding DNA Sequence Number=SeqID_96071
  Homolog annotation: Hit_ID=Q7CH57; Match level="QueryCoverage=55%, HitCoverage=100%, E-value=8e-34, Identity=67%"; Hit description =Putative starvation-inducible protein
  Pfam annotation: Domain name=PsiF_repeat; Domain location=124-158; Score=57.5; E_value=4.3e-14; Accession=PF07769.4; Description=psiF repeat
  Pfam annotation: Domain name=PsiF_repeat; Domain location=168-202; Score=72.4; E_value=1.4e-18; Accession=PF07769.4; Description=psiF repeat
  Pfam module annotation: Pfam domain module=PsiF_repeat::PsiF_repeat; Domain location=124-158::168-202
  Subcellular localization annotation: CTP_CleavageSite=36; ConfidenceScore=5.46e-01
MAAATPTMPAWRWRASSCRTARTIPSGRSRTAGCSRGAAIAAPRIISFILSDPPRPSPAHYTQATVISTTPCATSPFSANGGQSIAEGTPMRLITALPLLAGLMLSTNLMAADATTATKTPSPAQAAQQKRMTDCNQQASTKSLKGADRSTFMSTCLKSEGSAATGKTLTPQQQKMKNCNADAKTKDLKGDARKTFMSNCLKKSA

SEQ ID NO: 212850 - protein, 50 aa, Glycine max
  Coding DNA Sequence Number=SeqID_96072
MWEILHDGLKYKIEIHCQNISAIRAVIEENSHGILEIEDRKVKGVESGPR

SEQ ID NO: 212851 - protein, 223 aa, Glycine max
  Coding DNA Sequence Number=SeqID_96073
  Subcellular localization annotation: CTP_CleavageSite=30; ConfidenceScore=5.72e-01
MTKGQGNFYHYPWLVQFPSPATLRVATRVSSSAFTGMATRVSSSAFTRDSNILPSSTYAYKDVHKKAQAIQKQNTTPHVVSRGGYDYLEQKLLSEKTEKKLEEVAQSESVDGVIDPPSPVRRHVKWKMARTKKTGEITTEVAKEITEKIDSFEEQATQGSFVPHGRQDVLPAAIGRPKKLGRVRAIGAGVTIKQYFGSAPRTSRSDSSLPPNELQQLTQLIRD

SEQ ID NO: 212852 - protein, 268 aa, Glycine max
  Coding DNA Sequence Number=SeqID_96074
  Gene Ontology: Mol. function=kinase activity; Cellular component =integral to membrane; Biological process=ion transport
  Homolog annotation: Hit_ID=Q9SKB8; Match level="QueryCoverage=59%, HitCoverage=33%, E-value=5e-62, Identity=52%"; Hit description =Ankyrin-like protein
  Pfam annotation: Domain name=Ank; Domain location=141-170; Score =20.4; E_value=0.0063; Accession=PF00023.20; Description=Ankyrin repeat
  Pfam annotation: Domain name=Ank; Domain location=176-208; Score =25.7; E_value=0.00017; Accession=PF00023.20; Description=Ankyrin repeat
  Pfam annotation: Domain name=Ank; Domain location=210-242; Score =20.2; E_value=0.0074; Accession=PF00023.20; Description=Ankyrin repeat
  Pfam annotation: Domain name=Ank; Domain location=244-267; Score =13.3; E_value=0.38; Accession=PF00023.20; Description=Ankyrin repeat
  Pfam module annotation: Pfam domain module=Ank::Ank::Ank::Ank; Domain location=141-170::176-208::210-242::244-267
MGYEVFMPIEPDVVAWGSFLSSCRVHKYVDLAKVAAEKLLLIDPNNSGAYSALANTLSACGKWEDAAKVRKSMKDKAVKKEQGFSWVQIKNNVHIFGVEDALHPQRDAIYPRAGNLSRVKEIIQNYSNYETKDLLAKQNLEGETPLYVASANGHALVIREILKYLDLQTVSIAAKNGYDPFHIAAKQGHLEVLRELLHSFPNLAMTTDLSNSTALHTAATQGHIDVVNLLLESDSNLAKIARNNGKTVLHSAARMGHLEVVKALLNKD

SEQ ID NO: 212853 - protein, 1592 aa, Glycine max
  Coding DNA Sequence Number=SeqID_96075
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=94%, HitCoverage=99%, E-value=0.0, Identity=57%"; Hit description=Chromo
  Pfam annotation: Domain name=Chromo; Domain location=1483-1537; Score= 42.4; E_value=1.5e-09; Accession=PF00385.14; Description='chromo' (CHRromatin Organisation MOdifier
  Pfam annotation: Domain name=RnaseH; Domain location=933-1052; Score=- 16.1; E_value=0.0018; Accession=PF00075.14; Description=RNase H
  Pfam annotation: Domain name=rve; Domain location=1180-1336; Score =90.0; E_value=7.2e-24; Accession=PF00665.16; Description=Integrase core domain
  Pfam annotation: Domain name=zf-H2C2; Domain location=1121-1162; Score=13.8; E_value=0.0052; Accession=PF09337.1; Description=His(2) -Cys(2) zinc finger
  Pfam module annotation: Pfam domain module=Chromo::RVT_1::Retrotrans _gag::RnaseH::rve::zf-H2C2; Domain location=1483-1537::673-842::171 -261::933-1052::1180-1336::1121-1162
MASGARAGHESKDDESRIVEGMNNKLPDDAELGRGKRLVIINKVQLSLVHFTVTFITLVLSSHHGRQHTHERDLCRIEKNADAITRVSEDFHRQIERLEGANHAHMERMEAIQIANESQITQLNSAMTQILQRLQSIPVSSHGASNSNKEQTRTPFQFFDYYATPDADRLLIASVHLDHDVVPWYQMMQKTDPLLSWQALTRALELDFGPSAYDCPRATLFKLAQSASVNEFYIQFTALMNRVDGLSPAAILDCFISGLQDEIRRDVKAMEPRTLSKAVALAKLFEEKYIANKKPNQMTNLARNYSQNTSFNHKNNQNSQKFDHTTKPNLPPLLPTPQIKPFNPRNQNIKKISPAEIQLRREKNLCYFCDEKFSPAHKCPNRQVMLLQLEDDEELQSDQNQATIEEGEEGSNETETHHLSLNAMKGSNGVGTIRFTGQVGSIRVKILVDGGSSDNFIQPRVAQVLKLPIEPAPNLRVLVGNGQTLQAEGMIQQLPLHIQGQEVKVPVYLLQISGADVILGSTWLATLGPHVADYAALTLKFFQNGHFITLQGEGTMEPSPAQFHHFRRLHNTDAIEECFAIQWLQNEVPGDTLLELPTDMDPEIAILLHTYAQVFKVPSSLPPPREQDHAIPLKQGSEPVKVRPYRYPHTQKEQIEKMVQEMLDQGIIQPSTSPFSSPILLVKKKDGSWRFCTDYRALNAITVKDSFPMPTVDELLDELYGAQYFSKLDLRSGYHQIMVKPEDRAKTAFRTHHGHYEWLVMPFGLTNAPATFQSLMNKVFQSALRKFVLVFFDDILVFSSSWHDHLKHLEAVLQILQQHQLYARLSKCSFGASEVDYLGHQVSGKGVSMESTKVQAVLEWPPPTNVKQLRGFLGLTGYYRRFIKAYAHIAAPLTDLLKKDNFVWNSEAEAAFLKLKNAMTIAPVLALPDFTQPFILETDASGIGVGAVLGQNGHPIAYFSKKLAPRMQKQSAYTRELLAITEALAKFRHYLLGNKFIIRTDQRSLKSLMDQSLQTPEQQAWLHKFLGYDFKIEYKPGRDNQAADALSRMFLLAWSEPHSLFLEELRSKLTANPHLKQLMEDYRSSNEASHYAVREGLLYWKDRLVIPVEEEMVQRILQEYHSSPIGGHAGITRTLARLKAQFYWPKMQEHVKEYVQNCVICQQAKVSNTLPSGLLQPLPIPQQVWEDVAMDFITGLPSVNGYSVIMVVVDRLTKYAHFLPLKADYSSKSVAETFMNNIVKLHGIPKSIVSDRDRVFTSSFRQNLFKLQGTTLAMSSAYHPQTDGQSEILNKCLEMYLRCFTYENPKGWVKALPWSEFWYNTAFHTSLGLTPFKALYGREPPTLTRQPCTTLDPVELREQLINRDNLLAKLKNNLARAQQVMKTQADKKRQEVSMKVGDHVLVKLQPYRQHSAVLRKNQKLAMKYFGPFKIIAKIGTVAYKLELPDTARIHPVFHVSQLKLFKGNSSEPYLPLPLTVTEMGPVMQPVQILANRKLLRGTTQIDQILVQWENGVQEEATWEDIEDIKASYPTFNLEDKVDFKGEGNVTASGARAGHESKDDESRIVEGMNNKLPDDAELGRGKRVRRPSWKLTE

SEQ ID NO: 212854 - protein, 361 aa, Glycine max
  Coding DNA Sequence Number=SeqID_96076
  Gene Ontology: Mol. function=binding; Cellular component =intracellular; Biological process=protein amino acid phosphorylation
  Homolog annotation: Hit_ID=Q1RXQ0; Match level="QueryCoverage=99%, HitCoverage=88%, E-value=3e-44, Identity=27%"; Hit description =Tetratricopeptide-like helical
  Pfam annotation: Domain name=PPR; Domain location=147-181; Score =23.2; E_value=0.00094; Accession=PF01535.11; Description=PPR repeat
  Pfam annotation: Domain name=PPR; Domain location=282-316; Score =37.5; E_value=4.5e-08; Accession=PF01535.11; Description=PPR repeat
  Pfam annotation: Domain name=PPR; Domain location=38-72; Score=33.1; E_value=9.7e-07; Accession=PF01535.11; Description=PPR repeat
  Pfam module annotation: Pfam domain module=PPR::PPR::PPR; Domain location=147-181::282-316::38-72
MPLKTSFSWNSILSAHAKAGNLDSARRVFNEIPQPDSVSWTTMIVGYNHLGLFKSAVHAFLRMVSSGISPTQLTFTNVLASCAAAQALDVGKKVHSFVVKLGQSGVVPVANSLLNMYAKCGDSVMAKFCQFDLALALFDQMTDPDIVSWNSIITGYCHQGYDIKALETFSFMLKSSSLKPDKFTLGSVLSACANRESLKLGKQIHAHIVRADVDIAGAVGNALISMYAKLGAVEVAHRIVEITSTPSLNVIAFTSLLDGYFKIGDIDPARAIFDSLKHRDVVAWIAVIVGYAQNGLISDALVLFRLMIREGPKPNNYTLAAILSVISSLASLDHGKQLHAVAIRLEESKVQEEIAGKEVSE

SEQ ID NO: 212855 - protein, 337 aa, Glycine max
  Coding DNA Sequence Number=SeqID_96077
  Gene Ontology: Mol. function=RNA-directed DNA polymerase activity; Cellular component=extracellular region; Biological process=RNA -dependent DNA replication
  Homolog annotation: Hit_ID=Q1RXD8; Match level="QueryCoverage=65%, HitCoverage=25%, E-value=5e-24, Identity=29%"; Hit description=RNA -directed DNA polymerase
MEKYPKLYLISDQQNKNIQEMGQQTDNGWEWNFKWRRHLFDRELEMADCFLNDVAGSCIQIHKKDEWIWKTEPSGQYSVRSAYNMLKGVDVEEDNVWMFEELWKIRVPTKITIFAWRLLKERLQTKTSLRRRRVAISDTLCPFCGNSEENEAHVFFICDRILPLWWKSMTWVNIHGAFPQKPWQHFSQHAFCLPNRIRVNRWRSWWLALTWTVWQHRNKIIFSNETFDGNKLMEDAIFTLWTWLKSFEKDFAFTYSYWSSNIASGFVFSGGSKFDEFQCGLNNHKHRNKVIFMNAPFNGSKLLEDALFLAWTWFRAMEQNFTIHFNYWSSNLPAGFL

SEQ ID NO: 212856 - protein, 51 aa, Glycine max
  Coding DNA Sequence Number=SeqID_96078
MFLLTKFEIRGLRILCPCRLDFAKQHKCQTPKCRVQSTMDYWHHLSPNNQT

SEQ ID NO: 212857 - protein, 48 aa, Glycine max
  Coding DNA Sequence Number=SeqID_96079
  Gene Ontology: Mol. function=RNA-directed DNA polymerase activity; Biological process=RNA-dependent DNA replication
MRDDSGSLMKPREKPTTRFPSWIKCLRDLQGNLSTGFWMDTRITIRLQ

SEQ ID NO: 212858 - protein, 78 aa, Glycine max
  Coding DNA Sequence Number=SeqID_96080
  Subcellular localization annotation: CTP_CleavageSite=44; ConfidenceScore=5.02e-01
MAAQVPGVDHAFRGDPNPGKTSYPIARRLFAMRRTLGQGDALTSADQGATSTDTSGCTRHPLQWQFGQYSPKHGSHGQ

SEQ ID NO: 212859 - protein, 293 aa, Glycine max
  Coding DNA Sequence Number=SeqID_96081
  Gene Ontology: Mol. function=nucleic acid binding; Cellular component= intracellular; Biological process=ubiquitin cycle
  Homolog annotation: Hit_ID=Q1RZ04; Match level="QueryCoverage=98%, HitCoverage=49%, E-value=4e-95, Identity=59%"; Hit description=Zinc finger, RING-type; Zinc finger, RanBP2-type; Zinc finger, C6HC- type
  Pfam annotation: Domain name=IBR; Domain location=211-274; Score =90.4; E_value=5.4e-24; Accession=PF01485.11; Description=IBR domain
MESEDDMHDANDIESLDDDFYSGETEDAPLDYYSDDDADDYFDDAERIESRRPEESDIRLRQEDDVARVATVLSISRVSASLLLRHHNWSVSRVHDTWFADEERVRKAVGLLEKPIVQHPNARECPIFWTLAMLGLLAVSVLKIILVLGLKWLPVGIPIVSHAGKKRKGGYISTSINDGPGCLMLRCPDPTCGAAIGQDMINLLVSDEDKQKYARYLLRSYIEDNKKSKWCPAPGCEYAVTFDAGSAGNYDVSCFCSYGFCWNCTEEAHRPVDCGTVAKWILKNSAESENMNW

SEQ ID NO: 212860 - protein, 246 aa, Glycine max
  Coding DNA Sequence Number=SeqID_96082
  Gene Ontology: Mol. function=nucleic acid binding; Cellular component= intracellular; Biological process=ubiquitin cycle
  Homolog annotation: Hit_ID=Q1RZ04; Match level="QueryCoverage=82%, HitCoverage=39%, E-value=3e-79, Identity=66%"; Hit description=Zinc finger, RING-type; Zinc finger, RanBP2-type; Zinc finger, C6HC- type
HGERTGGFYACNRYEAAKQEGVSRQKALADLQQMQTVHIEKLSDIQCQPESQLKFITEAWLQIIECRRVLKWTYAYGFYLPEHEHAKKQFFEYLQGEAESGLERLHQCAEKELQPFLSADDPSREFNDFRTKLAGLTSVTRNYFENLVRALENGLSDVGSNGAAFSKATSSKNAAGSSKGRAGRGKGTFRTSLSSKLNDDSHCTCLLPKASAPKAEMETFLMKGVRHGRKAFVTQYHNTTDVGEWR

SEQ ID NO: 212861 - protein, 128 aa, Glycine max
  Coding DNA Sequence Number=SeqID_96083
  Gene Ontology: Mol. function=protein serine/threonine kinase activity; Cellular component=cytoplasm; Biological process=protein amino acid phosphorylation
  Homolog annotation: Hit_ID=Q3YAT0; Match level="QueryCoverage=93%, HitCoverage=22%, E-value=7e-36, Identity=57%"; Hit description =Calcium-dependent protein kinase 2
  Pfam annotation: Domain name=efhand; Domain location=29-57; Score =33.7; E_value=6.6e-07; Accession=PF00036.22; Description=EF hand
  Pfam annotation: Domain name=efhand; Domain location=66-94; Score =35.4; E_value=2e-07; Accession=PF00036.22; Description=EF hand
  Pfam module annotation: Pfam domain module=efhand::efhand; Domain location=29-57::66-94
ADIDGNGTLNYEEFITMSVHLRKIESDEHLSEAFRYFDKNQSGYVEFEELKDALSDDDSEASDDQVVKDILNDVDLDKDGRISFEEFKAMMNTGGDWKMASRQYSRALLNALSFKMFKDTSSNSVKCN

SEQ ID NO: 212862 - protein, 414 aa, Glycine max
  Coding DNA Sequence Number=SeqID_96084
  Gene Ontology: Mol. function=protein serine/threonine kinase activity; Cellular component=flagellin-based flagellum; Biological process=protein amino acid phosphorylation
  Homolog annotation: Hit_ID=Q3YAT0; Match level="QueryCoverage=100%, HitCoverage=76%, E-value=1e-159, Identity=67%"; Hit description =Calcium-dependent protein kinase 2
  Pfam annotation: Domain name=Pkinase; Domain location=66-324; Score =336.8; E_value=3.7e-98; Accession=PF00069.15; Description=Protein kinase domain
  Pfam annotation: Domain name=Pkinase_Tyr; Domain location=66-319; Score=-22.2; E_value=4.1e-11; Accession=PF07714.7; Description =Protein tyrosine kinase
  Pfam annotation: Domain name=efhand; Domain location=371-399; Score =34.8; E_value=3e-07; Accession=PF00036.22; Description=EF hand
  Pfam module annotation: Pfam domain module=Pkinase::Pkinase _Tyr::efhand; Domain location=66-324::66-319::371-399
  Subcellular localization annotation: CTP_CleavageSite=39; ConfidenceScore=5.69e-01
MGSCISTQAVRTRKRSRSPNHKPSTPRGRGHEVARRSSVAARRSSVTARPLNVVSGPSPGNIFDKYQFGKELGRGEFGVTHRVVDVESGEAFACKKISKTKLRTEIDVQDVRREVQIMRHLPQHPNIVAFKEAYEDKDAVYLVMELCEGGELFDRIVAKGHYTERAAANVVKTILEVCKVCHEHGVIHRDLKPENFLFADTSESAPLKSIDFGLSTFYESGERFSEIVGSPYYMAPEVLRRNYGQEIDVWSTGVILYILLCGVPPFWAESEEGIAQAIIRGKVDFTRDPWPKVSDEAKHLVKRMLDPNPFTRITVQEVLDNSWIQNREHGRTISLGDQVRMRIKLFSLMNRFKRKVLRVVADNLSDEQIDVFKQMFNMMDKDKNGNLSFEELRDGLSMIGHAIPDPDVEMLMDA

SEQ ID NO: 212863 - protein, 229 aa, Glycine max
  Coding DNA Sequence Number=SeqID_96085
  Homolog annotation: Hit_ID=UPI00005268DE; Match level="QueryCoverage =34%, HitCoverage=44%, E-value=2e-15, Identity=53%"; Hit description =intracellular protease, PfpI family
MVRVDDSARQDQRLELIRRRLGRVHVDGLLVPVLARDRRAVGGHHRRARALSGHRLPRAGQFAVLEPVGRQESHSGAGESHHSSFRGVVGRSLRISRPSPGGIRASRGWQITGAGGTRCRRPGVLCADLCAAAVASRHAPSSCPRPPSGARAPRRLCPGACTEPLPVGDLDACSHHARTDPHGRGDPHPGTVGVGVHDSAARGAVHREDPEPRTGRNLLRRHGHHRAAG

SEQ ID NO: 212864 - protein, 82 aa, Glycine max
  Coding DNA Sequence Number=SeqID_96086
  Subcellular localization annotation: CTP_CleavageSite=63; ConfidenceScore=5.59e-01
VDSRGSHTPIIRGSWVRAPRGPPVRHWDRLRTRPRRRPPGVRRGSRRHRPAGTPRAARTPGPRGSRRSRTRRRCPGRPQSAG

SEQ ID NO: 212865 - protein, 162 aa, Glycine max
  Coding DNA Sequence Number=SeqID_96087
  Gene Ontology: Mol. function=hydrolase activity; Biological process =metabolic process
  Homolog annotation: Hit_ID=Q1M834; Match level="QueryCoverage=73%, HitCoverage=53%, E-value=9e-11, Identity=35%"; Hit description =Putative dehalogenase-hydrolase
MNEVTGGNVDTFEIYLLILSALQVDIKEINTYDLNAFYIKSEELFLEYKPVIIFDNIHQLFDEIKNQGKTINILSNTGFIKGKTLRKFLIEENLDDYIDFHIYSDEINCSKPNPIAFQEVKSKIKNQELELRQILHIGDNAIADFNGAKSFGFNAHLLKHSI

SEQ ID NO: 212866 - protein, 51 aa, Glycine max
  Coding DNA Sequence Number=SeqID_96088
MIRKSIVQCNRSTNLRPNKVFSPPLYWILTLPRLRQESPNRRLFDIGDRLT

SEQ ID NO: 212867 - protein, 34 aa, Glycine max
  Coding DNA Sequence Number=SeqID_96089
MTIEVPRSLSMQLFLLVKTIQDVPLLVVYFSFAT

SEQ ID NO: 212868 - protein, 50 aa, Glycine max
  Coding DNA Sequence Number=SeqID_96090
  Gene Ontology: Mol. function=protein serine/threonine kinase activity; Biological process=protein amino acid phosphorylation
  Homolog annotation: Hit_ID=Q9LW62; Match level="QueryCoverage=76%, HitCoverage=8%, E-value=2e-13, Identity=89%"; Hit description=Casein kinase
MDHVIGGKFKLGRKIGSGSFGELYIAVNIQTGEEVAVKLVMRVPLRIRDT

SEQ ID NO: 212869 - protein, 91 aa, Glycine max
  Coding DNA Sequence Number=SeqID_96091
DVTTCTKRTSTNKATYLSLKSDLQREFGVFLEEASVCTRVWPWLEAFACFDPRGEGDILTTGVFAVFHLVLLFVVKEVSELWKAKSSVGSS

SEQ ID NO: 212870 - protein, 51 aa, Glycine max
  Coding DNA Sequence Number=SeqID_96092
MVPAKFQVELEWCMAVDGGKYGYGRRRLRDVERRGDGSAMCWLWKREVVLG

SEQ ID NO: 212871 - protein, 113 aa, Glycine max
  Coding DNA Sequence Number=SeqID_96093
MDNYMDLGGLKFKPKLKKILTQKERVLLAHPFWLLDCELLFPLVRVNFELGVIMVIAVSFGKPVVPAALMNRPTRGERRFAYWALAECILAYYVGTDEGVSEVLHVAGEKRLH

SEQ ID NO: 212872 - protein, 132 aa, Glycine max
  Coding DNA Sequence Number=SeqID_96094
MAVTRVRKECDELRDVNMTTAEALERETKRARKEEWGQNKFRRALWGNNNKLKLQRAKKDESRVESMILEDKLRACQRSKRSLTEQLSSTEENMLTIIDQYKEKLNLAASHRQRLKDEHAKVSTLQVEREAR

SEQ ID NO: 212873 - protein, 166 aa, Glycine max
  Coding DNA Sequence Number=SeqID_96095
MPYACDTRLDVPNQFVSRYERPTLLLDLLQKHVQGLKIWGVRYRQLDNGGCSFQEPMNRQTAFRSYPLGWCKPTDGHHAQKIKLPIIIQCTFKWYTVTRQLGQIIKEGLVNDHLYPIDLRNQEKKSISMNLGSMIEREEKRLVYRVRCSSDENNEEEEMEEGIGVS

SEQ ID NO: 212874 - protein, 39 aa, Glycine max
  Coding DNA Sequence Number=SeqID_96096
MPESEDFRIRLPNQVVFKDCRNWFHSKVNLGSKSMFLRP

SEQ ID NO: 212875 - protein, 625 aa, Glycine max
  Coding DNA Sequence Number=SeqID_96097
  Gene Ontology: Mol. function=dolichyl-diphosphooligosaccharide -protein glycotransferase activity; Cellular component=oligosaccharyl transferase complex; Biological process=protein amino acid N-linked glycosylation via asparagine
  Homolog annotation: Hit_ID=Q5N7W3; Match level="QueryCoverage=90%, HitCoverage=78%, E-value=1e-167, Identity=54%"; Hit description =Putative ribophorin II
  Pfam annotation: Domain name=Ribophorin_II; Domain location=1-614; Score=538.2; E_value=8.7e-159; Accession=PF05817.4; Description =Ribophorin II (RPN2)
LEEAYEALRVFEILGIGNKPDVSTTTCKKVAENLELSSPVKDLFYSLKVNGILKCKVDGDVFTDIALRLKATVNDASTLVDMYYSIGSLVLIKDQASDVDVLLTDADGTFHSIKALSQSDGRWRYSSDNPESSTYAAGLALEALAGVISLASSEIDQSRVNTVKNDILKLFDSIEKYDDGTFYFDEKFVGGSEHQGSLSTTSSVVQGVTAFAAVTSGKINLPGDKILGLANFFLGIGIPGDAKDFFNQVESLALLENNRQGFHPIGTVTSCNGLFIIQKRSAQVFLVLTYTWENMTNFYFKMNQVRVNTVLGSAAPPLTVKLVRAFRSDAKDSAIIESKELQYDQNNGIHVLEAFPNNVDVGTYAFVFEIALHDSAGEKVYATGGQIHVPIYVTGIIKVSNAEIAVLDSDLGSVETQKTLDLAGNDVVSLSANHLQKLRFSFQLTTPHDHAFKPLQAFFKLKHETKHEHIFVVGNTGKKFEIILDFLGLVEKFYYLSGRYDIELTVGDAVMENSFLWLLGQVDLDLPEAPEKAARLPPLPVDPYSRYGPKAEIAHLFRAPEKRPPQELSLTFLGLTLLPFIGFLVGSSDLGAWEQLMVTKANAIMETPMEAMEKAIEENCEVVEA

SEQ ID NO: 212876 - protein, 76 aa, Glycine max
  Coding DNA Sequence Number=SeqID_96098
MAPRKLASKRSRKDKVAEGPSSAPEFDSHRFRSAEHQQRFEAIKEWSFLRERRVQLRDDEYTDFQEEIVRRRWASL

SEQ ID NO: 212877 - protein, 120 aa, Glycine max
  Coding DNA Sequence Number=SeqID_96099
  Gene Ontology: Mol. function=protein binding; Cellular component =ribonucleoprotein complex; Biological process=rRNA processing
  Homolog annotation: Hit_ID=Q6K950; Match level="QueryCoverage=57%, HitCoverage=27%, E-value=7e-28, Identity=82%"; Hit description =Nucleolar RNA-binding Nop10p-like protein
  Pfam annotation: Domain name=Nop10p; Domain location=59-109; Score =91.2; E_value=3.2e-24; Accession=PF04135.3; Description=Nucleolar RNA-binding protein, Nop10p family
MGHRVHNQYLNERPILVETKHLCSRPEDLKTLNPFLASIAGFYLYCCSLLRLGSVTMYLQFYINDNGDKVYTTKKDSPLGLPTQSAHPARFSPDDKYSRQRVLLKKRFGLLPTQQPPPKY

SEQ ID NO: 212878 - protein, 39 aa, Glycine max
  Coding DNA Sequence Number=SeqID_96100
  Homolog annotation: Hit_ID=Q40547; Match level="QueryCoverage=100%, HitCoverage=7%, E-value=9e-09, Identity=74%"; Hit description =Protein kinase
MEAAFIPEVNDELDTQNFEKFEESDSQSHSSSRIGPWRK

SEQ ID NO: 212879 - protein, 369 aa, Glycine max
  Coding DNA Sequence Number=SeqID_96101
  Gene Ontology: Mol. function=protein serine/threonine kinase activity; Cellular component=phragmoplast; Biological process =protein amino acid phosphorylation
  Homolog annotation: Hit_ID=Q9LW99; Match level="QueryCoverage=99%, HitCoverage=65%, E-value=0.0, Identity=85%"; Hit description=Protein kinase MK6
  Pfam annotation: Domain name=Pkinase; Domain location=120-369; Score =184.3; E_value=3e-52; Accession=PF00069.15; Description=Protein kinase domain
  Pfam annotation: Domain name=Pkinase_Tyr; Domain location=120-366; Score=-24.7; E_value=5.9e-11; Accession=PF07714.7; Description =Protein tyrosine kinase
  Pfam module annotation: Pfam domain module=Pkinase::Pkinase_Tyr; Domain location=120-369::120-366
MDSARSWLQKFQPRDKLRASTRKNDDTNGEDEIPNMSMDEATLSNITKQKVAAAKQYIENHYKEQMKSLQERKERRTILEKKLADADVSEEDQNNLLKFLEKKETEYMRLQRHKMGVDDFELLTMIGKGAFGEVRVCREKTTDHVYAMKKLKKSEMLRRGQVEHVRAERNLLAEVDNNCIVKLYCSFQDDEYLYLIMEYLPGGDMMTLLMRKDILTEDETRFYVGETVLAIESIHKHNYIHRDIKPDNLLLDRYGHLRLSDFGLCKPLDCSTLEEADFSTSQNANGSTRNDEHATPKRTQQEQLQNWQKNRRTLAYSTVGTPDYIAPEVLMKKGYGMECDWWSLGAIMYEMLVGYPPFYSDDPMSTCRK

SEQ ID NO: 212880 - protein, 402 aa, Glycine max
  Coding DNA Sequence Number=SeqID_96102
  Gene Ontology: Mol. function=aspartate-tRNA ligase activity; Cellular component=cytoplasm; Biological process=tRNA aminoacylation for protein translation
  Homolog annotation: Hit_ID=Q5H2B1; Match level="QueryCoverage=47%, HitCoverage=33%, E-value=4e-95, Identity=89%"; Hit description =Aspartyl-tRNA synthetase
  Pfam annotation: Domain name=tRNA-synt_2; Domain location=325-402; Score=-210.8; E_value=0.082; Accession=PF00152.11; Description=tRNA synthetases class II (D, K and N)
  Pfam annotation: Domain name=tRNA_anti; Domain location=228-310; Score=77.7; E_value=3.7e-20; Accession=PF01336.15; Description=OB -fold nucleic acid binding domain
  Pfam module annotation: Pfam domain module=tRNA-synt_2::tRNA_anti; Domain location=325-402::228-310
GEFGAAAATDPDRAIAHTPGAAFVAGAAGQLADQPGIAPAYRTAALAVVLALAADGFAGPAVVASPATAIAAAPATAGLDEFGTAAIGDPDAAIAAAPGAAFVAGAAGQLADQLRIAPAGVADPFAVVLALAADHPVLRGGRGGGQGERGDGAQAQGHGQAGQGQRFHGGIPYGGSRCDWPDLPRPGPRPQNTRLSGPHPVPAFSSGASPMRTHFCGLVDETLIGQTVTLAGWTDVARNQGGVCFIDLRDHEGIVQVTVEVDNAEVFAVAASLGYEDVLQVEGVVRARHAVNDKMRTGKVEVIVTAITVLNKAAPLPFHAHENPGEEIRLKYRYLDLRRPEMQRMQRTRIKLVQALRRHLDEKGFQDIETPILTKAIPEGARDFLVPARMHPGEFYALPQSP

SEQ ID NO: 212881 - protein, 67 aa, Glycine max
  Coding DNA Sequence Number=SeqID_96103
MSRNFTYCATKGAKYLEALNVCGKVHLKTKLQEIAYPDLDSMCPPPEKVTIDKWMNNTDMGYLIALR

SEQ ID NO: 212882 - protein, 301 aa, Glycine max
  Coding DNA Sequence Number=SeqID_96104
  Gene Ontology: Mol. function=chitin binding; Cellular component =extracellular region; Biological process=chitin metabolic process
  Homolog annotation: Hit_ID=UPI000044A8F0; Match level="QueryCoverage =93%, HitCoverage=99%, E-value=2e-29, Identity=27%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MRGTVHEPQASIRADQKVDPWVLVPSPSEDCTFSPSEDYTSSPSEGCTPSPPLGTSTLSFKELHILTIRGLHVLTFRGLHALAIRRSRALTFKGLHALAIRRPRALTFRGLHVLAFRGLHVLAFRGLHVLTFRGLHILTFRGPHVLAFGGLQALTFRGLHILTFRGLHVLAFRGLHVLAFRGLHVLAFRGLHVLTFRGPHVLAFRGLPALTFRGLHDLTFKGLHILTIKGLHVLAIRGLHALTFSGLDVLAFKGLVPSPLEDHMSLPSEDKTSSPSEDYASSPSEGCTLAPLQDYTSSPLE

SEQ ID NO: 212883 - protein, 56 aa, Glycine max
  Coding DNA Sequence Number=SeqID_96105
GMHHRLQMPVINAGNPRALLDLSGSRGCLRFGASRGLSERAQAIIDCTWLKAQSED

SEQ ID NO: 212884 - protein, 179 aa, Glycine max
  Coding DNA Sequence Number=SeqID_96106
  Gene Ontology: Mol. function=catalytic activity; Biological process =auxin mediated signaling pathway
  Homolog annotation: Hit_ID=P33079; Match level="QueryCoverage=51%, HitCoverage=100%, E-value=1e-47, Identity=100%"; Hit description =Auxin-induced protein 10A5
  Pfam annotation: Domain name=Auxin_inducible; Domain location=87-177; Score=185.5; E_value=1.3e-52; Accession=PF02519.5; Description=Auxin responsive protein
MWFIVLYDHVFSIGFLLTSKNLFRAVNLVGLRFTGCYRSHAYNDLKKHVRCLKHIHHWISHTTMPEQTLGCQVGNLVATNSEGEKIMGFRIAGIVRRTSFYTTQAASKRVDVPKGYAAVYVGDKMRRFTIPVSYLNEPSFQELLSQAEEEFGYDHPMGGLTIPCKEEEFLNVTAHLNEL

SEQ ID NO: 212885 - protein, 100 aa, Glycine max
  Coding DNA Sequence Number=SeqID_96107
  Homolog annotation: Hit_ID=UPI000069F178; Match level="QueryCoverage =94%, HitCoverage=36%, E-value=2e-08, Identity=34%"; Hit description =UPI000069F178 related cluster
  Subcellular localization annotation: CTP_CleavageSite=66; ConfidenceScore=5.32e-01
VRACSPLKARTYSPLEVKACSPLMVRACSPLKARTYSPLEVRACSPLMVRTRSPLKARTCSPLTVRARTYSPLEVKACSPLMVRTRNPLKARTCIPLNGE

SEQ ID NO: 212886 - protein, 58 aa, Glycine max
  Coding DNA Sequence Number=SeqID_96108
MDKFGACQRWGGPSTLSSSFARDDESIPSTCNFFDWDKGPVNVIGANVDGRQMAVADP

SEQ ID NO: 212887 - protein, 335 aa, Glycine max
  Coding DNA Sequence Number=SeqID_96109
  Gene Ontology: Mol. function=chitin binding; Cellular component =extracellular region; Biological process=chitin metabolic process
  Homolog annotation: Hit_ID=UPI000044A8F0; Match level="QueryCoverage =78%, HitCoverage=100%, E-value=3e-39, Identity=31%"; Hit description= PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MPSEDSTSSPSEDCMSTTLEGYTPSPSKHYMPSPSEDYSSSPLEDYRSSPIEGYTPSLSEGYTSSPSEDLHALAFRRLHVLAFRGLHVLTFIGLHHILAFRGLHVLVFRGLHALAFRGLQVLAFRGLHVLSIRGLQVLAFRGLHALALRGLHVHVFIGLHAHAFRGLHALPFRGLHILTFRGLQVLAIRGLHAYAFRGLHAFAFRGLHALAFRGLHAIAFTGLHGLTFRRLHALAFRRLHVLAIGGLYVLAIRGLHGLTIRGLHVLAFRGLHALAFRGLHVLAFIVLHVLAFSGKHALAFIGLHVLIFRELRALAFRGLRVLALRGLHGLALRRL

SEQ ID NO: 212888 - protein, 466 aa, Glycine max
  Coding DNA Sequence Number=SeqID_96110
  Gene Ontology: Mol. function=RNA-directed DNA polymerase activity; Cellular component=chromatin; Biological process=chromatin assembly or disassembly
  Pfam annotation: Domain name=Chromo; Domain location=410-461; Score =39.5; E_value=1.2e-08; Accession=PF00385.14; Description='chromo' (CHRromatin Organisation MOdifier
  Pfam annotation: Domain name=rve; Domain location=134-290; Score =95.7; E_value=1.4e-25; Accession=PF00665.16; Description=Integrase core domain
  Pfam module annotation: Pfam domain module=Chromo::rve; Domain location=410-461::134-290
QHYYLAKLLGYDYQIKFKRGHSNVVTDALSRVQPPLEATCLILHVPQLDFMHQLRQSLRASTKFQEKLRAIQTSPTDYPDFLIHNELIFYKGSIWITDDNPFIPSLLNEFPSTPLGGHFGVLKTTHRLQANFTWPNIRRDDLLMDFITHLPNSQNHTVVMVFVDRFSKGVHFGALHSNFTAYKVANLFLDIICKLHGFPKSIVSYRNPIFVNQFWRELFRLSGTTLHLSTTYHPQSDGQTEVINRVLEQYLRAFIHDRPAEWVKYLPLAEWSYNTSLHSSIEFTPFEVIYGEPPPSIPDSLLSSSNNEAAKSLLRDRTSVHQKLQNCLLKAQSTMKHFADMKRWPESFDRFFGPFEITKRIGLVAYRLNLPAASKIHPVFHCSLLQRYYGPIPPATHNLPPTAHGNLPILEPLAILAHKDDNTTSPSTPLVLVQWKGLLPEETSWEPLSAISDKLHLEDKVPLPAG

SEQ ID NO: 212889 - protein, 189 aa, Glycine max
  Coding DNA Sequence Number=SeqID_96111
VEEDSLVFGEDVCNFGNGVGSDGFQRLRSELHMEGGVVSNDEPKLLKPIYTQYNVSSAYREPKRWNVVGAVNPERALKLMWGVGSSGGGSGVSVVGWVVGFCDEKEDSTATLVGWAPLVVAVIAQTLLSSEGHVFWRAMDKGLTGWYGRGLWGLGKGMSDRGRGWVGSGSGLREGDRLECEYLPTDFRR

SEQ ID NO: 212890 - protein, 52 aa, Glycine max
  Coding DNA Sequence Number=SeqID_96112
MAYRRPYLHEVFPVVPACSFLTRQKAKESSDYGDCQQGCMKCLQTLGIVYTF

SEQ ID NO: 212891 - protein, 133 aa, Glycine max
  Coding DNA Sequence Number=SeqID_96113
MAEHGTRKTTTDRLEEALARLTLHHESLAAQHSDLASKVAIFLNKFSHPQPTPALPPPASPKPHIKLEVPRFDGRDPLGWIFKISQFFDYQSTPEEERITLASFYLDGPALSWFQWSYRNGFITSWSGFLQAL

SEQ ID NO: 212892 - protein, 63 aa, Glycine max
  Coding DNA Sequence Number=SeqID_96114
  Homolog annotation: Hit_ID=Q10LR1; Match level="QueryCoverage=96%, HitCoverage=41%, E-value=8e-08, Identity=46%"; Hit description=BHLH transcription factor bHLH033, putative, expressed
MDSRRRSKKAAMQRKLQQLRSVNKASIIVDATRYIEELKQKVDGLNSELGTAESSISQDELPM

SEQ ID NO: 212893 - protein, 89 aa, Glycine max
  Coding DNA Sequence Number=SeqID_96115
  Gene Ontology: Mol. function=protein serine/threonine kinase activity; Biological process=protein amino acid phosphorylation
MGIEILEPNTCIRGCCTSPSIPLHLPPSSYTLLSPIARGSESVVYEGTLDGTRVAVKKPILSTSEDINKFHKELQLLWSLSLSTASLLM

SEQ ID NO: 212894 - protein, 53 aa, Glycine max
  Coding DNA Sequence Number=SeqID_96116
MKIDTTQHGNYSAAEECVCDGNFVSLDVMLLEFWPFHADVPGSCGAQKKWTPP

SEQ ID NO: 212895 - protein, 137 aa, Glycine max
  Coding DNA Sequence Number=SeqID_96117
  Gene Ontology: Mol. function=lipid binding; Cellular component =cellular_component; Biological process=lipid transport
  Homolog annotation: Hit_ID=A0AT30; Match level="QueryCoverage=71%, HitCoverage=82%, E-value=2e-25, Identity=56%"; Hit description=Lipid transfer protein 3 precursor
  Pfam annotation: Domain name=Tryp_alpha_amyl; Domain location=31-116; Score=117.9; E_value=2.9e-32; Accession=PF00234.12; Description =Protease inhibitorseed storageLTP f
MTSFKVACVVAMMCMVVAMSVTPMAQAAITCGQVAGDVSPCLSYLRSGGKPSDACCNGVKSLSGAAKTTADRQAACNCLKNLANNMGQSLNAGNAASLPGKCGVNIPYKISTSTNCATNHLMYCTYFNISFAKIPKE

SEQ ID NO: 212896 - protein, 121 aa, Glycine max
  Coding DNA Sequence Number=SeqID_96118
MDVSISFLNDHLEEALGSTKIQENHSKCINLTQCEANKSPTHRISVCNQRERATLGRGVANYPSEGGRRVTRGDASSKKGIRAESPPTFIGGKCWKNQKRRGLRILSKKVRELYLRTGKGV

SEQ ID NO: 212897 - protein, 570 aa, Glycine max
  Coding DNA Sequence Number=SeqID_96119
  Gene Ontology: Mol. function=nucleic acid binding
MGSWVMNPTLKWGGKEENVYHDLDMGTWSFLEVVDLIHDLEYFVIDGLKMWWKGFDVNNETLRDLSNDQDSMDLARESDYEEVTEDEVRGELTEGEELFKDQQILVFDHGVDDLFDWDSVMAFDDNDEPSRKQNELRVKSKVSNKGKQKDSGYEDPFVENPSQCDEDPNWMDDDSMTNPPHEEPNTNFKEMHDLETGNETEELYSDVESKDDTTKPGKRFPMFRGKKLSKAFKWTLGMQFTCLQDFKEGMMEYFVLNGYQVCFPKNDHSRVKPVCKIKECPFTTYVSRVGETITFQLKTLELTHTCARVFYNKNVKSKWVTKVLLDKFRTPERFKFPQIMQEMKSTYVVGITRSCAIFARKLTLCQIEAFVVVETENKESWKWFLNELLAGIGDFETHKWVFISDRKKGLVKAFHETDDRIEHRLCVRHMSSAKRRSNGCFKATYLEAYEEKMNQIKEINNKGKIMPRPMKRLEWETEKSKHWFVEYAGNMLYERCLQYGHNTQTCKERPMAAGESKAQVIGSKIPATGNTVEASGFEAQAVGSKIPTVGNTFEDGGFEAQVTGSEIPTA

SEQ ID NO: 212898 - protein, 218 aa, Glycine max
  Coding DNA Sequence Number=SeqID_96120
  Gene Ontology: Mol. function=chitin binding; Cellular component =extracellular region; Biological process=chitin metabolic process
  Homolog annotation: Hit_ID=UPI000044A8F0; Match level="QueryCoverage =93%, HitCoverage=99%, E-value=2e-28, Identity=28%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MRGIVHEPQGGPLGTSTLVFRGLLALSIRGLHALAFVGLHALTFRGLHVLTFRVLHVLAFRGQHVLAFAFVGLHALTFRVLHILAFKGLHVLHFRELHVLALRGLHVLTFRGPNILIFRGLHVLIFRGLHVLIFIGLHALIFRGLHVLAFRGLHVLAFRGLHVLAFRGLHVLAIRGLHALAIRGLHVLVIKGLHTLVFRGLHVLAIRGLHVLAFRGLH

SEQ ID NO: 212899 - protein, 117 aa, Glycine max
  Coding DNA Sequence Number=SeqID_96121
  Subcellular localization annotation: CTP_CleavageSite=64; ConfidenceScore=5.21e-01
MQFQQETRALIQSLTNQMGQMATQLNQAQSQNFDKLPSQSVQNPKNVSAITLRSGKQYQGPQPVASSSSANEPAQLHSTPEKDDDKNLKTTYPSSIPSKSNFQQKNGRGKEGDLGNI

SEQ ID NO: 212900 - protein, 287 aa, Glycine max
  Coding DNA Sequence Number=SeqID_96122
  Gene Ontology: Mol. function=nucleic acid binding; Biological process= DNA integration
  Homolog annotation: Hit_ID=Q1RWN2; Match level="QueryCoverage=89%, HitCoverage=20%, E-value=1e-47, Identity=41%"; Hit description =Peptidase S8 and S53, subtilisin, kexin, sedolisin; Integrase, catalytic region; Zinc finger, CCHC-type
  Pfam annotation: Domain name=zf-CCHC; Domain location=221-238; Score =26.0; E_value=5.1e-05; Accession=PF00098.13; Description=Zinc knuckle
VSRARLREREQSKGVRETVVQKSPSDDVALTEAQQKEYEVMKLKDLKAKNYLFQAIDRSSLETILCKDTSKDIWDSMKKKYQGSSQVKSAQLQALRRDFEVLQMKESESVTDYCSRTMGIANNMRFHGEEMTDTAIVEKILRSLTPKFDYVCMNKRSAMEEHALKASTNTHSNNSRGRGRGRGRGRGRGDRGNRDFSNNSKDNNDQSQGNGRGRDHDKLKVQCYRCQKFGHYASNCYTRLPNLKEKGESSNFIKEKEVETLLMVVEDAKDGEAEIWYVDTGCSNHMS

SEQ ID NO: 212901 - protein, 70 aa, Glycine max
  Coding DNA Sequence Number=SeqID_96123
MPQGFSSLVIDYTALLIDYQRPNSNYTTSEHENLQYALCNRLHITGNRLPVACYSVMQSYPARALDRKTP

SEQ ID NO: 212902 - protein, 180 aa, Glycine max
  Coding DNA Sequence Number=SeqID_96124
QQKVYTDNHSGIFGRQRDSKVSMTDLMSAEDNAFRLTDSKTFIRITTQGAEDDVSLCVLSGFSSYRMQKVYTDNHSGISGRQRDSKVSMTDLVSAEDDVAEDDVSLCVLSGFSSYRQQKVYTDNHSGISGRQRDSKVSMTDLVSAEDDAFHLTDSKKFIRITTRVFPARQRDSKVSMTDL

SEQ ID NO: 212903 - protein, 99 aa, Glycine max
  Coding DNA Sequence Number=SeqID_96125
MDKGKTFSVRLQQLWHVLLQSNQSKDPSLVFLSTKLQNKPKWTQKLDRKQGIYFPKIYNQKKDQTKIDAYVRNKRTQQGTTKHECKHATKEMEKQRRRT

SEQ ID NO: 212904 - protein, 168 aa, Glycine max
  Coding DNA Sequence Number=SeqID_96126
MPRFASVESSSPILASPGCLHKGRSVGDFNCHERRPRKGVASVPPLGSVIELNDSDTDEDEDHDLDNAIANAVNGASSSVESPSKKQWTSEAEEVVLPVVFVTPLPPTPVPPPTLMLSLLAMEYASNSAASRTNASKSLSLNSSKQFWKAGDYDGAPLGGSTAVAGAS

SEQ ID NO: 212905 - protein, 82 aa, Glycine max
  Coding DNA Sequence Number=SeqID_96127
  Gene Ontology: Mol. function=drug transporter activity; Cellular component=membrane; Biological process=multidrug transport
  Homolog annotation: Hit_ID=Q1SD91; Match level="QueryCoverage=98%, HitCoverage=22%, E-value=1e-23, Identity=51%"; Hit description=Multi antimicrobial extrusion protein MatE
MQFKYGIPEAMISTILAYWIPDIGQLIFITCGWCPGTWKGFFFIIQRSLLVAKLSISSDAMLCININGWEMMIAFGFMAAAS

SEQ ID NO: 212906 - protein, 136 aa, Glycine max
  Coding DNA Sequence Number=SeqID_96128
  Gene Ontology: Mol. function=lipid binding; Cellular component =cellular_component; Biological process=lipid transport
  Homolog annotation: Hit_ID=Q9M5X6; Match level="QueryCoverage=65%, HitCoverage=77%, E-value=9e-30, Identity=64%"; Hit description =Nonspecific lipid-transfer protein precursor
  Pfam annotation: Domain name=Tryp_alpha_amyl; Domain location=32-117; Score=115.2; E_value=1.9e-31; Accession=PF00234.12; Description =Protease inhibitorseed storageLTP f
MASLKVACVVAVMCMVVVAMSAAPMAQAAITCGQVAGDMSPCFSYLRSGGKPSQACCNGVKSLSSAAKTTADRQGACSCLKNLANNMGQSLNAGNAASLPGKCGVNIPYKISTSTNCATAMRDPPVRVSSWYCRVP

SEQ ID NO: 212907 - protein, 104 aa, Glycine max
  Coding DNA Sequence Number=SeqID_96129
  Homolog annotation: Hit_ID=Q9LKZ6; Match level="QueryCoverage=50%, HitCoverage=5%, E-value=2e-12, Identity=67%"; Hit description =Receptor-like protein kinase 1
  Subcellular localization annotation: CTP_CleavageSite=52; ConfidenceScore=5.52e-01
MAKASCFRNYYSLSGTATATQSLIPSPFSPTSNSVQIQTKHAVGELVASRLVAGEGEGLDVLPGAILGRDLAGEEVAAEVKVVEEGHDGNGERNFQIHSLEDRI

SEQ ID NO: 212908 - protein, 525 aa, Glycine max
  Coding DNA Sequence Number=SeqID_96130
  Gene Ontology: Mol. function=oxidoreductase activity; Cellular component=membrane; Biological process=electron transport
  Homolog annotation: Hit_ID=O49859; Match level="QueryCoverage=99%, HitCoverage=99%, E-value=0.0, Identity=70%"; Hit description =Cytochrome P450 82A4
  Pfam annotation: Domain name=p450; Domain location=39-514; Score =283.3; E_value=4.8e-82; Accession=PF00067.12; Description=Cytochrome P450
MEFVLNYLNATAIGVLSITLFFLFLYNPFKFALGKKEAPKVAGAWPILGHLPLLSGSETPDRVLGALADKYGPIFTINYGVKKALVISNWEIAKECFTKNDIVVSSRPKLLAIELMCYNQAMFGFAPYGPYWREQRKITTLEILTSRRVEQLQHVRVSEVQSSIKELFNVWSSNKNNESGYALLELKQWFSQLTYNMVLRMVVGKRLFGARTMDDEKAQRCVEAVKEFMRLMGVFTVADAIPFLRWFDFGGYEKAMKETAKDLDEIFGEWLEEHKQNRAFGENNVDGIQDFVDAMLSLFDGKTIHGIDADTIIKSNLLTVISGGTESITNTLTWAVCLILRNPIVLEKVIAELDFQVGKERCITESDISKLTYLQAVVKETLRLYPSVPLSSPREFIEDCTLGGYNVKKGTRLITNIWKIHTDLSVWSNPLEFKPERFLTTHKDIDVRGHHFELLPFGGGRRVCPGISFSLQMVHLILASLFHSFSFLNPSNEPIDMTETVGLGKTKATPLEILIKPRLSSNCYL

SEQ ID NO: 212909 - protein, 117 aa, Glycine max
  Coding DNA Sequence Number=SeqID_96131
  Gene Ontology: Mol. function=lipid binding; Biological process=lipid transport
  Homolog annotation: Hit_ID=Q8W539; Match level="QueryCoverage=72%, HitCoverage=72%, E-value=2e-20, Identity=54%"; Hit description=Lipid transfer protein-like protein
  Pfam annotation: Domain name=Tryp_alpha_amyl; Domain location=29-102; Score=25.8; E_value=0.00015; Accession=PF00234.12; Description =Protease inhibitorseed storageLTP f
MASFTKLAWVVLVCMVVMGAHNTVQGITCGQVQGNLAPCLGFLHNGGAVTRGCCNGVRSIVSNARTTADRRGVCNCLMVAAGAVPSGEGQKDLDRFGRDELCIWYYVYVLGKRNKGR

SEQ ID NO: 212910 - protein, 234 aa, Glycine max
  Coding DNA Sequence Number=SeqID_96132
  Gene Ontology: Mol. function=binding; Cellular component=membrane; Biological process=photosynthesis
  Homolog annotation: Hit_ID=Q6ZGV8; Match level="QueryCoverage=80%, HitCoverage=15%, E-value=1e-56, Identity=57%"; Hit description =Eukaryotic translation initiation factor 3 subunit (EIF-3)-like
MRHLRCQLPSEDLNALVSITSDEDLAKPHRGIRSRFIAEIIHFKHLISHHRRDAVRAENALTLLYGNEPIGMQRDWNEELQSCREFPHTSPQERILRDRALYKVTSYFVDAAINGAIGVISGCIPPINPTDPECFHICQRNLWMLIQNLGAPALCKVLLIKIPFQFMEKVSSEDLNGTKITQDVSPEAQLAENEQATYASANNDLKGTKAYQEADVPGLYNLAMAIIDYKGHRV

SEQ ID NO: 212911 - protein, 680 aa, Glycine max
  Coding DNA Sequence Number=SeqID_96133
  Gene Ontology: Mol. function=protein dimerization activity; Biological process=DNA integration
  Homolog annotation: Hit_ID=Q2R1C3; Match level="QueryCoverage=71%, HitCoverage=88%, E-value=2e-61, Identity=39%"; Hit description=HAT family dimerisation domain containing protein
  Pfam annotation: Domain name=DUF659; Domain location=228-360; Score =42.0; E_value=9.1e-11; Accession=PF04937.6; Description=Protein of unknown function (DUF 659)
  Pfam annotation: Domain name=hATC; Domain location=480-570; Score =5.0; E_value=0.0095; Accession=PF05699.5; Description=hAT family dimerisation domain
  Pfam annotation: Domain name=zf-C2HC_plant; Domain location=111-159; Score=14.7; E_value=0.00074; Accession=PF07567.3; Description =Protein of unknown function, DUF1544
  Pfam module annotation: Pfam domain module=DUF659::hATC::zf-C2HC _plant; Domain location=228-360::480-570::111-159
MDGTKPQTHVSLLERSAFESMERGKLKPIFFSSPHYVTTETKLQSDYVPRRRGSSSSLIVLQAIFNSAFFSTTGSSSTALFIGSSASTLVAVDSRHHRFPSLLFLVCGCVCCAVKDVPLWSCNFCEKVVKSSYSRVKAHLLRICGNGIATCPKVTDAYFVDLRRVCEETKNILKSKNVPLPTDKRTPTPPTFPPKRRKSSNIESAFNIEDRNHLRAEIARMFYSASLSFHLARNPYFVSSYSFAANYNLSGFLPPRVTLVADGWTDAQRRPLINFMAISEEGPMFLKAIDGSKEYKDKHYMIDLLKDVIKEVGPQNVVQVITDNALVCKAAGLLIEAEFPHIFWTPCVVHTLNLGVKNICAPKNVDGNENVFNECGWIAKVIGDASFIKVKTTIYRHDEVLENEVSSFFEVIHEILNSRWSKSCNPLHCLAHSLNPRYYSDNWLNEVPNKVPPHRDDELSSQRNKCLKRYFPHVNVRTKVYEEFSKFSSCAGDSIEDRWALDPKTWWVMHGSSTPILQKVALKLLVQPCSSSCCERNWSFLSRKEEGYKKGEIRLWDINGDVHDPLDDSVGVLEMADLSLDEPDLEAMLFLNDGNGGEENETIREDALNGACPTEEKSDCLEAGPTMNSKLKELIPHEGIIFWSDIEDVTNIALDPLFMFVFHLGVNGAAIAHVINLRFS

SEQ ID NO: 212912 - protein, 192 aa, Glycine max
  Coding DNA Sequence Number=SeqID_96134
  Gene Ontology: Mol. function=oxidoreductase activity; Cellular component=membrane; Biological process=electron transport
  Homolog annotation: Hit_ID=O49859; Match level="QueryCoverage=98%, HitCoverage=36%, E-value=9e-88, Identity=78%"; Hit description =Cytochrome P450 82A4
MCLILKNPYVLEKVKAEFDIQVGKENCISESDISKLTYLQAMVKETLRLYPPGPLSGPREFTENCTLSGYNIEKGTRLITNLWKIHTDLNVWSDPLEFKPERFLTTHKDIDIRGHHFELLPFGSGRRICPGISFGLRMLHFPLASFLHSFEILNPSTEPLDMTESFGLVNAKATPLEIFIKPRLSPSCYESK

SEQ ID NO: 212913 - protein, 162 aa, Glycine max
  Coding DNA Sequence Number=SeqID_96135
  Homolog annotation: Hit_ID=Q6ZGV8; Match level="QueryCoverage=84%, HitCoverage=9%, E-value=5e-20, Identity=46%"; Hit description =Eukaryotic translation initiation factor 3 subunit (EIF-3)-like
MSDLPGILQGDKSDSLSCTALLTMERKFAGFSFQGVRGCQKCLHLKEHLVLDGSGNLFKLAAPVECKGIVGRDDRHYLLDLLRVTPRDANYTGPGSRFCILRLELITVYCQAQVAETLKSKEKNFQEADNLAIESQNGQNFSMLKKCFFAIGKLIQMGSIFS

SEQ ID NO: 212914 - protein, 319 aa, Glycine max
  Coding DNA Sequence Number=SeqID_96136
  Gene Ontology: Mol. function=oxidoreductase activity; Cellular component=membrane; Biological process=electron transport
  Homolog annotation: Hit_ID=O49859; Match level="QueryCoverage=100%, HitCoverage=60%, E-value=1e-124, Identity=70%"; Hit description =Cytochrome P450 82A4
  Pfam annotation: Domain name=p450; Domain location=39-319; Score= -154.5; E_value=0.00061; Accession=PF00067.12; Description=Cytochrome P450
MDFILNYLNVTAIGFVSLILFCLFLYNPLKLAQRKKEAPTVSGAWPILGHLLLLSSSKAPHRVLGALADKYGPIFTIKLGAKKALVISNWEIAKECFTTNDIVVSSRPRLVAAENMGYNHAILGFSPYGPYWRELRKITTLEILTSRRVEQLQHVRVSEVQSSIKELFDVWRSKKNESGYALVDLKQWFSRLTFNMVLRMVVGKRYFGATTVDDDDVEKAQRCVNAIKDFMRLFGVFPVADAIPYLRCFDFGGHEKAMKETAKDLDSIISEWLEEHRQNRALDENVDRVQDFMDVMISLLDGKTIDGIDADTMIKSTVL

SEQ ID NO: 212915 - protein, 249 aa, Glycine max
  Coding DNA Sequence Number=SeqID_96137
  Gene Ontology: Mol. function=oxidoreductase activity; Cellular component=vacuole; Biological process=hydrogen peroxide catabolic process
  Homolog annotation: Hit_ID=P22195; Match level="QueryCoverage=99%, HitCoverage=78%, E-value=3e-85, Identity=62%"; Hit description =Cationic peroxidase 1 precursor
  Pfam annotation: Domain name=peroxidase; Domain location=1-213; Score= 269.5; E_value=6.9e-78; Accession=PF00141.13; Description=Peroxidase
GCDASVLLKDTANFTGEQSVIPDVDSTNGTDIILIEKIKARLEKLCPDVVSCADIIAVAAKDSVVALGGPTWNVLLGRRDSTTANLSAVLTDFPTTFMNLTELLATFGKKNFTAQEMVAFTGAHTTGRIKCLFFRTRIYNESNINPSYARSLQAKCPFVGGDDNLAPLDRTTPILFDNAYYKNLLKQKGLLHSDQQLYNNGSTDTIVEFYAKNPLGFRTDFAKVMTKMGNLSPLTGTNGQIRKQCSKVN

SEQ ID NO: 212916 - protein, 117 aa, Glycine max
  Coding DNA Sequence Number=SeqID_96138
MVFHTNYNVKPRITRCFDQEYKRIPRKGQNSLFLTFLDPSSPRLASGSPGPPNSFMVKKPTRLGELTASGLSFSLPGRALARLGELQLPQSDHLPINRRPRGVLRGSKVQKLRELRE

SEQ ID NO: 212917 - protein, 185 aa, Glycine max
  Coding DNA Sequence Number=SeqID_96139
  Gene Ontology: Mol. function=RNA-directed DNA polymerase activity; Cellular component=chromatin; Biological process=chromatin assembly or disassembly
MAESTRSKSNWDRLEEVIVKLASNQIHVIEKLDDLMHPITVLENTSPLVASPFSSSAIPKPPTHLTNPPKMKLDVPRFDGLGPSGWVFKITQFFEYYSTPKSERLTIASFYIEGPALAWLFSLSPWFTPPVWPAFKKKHLQNIVVALAVGLSMDPVSLHCDPLLPLSHPQTYHYYHLQQNPLPNP

SEQ ID NO: 212918 - protein, 175 aa, Glycine max
  Coding DNA Sequence Number=SeqID_96140
  Gene Ontology: Cellular component=integral to membrane
  Homolog annotation: Hit_ID=Q1S566; Match level="QueryCoverage=50%, HitCoverage=28%, E-value=9e-21, Identity=55%"; Hit description =GNS1/SUR4 membrane protein
  Subcellular localization annotation: CTP_CleavageSite=70; ConfidenceScore=5.94e-01
MPNHGEPRGPSSSPQSPPTSSSQSSSTFLFLSSFATVKSLLGHSLPSTTSPCLSSLPRSSPASSSPSPLRSAERSGSGGTPKHPYSGSSAGGQLRLRELREEEEEEEGEEDLECEGEQDQEKEHERQEERESEGEEEPEEELEMEPEGEPRPCPGFAIVVAERKERMKPSDKPKE

SEQ ID NO: 212919 - protein, 189 aa, Glycine max
  Coding DNA Sequence Number=SeqID_96141
  Gene Ontology: Mol. function=hydrolase activity, hydrolyzing O -glycosyl compounds; Biological process=carbohydrate metabolic process
  Homolog annotation: Hit_ID=Q105A0; Match level="QueryCoverage=52%, HitCoverage=13%, E-value=1e-44, Identity=85%"; Hit description =Isoamylase isoform 3
MKLSKFLGTYDFDSLPFDWGENYKLPNISEKDLVIYEMNVWAFTSDESSGLDSNIRGSYLSMIEKIPHLLKLGINAVELLPVFEFDELEFQKLPNPIDHMNKAKDNDSDHNVDFAAGNVKLITTKEAWDQYLEEARRAGKIFRGGSESNGIRRGEGEDREVRWQRFQLLEDADRGLSILEEAVSALIRG

SEQ ID NO: 212920 - protein, 74 aa, Glycine max
  Coding DNA Sequence Number=SeqID_96142
  Homolog annotation: Hit_ID=Q8GVF6; Match level="QueryCoverage=70%, HitCoverage=24%, E-value=5e-08, Identity=49%"; Hit description =Pyrrolidone carboxyl peptidase-like protein
MNKKGLPKGLVIGSSSILEIAGQGALVPLYQRLQSSVIAKDSESSNSNKIIWVIRQEKTKQNFEMALESIRQLI

SEQ ID NO: 212921 - protein, 115 aa, Glycine max
  Coding DNA Sequence Number=SeqID_96143
  Gene Ontology: Mol. function=oxidoreductase activity; Cellular component=vacuole; Biological process=hydrogen peroxide catabolic process
  Homolog annotation: Hit_ID=P22195; Match level="QueryCoverage=92%, HitCoverage=39%, E-value=6e-19, Identity=41%"; Hit description =Cationic peroxidase 1 precursor
MSATFPEFKLRICLLLCIIGTGFADSANDLRPDFYKSQCPQALEAIKAEITSAGCDASYLLKDTANFTGEQSAIPSLDSRNGTDIIEKIRARVEKLCPGVVSCANIVAFAAEIPL

SEQ ID NO: 212922 - protein, 649 aa, Glycine max
  Coding DNA Sequence Number=SeqID_96144
  Gene Ontology: Mol. function=RNA-directed DNA polymerase activity; Cellular component=chromatin; Biological process=chromatin assembly or disassembly
  Pfam annotation: Domain name=rve; Domain location=341-472; Score=6.8; E_value=0.0016; Accession=PF00665.16; Description=Integrase core domain
  Pfam annotation: Domain name=zf-H2C2; Domain location=286-323; Score =13.5; E_value=0.0058; Accession=PF09337.1; Description=His(2)-Cys(2) zinc finger
  Pfam module annotation: Pfam domain module=rve::zf-H2C2; Domain location=341-472::286-323
MPTIDELLDDLGHASWYSKLDLQQGFHQILMAANDIPKTAFRTHQGHYEYRVMPPCYKANFISNDPSVLLLNEGSNTWATSSRNVGVSQPHGILPEVHPRLRHNRLSPDRPLCKNAFSWTAESQSAFEKLKTAMTHAPVLALPNFDCPFVLEIDASGTTMGTELHAIVTAVRKWCQYLLGHPFTILTDHKSLKDLLSQVIQTPEQQHYLSKLLGYEYTIQYKAGASNTFKDSPEFRTQFARVEAHPSAHTDFTISNGLLFFQGCIWFTPDNPFITSLITEFHSTPLGRHLGIVKTTHRVNANFYWTTLCQDVKQFVCNCVTCQQSKSPTTRPAGLLQPIPIPSGVWEDLSLDFITHLSCSHSFIAILVVVDRFSKRVHFDALPTNFTTYRVAVLFHDMGTIQTQWYAPAYEHRLPSSTDGQTEVLNHVLEQYLRSFVSSCPSDWSKFLALAEWSYNTSVHSGTSFTPYEIIYGKPPPSIPHTFWDPPTTKLLAQTIMKQHADAHQRDVNYEVGQWVYVKVCPFHQRSVTGSVHPKLSKRFFGPFQITEKIGPVAYRLQLPDNAKLHLVFHCSLLRPHHGPTPTAPEDSTWETWADMKDKYHLEDKVDLEEGGIDSNTHTTRGTTSNTHAHTSKPNRNTQPPHYLKDYIT

SEQ ID NO: 212923 - protein, 205 aa, Glycine max
  Coding DNA Sequence Number=SeqID_96145
  Homolog annotation: Hit_ID=Q9ZVQ6; Match level="QueryCoverage=53%, HitCoverage=38%, E-value=5e-09, Identity=32%"; Hit description =Putative phloem-specific lectin
MEEGTQLVFECSKIRWLHFVTRAYKDMLQGQTGSVFRRARETICHRHASSDGKRSEETLLKVRRILRVVEKTCFDPGEAIENTLLMFLTWISVFAVKLIRAISALRWIFPTLIREQHSEVTEIVSVSWLKILGRIKTGMLSPNTLYGAYLVFKESNDGAYGFKNMTVEVSIGVIGEVTDSRIMNLVVGSSESSIRGRVTMVVDGC

SEQ ID NO: 212924 - protein, 133 aa, Glycine max
  Coding DNA Sequence Number=SeqID_96146
  Homolog annotation: Hit_ID=Q1SP02; Match level="QueryCoverage=78%, HitCoverage=21%, E-value=2e-10, Identity=35%"; Hit description=IMP dehydrogenase/GMP reductase
MWFTLTLSETSLRVVVMLVELSRWTIGQLAGYLMLLQCWIYEHFPSVHLCVTDDTYQETSPRASRWLTSKAHMKGITGAPYRARCDGLTVTDVSWLPYMENRGVRAFQEISSFQGQLRWGPMVVTARPERVVR

SEQ ID NO: 212925 - protein, 45 aa, Glycine max
  Coding DNA Sequence Number=SeqID_96147
MSEVVTYMQMVDKLDGGRDLQAVGKALIAAHVQGQLKSKIMSNPE

SEQ ID NO: 212926 - protein, 88 aa, Glycine max
  Coding DNA Sequence Number=SeqID_96148
MQVAGGIGAFRDDVTPGTGVASAVSMLQEVGLASQTGELRVGEFRGCRPTEAISEGCSLQRAEVAGCRQVQWRFGWAKAPARAAICVA

SEQ ID NO: 212927 - protein, 94 aa, Glycine max
  Coding DNA Sequence Number=SeqID_96149
MADPDMGDSDKYELYIKENPSCLVAIGRVYEGSIVVHNIPLLHGQVKVGVEEVKDANALVPIPTDETAVSTAKLADRTDHEVDDPLYLMTLTIP

SEQ ID NO: 212928 - protein, 73 aa, Glycine max
  Coding DNA Sequence Number=SeqID_96150
MTKNERKMAENLHGITHGNVSDPSRKRRHRLLEEHPGRPKWARTSRIMQKWVPSTSKRSSKGCMPSTMVPEQN

SEQ ID NO: 212929 - protein, 104 aa, Glycine max
  Coding DNA Sequence Number=SeqID_96151
  Gene Ontology: Mol. function=protein binding; Cellular component =nucleus; Biological process=multicellular organismal development
  Homolog annotation: Hit_ID=Q41261; Match level="QueryCoverage=81%, HitCoverage=49%, E-value=4e-37, Identity=78%"; Hit description =Protein CENTRORADIALIS
  Pfam annotation: Domain name=PBP; Domain location=22-103; Score=28.9; E_value=2e-07; Accession=PF01161.10; Description=Phosphatidylethanolam ine-binding protein
MAMNMISSDPLVIGKVIGDVVDHFTPTVKITVSYNNNKQVYNGHEFFPSSVTTKPKVQIHGGDMRSFFTLVMTDPDVPGPSDPYLREHLHWYLYDTIYYTIYMI

SEQ ID NO: 212930 - protein, 68 aa, Glycine max
  Coding DNA Sequence Number=SeqID_96152
MEFVFATYRLRSKKTRKGKSPRKGGKRFWKSIVVGFKTPREAIEGDLFVFFSRCQGSLLLVFCVLLSH

SEQ ID NO: 212931 - protein, 168 aa, Glycine max
  Coding DNA Sequence Number=SeqID_96153
  Gene Ontology: Mol. function=protein serine/threonine kinase activity; Biological process=protein amino acid phosphorylation
  Homolog annotation: Hit_ID=Q8H2C2; Match level="QueryCoverage=36%, HitCoverage=13%, E-value=1e-20, Identity=77%"; Hit description =Serine/threonine kinase
MEQKGGVLMQRYELGRLLGQGTFGKVYHARNIITGMSVAIKITDKEKILKVGMIDQIKRESSNCTRCTQVAVENLGFKPKDKDINGQNHGKFLVQKDKLDRFSDELEKLFAIDMQAQMARDQKETLLKVRRILRVVEKTCFDPGEAIDNTLLMFLTWISVFVVKLIDT

SEQ ID NO: 212932 - protein, 326 aa, Glycine max
  Coding DNA Sequence Number=SeqID_96154
  Gene Ontology: Mol. function=RNA-directed DNA polymerase activity; Cellular component=mitochondrion; Biological process=RNA-dependent DNA replication
  Pfam annotation: Domain name=rve; Domain location=49-220; Score=18.2; E_value=0.00018; Accession=PF00665.16; Description=Integrase core domain
MVAWTKTSKRSRGQEPTMLHRLATCLGACCQQIPDQGNNVAQAPQDYHLGDAPNSHHRHWRSYGWRRGGTRLDDPLQEFPNSGGIAIRRERSLTSEIEARLLRYLVNGVEKFTWKHLICKYGLPHAIIIDNDPQFKDHAYEDFLTRLGIKRLVTFVEHPQTNDQVEVANRVILKALRTRLNKAYRCSPQTSTNETPYRLTYGTNTMIPVEVGEPPKRRLLFQQQQKEENMRQEDIIQRFNPEHFNSATSCGEFEAKPKKIPKRESLVPIGKTKAHSGTGTSLVAAPQAHQTQRLSLVSLTKIQDEHIAGQFSKGSQNPRYALGESL

SEQ ID NO: 212933 - protein, 123 aa, Glycine max
  Coding DNA Sequence Number=SeqID_96155
MECNATSGLRLWIWTTMHPNLSMNFWRDSSSVCHRLAKVLDKSVEAIDGPWRESTVPGQESIQMIIWIGGPIIPLQGVIPFECAQAMYEQSARHPRGVRNEPPADRGQPLAFLAPPHGVTPPP

SEQ ID NO: 212934 - protein, 173 aa, Glycine max
  Coding DNA Sequence Number=SeqID_96156
MTKSKGKDPLEGLGGPMTRARARKAKEAFQQVLSILFEYKPKFQGEKSKVVPIGNLGINLLGDQMVVGLMVVGGEPEANQGEPGLKESELWVARERETIKELEEELIMYEKEVAEQNEKGFNKAVREAGFFTKDLDLGLFDPFKDVNDGVLLEDEDIAAEEEAGEEQGDDANV

SEQ ID NO: 212935 - protein, 340 aa, Glycine max
  Coding DNA Sequence Number=SeqID_96157
  Gene Ontology: Mol. function=RNA-directed DNA polymerase activity; Biological process=RNA-dependent DNA replication
MKFPTLTREIVTVKADQKQHDSAGTSFVVQVEGTSTWVVVTENKRGYISCGSVQVEGTSTWLFKENKGGYILYGSLLVKVFTRLKRNLKDRRSLGDWMYHRRRRRIWDKNNAKQSEEVDKLLKANFIREVRYSTWLTNVVMDAYLLPNIDGLVDGASESQVLSFLNAYSGYNQIQMHALNEEIMTFITEDTNFCYKVYVNNIVVKSHSITQHVIDLEEEVQKLNGRLASLSRFLPKLAKKVKPLYKMLKKIESFLWDETCKQDFLVFKKTIATMPVLSRPRPGVLLLLHLLVVVEVVSSALIQEEGKHQLPIDCTSRILHDIEKRYQMIEKVALALITSA

SEQ ID NO: 212936 - protein, 83 aa, Glycine max
  Coding DNA Sequence Number=SeqID_96158
MLSGSVPHMELLDKEGFTTDKLLPQLENVVQVLMQRTMPKCMKRSSSHNRLFHIRPTTSTAMAYFGKKIEAGFQGPGPPRREE

SEQ ID NO: 212937 - protein, 335 aa, Glycine max
  Coding DNA Sequence Number=SeqID_96159
  Gene Ontology: Mol. function=peroxidase activity; Cellular component =vacuole; Biological process=response to oxidative stress
  Homolog annotation: Hit_ID=Q1T3V7; Match level="QueryCoverage=97%, HitCoverage=97%, E-value=9e-98, Identity=55%"; Hit description=Haem peroxidase, plant/fungal/bacterial
  Pfam annotation: Domain name=peroxidase; Domain location=43-299; Score=415.6; E_value=6.8e-122; Accession=PF00141.13; Description =Peroxidase
MASRKYFSIVIYAFILGAFANTAFSSLSRDYYDYSCPNALSTIRSVVEAAVQKERRMGASLLRTHFRDCFVNGCDGSILLDPSPTIDSEKSAVPDFQSDKAFKLVDEIKEAVDQACGKPVVSCADILTVAARDSVVAFNFYTIRLPWQIEQELLGGPTWEVRLGRRDSTIASRDAANANIPSPFFSLSELISNFKSHGLNEKDLVALSGGHTIGNARCATFRDHIYNDSNINPHFAKELKYICPREGGDSNIAPLDRTAAQFDSAYFRDLVHKKGLLRSDQELFNGGSTDALVKKYSHNTKVFRQDFAKSMIKMGNIKPLTGNRGEIRLNCRRVN

SEQ ID NO: 212938 - protein, 201 aa, Glycine max
  Coding DNA Sequence Number=SeqID_96160
MRQANNTISQVFKLGQLKESPLRIIVKGRSESRFQRLQEARPGGDELVAEHPLVETIENRIHFAGKFRVLIDKAPWSCGYPSGPFCIGLLMRYVANNHCGHSHLHDSHHSHCHDSLSSHFHDAWLLQLLTYASLLLPSPLTAVNVAAMDSDGDNRTGDDHHRGATTIMEVEVATTMTIGENCRYCQLVTKTGNSRNQPRDG

SEQ ID NO: 212939 - protein, 474 aa, Glycine max
  Coding DNA Sequence Number=SeqID_96161
  Gene Ontology: Mol. function=peroxidase activity; Cellular component =vacuole; Biological process=response to oxidative stress
  Homolog annotation: Hit_ID=Q1T3V2; Match level="QueryCoverage=63%, HitCoverage=94%, E-value=1e-99, Identity=59%"; Hit description=Haem peroxidase, plant/fungal/bacterial
  Pfam annotation: Domain name=peroxidase; Domain location=43-283; Score=458.2; E_value=1.1e-134; Accession=PF00141.13; Description =Peroxidase
MASHGYFSVLVHAFVFASLATSAFSQLSPNYYDYACPNALSTIKSVVEAAVQKEYRMGASLLRLHFHDCFVNGCDGSILLDPSPTIDSEKNAFANFQSVRGFEVVDDIKQAVDEACGTPVVSCADILAVAARDSVVALGGPTWEVQLGRRDSTTASKEAADANIPAPFFSLSQLITNFKNHGLDEKDLVVLSGGHTIGYARCVTFKDHIYNDSNIDPNFAQYLKYICPRNGGDLNLAPLDSTAANFDLNYYSNLVQKNGLLHSDQELFNGGSTDELVKQYSYDTEAFYVEFANSMVKMGNIQPLTGDQVALVSVDACSLEAVIRSRSLAGTWSCGYPFGLFCTGLLMRYVANNIPVLKHHLVLKVVCVTKLLPRLPCHVLRGLPQPLGAMHPREKEVVRDMRARGSSEKRGGCVYCLSGDKALAEGAELNINPLTNVRAWCLPVSSWQPVPYSTCIEVPRESLGRRISVNQQLR

SEQ ID NO: 212940 - protein, 404 aa, Glycine max
  Coding DNA Sequence Number=SeqID_96162
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=94%, HitCoverage=29%, E-value=3e-91, Identity=49%"; Hit description=Chromo
MYLATGNRLHPLGRPVELHADVAIGTESVSAPQVKRLIHTGLTSALFHLCLTPANPPDPSHHLPHAIPAIEALLTQFQHFQTPTNLPPPQQVVHCINLLPSTTPVNVRPYHYPHFQKSKIEKQVSELLSTGLIQPSTSPYSSLILLVKKKDGTWRMCVNYHALNSVTVRDCFPILTIDELLDELRHASWFSKALGISRNAIRLMHCALHLSGRHEQPGQIYLKRAKCLFAQIQLEYLGHIVSDKGVELEPSKIRAMVQWPTLTSAKELRAFLGLTRFYRKFIKNYASIVAPLTSLLCKDAFLWTLMSQIAFDQLKSTMTSAPVLALPNFAVSFIIETDASGTTMRVVLMQQGHPIAFFNKPFQPRLLHASTYVQELHAIVTAIRKWCQYLLGHSFTILTDHKSL

SEQ ID NO: 212941 - protein, 319 aa, Glycine max
  Coding DNA Sequence Number=SeqID_96163
  Gene Ontology: Mol. function=peroxidase activity; Cellular component =vacuole; Biological process=response to oxidative stress
  Homolog annotation: Hit_ID=Q1T3V2; Match level="QueryCoverage=97%, HitCoverage=98%, E-value=2e-99, Identity=57%"; Hit description=Haem peroxidase, plant/fungal/bacterial
  Pfam annotation: Domain name=peroxidase; Domain location=43-283; Score=466.4; E_value=3.5e-137; Accession=PF00141.13; Description =Peroxidase
  Subcellular localization annotation: CTP_CleavageSite=47; ConfidenceScore=5.04e-01
MASRGYFFVVLHALVFASIATSAFSQLSPNYYDYSCPSALSTIKSVVEASVQKERRIGASLLRLHFHDCFVNGCDGSILLDSTSSIDSEKNAAANLQSARGFEVVDDIKKAVDEACGKPVVSCADILAVAARDSVVALGGPSWKVRLGRRDSTTASREAADASIPAPFFSLSELITNFKNHGLDEKDLVVLSGGHSIGFARCVTFKDHIYNDSNIDPNFAQQLRYICPTNGGDSNLSPLDSTAAKFDINYYSNLVQKKGLLHSDQELFNGGSTDELVKEYSDDTEDFYEDFANSMIKMGNIQPLTGNQGEIRVNCRNVN

SEQ ID NO: 212942 - protein, 81 aa, Glycine max
  Coding DNA Sequence Number=SeqID_96164
MAWHKRTLHGSRWIHYSGRVMIAIQISWNGKSIRAARNWTIAGPEEIPENPHASMTVFEVVKQVLKSTLLCPLPISTIPPI

SEQ ID NO: 212943 - protein, 1163 aa, Glycine max
  Coding DNA Sequence Number=SeqID_96165
  Gene Ontology: Mol. function=RNA-directed DNA polymerase activity; Cellular component=chromatin; Biological process=chromatin assembly or disassembly
  Pfam annotation: Domain name=RVP_2; Domain location=72-197; Score= -18.4; E_value=2.7e-05; Accession=PF08284.2; Description=Retroviral aspartyl protease
  Pfam annotation: Domain name=RnaseH; Domain location=580-701; Score= -29.0; E_value=0.029; Accession=PF00075.14; Description=RNase H
  Pfam annotation: Domain name=rve; Domain location=835-991; Score =106.2; E_value=9.9e-29; Accession=PF00665.16; Description=Integrase core domain
  Pfam annotation: Domain name=zf-H2C2; Domain location=776-817; Score =13.9; E_value=0.0051; Accession=PF09337.1; Description=His(2)-Cys(2) zinc finger
  Pfam module annotation: Pfam domain module=RVP_2::RVT_1::RnaseH::rve:: zf-H2C2; Domain location=72-197::322-491::580-701::835-991::776-817
MAFRRERGLCYNCDDKWSSGHRCKGRILLFVADDVTQDSGEPGITNNTIDFDDNLSNPDPTSDSSSPHISLHAMAGSPSLETFRVYGTIRSARITVLIDSGSTHNFLQPRVASFLHLATESTQPLRVLVGNGSTLDCDKRCPDTPLTIQGHSFPVTFHLLHISGADAVLGVDWLRQFGPITTNYADFMMRFTHQGQEISLQADVATKPEPASANQVKRMLHTGSTSALFHLCILDSNPTDSTTNLLSPIIKPITELLLRYDQLFQPPKHLPPSREVNHRIPLLPSTAPVNVRTYRYPHFQKAEIERQVAELLSDGLIRPSTSPYSSPVLLVKKKDGTWRLCVDYRSLNSETVRNRFQIPTIEELLDELGHASWFTKLDLRQGFHQILMNEADIEKTAFRTHHGHYEYMVMPFGLCNAPSTFQAAMNHLLAPFLRRFAAVFFDDILVYSESLSSHVQHLDLIFQALLRGEFYLKRTKCFFAQRELEYLGHIVSGKGVTPEPSKVRAITQWPIPATARDLQAFLGLTGFYRKFVRNYAAITAPLTSLLCKDAFEWSIESQEAFNKLKSAMSDTPVLALPDFSKPFVVETDASGTAMGAVLTQAGHPLAFFSKNFAPKLLTASTYVRELHAITSAVRKWRQYLLGSTFTILTDHKSLRELMTQVIQTPEQHYYLSKLLGFNYTIQYKTGASNVVADALSRRPPEPSQLFVLSVPNLDFLSDIQQTLAINPEFQALRSNVQTNPSAYPHYRVHNGCLLFNNRIWINNTNPHIPSLLSEFHSTPLGGHFGVTKTLRRLEASFFWQGMKADVQRFIKECTVCQQNKSSTWRPAGLLQPLPPPTGVWEDISMDFVTHLPPSNGFTVIFVVVDRFSKGVHLGALPTGFSAFKVAMLFIEIVCKLHGFPKSIVSDRDPVFFSTFWRELFRLSGTQLRLSTAYHPQSDGQTEVVNRVLEQYLRCFVNSQPSSWYRYLSLTEWCYNTSLHSTSGMTPFEVVYGKPLPSIPQYLPGLTRNEAVESLVESRQLMHAKLQKRLKKAQTTMKKYADMKRDDITFSVNQWVYVKLRPSRQRSVTGNNHPKLSKRYFGPFRISAKVGNIAYRLELPPESRIHPVFHSSLLRLHHGPPPSSSEPWNLEIVGQKPLQRPLCLLDSKLDTSTTPPTRLVLTQW

SEQ ID NO: 212944 - protein, 351 aa, Glycine max
  Coding DNA Sequence Number=SeqID_96166
  Gene Ontology: Mol. function=RNA-directed DNA polymerase activity; Cellular component=chromatin; Biological process=chromatin assembly or disassembly
MTTIPLSPPSSSILASPSSPRPHMKLDVPRFDGHDPIGWIFKASQFFDYQGIPDHERLTVPSFYMEGPTLCWYQWMSRNGFLTSWTGMLEALESRFAPAYYDDPSSTLFKLQQQGSVNDYLTKFKHLANRIFGLAPSFLLSCFISGLTLGLRREDIDPFASSPDAPSLPSDNFDPPDPDPDPDPVPQISLHAMDGDTLRVMVGDDYMLDCTTTSWQVTSYIQGHTFVPDLFHLPISDADIVLGVQWLKQLGPTTKNYKALAMSFPFVSANNTYRECSLDTTFISAQQLNRCTQTQSLSALFALTASLSRYSTSSSPSHPHQTPTPPQITSIIIQCPEIFYEPTHLPPSCTI

SEQ ID NO: 212945 - protein, 200 aa, Glycine max
  Coding DNA Sequence Number=SeqID_96167
  Gene Ontology: Mol. function=peroxidase activity; Cellular component =vacuole; Biological process=response to oxidative stress
  Homolog annotation: Hit_ID=Q6V7W6; Match level="QueryCoverage=90%, HitCoverage=71%, E-value=4e-60, Identity=61%"; Hit description=Class III peroxidase GvPx2b
  Pfam annotation: Domain name=peroxidase; Domain location=6-164; Score= 148.1; E_value=2.4e-41; Accession=PF00141.13; Description=Peroxidase
MNEPSCEQELIMCICSMQLGGPSWKVRLGRRDSTTASREAADASIPAPFFSLSELITNFKNHGLDEKDLVVLSGGHSIGFARCVTFKDHIYNDSNIDPNFAQQLRYICPTNGGDSNLSPLDSTAAKFDINYYSNLVQKKGLLHSDQELFNGGSTDELVKEYSDDTEDFYEDFANSMIKMGNIQPLTGNQGEIRVNCRNVN

SEQ ID NO: 212946 - protein, 172 aa, Glycine max
  Coding DNA Sequence Number=SeqID_96168
  Gene Ontology: Mol. function=peroxidase activity; Cellular component =vacuole; Biological process=response to oxidative stress
  Homolog annotation: Hit_ID=Q1T3V7; Match level="QueryCoverage=60%, HitCoverage=32%, E-value=5e-30, Identity=60%"; Hit description=Haem peroxidase, plant/fungal/bacterial
  Pfam annotation: Domain name=peroxidase; Domain location=59-169; Score=44.5; E_value=8.9e-12; Accession=PF00141.13; Description =Peroxidase
MDGSGDRERDVFKMQRVLRCGVHIILGIDLVEKDVSHASLSQLSPNYYDYSCPKALSTIKSVVEASVQKERRMGASLLRLHFHDCFVNGCDGSILLDSTSSIDSEKNAAANLQSARGFEVVDDIKKAVDEACGKPVVSCADILAVAARDSVVAVSNNTIMLLQNCNARICWK

SEQ ID NO: 212947 - protein, 242 aa, Glycine max
  Coding DNA Sequence Number=SeqID_96169
  Gene Ontology: Mol. function=RNA-directed DNA polymerase activity; Cellular component=chromatin; Biological process=chromatin assembly or disassembly
  Pfam annotation: Domain name=Chromo; Domain location=188-239; Score =29.0; E_value=1.7e-05; Accession=PF00385.14; Description='chromo' (CHRromatin Organisation MOdifier
PMFVFLDQLWDTLLKDTQYTTLLDKVHRNPTKHPDLKEFHSSPIRGHIGVTKNFRRLQQNFDWPRILEDVPIWEDVSLDFITGLPPSHDFTIILVVMDQFSKEAHFGALSPHNTAYKTAFLFLDIWNQASDEHCLSLTDGQSNRGHPNGITSKIDPKFHISLSKLHHRPSPTYPTVLPPTIIKNHPVIEPLHILDWKWDSSSCPPTKLVLVQWDGLSQEDSTWESLDTLRPVLQPWGQGWFG

SEQ ID NO: 212948 - protein, 36 aa, Glycine max
  Coding DNA Sequence Number=SeqID_96170
MDDNGGREGDEFKMQREFCGAERCRGSFAKEEPIGN

SEQ ID NO: 212949 - protein, 491 aa, Glycine max
  Coding DNA Sequence Number=SeqID_96171
MVCNPQTYVEDLYNFVVNCLLKKAMGLPYCIRIAPIVVPEASVSRMKGTKKSGAVKTEKGSERFDAFVGNDMTQIFQFVLGEKTLRALKKEFTLQQYAVDESVAQTKRHDVILIMPMEALPRSSNNSSIVSIGKRSRMVYVVDYLSGWGKVCGCEEDERKSRNQSLDFRYRAEWVGRLVWVGPKININAKFHKMAQVVKLHGKSGVVGNYGAQLLQPINAQHDVNPIGQELHHARLYEVVGTTTVNEYREASLLEEIVETKGGVGWVDGAISSGVWRTKVWEGLGLGLGLVTGENDGLVWWLGGGLYVLRRSNILPSCNFTKAVVWGSEMGCRAWTSQWISGERPEMKQLRRNEGGSPIMCMSGRTVSPEPEGMPARRDLKDPSQWVVAVESQDIEFDGRAREEWGDGLVLGALQGVVKRVLESIGGGFTRAMAGRTKMIGAEGKLAGKGLEFEDKEPPTAKQSHLGWFRVCWLVDCYHPLTISWRILLFN

SEQ ID NO: 212950 - protein, 530 aa, Glycine max
  Coding DNA Sequence Number=SeqID_96172
  Gene Ontology: Mol. function=RNA-directed DNA polymerase activity; Cellular component=chromatin; Biological process=chromatin assembly or disassembly
  Homolog annotation: Hit_ID=Q6V7W6; Match level="QueryCoverage=33%, HitCoverage=70%, E-value=3e-53, Identity=59%"; Hit description=Class III peroxidase GvPx2b
  Pfam annotation: Domain name=peroxidase; Domain location=1-146; Score= 113.7; E_value=5.4e-31; Accession=PF00141.13; Description=Peroxidase
LGGPSWKVRLGRRDSTTASREAADASIPAPFFSLSELITNFKNHGLDEKDLVVLSGGHSIGFARCVTFKDHIYNDSNIDPHFAQQLKYICPTNGGDSNLSPLDSTAAKFDINYYSNLVQKKGLLHSDQELFNGGSTDELVKEYSDDTEDFYEDFANSMIKMGNIQSLTGNQDTTNAKFDSILERLAATTIVPFSPPSSPIAASPSSSWPYMKLNVPCFDGCDPIGLIFKASQFFNYQGIPDHELLTDASFYMEGMLKALESRFAPAYYDDPSSTLFKLQQQGFVNDYLTEFERLAYRILALQPSSLTQAAALAKLQETKLLGHHQNYYSPPSPRYQAPPNPNSPFLKPNTTLAPKIPFERLTSGEMALRRDHGRFYHCDDKWIPGHHCKPRLHLLIADEDIEPFASRLDAPSLPSDNFDPLDLDLDRYPIPQISLHAIDGTVTPDTFRQYDLPHQHHLVILVDEGSTHNFIQSHVTHFLYFLASPSDTLRVMVDDDYILDCTTSSQQLPLSLTSSNCPLVVQTLSWAFNG

SEQ ID NO: 212951 - protein, 97 aa, Glycine max
  Coding DNA Sequence Number=SeqID_96173
  Gene Ontology: Mol. function=RNA-directed DNA polymerase activity; Biological process=RNA-dependent DNA replication
MIFDRYGFQGPVIDTAAPTAVFLLDNIEHRGNLCFDFNFLEIWVTVGFDVDWVGVRGEISGNWVMMEVIWGGVGVWWGCDGEEEILGWDSDVVRAKE

SEQ ID NO: 212952 - protein, 73 aa, Glycine max
  Coding DNA Sequence Number=SeqID_96174
MARGSRIGLLLIACGGSALEFKSSFQFLMNHCSGGELGVNNFVGGSAKNILQYGRWRFAVDYLVWGHSGAGVD

SEQ ID NO: 212953 - protein, 467 aa, Glycine max
  Coding DNA Sequence Number=SeqID_96175
  Gene Ontology: Mol. function=RNA-directed DNA polymerase activity; Cellular component=chromatin; Biological process=chromatin assembly or disassembly
MVDSDIYKTGFKTHHGHYEFKAYAVLVAPLTSLLRKDKFQWFDKAQTTFEKLKRKMKEAPVLVSPDFSAPFTIKTDGSSRAISTVLQQNSHPIAYCSKMLCSHLHVASAYYKSRSQNIVADALSRIAAPDEAQFYSLSVPMFVFLDQFRDTLLKDTQYTTLLDEVRQNPAKHPELKEFHSSPIRGHMAKYNTKKPTGLLQLLPIPLVIWEDVQTEIHCLSTNFGGAFSPQWNQASDEHCLSPTNGQSNKEWSYNTSTHSGTGISPYEEIYGKPPPSIPHYILGDTIEVVDSLLATRTAILVVHHRHLLKAQTTMKTMADAHRQFAVGDWVYVCLRPYRQTSIAPAYTKLNKRFYGPFLERVGHVATENHPVIEPLHILDWKWDSSSCPPTKLVLVQWDGLAQEDTIQEPLDTLRQSYNLGDKVGLVEGGDDSNSDIQEQEDYKSNKELDNSKSKRNTRKPTRFNDCV

SEQ ID NO: 212954 - protein, 47 aa, Glycine max
  Coding DNA Sequence Number=SeqID_96176
MAEGGGINSNQQTSIHEPNQDDSAATKAQEGRPKRSTNRPAYLTDYE

SEQ ID NO: 212955 - protein, 319 aa, Glycine max
  Coding DNA Sequence Number=SeqID_96177
  Gene Ontology: Mol. function=peroxidase activity; Cellular component =vacuole; Biological process=response to oxidative stress
  Homolog annotation: Hit_ID=Q1T3V2; Match level="QueryCoverage=97%, HitCoverage=98%, E-value=1e-101, Identity=58%"; Hit description=Haem peroxidase, plant/fungal/bacterial
  Pfam annotation: Domain name=peroxidase; Domain location=43-283; Score=464.9; E_value=1e-136; Accession=PF00141.13; Description =Peroxidase
MASRGYFFVVLHALVFASIATSAFSQLSPNYYDYSCPKALSTIKSVVEASVLKERRMGASLLRLHFHDCFVNGCDGSILLDSTSSIDSEKNAAANLQSARGFEVVDDIKKAVDEACGKPVVSCADILAVAARDSVVALGGPSWKVRLGRRDSTTASREAADASIPAPFFSLSELITNFKNHGLDEKDLVVLSGGHSIGFARCVTFKDHIYNDSNIDPNFAQQLKYICPTNGGDSNLSPLDSTAAKFDINYYSNLVQKKGLLHSDQELFNGGSTDELVKEYSDDTEDFYEDFANSMIKMGNIQPLTGNQGEIRVNCRNVN

SEQ ID NO: 212956 - protein, 97 aa, Glycine max
  Coding DNA Sequence Number=SeqID_96178
MRFYLMVIYTFRKLGANEPVYARRLKSSSASFVVLTRESGDMRGYLMVIHTFGQPGANEPGYLMVTRTFGQPGANEPDDARRVTSSSAPFVVLTREV

SEQ ID NO: 212957 - protein, 60 aa, Glycine max
  Coding DNA Sequence Number=SeqID_96179
MENWRTALSNNFAGLQTPLGNDIHRAPKNSGEWRIGEQRYAITSRGSRLEGGGHMNRARQ

SEQ ID NO: 212958 - protein, 58 aa, Glycine max
  Coding DNA Sequence Number=SeqID_96180
MGVKYLEALKRRSHPTKQMVPWMKITSGNLKANKPIDTRRFTSSFRVDNFCHTDTGVT

SEQ ID NO: 212959 - protein, 55 aa, Glycine max
  Coding DNA Sequence Number=SeqID_96181
MVSKVWSFDGGFNGEEEEGNSNLCHMSPFEWSKKGPTFSLDVTHTQPQEEKNLTF

SEQ ID NO: 212960 - protein, 64 aa, Glycine max
  Coding DNA Sequence Number=SeqID_96182
MMAHLSAKAGGGAEVEDVEMPAIGAKEEGTSAALSLEVRASDPTPLNLHKVVIKVGKPKREELD

SEQ ID NO: 212961 - protein, 239 aa, Glycine max
  Coding DNA Sequence Number=SeqID_96183
MVTSNSSTVEIIPSKEIMTIHTDNEPSIHVENCFGIQELEKRIYLELIRTFWINAKFANKKFIVPKVLGTKVVLSSDSIAKATGCLHEGSAYQDRWEKNYDSHVVRALYKENADKDQGVYHVFDKMDDDSKHTLIAKSSVVAKQQKISMTNLKSMNVALEQNLKEAPQVDLDAINTMKQKRLAKAITFEDRGHNSFGIAKKIQKIMLEQEKKKKKETISERGGGRRRDYCKGAQDKEET

SEQ ID NO: 212962 - protein, 241 aa, Glycine max
  Coding DNA Sequence Number=SeqID_96184
MDMSNAVASHKDATTLSCTWHPTSSFVHQGYTNNSMEKPSEKNRRDPWQEMEPPKSEFQKKVNLQMSFTKLLLMHPIDLNLSHEDYSSLGNLHAQDDAKKKKVQVILHGRDALKKLVRVLDAYDTRIFWNQIVWTYTLKTSTSSYDGSNNVVHHNIIQEKMPLSKLKHLPKFVDDTIIHGIFTDLTNLVSWTKLHRMKLKQQKEEKMPMLRAIPSPPSIAPTPLSPPSSPSPTQPPPPLPA

SEQ ID NO: 212963 - protein, 275 aa, Glycine max
  Coding DNA Sequence Number=SeqID_96185
  Gene Ontology: Mol. function=protein dimerization activity; Cellular component=nucleus; Biological process=regulation of transcription, DNA-dependent
  Homolog annotation: Hit_ID=Q32WR6; Match level="QueryCoverage=82%, HitCoverage=85%, E-value=4e-31, Identity=57%"; Hit description=BZIP transcription factor
  Pfam annotation: Domain name=bZIP_1; Domain location=191-250; Score =34.3; E_value=4.4e-07; Accession=PF00170.11; Description=bZIP transcription factor
  Pfam annotation: Domain name=bZIP_2; Domain location=192-247; Score =44.9; E_value=2.8e-10; Accession=PF07716.5; Description=Basic region leucine zipper
  Pfam module annotation: Pfam domain module=bZIP_1::bZIP_2; Domain location=191-250::192-247
MGSQGNGQQSHLQPSSLSRQGSWYSLTLDEVNCQLGDMGKPLGSMNLDELLQNVWTAEASKSLVIGAESENMSSSSSLQRQASLTLARALSGKTVDDVWREIQQGQKKRYGEDVKSQEGEMTLGETTLEDFLVQAGLFAEASISPAVGLDTMDSSAAQGFQQKTGLLSSPSIGSLSDTRPGRKRDAPDAYEKTLERRLRRKIKNRESAARSRARKQAYHNELVSKVSRLEEENVKLKKEKVFVLPFIRNLLCVICGLYAIDFSFLIKKFRMCSVD

SEQ ID NO: 212964 - protein, 49 aa, Glycine max
  Coding DNA Sequence Number=SeqID_96186
MLTTPTLPSFSLFDMEHTLLLEQMQSSSNSNEQCNDAILDMSPSNQEHE

SEQ ID NO: 212965 - protein, 264 aa, Glycine max
  Coding DNA Sequence Number=SeqID_96187
  Gene Ontology: Mol. function=transporter activity; Cellular component= integral to membrane; Biological process=transport
  Homolog annotation: Hit_ID=Q9SHZ3; Match level="QueryCoverage=87%, HitCoverage=44%, E-value=1e-111, Identity=83%"; Hit description =Putative membrane transporter
MIKRGKAILPPPPPPPPPSILVNFQQWLDHALLMQSTGAYKAASRLAIATPPPAYVLSRGIGWQGIGILLDGLYGTGTGSTVSVENAGLLGLTRVGSRRVVQISAGFMIFFSTLGKFGAVFASIPFPIFAALYCVLFGLVAAVGISFLQFTNMNSMRNLIITGLTLFLGISVPQFFSQYWTSSHHGPVHTNAGWFNAFLNTIFSSPATVGLIVAVFLDNTLEVERSKKDRGMPWWVKFRTFRGDNRNEEFYTLPFNLNRFFPPT

SEQ ID NO: 212966 - protein, 214 aa, Glycine max
  Coding DNA Sequence Number=SeqID_96188
  Gene Ontology: Mol. function=transporter activity; Cellular component= integral to membrane; Biological process=transport
  Homolog annotation: Hit_ID=Q9SHZ3; Match level="QueryCoverage=73%, HitCoverage=30%, E-value=7e-74, Identity=81%"; Hit description =Putative membrane transporter
  Subcellular localization annotation: CTP_CleavageSite=34; ConfidenceScore=5.03e-01
MRAIQGALIVASSIQIVLGYSQVWGLFSRFFSPLGMAPVVGLVGLGLIQQGFPALGNCVEIGIPMLLLVVGLSQYLKHVRPFRDTPIFERFPVLICVTIVWIYSVILTASGAYRHRPTITQNSCRTDRANLISTAPWFMFPYPLQWGPPTFSAGHSFAMMSAVIVSMVEVSVVPFPLLTSLARQLLLGFCSGSTSELYYIHLYIIFRLNYTSHP

SEQ ID NO: 212967 - protein, 42 aa, Glycine max
  Coding DNA Sequence Number=SeqID_96189
  Homolog annotation: Hit_ID=Q9SHZ3; Match level="QueryCoverage=93%, HitCoverage=7%, E-value=3e-08, Identity=70%"; Hit description =Putative membrane transporter
MADITHPPMEQLQDLEYCIDSNPPWVLLVLGAGMLSVLCLKN

SEQ ID NO: 212968 - protein, 162 aa, Glycine max
  Coding DNA Sequence Number=SeqID_96190
  Gene Ontology: Mol. function=RNA-directed DNA polymerase activity; Biological process=RNA-dependent DNA replication
  Homolog annotation: Hit_ID=Q1SRI1; Match level="QueryCoverage=58%, HitCoverage=14%, E-value=6e-15, Identity=41%"; Hit description=RNA -directed DNA polymerase
MPSSVVRRVVSMQRNFLLGGEEGKKKVAWLSWENGCKPKSLGGLDIKNIGLFNFALLAKWRWEFCREGDGLWKRVLISNMMVRGGLGALEGIRSLQSIWWRDLVKVCGGSKMIPSGLTNCRMEGGRWGFHKEEVDVWLWKSGTCWDYITKGRDTHVYLDPCW

SEQ ID NO: 212969 - protein, 135 aa, Glycine max
  Coding DNA Sequence Number=SeqID_96191
  Homolog annotation: Hit_ID=Q1SRN1; Match level="QueryCoverage=36%, HitCoverage=5%, E-value=8e-09, Identity=69%"; Hit description =Integrase, catalytic region
MEKEKGTQGLELSSYQYRKQGLKCAQKETTKLLKLGLADEVTGGGVGRAPRGAHNPGFAGKFDDGRQRPEVAAAAADSGRRTTAGGQSRLVAKGFYQQLGYDYNETFSPAIRPVTIRLSPPTNSLCEDFTKPLMA

SEQ ID NO: 212970 - protein, 144 aa, Glycine max
  Coding DNA Sequence Number=SeqID_96192
MHQLKYGREKENLRKCFSTGTRKNEEMSSLYIGIAPSRGACAGLLCIWDTLKFQVHRHFVGDRFILLEGTWLENGVIVANAYLLCKLRNKKKLWDELRGRRALLGVGVWLETLIALEGWRKVLEMMMALTLVAWGKSLTISLSI

SEQ ID NO: 212971 - protein, 67 aa, Glycine max
  Coding DNA Sequence Number=SeqID_96193
MDKSERLTYGGDERKMVDKINKMEHRDTVEIKEIQERFFWRGCRSWVMKILSYKRERIGGRSKRKIC

SEQ ID NO: 212972 - protein, 325 aa, Glycine max
  Coding DNA Sequence Number=SeqID_96194
  Gene Ontology: Mol. function=oxidoreductase activity; Cellular component=vacuole; Biological process=response to oxidative stress
  Homolog annotation: Hit_ID=Q5U1F7; Match level="QueryCoverage=95%, HitCoverage=98%, E-value=3e-96, Identity=55%"; Hit description=Class III peroxidase 136 precursor
  Pfam annotation: Domain name=peroxidase; Domain location=47-289; Score=438.8; E_value=7.2e-129; Accession=PF00141.13; Description =Peroxidase
MASRVYLSVLLHAFVSTALATFIHATIFSPLSPNYYEFSCPNALTAIQIIVEAAVQKEPRMGASLLRLHFHDCFVNGCDGSILLDSSPTIDSEKDALPNINSVRGFEVVDDIKKAVDEACGQPIVSCADILAVAARDSVVTLGGPTWEVQLGRRDSTTASKEAANANLPAPSFDLSELINNFNNHSLDVKDLVVLSGAHTIGFSFCKFFKDRVYNDTNINPIYAQQLRNICPIDGSGDFNLGPLDQTSPLLFNLQYFSDLFQYKGLLHSDQELFNGGCTDAMVERYSYDYIAFFQDFANSMIKMGNIQPLTGTQGEIRVNCRVVN

SEQ ID NO: 212973 - protein, 86 aa, Glycine max
  Coding DNA Sequence Number=SeqID_96195
MPHNIFICLNSHISTPKFRLSIIIKKASKAQNAKANPGIGLTPELRKTSSFDKTQEHTVAKSVAYEFVAPDEASNNKPKDSKGAIV

SEQ ID NO: 212974 - protein, 470 aa, Glycine max
  Coding DNA Sequence Number=SeqID_96196
  Pfam annotation: Domain name=RnaseH; Domain location=312-439; Score= -4.7; E_value=0.00016; Accession=PF00075.14; Description=RNase H
  Pfam annotation: Domain name=TB2_DP1_HVA22; Domain location=7-105; Score=27.4; E_value=8.6e-08; Accession=PF03134.9; Description=TB2DP1, HVA22 family
  Pfam module annotation: Pfam domain module=RnaseH::TB2_DP1_HVA22; Domain location=312-439::7-105
  Subcellular localization annotation: CTP_CleavageSite=34; ConfidenceScore=5.36e-01
MGWIEAIYTLLTKSFTVLSWPPVSFLCPLFVSVRVMKSDSRSSNQRCLAFWVLYSLCMIMEGELSVLFNCLPWWPHVKSIATILLLIPYVGAAPYVYKFLIRHYFTWSLFTRTSNIFSEKSTHLESDEDSKLVDVSDQMTSQIQEKKLEAYQVLVSSLYRSIFMPLQQITDNFSEKSRNLESDEDSKLFNVSDQTITTSQIEEKKLEAYQETDDIAGCDKTESSYTRLTIKNLVQKEWSCALCQISTTSENCLRAHLKGRKHKDKENELRVEFSSTQKRIKGMVLLRNLNQIASILNPVSRSIRWCEWTKPEFGWTKLNTDGSIHSNTVSFGGLLRDYRGEPICAFVSKAPQGDVFLAELWAIWRGLVLSLGLGIKAIWVESDSMSVVRTVNRKQLCPKAVGYLNQIWKLLKKFDKYQISHSWRETNRAADHLAKMDLLANDVVLSPVDFPPSLSRIIEDDAKGTKYRRR

SEQ ID NO: 212975 - protein, 221 aa, Glycine max
  Coding DNA Sequence Number=SeqID_96197
  Homolog annotation: Hit_ID=P46643; Match level="QueryCoverage=21%, HitCoverage=11%, E-value=2e-10, Identity=60%"; Hit description =Aspartate aminotransferase, mitochondrial precursor
MAAKHDIILDRLSALIPTPFSPNSFPTGAPPPVETLTIEPLNTEIDLSISLPLVPVTAKGSFVVTVSLFVSVGLLLGPAVLVIVCVVIPQPPALPIIDVNVRRHTRHHAPLPPPSSPPPVFNAFLGCSAARITNTILSLAVSCHGSHTLPAHLNIIIVRPKPAHKQTPKDPIVSVNEAFLADPFPHKINLGIGTYRGDDGKPFVPQSVRDAETKIQRCKLE

SEQ ID NO: 212976 - protein, 49 aa, Glycine max
  Coding DNA Sequence Number=SeqID_96198
MAKAFMKSSQQIFIYNDLYRSLELSDGCVKLSSNYVSMDWKLWNLVGAT

SEQ ID NO: 212977 - protein, 257 aa, Glycine max
  Coding DNA Sequence Number=SeqID_96199
  Gene Ontology: Mol. function=transferase activity, transferring nitrogenous groups; Cellular component=mitochondrion; Biological process=amino acid metabolic process
  Homolog annotation: Hit_ID=Q43057; Match level="QueryCoverage=94%, HitCoverage=67%, E-value=2e-55, Identity=60%"; Hit description =Aspartate aminotransferase precursor
  Pfam annotation: Domain name=Aminotran_1_2; Domain location=2-243; Score=-40.4; E_value=2.4e-05; Accession=PF00155.11; Description =Aminotransferase class I and II
MGFYIGFLPNFKGISILILKCIYQIQPGPSSHHNIWRQAEIPVKTFHYYHPDTKGLDFAALLNDVKNRQYALSFIGCFLSCLSDKSNTLYYHECTRLFFLLHPCAHNPTGVDPSEEKWREISLQFKAKNHFPFFDMAYQGFSSGDLDKDVIALRIFLEDGHLIGCAQSFAKNMGLSEHKAGCLSYQMLEESYYIMSTQFYTLMHIQMQVKQLEKLFHIYMTPDGRMSMSGVTSSNVDYLANAIHQVTRIDEEALRSC

SEQ ID NO: 212978 - protein, 119 aa, Glycine max
  Coding DNA Sequence Number=SeqID_96200
MVNCSHPPQESKRKEFLESLEGGKESQRRRSEFKISPSKHTYKSIIFTLQQRWVSTISSVSDEDNKHNAEDILRMVAVEEVPSEAVRSSTSTRGSSNDGAQQEKHTQGLEKMRSVGIWI

SEQ ID NO: 212979 - protein, 97 aa, Glycine max
  Coding DNA Sequence Number=SeqID_96201
MIHLHKTCNLRDYKRLANKFGCGGLVEEPMAVVESTTGNQESVENCEAIEVVGGVLCCSTNEGGDLAIKGGYHRGFDGGERNKLVVVVQIPNVFFIW

SEQ ID NO: 212980 - protein, 77 aa, Glycine max
  Coding DNA Sequence Number=SeqID_96202
  Homolog annotation: Hit_ID=Q1SGX5; Match level="QueryCoverage=88%, HitCoverage=16%, E-value=2e-07, Identity=33%"; Hit description =Peptidase S10, serine carboxypeptidase
LGHEADLKLSTVFQSYYHILVDTWANDENVRKALHVREGTKEEFLRCNRTMAYTTTRLNTVEFYRNLTNANLEALVY

SEQ ID NO: 212981 - protein, 136 aa, Glycine max
  Coding DNA Sequence Number=SeqID_96203
  Gene Ontology: Mol. function=serine carboxypeptidase activity; Biological process=proteolysis
  Homolog annotation: Hit_ID=O64808; Match level="QueryCoverage=83%, HitCoverage=29%, E-value=4e-22, Identity=42%"; Hit description =Putative serine carboxypeptidase I
MQWFIDHPKFSSNPFYIGGGSYSGMITGPLVQQGYVLASPAVDGFREQNMKVLYAYQRSLIPEALYKSMKENCNGDYINIDPENTKCVSDYSVYVELVRYINEQQIMEPLCITTPGVNREILQEVQDPPTFWCRVE

SEQ ID NO: 212982 - protein, 98 aa, Glycine max
  Coding DNA Sequence Number=SeqID_96204
MKNELVFPQHHRTNADLQKYQCDDPEKDTDTSVSDTEQMFVACNTFHGHAPPFVGNILPLQQPPFVCLYPEFQHLTEACETIVREIDALMQDHVTLAQ

SEQ ID NO: 212983 - protein, 670 aa, Glycine max
  Coding DNA Sequence Number=SeqID_96205
  Gene Ontology: Mol. function=RNA-directed DNA polymerase activity; Cellular component=chromatin; Biological process=chromatin assembly or disassembly
  Pfam annotation: Domain name=Chromo; Domain location=575-627; Score =8.3; E_value=0.1; Accession=PF00385.14; Description='chromo' (CHRromatin Organisation MOdifier
  Pfam annotation: Domain name=rve; Domain location=355-511; Score =102.8; E_value=1e-27; Accession=PF00665.16; Description=Integrase core domain
  Pfam module annotation: Pfam domain module=Chromo::rve; Domain location=575-627::355-511
MVQRKEETKRRIVKPVITCSRGTQVEYLGHIVSQRGVEPIASKISVIQQWPTPRTTKALRNFLGHAGFYRRFIRGYATIVAPLVKATMSEPLQWSSSAQIAFDCLKEALSTAPVLALPDFTKPFTLETDASGVGMGAVLSQQGHPLAFFSKPFTQKLLRSSTYVQELCAITTAVRKWRQYLLGHHFTIITDHRSLKELFGQYRSGTCNQAADSLSRLPDHNASLTMLLSVPCLSFLKELRTQLSANDDYNNLRQNILLHPHNYSDYSVMQDLVLYKSRIWLPRELPLIQTLLQEFHSTPTGGHADVTKTIARLLENFYWPKLREDVVCFVAHCQDFQITKYESKKTAGLVCPLPTPYRPWDDLSMDFIVGLPVYKGNTVILVIVDRFSKGIHLGMLPTAHTAHMVATLFMNIVVKLHGFPRSIVSDRDPLFISHFWRDLFRLSGTLLRLSSAYHPQSDGQTEVLNRVIKQYLRAFVHERQGAWGKYLSWVEWSHNSAWSAITGSTPYEIMYGRKPFTFPEYLAGTSKNDVVDELLVDRETKFHSIRKKLLKAQETMKRYADAKRRDVVYQPNDWLHPTPAIQRRTLGSSPIAWEVLVQWEGLSPDEASWENWHQLCHDYHLEDKVDFQGAKDVTHELRMPYTQETPTSMVQRNEETKRRIVKPAYLADYV

SEQ ID NO: 212984 - protein, 160 aa, Glycine max
  Coding DNA Sequence Number=SeqID_96206
  Gene Ontology: Mol. function=chromatin binding; Cellular component =chromatin; Biological process=chromatin assembly or disassembly
  Homolog annotation: Hit_ID=Q1SAV4; Match level="QueryCoverage=98%, HitCoverage=43%, E-value=2e-25, Identity=39%"; Hit description =Integrase, catalytic region
MGLTPFEVMLGKPPPRFPPYSSGDIPVKVVDSILSTRKPMYALLQKRLAKAQADMKWYTDARCRNLSFMRQSSLVGSYSKLAKRFFGPFQITERIGAVAYRLLLPLSSKIHDVFHVSLLKGHYGPSPSLSVDLPPSSVDHHPLVKPLAILVSKVDTSTTH

SEQ ID NO: 212985 - protein, 123 aa, Glycine max
  Coding DNA Sequence Number=SeqID_96207
MHHHRRHYHYYDCRHDHGHRHQHNYCCYHHQLDAFGDPEVVIGALCNPTFGVLEVVICVFSGPDAEIGVFGGPEVVIGTLGDPSFGLEVVTDAFGGPVFGGPQVEIGAFGIPEVVVGVLNSLR

SEQ ID NO: 212986 - protein, 161 aa, Glycine max
  Coding DNA Sequence Number=SeqID_96208
  Gene Ontology: Mol. function=protein serine/threonine kinase activity; Cellular component=cytoplasm; Biological process=protein amino acid phosphorylation
  Homolog annotation: Hit_ID=Q5W736; Match level="QueryCoverage=59%, HitCoverage=27%, E-value=3e-27, Identity=49%"; Hit description =Putative serine/threonine protein kinase
MCLTVKNSFTEANEFVPPSELSLFNLDDIGCLVHCPYLFFARATEVPRNLSHCAISKHNDCEDVFLEMEQKGGVLMQRYELGRLLGQGTFAKVYHARNIITGMSVAIKITDKDKILKVGMSDEANQASTCGGELFNKVSKGKLKQDDARRYFQQLISAVDY

SEQ ID NO: 212987 - protein, 121 aa, Glycine max
  Coding DNA Sequence Number=SeqID_96209
  Homolog annotation: Hit_ID=Q00M75; Match level="QueryCoverage=22%, HitCoverage=4%, E-value=9e-07, Identity=92%"; Hit description=PPR -repeat containing protein
MAWCSGKVMSWRLVGHEFESGNSLFAYARLDRAHHYLTLCPPSRALSLVPSLVPTIKVFASFCYLASAIVPFFVSSTVPSGNISVLSCGSKFGEEFLMFDDLSFGLVFMDSFLLFRVDLEL

SEQ ID NO: 212988 - protein, 106 aa, Glycine max
  Coding DNA Sequence Number=SeqID_96210
MHLKFHQHAHDKSCIGKGHGLTWYLDSGRSRHMTGEKSMLLNLKPIEGGITSFGGMGKGKIIGIANVLFHSKVLRMMLRKVQRTVVKVKNSEDLLKPIRMMKSNSF

SEQ ID NO: 212989 - protein, 146 aa, Glycine max
  Coding DNA Sequence Number=SeqID_96211
MAKLRDSWEIEATVAIKTCHRVAIPGKLLEEGKNVNFSSSFDLESKQTFFGGNLLAHIFDELKICSKFEFGQNLFESKREKSRLKGIPRFKEVFAKYKARTRKRASNHWAIRTGVYSSRSRGSQISGLSAISDKTSQNQFDFEQCG

SEQ ID NO: 212990 - protein, 60 aa, Glycine max
  Coding DNA Sequence Number=SeqID_96212
MSSVIYASQSGNVKTREESVKGGDLSSETVIEKKRDGGGGVSDDDASQSENGGREKQDFE

SEQ ID NO: 212991 - protein, 102 aa, Glycine max
  Coding DNA Sequence Number=SeqID_96213
MMHDDTYIIPNPPVLPIHSASIPQPPSLVVVDADMPRHAVATCQKIAEILEHMINIRMVTGGIDAYTLIEHYLRLAKGVTEQGNVYVRSRQRRDTHDKDGDE

SEQ ID NO: 212992 - protein, 316 aa, Glycine max
  Coding DNA Sequence Number=SeqID_96214
  Gene Ontology: Mol. function=transferase activity
  Homolog annotation: Hit_ID=Q1S9Q3; Match level="QueryCoverage=94%, HitCoverage=61%, E-value=3e-73, Identity=47%"; Hit description =Ankyrin
MVAKLNNRQLIEASVYDAMLDAAKHGIVEFIEAMREANHELLWALDSHKRGVFSYAVLNRKQDVFQLIHTVNGRRDIIKSRKDRFGNNLLHLAGHLGPSSELSQTPGAALQMQREYKWFEAVEKIVHPKCREEKNGDDKKPHELFTETHKELVIDGEKWAKQSAKSFSIVGTLMTTILFAAAFTIPGGNDEKTGVPIFSNNMAFTVFIIADSISVFTSATSVMIFIWILTSRFAERDFRLWLPLKLLLGLVFLLFSVVSMMVAFCAALAIILKAYRAYRYLIIGAAICGSMPITVLVISQVNLIRDILKSTISPIG

SEQ ID NO: 212993 - protein, 423 aa, Glycine max
  Coding DNA Sequence Number=SeqID_96215
  Gene Ontology: Mol. function=nucleic acid binding; Cellular component= intracellular; Biological process=DNA integration
MITICPSGVVHALQLSKALKEKSSGNVLMGNDASCKLVNVGSVQIRMHDGVQARLTWKSQGGTTLVYEKRHQTKFPKVVHTTKVILDYIHYDYWGPSRVPSLGGARYFLSIIDDYSRMTWAASTTCYLMNHSPSNAIGFKTPIKVWPNKPTKYSMLKVFGSLAYYHVSEAGEWMRAMNEDGIPQKNQTWDLVELPKGRQVMGCKWHFKKKIGSSIEEVISYKSCLVAKSYMRTLDMELEQLDVKTVLLHGRLEEDILMQQLEGFKVEDGSHIYLLLNVEDMLITSQNLLAIQKLKSLLSNEFEMKDIGAAKKIWGMEIKRDRVQKKFFLCQKEYIQKEYTSCVPYASVVSSLLYAMVCTKTDLAQVASVVNRYLKGTTNIELVYHRDTFFALVGYSDSDYATNLGVKRSMTRYAFMISNSLIS

SEQ ID NO: 212994 - protein, 78 aa, Glycine max
  Coding DNA Sequence Number=SeqID_96216
  Homolog annotation: Hit_ID=Q1S9Q3; Match level="QueryCoverage=97%, HitCoverage=23%, E-value=8e-15, Identity=58%"; Hit description =Ankyrin
MAVEKIVHPKLKEDKNAAGKKPREIFSESHEEIVKAGEKWAKDTASSFTLVYHSRCIISLYIFHFSHDLYWDPHVTLC

SEQ ID NO: 212995 - protein, 174 aa, Glycine max
  Coding DNA Sequence Number=SeqID_96217
MEPIIELKVVARVMIDWEAHNIPKPKKNAKESVLWAAEIEGFCVCFYERCIAILNSSSLSNFIADHHESASDDVDTGVPDIFGEERVCENIDLAHLTKRQWKWRREWMAIVVSMRIGHARGAMKRFHHSVVKEIERNKRKEEERRGTEAEALPNRDCDQSLHRSLFGVLHATVG

SEQ ID NO: 212996 - protein, 106 aa, Glycine max
  Coding DNA Sequence Number=SeqID_96218
MMHTIGDGGECDMWSRRWRGSCGMSDHIIYFVRVLSRNHIDPWDNPGGGVVGESILRARMTIELMEAHPYNQHFSDGTGDVVQRKGYNNANDEDVREGPSEEASQS

SEQ ID NO: 212997 - protein, 256 aa, Glycine max
  Coding DNA Sequence Number=SeqID_96219
  Gene Ontology: Mol. function=protein dimerization activity; Cellular component=nucleus; Biological process=regulation of transcription, DNA-dependent
  Homolog annotation: Hit_ID=Q9ZPJ6; Match level="QueryCoverage=98%, HitCoverage=50%, E-value=2e-20, Identity=33%"; Hit description =Transcription factor PERIANTHIA
  Pfam annotation: Domain name=bZIP_1; Domain location=187-242; Score =23.1; E_value=0.00046; Accession=PF00170.11; Description=bZIP transcription factor
  Pfam annotation: Domain name=bZIP_2; Domain location=187-237; Score =19.3; E_value=0.0082; Accession=PF07716.5; Description=Basic region leucine zipper
  Pfam module annotation: Pfam domain module=bZIP_1::bZIP_2; Domain location=187-242::187-237
MQGFKTAQPSSQQLYCHSSFLLRGNDPNQNPARFSDLGEHHHFSAVFHQEDAADLSSSSMFSVKSSNVVGGSNMQYGTLNTVVFLPLTFCLRCCRKMNVGHAEIGSSGGGCMDTRQQLMYHKGVTMAALPLGNGQVENWADSGKADNSQQTDDTSTDIDTDDIIPCNRVKNGTRMVVHSKDETKVKPGDQKTLRRLAQNREAARKSRLRKKAYVQQLESSRVKLVQLEQELQRARQQGIFIATPGDQGHLAVGNGT

SEQ ID NO: 212998 - protein, 72 aa, Glycine max
  Coding DNA Sequence Number=SeqID_96220
  Subcellular localization annotation: CTP_CleavageSite=31; ConfidenceScore=5.10e-01
MGLFQQCIEMPLNFLPTLDKLPMVNSRSLVKAATQRCNKQLARSLVKTVTKGGAARSKGKENVAELTLGGNL

SEQ ID NO: 212999 - protein, 100 aa, Glycine max
  Coding DNA Sequence Number=SeqID_96221
MSILTLGSGKNRRGISNQRKGKKEDFQSKRKQKRERRKISNRRESKKRKEGKFPNQRVGESKKKRKEIPNQRMGERNNLQSQVMTYLWSGIRMKHLPVRD

SEQ ID NO: 213000 - protein, 52 aa, Glycine max
  Coding DNA Sequence Number=SeqID_96222
MGNKKKQNIDNVNGRDEMIQKDCDMLEQIVAKMLRIVICWNKKKLTSRERSK

SEQ ID NO: 213001 - protein, 36 aa, Glycine max
  Coding DNA Sequence Number=SeqID_96223
VRPQSNLAPLSGSSGPKCSVSHFSRVLYLALPCFSC

SEQ ID NO: 213002 - protein, 861 aa, Glycine max
  Coding DNA Sequence Number=SeqID_96224
  Gene Ontology: Mol. function=nucleoside-triphosphatase activity; Cellular component=membrane; Biological process=proteolysis
  Homolog annotation: Hit_ID=Q9LET7; Match level="QueryCoverage=98%, HitCoverage=81%, E-value=0.0, Identity=57%"; Hit description =Calmodulin-binding protein
  Pfam annotation: Domain name=AAA; Domain location=283-468; Score =260.5; E_value=3.5e-75; Accession=PF00004.19; Description=ATPase family associated with various cellular activities (AAA)
  Pfam annotation: Domain name=AAA; Domain location=612-798; Score =308.8; E_value=9.7e-90; Accession=PF00004.19; Description=ATPase family associated with various cellular activities (AAA)
  Pfam annotation: Domain name=AAA_2; Domain location=609-739; Score= -46.3; E_value=0.031; Accession=PF07724.4; Description=ATPase family associated with various
  Pfam annotation: Domain name=AAA_3; Domain location=612-742; Score= -22.5; E_value=0.095; Accession=PF07726.2; Description=ATPase family associated with various
  Pfam annotation: Domain name=AAA_5; Domain location=283-415; Score =0.5; E_value=0.0016; Accession=PF07728.4; Description=ATPase family associated with various
  Pfam annotation: Domain name=AAA_5; Domain location=612-745; Score =6.9; E_value=0.00053; Accession=PF07728.4; Description=ATPase family associated with various
  Pfam annotation: Domain name=NACHT; Domain location=282-431; Score= -41.1; E_value=0.092; Accession=PF05729.3; Description=NACHT domain
  Pfam module annotation: Pfam domain module=AAA::AAA::AAA_2::AAA _3::AAA_5::AAA_5::NACHT; Domain location=283-468::612-798::609 -739::612-742::283-415::612-745::282-431
MGCPPLGTSVFVHPIQKSLANGSNEQHSTENNCLPIYNCKELYLQLVPSKNGLPLKFNNFPSSGMSKVKSHVQSENDIIASPATPSNGSKFSNAIGMSSPLFDDSASSVPNLNSQSLNSFDVSLALRDESSKEILLTGAKPWLYSRSLLLGNLVNVPMLSELCFFQVIGAKKQPVTKSDHCPSNGNSDLYPEDSDIAESVNQAFTVNDETKVFLSLPSNAASEEPIQRDIPCVKLEHKVANASLHDKISKLGGLSKEYTLLKDIISSSVSDALSSFGLRTTRGVLLHGPPGTGKTSLAQLCAHDVGVKFFPINGPEIVTQYYGESEQQLHELFDSAIQAAPAVVFIDELDAIAPARKDGGEELSQRLVATLLNLVDGISRSEGLLVIAATNRPDHIEPALRRPGRFDKEIEIGVPSPNQRSDILLTLLSEMDHSLAELQIENLATVTHGFVGADLAALCNEAALICLRRYANFKKTYDSCSDYITEQPALMNGATNSIDHSGDATSSVSDMSVASSRVLPSCMIGMTSEAMEIIPDSGEEEQILKVSFEDFQKARMKIRPSAMREVILEVPKVNWEDVGGQKEVKAQLMEAVEWPQKHHDAFNRIGTRPPTGVLMFGPPGCSKTLMARAVASEAGLNFLAVKGPELFSKWVGESEKAVRSLFAKARANAPSIVFFDEIDSLAVTRGKESDGVSVSDRVMSQLLVELDGLHQRVNVTVIAATNRPDKIDPALLRPGRFDRLLYVGPPNEVDREEIFRIHLRKIPCGSDVSLKELARLTDGCTGADISLICREAAVAAIEESLDASVITMEHLKMAIKQIQPSEVHSYQKLSTKFQRAVRCCDIKDEFNDMPCDSRSTQFSIW

SEQ ID NO: 213003 - protein, 355 aa, Glycine max
  Coding DNA Sequence Number=SeqID_96225
  Gene Ontology: Mol. function=DNA binding; Biological process =regulation of transcription
  Homolog annotation: Hit_ID=Q8LA15; Match level="QueryCoverage=67%, HitCoverage=81%, E-value=2e-32, Identity=38%"; Hit description=ARR1 protein-like
  Pfam annotation: Domain name=Myb_DNA-binding; Domain location=113 -163; Score=43.6; E_value=6.5e-10; Accession=PF00249.21; Description =Myb-like DNA-binding domain
MREEDSNWFSRWEEEFPSPEELMPLSQTLITPDLAMAFDIRNPHTTNTAQQQHHQHQQQPQQQQQPSNPSSLPNPLQQQQQQQQPTSAEFADSGELGSGTAGEEPARTLKRPRLVWTPQLHKRFVDAVAHLGIKNAVPKTIMQLMSVDGLTRENVASHLQKYRLYLKRMQGISAAGPGGPGGGASGAVADPATDHLFASSPVPAHFLHPAARPNSDHFLPFVPALHPHQQQQQMAAAAQYHRQVGHFGSPPNGHFENPFMSRPNLQRMGGGGGGGPVHNNHHPVSGYVEDMESANAASGGFVSVFMEGVAKATNLVLVSAGGNKRGLQLVETNGGVSDWHEVSCTLFDSIGDFNA

SEQ ID NO: 213004 - protein, 293 aa, Glycine max
  Coding DNA Sequence Number=SeqID_96226
  Homolog annotation: Hit_ID=Q1T0R3; Match level="QueryCoverage=37%, HitCoverage=71%, E-value=1e-13, Identity=35%"; Hit description =Hypothetical mitochondrial protein atmg00310
IGVVDGECSQVTLDRNILDHCVIIIRDSNVDWDPKLFRTLDCWFHDKTFCGVCEKSLEKFGCSRLGSYVFKEKLKALKNGLKGDSNSKFFHECELEKEEKLVEGGSSFPNISQDEYGNFEEDEIKKAIWECGSSKSLGPDGFNFGKRCVAQKGWRAKVLDTYVGSMSVFLLSGVGRCSMIMTPYGGKSLFLSMMGMCKKCVDMWFHKLRVWKIGNGHITRFWEDSWLEGKCEWAFSWRRSWFVWESLMVDPFMGKLQNCNFVQGVPNVWGLRFGNSTKGSVHGVEANIGSTPD

SEQ ID NO: 213005 - protein, 165 aa, Glycine max
  Coding DNA Sequence Number=SeqID_96227
PGPPPDIGGGPTVRAQLEREAITQLLCIPVQDFTRAAAKRRVWIMHTNMNRVAPTRHPVDPEKSNRALGFLALVTGIVPARHPMDPKKSNRVLGFPALITGLCQFYGVPVTPNKVIRPPTNRAFIKRYCAPRQAQDETPQQPGDGQQQATNASPPPPEPLNSSTK

SEQ ID NO: 213006 - protein, 202 aa, Glycine max
  Coding DNA Sequence Number=SeqID_96228
  Subcellular localization annotation: CTP_CleavageSite=40; ConfidenceScore=5.17e-01
MMRLRQNGSSRKDLKGCLSASLSATMGLNNNAFLENRPVVAARVANGANMVVQWVLEDLCGGGGSFGSDNGPLPPPSSVVDHCHKWNEEEVQHGEVQRLSIVATLLCEGEDGGVGGRVRCMGADRDDVRLGVAGEDHGAEVVHGVGGGLKERGDELVEGGVGDDKNGEGGAIPGKGRDGSEEGGKLGELLHDGEEGGEIVNV

SEQ ID NO: 213007 - protein, 368 aa, Glycine max
  Coding DNA Sequence Number=SeqID_96229
  Homolog annotation: Hit_ID=UPI000034EE59; Match level="QueryCoverage =97%, HitCoverage=36%, E-value=1e-78, Identity=47%"; Hit description =transcription factor
MASEDAKNLVNQEKSFACAEIESARAVVLRIGEALEEQEKASQASKPQYVKCTPSVVLHCQDVDGLVEEVQESRRIKLLHHPSKVMAMEYELRALRDQIREKSIFSIKLQKELWVHICESSLAQMKCHRFRNVHFSGTACLLKAAGGKLFQPLCICKGKAAYNIPPPYLRIAKSLWAMGGLGRGSNGQQLEERSSKSRFLHLGWDSANKSIYAPDPSDVGRILQVDIVSNGKKLTLTTNPIQTVSGLGSHVETLLRKSNTDFNVVISQMNGKDHSSHSTHSFNVGRMRIKLCRGWITKAREIYSPSMQLCGVRSDVANAAKVLFWQARKGLSFVLTFESERDRNSAIMVARKYALDCNVVLAGPDDLV

SEQ ID NO: 213008 - protein, 294 aa, Glycine max
  Coding DNA Sequence Number=SeqID_96230
  Gene Ontology: Mol. function=kinase activity; Cellular component =nucleus; Biological process=regulation of progression through cell cycle
  Homolog annotation: Hit_ID=P25011; Match level="QueryCoverage=97%, HitCoverage=75%, E-value=1e-110, Identity=64%"; Hit description =G2/mitotic-specific cyclin S13-6
  Pfam annotation: Domain name=Cyclin_C; Domain location=211-293; Score= 53.5; E_value=6.9e-13; Accession=PF02984.9; Description=Cyclin, C -terminal domain
  Pfam annotation: Domain name=Cyclin_N; Domain location=84-209; Score =204.5; E_value=2.5e-58; Accession=PF00134.13; Description=Cyclin, N -terminal domain
  Pfam module annotation: Pfam domain module=Cyclin_C::Cyclin_N; Domain location=211-293::84-209
SFGAKLLATVQAPAAAENNMKQACANVAGAPPVAKGVALAKRAVAPKPGQKKVTVKPKSEEDQILDIDASDVDNELAAVEYIDDIYKFYKLVENESHPRDNIDSQPEITERMRAILVDWLIQVQTKFELSLETLYLTINIVDWFLAVKNVPKRELQLVGISAVQMATKYEEIYPPQVHNFVFLSGRAYTHEQILIMEKIILAKLDWTLTVPIPLVFLLRFIKASVPDQELENMAHFLSELGLMNYATEMYWPSMVAASAVFAARCTLNKAPLWNETLKLQTGYSQEQLMYVNLN

SEQ ID NO: 213009 - protein, 185 aa, Glycine max
  Coding DNA Sequence Number=SeqID_96231
ITLLSEEEDKILEAHEDAPPSQPQFEHQQFNILQQSVETQGLARRWETVDAATYSLSPMPERQHEMYYTLSTFTQEPSQMPPMYSYPHDFQPGYSFAGIFGSSPPFTQSGQVSTPNASLAGPWNVPGDISDMDDFLGFDLRHDFSAEVDQVDERANPRRRNPDRAARNWDRPCGTSSRHHIHSDD

SEQ ID NO: 213010 - protein, 262 aa, Glycine max
  Coding DNA Sequence Number=SeqID_96232
  Gene Ontology: Mol. function=helicase activity; Biological process =viral genome replication
  Homolog annotation: Hit_ID=Q1SN45; Match level="QueryCoverage=100%, HitCoverage=15%, E-value=9e-54, Identity=43%"; Hit description=AAA ATPase
MMLSTAKGAQSYSDIRTVNGLVYPTFREACFAKGFLGSGQEFISALQEANNWGTAHYLRKLFVKLLFMNTMDKSEYVWQQTWQWMADDIIFNHRKQGIRLAEKETIHLCLTEIENMLQVNIRSLRDFPSMPYPIGYAPNQHHNNLIHNEMAYDKEMLAEQYYTAYQLLTDEQKTIVNTIMSVVNTQSAAVYFLYGYGGTGKTFVWTTLSSGIRSNGGIVCTIASLLLPGGRIAHSKFAIPVPATENSTCNIHQGSELAELLK

SEQ ID NO: 213011 - protein, 213 aa, Glycine max
  Coding DNA Sequence Number=SeqID_96233
  Gene Ontology: Mol. function=hydrolase activity; Cellular component =intracellular; Biological process=response to DNA damage stimulus
  Homolog annotation: Hit_ID=P76213; Match level="QueryCoverage=93%, HitCoverage=83%, E-value=1e-60, Identity=62%"; Hit description =Excinuclease cho
MAHCALGSVGGFALQLNQRINAGQQRPAENFVAVMVEAVTRPLQLTRFLLTADRSQPEPVIDDVNLRHLRPALHHTHRALPRPAHHAQLLQPCQQALLMRRQRRAPAAGALIPAGRGTGAARRRGFSASLRRQSGCGIARTGQALIEQRLLRFDHLRFEQLCAHVPGGGDPADAPRLAQHAGFIRRAKMGHHPAAQVDALADVQRQVVVITVE

SEQ ID NO: 213012 - protein, 342 aa, Glycine max
  Coding DNA Sequence Number=SeqID_96234
  Gene Ontology: Mol. function=hydrolase activity, acting on ester bonds; Biological process=arginine catabolic process to glutamate
  Homolog annotation: Hit_ID=Q5PHC2; Match level="QueryCoverage=93%, HitCoverage=98%, E-value=2e-98, Identity=57%"; Hit description =Succinylglutamate desuccinylase
  Pfam annotation: Domain name=AstE_AspA; Domain location=53-334; Score= 236.7; E_value=5e-68; Accession=PF04952.5; Description=Succinylglutama te desuccinylase  Aspar
  Pfam annotation: Domain name=Peptidase_M14; Domain location=12-269; Score=-74.0; E_value=0.019; Accession=PF00246.14; Description=Zinc carboxypeptidase
  Pfam module annotation: Pfam domain module=AstE_AspA::Peptidase_M14; Domain location=53-334::12-269
MCCPLCQKGVNMQDFLQQTLSGRPPAQRQGSNAHLHWQWHDEGILSLTPHTSTQQALVLSAGIHGNETAPVEILNLLLTPLLQGEKPLAVRLLVILGNPAALRSGKRYQHYDINRLFGGRWQQVADVPEAQRALQLEQALENFWCECLDHEIRWHLDLHTAIRGSWHTRFGVMPLNIQPWPADFLHWLAAAELEALVFHRAPGGTFTHFSCEHYAAASCTLELGKALPFGENDLTQFSGVQRALAALLYGEALPPVRETPRHYRVAQQITRHGEQFVLHMGPETLNFTAFPQGTLLAEEGERRYYVQQAREYVLFPNPNVAPGLRAGLMLVEESEQTQALEL

SEQ ID NO: 213013 - protein, 209 aa, Glycine max
  Coding DNA Sequence Number=SeqID_96235
  Gene Ontology: Mol. function=hydrolase activity; Cellular component =cytoplasm; Biological process=metabolic process
  Homolog annotation: Hit_ID=Q5PHA2; Match level="QueryCoverage=98%, HitCoverage=93%, E-value=1e-70, Identity=65%"; Hit description =Putative hydrolase
  Pfam annotation: Domain name=Hydrolase; Domain location=1-181; Score =88.7; E_value=1.7e-23; Accession=PF00702.16; Description=haloacid dehalogenase-like hydrolase
MDGLLIHSEPLWDRAELEVFASLNVDISRRHELPDTLGLRIDQTVRMWYEALPWNGPDQAEVTQRIIARALALVEETRPLLPGVEQALQLCQQQGLAIALASASPLAMLERVLEMFNLRHYFSALASAEALPYSKPHPQVYLDAAAKLGVDPLNCVALEDSFNGMIASKAARMRSIVVPAAEHRHDARWALANVQLENLTQLQAEHLFN

SEQ ID NO: 213014 - protein, 55 aa, Glycine max
  Coding DNA Sequence Number=SeqID_96236
  Gene Ontology: Cellular component=integral to membrane
  Homolog annotation: Hit_ID=Q5PHA3; Match level="QueryCoverage=100%, HitCoverage=30%, E-value=1e-18, Identity=83%"; Hit description =Putative membrane protein
MTYQQAGRIAILKRVAGWVIFIPALLSTLISILGFMFKHSEKQPGIDAVMLDFVH

SEQ ID NO: 213015 - protein, 71 aa, Glycine max
  Coding DNA Sequence Number=SeqID_96237
  Subcellular localization annotation: CTP_CleavageSite=36; ConfidenceScore=5.09e-01
AKFDIAEATKVKTKVMSTVATRWRQFKSTLTSKFVFAKSEGQQTQDVVTKYGLDPEAWKQFEETRLTPNWE

SEQ ID NO: 213016 - protein, 81 aa, Glycine max
  Coding DNA Sequence Number=SeqID_96238
  Gene Ontology: Cellular component=nucleus; Biological process =regulation of progression through cell cycle
  Homolog annotation: Hit_ID=P25011; Match level="QueryCoverage=85%, HitCoverage=16%, E-value=2e-17, Identity=64%"; Hit description =G2/mitotic-specific cyclin S13-6
MAHFLSELGLMNYATEMYWPSMVAASAVFAARCTLNKAPLWNETLKLQTVCSLKLIAKTSSDYYNVFSEGPFESGTEISLT

SEQ ID NO: 213017 - protein, 392 aa, Glycine max
  Coding DNA Sequence Number=SeqID_96239
  Gene Ontology: Mol. function=kinase activity; Cellular component =nucleus; Biological process=regulation of progression through cell cycle
  Homolog annotation: Hit_ID=P25011; Match level="QueryCoverage=99%, HitCoverage=97%, E-value=1e-143, Identity=65%"; Hit description =G2/mitotic-specific cyclin S13-6
  Pfam annotation: Domain name=Cyclin_C; Domain location=264-384; Score= 174.5; E_value=2.6e-49; Accession=PF02984.9; Description=Cyclin, C -terminal domain
  Pfam annotation: Domain name=Cyclin_N; Domain location=139-262; Score= 181.2; E_value=2.6e-51; Accession=PF00134.13; Description=Cyclin, N -terminal domain
  Pfam module annotation: Pfam domain module=Cyclin_C::Cyclin_N; Domain location=264-384::139-262
MASRGEAVVWGGKQQKKKKGIAVGRNRKILGDIGNLVNRPITRSFSAQILAKVQAAAKNNKKQASVKVKPKAEEVIDIEAGPDKEVQKNKNKESRASTSVLTARSNAACDITNKPREQIIDIDASDSDNELAAVEYIDDICKFYKLVENENHPHDYIDSQPEIDQRSRAILVNWLIDVHTNLDLSLETIYLTINIIDRFLAVKTVPRLEMQLVGISAMLMASKYEEIWTLEVDELVRLTDYTHEQVLVMEKTILNKLEWNLTVPTTFVFLVRFIKASVPDQELENMAHFLSELGMMHYATLKYFPSMVAASAVFAARCTLNKAPLWTETLKLHTGYSQGQLMDCARLLVSFHSMAGNGEEKVVYIKYSDPEKGAVAMLPPAKNLMPEGSDSQ

SEQ ID NO: 213018 - protein, 78 aa, Glycine max
  Coding DNA Sequence Number=SeqID_96240
MVVVCGGGARCTLRPILPPPLGSLSSGVSPKGRRIGKECVDATVGSYRVLSKESIGCCEWGHDAGWFLQNFYQTFGEH

SEQ ID NO: 213019 - protein, 644 aa, Glycine max
  Coding DNA Sequence Number=SeqID_96241
  Gene Ontology: Mol. function=polynucleotide adenylyltransferase activity; Cellular component=nucleus; Biological process=RNA polyadenylation
  Homolog annotation: Hit_ID=Q9LMT2; Match level="QueryCoverage=64%, HitCoverage=59%, E-value=0.0, Identity=72%"; Hit description =F2H15.20 protein (Hypothetical protein At1g17980) (At1g17980) (Poly(A) polymerase)
  Pfam annotation: Domain name=PAP_RNA-bind; Domain location=261-398; Score=188.8; E_value=1.3e-53; Accession=PF04926.5; Description =Poly(A) polymerase predicted RNA binding domain
  Pfam annotation: Domain name=PAP_central; Domain location=29-260; Score=434.4; E_value=1.6e-127; Accession=PF04928.8; Description =Poly(A) polymerase central domain
  Pfam module annotation: Pfam domain module=PAP_RNA-bind::PAP_central; Domain location=261-398::29-260
MHPEMYGHISYQPKLLLNVPQEDFFGGLQKMLSEMQEVTELHPVPDAHVPVVKFKFNGVSVDLLYARLALWVIPEDLDISQESILQSVDEQTVLSLNGCRVTDQVLRLVPNIQTFRTTLRCMRFWAKRRGVYSNVAGFLGGINLALLVARICQLYPNALPDMLVSRFFRVYTQWRWPNPVMLCAIEEGSLGLPVWDPRRNPKDRYHLMPIITPVYPCMNSTYNVTSSTLRVMSDEFRRGSEICEAMEASKADWDTLFEPYPFFESYKNYLQIDITAENADDLRQWKGWVGSRLRQLTLKIERHTYGMLQCHPHPGEFSDNSRPFHHCYFMGLQRKQGVPVNEGEQFDIRLTVEEFKHSVNAYTLWKPGMDIHVSHVKRSNIPNYIFPGGVRPTFPSKVTAENKQSSKSRASGHGQTEKPQGGKAVAVGADDVRKRKRSEDNMDNNPRNSRSPVSLPPPSREVHEDISPISASSSCSMKFDESEVNSIGGQKSEKLCLKSPGEIPSGDSGTNGSVTSNQQVNPVLAAADTSNSKEEEKLAIEKIMSGLYDAHQAFQEEPKELEDNTQYKNQDKDSSANMKNNMESLDSKPAVPEEPVISKEITCSTHLCSNESLEELEISDFPKLLAIVCAVLKLLKTQSNLHRS

SEQ ID NO: 213020 - protein, 224 aa, Glycine max
  Coding DNA Sequence Number=SeqID_96242
  Gene Ontology: Mol. function=oxidoreductase activity, acting on paired donors, with incorporation or reduction of molecular oxygen, 2-oxoglutarate as one donor, and incorporation of one atom each of oxygen into both ...
  Gene Ontology: Mol. function=donors; Biological process=protein metabolic process
  Homolog annotation: Hit_ID=Q5QMV1; Match level="QueryCoverage=92%, HitCoverage=45%, E-value=4e-53, Identity=54%"; Hit description =Oxidoreductase, 2OG-Fe(II) oxygenase-like protein
MNKFGAVLDDFGLETMLDKLMEGFIRPLSRVFFAEVGGSTLDSHHGFVVEYGKDRDVDLGFHVDDSEVTLNVCLGKQFSGGELFFRGVRCEKHVNTGSHSEQKALTPSVPQIASCPPCFREIYGPLLFAISHRWLYTFESRRSLIILMSLDELSFIVVVIAMVLELQHLVIGSVFREMKLYQKDFSSWCGECNREKKERQRSTVAATKLKSTGVLRIQEYDCVG

SEQ ID NO: 213021 - protein, 338 aa, Glycine max
  Coding DNA Sequence Number=SeqID_96243
  Gene Ontology: Mol. function=molecular_function; Cellular component =membrane; Biological process=auxin mediated signaling pathway
  Homolog annotation: Hit_ID=Q9LV20; Match level="QueryCoverage=92%, HitCoverage=87%, E-value=1e-103, Identity=58%"; Hit description =Nodulin-like protein
  Pfam annotation: Domain name=DUF6; Domain location=174-303; Score =67.7; E_value=3.8e-17; Accession=PF00892.11; Description=Integral membrane protein DUF6
  Pfam annotation: Domain name=DUF6; Domain location=20-132; Score=5.9; E_value=0.031; Accession=PF00892.11; Description=Integral membrane protein DUF6
  Pfam annotation: Domain name=TPT; Domain location=165-303; Score= -19.0; E_value=0.0071; Accession=PF03151.7; Description=Triose -phosphate Transporter family
  Pfam module annotation: Pfam domain module=DUF6::DUF6::TPT; Domain location=174-303::20-132::165-303
MASVVTEKVKLLVALLTLQLCFAGYHIVSRLALNIGVSQVIYPVYRNLIALLLLSPFAYVLEKITANQGFYLLGLYYASPTFASALQNSVPAITFILALALRLEEVNITRRDGLAKVLGTIASVGGATVITLYKGPPLLHLQMDQIQGDTLEVDQSTKVQNWTWGCIYLLGHCLSWACWIVFQAPVVKKYPAKLTLTSFTCFFGLIQFLIIAAFAENDLENWKIQSLEELFIILYAGIIASGVVISLQTWCIQKGGPVFVAVFQPVQTILVAVMAALILGDQLYSGGLIGAILIVLGLYLVLWGKNNEKKVTEPSLTNPLLKAEEENKETVSVPKDIP

SEQ ID NO: 213022 - protein, 121 aa, Glycine max
  Coding DNA Sequence Number=SeqID_96244
  Gene Ontology: Mol. function=oxidoreductase activity, acting on paired donors, with incorporation or reduction of molecular oxygen, 2-oxoglutarate as one donor, and incorporation of one atom each of oxygen into both ...
  Gene Ontology: Mol. function=donors; Biological process=protein metabolic process
  Homolog annotation: Hit_ID=Q5QMV1; Match level="QueryCoverage=50%, HitCoverage=15%, E-value=8e-13, Identity=51%"; Hit description =Oxidoreductase, 2OG-Fe(II) oxygenase-like protein
  Subcellular localization annotation: CTP_CleavageSite=35; ConfidenceScore=5.26e-01
MVPLRHYHRYPFNKIRPLASWMQQHSPCSLNQQLRASSASGNGTVAAASTASLRLRLNPNKEHKPDGYEDMQLDFSPNIFSSLERYLPPSMLNVTRDEKAKFMREILLKYLPLGERNRVCF

SEQ ID NO: 213023 - protein, 386 aa, Glycine max
  Coding DNA Sequence Number=SeqID_96245
  Gene Ontology: Mol. function=nucleic acid binding; Biological process= DNA integration
  Homolog annotation: Hit_ID=Q1T010; Match level="QueryCoverage=91%, HitCoverage=27%, E-value=8e-55, Identity=34%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
  Pfam annotation: Domain name=zf-CCHC; Domain location=173-190; Score =19.9; E_value=0.00052; Accession=PF00098.13; Description=Zinc knuckle
MSWRKSLTMRRPKKHGMCWLQLTPMKSNEMVVQFVNRLVILTNQMKSYGEVVTDSMKVEKVLTDLTPNYDHVVFAIEQSKDLETLKLEQLLGSLEAHELKMKNREGIKKEEKDSKKALFAQNQKKDGGDSWKNKKGKGNWKYNKQESSGSKSENQKKEGENNGKGKKKSKEYIQCYNYQKYGHYAYECSNPKVLRKRSEEAQFARDSDDEEAVLLMAIVNSETGIEEWWYLDTGCSNHMTGHKDWFCEIDETVRRSIRFSDGRSVMAKGIGKVAIRRVDGSKVTISDVLYVPNMESNLLSLGQLLEKGFSMHMEGEHMEVSDSNGKCVLKAPVSKNRTFKVGVSTIEQKCLTAQSNDSVYCLGFFFTLGEFSFALSGSPRLVNLAH

SEQ ID NO: 213024 - protein, 308 aa, Glycine max
  Coding DNA Sequence Number=SeqID_96246
  Gene Ontology: Mol. function=protein-tyrosine kinase activity; Cellular component=integral to membrane; Biological process=protein amino acid phosphorylation
  Homolog annotation: Hit_ID=Q6RZV9; Match level="QueryCoverage=62%, HitCoverage=71%, E-value=6e-50, Identity=53%"; Hit description =Hypothetical protein G9-6
  Pfam annotation: Domain name=Hin1; Domain location=128-274; Score =15.3; E_value=7.9e-05; Accession=PF07320.4; Description=Harpin -induced protein 1 (Hin1)
  Subcellular localization annotation: CTP_CleavageSite=69; ConfidenceScore=5.37e-01
MHAKTDSEVTSLAASSPTRSPPRRPLYYVQSPSRDSHDGEKTATTSFHSTPVLSPSASPPHSRHSSSTRFSKKDHSHSLKPWKQIDVIEEEGLLQGDDHHNGLPRRCYFLAFVVGFLVLFSFFSLILWGASRPMKPKINIKSIKFDHVRVQAGSDATGVATDMITLNSTLKFAYRNTGTFFGVHVTSTPVELSYSDIVIASGNMKKFYQSRRSQRLVSVAVMGNKIPLYGSGASLSSTTGVPTVPVLLNLNFVLRSRAYVLGKLERNGTAREQCAKDAFLGLLGLPKLPQIAVRSMVRVHVQDQVNGS

SEQ ID NO: 213025 - protein, 226 aa, Glycine max
  Coding DNA Sequence Number=SeqID_96247
MSHLKLQYLAKPHDEVECKRERRERQGARERERAIESARERDEGWVRVASKSRGGTRNNSRDRKDPQRSYACSSFHGSWNTQTQWKDRSNTTSFYFTRFLENVNEMDLWGIFGENKEGRRYGFERFSGVIAVNRLERQLDNLVIGGLKLHINVPKYERQNESRPQLRLGLETRRGGGTQWQGSASARLTHGESHSSVHLDIPAGAKHWFSDAWVGQLKLMKTLEEA

SEQ ID NO: 213026 - protein, 89 aa, Glycine max
  Coding DNA Sequence Number=SeqID_96248
MGTEPPHGKNKEMEMVEIENLLMCLLWFVMLLPIVNTNVILEGLPRDFDSMIALIESCLPLITVEEAEASGGRNAHDEGGFNRGGGHGG

SEQ ID NO: 213027 - protein, 974 aa, Glycine max
  Coding DNA Sequence Number=SeqID_96249
  Gene Ontology: Mol. function=RNA-directed DNA polymerase activity; Cellular component=membrane; Biological process=RNA-dependent DNA replication
  Pfam annotation: Domain name=Exo_endo_phos; Domain location=223-416; Score=39.2; E_value=1.4e-08; Accession=PF03372.13; Description =EndonucleaseExonucleasephosphatase family
  Pfam module annotation: Pfam domain module=Exo_endo_phos::RVT_1; Domain location=223-416::659-888
MGTEMLYANKEKGGEILDVCGGCIKRQSRADMESGLDNDNYMQSINAQVNIGPCGPALDISNESHALHIGSTENSNLCGNLNKDIANDHTVGANGPLLLGLTTHTTENEHPSSPNTIKAEATTPVSRKVYSKSTWRKKQQACHQPNEQAKHSDKDQTKLGLVTNSILNTGSLTPMSAASTFIVGTSNTLQEAKHLWNMAKQMGPWNLETEKRQRSWEIEKCPMNILTYNVRGLGRGIKWTAIKRLVTKHKVDLLCLQEMKKQHIEIKLCQSMWGDTDVTWEILLATNTTGGLLCLWSEKSFNVERRLKDLNRRGLWCLLGDFNSVRNASERVGVSQRGGGGGDPLINEFNDWLDDVEVLEPPCIGSKYTWYRPNGTARSKLDRVFISSDWLSKWPASTQHILDKNFSDHCPMLVKSKNADWGPKSFRLLDCWLKDKSFGKVVKDSWTQTQQTGWSGYVLKEKIKCLKERIKLWNKEQNGDTFKKFQNIEAELNKLENDIAKRQMTPQESLNRKRLQQDLWRAALSHKSLMRQKARSRWIKEGDCNSRNWSVNGSWVEEPNRVKEEVHRFFQQRFQEPLQTRPTLNGISFNSIGHQPNQLLVGTFSEEETKSAVWEYGSEKSPGPDGLNFKFIKQFWQTLKPVILRFLGEFHAHGTFPRGGNASFIALIPKVTDPQCLNNFRPISLKGSVYKIVAKVLANRLKRVMPTIIDERQSAFIAGRHLLHSVVIANEVVEEARWGKKPCLIFKVDFERAYDSVLWDFLFYILRRLRFSDKWIQWMDGCLKSASVSVLVNGSPTSEFVPQRGLRQGDPLAPLLFNIAVEALTGLMREAIKKLSTEFLVGANKAAEYLNCRILSMPFTYLGIPIGTNPRHSELIPNKVAVKLVQIQRRFLWGGGPDQKKVAWIKWETICLPKEKGGLGIKEIRIFNKALLAKWRWNMLQQNSELWARILESKYGGWRALAEGKRANNESIWW

SEQ ID NO: 213028 - protein, 42 aa, Glycine max
  Coding DNA Sequence Number=SeqID_96250
MMGTMSYPRQMKIIKKNHAYSLPKDKEMIFHTPSQPLMEWQI

SEQ ID NO: 213029 - protein, 108 aa, Glycine max
  Coding DNA Sequence Number=SeqID_96251
MSPRARPTRFCLTVQTKKRGPDVPEAAPGERMPWKGRVSEHEADAGHRALEFLLQADGAVAALLVRVQLEPVIAGEHAEVLREAVIDDGVGAAQVALVVIKAAPARVE

SEQ ID NO: 213030 - protein, 131 aa, Glycine max
  Coding DNA Sequence Number=SeqID_96252
  Gene Ontology: Mol. function=dihydrolipoyl dehydrogenase activity; Cellular component=cytoplasm; Biological process=cell redox homeostasis
  Homolog annotation: Hit_ID=Q5H4Z4; Match level="QueryCoverage=90%, HitCoverage=18%, E-value=3e-44, Identity=77%"; Hit description =Dihydrolipoamide dehydrogenase
MPGLFIWNGAGALLLLRHVQIGDRAVVDFRGHCHRFAQCRVRMDGVADVFGFGTHLDGQADLGQQVTGMHANDRTTDDAVGLFVEDQLGEALGTADADRAATGGPRELGHAHLQALGLGFGLGHADPGDFR

SEQ ID NO: 213031 - protein, 67 aa, Glycine max
  Coding DNA Sequence Number=SeqID_96253
MEAKNAWVVAKIRLYLISTTTLFCRKQKWSLSPLQNPFQSKTPKTEIGEALNRKTETEHTLNKIPGH

SEQ ID NO: 213032 - protein, 90 aa, Glycine max
  Coding DNA Sequence Number=SeqID_96254
MGGGAWPFLVGGAICLVNSVNERDLSLLNSYVEEFLVSASHQLALTTSLPFVHTARRSYRLNGPVKVFGLRRRERFAARDVVRSPLNLII

SEQ ID NO: 213033 - protein, 109 aa, Glycine max
  Coding DNA Sequence Number=SeqID_96255
  Subcellular localization annotation: CTP_CleavageSite=79; ConfidenceScore=5.03e-01
MAMMSIRKIMKANAVTIAATSTVAKVNPMPPSGLNQMNHPTLDMVGKDLGSRGGPHDVQIQNEHAFPPYGLPLNYTPPNVAYTPNKNVNNSTPIPIESQQPQTDHAHVS

SEQ ID NO: 213034 - protein, 448 aa, Glycine max
  Coding DNA Sequence Number=SeqID_96256
  Gene Ontology: Mol. function=RNA-directed DNA polymerase activity; Cellular component=chromatin; Biological process=chromatin assembly or disassembly
MGDRIEALETQMGNVTTTLQELALQMSQHAQQMQQQSLVLTELSKQIGQKGATQEGEASVGDSSQNESRLAGKKVKLPLFEGEDPVAWITRAEIYFDVQNTPEEMRVKLSRLSMEGSTIHWFNLLMETEDDLSWEKLKKALIARYGGRRLENPFEELSMLRQTGSVEEFVEAFELLSSQVGRLPEEQYLGYFMSGLKAPIRRRVRTLNPTNRMQMMRIAKDVEEELREEDDDENRTSMKKNVGRSEYGPGSKFRTGSNLAQKEITRFSKSGWSNPSRKTVSIGSTSNTTSSLSSTGRKHEGDRRGGTNDRWRGISSEEMEERRAKGLCFKCGGKYYPTQHKCPERSLRVLILGDGESLNDDGEIVAMEGEESEEEEMTEAECKLIGVLGKMGESQTMKIEGKLEHVNVGVLIDSGASHSFISPELVTALGLKVTPTTVKRIKLGDGHK

SEQ ID NO: 213035 - protein, 45 aa, Glycine max
  Coding DNA Sequence Number=SeqID_96257
NADELVGIDEGPRPKVWRVYQRKNKKGIMGNVGNRKNDYVEGNIV

SEQ ID NO: 213036 - protein, 63 aa, Glycine max
  Coding DNA Sequence Number=SeqID_96258
MASVETSAMARSQILLNVYGTDAFYEYGSPGDCPLLRYNIRAAWCPMYAFKKATRTLHQFVTK

SEQ ID NO: 213037 - protein, 440 aa, Glycine max
  Coding DNA Sequence Number=SeqID_96259
  Gene Ontology: Mol. function=1-pyrroline-5-carboxylate dehydrogenase activity; Biological process=negative regulation of transcription
  Homolog annotation: Hit_ID=Q2KZJ2; Match level="QueryCoverage=95%, HitCoverage=33%, E-value=0.0, Identity=87%"; Hit description =Bifunctional PutA protein [includes: proline dehydrogenase; delta-1- pyrroline-5-carboxylate dehydrogenase]
MTAAARQVDDVVDDERRALLVGLDHEADAIPAFQLGREAQRLQQIQRDFQAVGFFGIDVQADVVAARQDGQRLHARQQLGHDAFALGARIARVQRRQLDGDAGAFIDAAAGGGLADGVDGLLVRSVIALGVLGRGGRFAQHVVRIAEAAAFHLAVVGQRLGNGLARHELLAHHAHGDVHALAHQRLAALADQARQRLGQRLLAAHGHQLAGDHQAPGGGVDEQRLRTAHVRFPVAARDLVADQRIARGAVGNAQQRLGQAHQRHALLAGQREFLDQSLDAAAAALAAQLLDQIAGHGMHFFQVRHASLAQQQRHALGLGPAIGRRDGRAQHRLRLHVLAELVERRRGGGLVLTAVFIASLVAAQVGHLGRQVATLDLVQVGENRLLVQPVRRAIEFLRGGLQAVAQRVIDLDAEGGAGHKRLLPVAWQRSHRARKGARHR

SEQ ID NO: 213038 - protein, 313 aa, Glycine max
  Coding DNA Sequence Number=SeqID_96260
  Gene Ontology: Mol. function=protein binding; Cellular component =integral to membrane; Biological process=protein amino acid phosphorylation
  Homolog annotation: Hit_ID=Q1SWI7; Match level="QueryCoverage=85%, HitCoverage=88%, E-value=3e-40, Identity=34%"; Hit description =Leucine-rich repeat
  Pfam annotation: Domain name=LRR_1; Domain location=104-126; Score =9.3; E_value=5.2; Accession=PF00560.23; Description=Leucine Rich Repeat
  Pfam annotation: Domain name=LRR_1; Domain location=128-150; Score =12.8; E_value=1.1; Accession=PF00560.23; Description=Leucine Rich Repeat
  Pfam annotation: Domain name=LRR_1; Domain location=152-174; Score =20.8; E_value=0.005; Accession=PF00560.23; Description=Leucine Rich Repeat
  Pfam annotation: Domain name=LRR_1; Domain location=176-198; Score =16.0; E_value=0.14; Accession=PF00560.23; Description=Leucine Rich Repeat
  Pfam annotation: Domain name=LRR_1; Domain location=200-222; Score =18.5; E_value=0.024; Accession=PF00560.23; Description=Leucine Rich Repeat
  Pfam annotation: Domain name=LRR_1; Domain location=229-251; Score =9.6; E_value=4.6; Accession=PF00560.23; Description=Leucine Rich Repeat
  Pfam annotation: Domain name=LRR_1; Domain location=253-276; Score =10.5; E_value=3; Accession=PF00560.23; Description=Leucine Rich Repeat
  Pfam annotation: Domain name=LRR_1; Domain location=278-301; Score =8.7; E_value=6.7; Accession=PF00560.23; Description=Leucine Rich Repeat
  Pfam annotation: Domain name=LRR_1; Domain location=29-51; Score=7.5; E_value=11; Accession=PF00560.23; Description=Leucine Rich Repeat
  Pfam annotation: Domain name=LRR_1; Domain location=3-24; Score=11.9; E_value=1.7; Accession=PF00560.23; Description=Leucine Rich Repeat
  Pfam annotation: Domain name=LRR_1; Domain location=53-78; Score=2.0; E_value=1.2e+02; Accession=PF00560.23; Description=Leucine Rich Repeat
  Pfam annotation: Domain name=LRR_1; Domain location=80-102; Score =12.5; E_value=1.3; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1; Domain location=104-126::128-150::152-174::176-198::200-222::229-251::253 -276::278-301::...
  Pfam module annotation: Domain location=29-51::3-24::53-78::80-102
MSKLEYLDLSYANLSKAFHWLHTLQSLPSLTHLSLSHCTLPHYNEPSLLNFSSLQTLHLSATSYSPAISFVPKWIFKLKKLVSLQLQGNEIHGPIPGGIRNLTLLQNLDLSFNSFSSSIPDCLYGFHRLKSLDLSSSNLHGTISDALGNLTSLVELDLSYNQLEGTIPTSLGNLTSLVGLYLSYNQLEGTIPTSLGNLTSLVELDLSRNQLEGTIPTFLGNLRNLWEIDLKYLYLSINKFSGNPFESLGSLSKLSTLLIDGNNFQGVVNEDDLANLTSLKEFDASGNNFTLKVGPNWIPNFQLTYLDVTSWHI

SEQ ID NO: 213039 - protein, 98 aa, Glycine max
  Coding DNA Sequence Number=SeqID_96261
  Gene Ontology: Mol. function=transition metal ion binding; Cellular component=cytoplasm; Biological process=fucose metabolic process
MGDHLEDMIRDLGQESFQEAHAPVYEGLQSDSKKPLYTRCKNSLTLLSVVLSLVNVKAKYGWSDQSFTSLLEVVHNLLPEDNTLPKTYYKAKKILCPM

SEQ ID NO: 213040 - protein, 100 aa, Glycine max
  Coding DNA Sequence Number=SeqID_96262
  Homolog annotation: Hit_ID=Q9FN34; Match level="QueryCoverage=45%, HitCoverage=12%, E-value=2e-08, Identity=56%"; Hit description =Ribosomal protein L11 methyltransferase-like protein
MQKPGAVVGLSGILSEQVQYIIERYSPFLEGIEVSKMDDWACRFGSSQPIPHCSLMPPSKFCVGQLLTCHLTMHFGMVNVVFGCNSFAKQKIRLKGQCRA

SEQ ID NO: 213041 - protein, 200 aa, Glycine max
  Coding DNA Sequence Number=SeqID_96263
  Homolog annotation: Hit_ID=Q1RYB0; Match level="QueryCoverage=67%, HitCoverage=36%, E-value=1e-25, Identity=49%"; Hit description =Ankyrin
MDEHDHCSTLVLCIAQLPGGAQIFFKSSFLGYFPTCSILVALLTKNALQLLLKTKVDLKAKNLENSTALDVVTSAEIRNALVKAGAKQGSSVTNAPTLADKLRWNITLMGKITIFVLRIRSDITEDQRQAFLIVAALIATATYQSALSPPGGVFQANAGNNNNNNVNITSLNSTTIATQGINVGTSVISEENEVSEDEGL

SEQ ID NO: 213042 - protein, 126 aa, Glycine max
  Coding DNA Sequence Number=SeqID_96264
MVIVARTCVNMVHLLHVWLLFKLAYVSRESLVMGDKKVGEKLQVEENDSKDKKVGEKLQVEENHNEGFDNIVLPKLLAEVKGFVRFDGKGAEAASGDVLVGLEVVAMEAEGGGVFVEVVARDFDVE

SEQ ID NO: 213043 - protein, 154 aa, Glycine max
  Coding DNA Sequence Number=SeqID_96265
  Homolog annotation: Hit_ID=Q6RC06; Match level="QueryCoverage=44%, HitCoverage=14%, E-value=3e-13, Identity=62%"; Hit description =Serine/threonine protein kinase
  Subcellular localization annotation: CTP_CleavageSite=14; ConfidenceScore=5.19e-01
MPHASCNSGYHHVRSSKPHSPPHTSLQLHIHSLHSPSCRMRVDRINGIRFIFSGGALGENLKGEFSNAANESFFATAVEVDGSDVADADVAEEVEVAEGEGDLVEEGGRADGGVGEVGGVVRLDGETLRRRRHDDDELRSRGVVTWQRFLWSIA

SEQ ID NO: 213044 - protein, 187 aa, Glycine max
  Coding DNA Sequence Number=SeqID_96266
  Gene Ontology: Mol. function=transition metal ion binding; Cellular component=cytoplasm; Biological process=protein amino acid phosphorylation
MERESQSKSIDVQMGDRLKEMIRDLDKNLFSKQMPLWCKKSLTLLSAVLSLVNVKARYGWNEKIFTSLLQVVHDMFLEENTLPKSFYQAKKILCPMGMQYQKIHVCPNDCILYRNEFEELHNCPKCGVLRYKVKDDDKCSSDESTKKGPPMKVLWYLSIILKRLFANADDAKDLTWYADGRNCNEML

SEQ ID NO: 213045 - protein, 69 aa, Glycine max
  Coding DNA Sequence Number=SeqID_96267
MEHGDDGIVEQTSQTHTVMQSYPARALNRRLQEDWARDAREGPRVLMSLRVRYPRSVGFFSPYILGHLD

SEQ ID NO: 213046 - protein, 96 aa, Glycine max
  Coding DNA Sequence Number=SeqID_96268
  Gene Ontology: Mol. function=nucleic acid binding
MEAIKRKNEKAWLYLDKWPCESWTKAYFDENCKVDRLPTMISRPEKEKLESNKWTANWVDDPDGTRFEVCHHETRIDVDLCSRLASAPDRTSSIKR

SEQ ID NO: 213047 - protein, 263 aa, Glycine max
  Coding DNA Sequence Number=SeqID_96269
  Gene Ontology: Mol. function=nucleic acid binding
MLIQRGGPVSDIGLVIEVHAMPINCSAENVVEAVAEECTHNDIEDMDVDVAKETEVVEIELEVVGVETEVNNDADDDEVKEHDGHAEFSNYFECDPDYVYVSLEDDGQSTAHWQIVTSLENFNPFPTMMMKRSEMDACKKGFKAGYRPFIGLNGCFLKGYYGGHLLAAVGQDANNVFFVIAYEIVNAKDKDNWKWFVTLLHEDIGDYKQYGWNFMLDIQKGLYRAMHEVMPSVKHGYCVMHLWRNFSKQWKDKKLRGLGWKCA

SEQ ID NO: 213048 - protein, 103 aa, Glycine max
  Coding DNA Sequence Number=SeqID_96270
  Subcellular localization annotation: CTP_CleavageSite=74; ConfidenceScore=5.32e-01
MTMQNMQFQQETRASIQSLTNQMGQLATQLNQQQSHNSNRLPSQSVQHPKNVSAIALRLGKQCQGPQPATSSSSANETAQLHSTPEKDDDKNLKSKLPNNFYA

SEQ ID NO: 213049 - protein, 116 aa, Glycine max
  Coding DNA Sequence Number=SeqID_96271
MREKREQEKENSEAPQRNRIKKTDTLEGKSDTHKRKSDTHERKFNCFAEEFKDVFPKEISHGLPPSRGIEHQVDLLMRILKLTKYRLKAQVEKGEGPSGEGQSPRVENDEGPSGEG

SEQ ID NO: 213050 - protein, 360 aa, Glycine max
  Coding DNA Sequence Number=SeqID_96272
  Gene Ontology: Mol. function=transition metal ion binding; Cellular component=cytoplasm; Biological process=proteolysis
  Pfam annotation: Domain name=Transposase_21; Domain location=132-245; Score=-58.3; E_value=1.2e-09; Accession=PF02992.5; Description =Transposase family tnp2
MQRGSQTESVDVEMGDQLEDMIQDLGQKFFQQSHAPMYDTLESDSEKPLYSRCKKSLTLFSAVLSMVSVKAKYGWSDKSFTSLLQVLHDMLPEENMLPKSYYEAKNILYPMGMEYQKIHACPNDCILYRHEFEEMQKCPSMPPWLCMKRKYMMLSMMISGPRQPRNDINVYLSPLVEDLTKLWDEGFTVFDGYRNETFKSILFDLPYWSDLDVRHCIDVIHVEKNMCDSVIGTLLNIQGKTNDAKQECYVEDPCDERWSVVLHGKTIGLNLEDDDSTLDTCLTPFSTQMPNVKGEEEVDDIHANPPSSSSLKKTRKATWLRSLAARPVRMERPVVHVDPATRKVDCPHKKQLRTYLGIVA

SEQ ID NO: 213051 - protein, 592 aa, Glycine max
  Coding DNA Sequence Number=SeqID_96273
  Gene Ontology: Mol. function=protein serine/threonine kinase activity; Cellular component=cytoplasm; Biological process=protein amino acid phosphorylation
  Homolog annotation: Hit_ID=Q9LDN6; Match level="QueryCoverage=98%, HitCoverage=85%, E-value=1e-164, Identity=54%"; Hit description=MAP kinase
  Pfam annotation: Domain name=Pkinase; Domain location=1-148; Score =42.3; E_value=4.4e-11; Accession=PF00069.15; Description=Protein kinase domain
  Pfam annotation: Domain name=Pkinase_Tyr; Domain location=2-148; Score=-69.2; E_value=3.2e-08; Accession=PF07714.7; Description =Protein tyrosine kinase
  Pfam module annotation: Pfam domain module=Pkinase::Pkinase_Tyr; Domain location=1-148::2-148
MVLLQLQSGPPLDEMSIACILRDLLHAIDYLHNEGKIHRDIKAANILLTDNGDVKVADFGVSAQLTRTISRRKTFVGTPFWMAPEVIQNSEGYNVKADIWSLGITAIEMAKGEPPLADLHPMRVLFIIPRENPPQRPSAKELLRHRFIRNARKSPKLLERIRERPKYQIKEDQMTPRNAPRGMGEASDTIKVAKDLRGDETNQPSKFSDGQFLNCSGQGKSLRSSGWDFSIGGSQGTGTFRSVSRPPQFRDKKIELSNHQLNQRKSPESGYQVGSDNKSAHNESLETYFGKDLGVAYHDEHPDNHLEDDEFSGNGSGTVVIRSPKGPQPSLFRDQSSRSSSSYASFEDVSTSGTVVLRSQYNDSDSPQTPRSRLGLNSRNSNASLEDSATNLAEAKVAIQGGLRKVNIRERFALGKLNNDVQDSRRGQISSSSDSSRPSREYFDAQKGFSRSHYAIDDEESAKIISSSAPLSVLLIPSLKEAIADDPDGSIVQIVIDALVNMESTKPQSCDVLVKKLLQQLASSKESSLKDLQELAGQIFSKTKSAEENRNAESDNKKKQNKEVHSNSNLSPLARFLLSRWQGQTSRDLNPA

SEQ ID NO: 213052 - protein, 837 aa, Glycine max
  Coding DNA Sequence Number=SeqID_96274
  Gene Ontology: Mol. function=RNA-directed DNA polymerase activity; Cellular component=chromatin; Biological process=chromatin assembly or disassembly
  Pfam annotation: Domain name=Chromo; Domain location=729-783; Score =38.6; E_value=2.1e-08; Accession=PF00385.14; Description='chromo' (CHRromatin Organisation MOdifier
  Pfam annotation: Domain name=RnaseH; Domain location=171-290; Score= -14.7; E_value=0.0013; Accession=PF00075.14; Description=RNase H
  Pfam annotation: Domain name=rve; Domain location=426-582; Score =121.2; E_value=3e-33; Accession=PF00665.16; Description=Integrase core domain
  Pfam annotation: Domain name=zf-H2C2; Domain location=367-408; Score =15.5; E_value=0.0032; Accession=PF09337.1; Description=His(2)-Cys(2) zinc finger
  Pfam module annotation: Pfam domain module=Chromo::RnaseH::rve::zf -H2C2; Domain location=729-783::171-290::426-582::367-408
MPFGLMNAPATFQATMNDIFRPFLRQFVLVFFDDILVYSKNEQDHLNHVKLVLEVLVKHCFVANKKKCSFGCSQVDYLGHIISAAGVSVDPSKVKCIMEWPEPKTVKGVRGFLGLTGYYRKFVKDYGKIARPLTDLTKKDNFLWNESAREAFQKLKTVMTTSPVLALPNFDVAFEVECDAAGRGIGAVLMQNRQPIAYFSKALSENNLAKSVYEKELMALVLSIQHWRHYLLGKEFVVYTDHKSLKHFLQQKISSPDQQCWLAKLLGYQFEVKYKPGLENKAADALSRCYDDCELAVMAYSPVWIGRQQLLKDVENDVSVQELLKKVVENPDKYPGFVIHQGVLLYQDRLVIGKNSSMIPQLLKECHETPMGGHSGFLRTYKRVAENLYWIGMQKTVRDYVRACDVCQRQKYATTTPGGLLQPLPIPNAIWEDLSIDFITGLPKSRGYEAILVVVDRLSKYSHFILLKHPYTAKTIAEIFVKEVIRLHGIPMSIVSDRDPLFISHFWREIFKLQGTSLKMSSSYHPETDGQTEVINRCLESYLRCFVAEQPKTWSYWVSWAEYWYNTTYHESIGKTPFEVVYGRQPPKLIRFLSNETKVAAVALELQERDEALSQLKAHLLRAQQQMKTYADKKRRDVEFEVGEWVFLKLRPHRQQSVVKRINQKLAARFYGPFKIIKKIGAVAYKLQLPDQSKIHPIFHVSLLKKAVGEYHVQNELPKDLEVIMDEEIYPVRVLGTRIIMKNGSSVPQSLIQWKDKSIDDVTWEDDVVIRGQFPKFNLEDKVLIEEGGIDRNADELVGIDEGPRPKVWRVYQRKNKKGIMGNVGNRKNDYVEGNIV

SEQ ID NO: 213053 - protein, 58 aa, Glycine max
  Coding DNA Sequence Number=SeqID_96275
  Subcellular localization annotation: CTP_CleavageSite=25; ConfidenceScore=5.30e-01
MARVVRSPKGLRDAKSPSWSKDSVSESEQSKKRSSSSPRPSKDGNSIKSKSKSSRVLR

SEQ ID NO: 213054 - protein, 122 aa, Glycine max
  Coding DNA Sequence Number=SeqID_96276
MESSSASVFVVNKQLFWGFDDDCNDVVVIMFFVVVIVHLASIVKPLILMYDEMSLILHHNGKFIQNENGALEYIGSEFCVWEEVETNLVNVWTPQELCKACRNYVNFVSVCYLVSGIGLQRL

SEQ ID NO: 213055 - protein, 249 aa, Glycine max
  Coding DNA Sequence Number=SeqID_96277
  Homolog annotation: Hit_ID=Q5Z5A8; Match level="QueryCoverage=26%, HitCoverage=15%, E-value=2e-11, Identity=60%"; Hit description =Photosystem II stability/assembly factor HCF136, chloroplast precursor
MAGVCFWILAPLRYATVYGCSEATIVLGVPKKTWTTKNPKAIPFVCLHMRREGYQTKVCIKVIGEKSAKMVTDEGAIYVIANRGYNWRAIVQETVSATLNSMKVLPGKVGKDPVYGILSLINTQVLQGKVEKDQVYEILSLINTQEPNQPMVFKQKKMSVEQIICSRKTMQNEHFSVFVNWYVYKVHVTNSKVVHRFIPDYALSVACININGWEMMIALGFMAATSSKFAVLEWQMNLEEETHKLQSSL

SEQ ID NO: 213056 - protein, 95 aa, Glycine max
  Coding DNA Sequence Number=SeqID_96278
MQDQTMRRESHPQTRRAQEKFGSLLVVSTTSSREAWKPRVPRAMTHEVHDKLERSRESSCCDAFALVALPKAWVKWWLDRNIEMAITEATELQMR

SEQ ID NO: 213057 - protein, 74 aa, Glycine max
  Coding DNA Sequence Number=SeqID_96279
MVHFHVGLEESPFGKRRKYRLIRASLVDLDRSFGTYFCDYTKYILVMVAHDADAPRRLYAMSTHHGFRKMHLPR

SEQ ID NO: 213058 - protein, 114 aa, Glycine max
  Coding DNA Sequence Number=SeqID_96280
MTSEATCEIVDRIMQPQGSVLPPEPKVGPSVSRVSTKGSCVDPSGDKQGVEGSKKPVDRPEPDDDPLGQMTLTISGLFLMPMQVSWDSTVFGDSMIFKEVNPRLLLNGFQLKFG

SEQ ID NO: 213059 - protein, 199 aa, Glycine max
  Coding DNA Sequence Number=SeqID_96281
  Homolog annotation: Hit_ID=Q2PMM5; Match level="QueryCoverage=94%, HitCoverage=8%, E-value=1e-107, Identity=100%"; Hit description =Protein ycf2
MVERKNPYLTRLLTIPMNSIGPKNDTLEESSESSNINRLIVPLLYLPKGKKISESYFLDPKESTRVLPITKKYIMPESNWGSRWWRNWIGKKSDSSCKISNETIAGIEISFKEKDIKYLEFLFVYYMDDPIRKDHDWEFFDRLSPRKRRNIINLNSGQLFEILVKDWIYYLMFAFREKIPKEVEGFFKTTRDWVNYSIK

SEQ ID NO: 213060 - protein, 205 aa, Glycine max
  Coding DNA Sequence Number=SeqID_96282
  Homolog annotation: Hit_ID=Q2PEP9; Match level="QueryCoverage=35%, HitCoverage=24%, E-value=7e-13, Identity=67%"; Hit description =Putative RuvB DNA helicase-like protein
MALDDSHKHKHTQSRPMATSDNHNFNEHGGGGGGSGSNNDRRGLLTPTQSFGHKTLAHSLRDQIWCISCLQNARHIKHLIFDISREKILSLGDHGEGGFELEGLGLANAGLAGQEDCAVGDFVVLDHLEDHASGLYATPERISGQGREYGNACPRALCGSDRNSQSFSSAIVETTKMVGGRKRVLRVWYLESENMYSHFRVRGSG

SEQ ID NO: 213061 - protein, 367 aa, Glycine max
  Coding DNA Sequence Number=SeqID_96283
  Gene Ontology: Mol. function=protein binding; Cellular component =actin cytoskeleton; Biological process=signal transduction
  Homolog annotation: Hit_ID=Q1RVU7; Match level="QueryCoverage=92%, HitCoverage=77%, E-value=1e-94, Identity=54%"; Hit description=IMP dehydrogenase/GMP reductase
  Pfam annotation: Domain name=Ank; Domain location=131-163; Score =16.0; E_value=0.14; Accession=PF00023.20; Description=Ankyrin repeat
  Pfam annotation: Domain name=Ank; Domain location=177-209; Score =22.7; E_value=0.0013; Accession=PF00023.20; Description=Ankyrin repeat
  Pfam annotation: Domain name=Ank; Domain location=29-61; Score=6.5; E_ value=3.6; Accession=PF00023.20; Description=Ankyrin repeat
  Pfam annotation: Domain name=Ank; Domain location=63-96; Score=19.5; E_value=0.012; Accession=PF00023.20; Description=Ankyrin repeat
  Pfam annotation: Domain name=Ank; Domain location=97-127; Score=14.5; E_value=0.25; Accession=PF00023.20; Description=Ankyrin repeat
  Pfam module annotation: Pfam domain module=Ank::Ank::Ank::Ank::Ank; Domain location=131-163::177-209::29-61::63-96::97-127
AAQEGDINLLYTVIEEDPQVLEHNDLISFVETPLHIASSCGNIGFATEIMRLKPSLAWKLNQQGFTPIHLAMQHSHKRMVHRLVDINKELVRAKGREGLTPLHFASQIGEIDLLANFLLACPDSIEDVTIRGETALHIAVRYRQYEALQLLVGWLKGTCQKNAMQIEKTILNWKDEEGNTILHVSALMNDSKVLQLLLKTKVDLKVKNLENSTALDVAASAEIKNALVRAGAKHGSSVTNAPTLADKLRWNITLMGKIIIFVLRIRRDITEDQRQAFLVVAALIATATYQSALSPPGGVFQANAGNNDNNNVNITSPNSTTIATQGINAGTSVISEGWTFSVVCKRLKIHEKMRDIGTRNSTGRNIW

SEQ ID NO: 213062 - protein, 85 aa, Glycine max
  Coding DNA Sequence Number=SeqID_96284
MQHVIFSTIITSASVSRREEGVKKGPHWSRWCYWRDAQSAPVSLVLLAGCPIMLLVLAAPSHVSTILARASGDINGVADAAGGIK

SEQ ID NO: 213063 - protein, 84 aa, Glycine max
  Coding DNA Sequence Number=SeqID_96285
  Gene Ontology: Mol. function=nucleic acid binding
MYEKAWLEKKKVIENIYNNWEILYHDLSRLLQAMQHFHPGMVVEKETLSMPPQGGKYKGTLPVAVAQDDTNKILPIAFSIFKSE

SEQ ID NO: 213064 - protein, 152 aa, Glycine max
  Coding DNA Sequence Number=SeqID_96286
  Gene Ontology: Mol. function=nucleic acid binding; Biological process= DNA integration
MEEELHQFTINDVWTHVPNLENKSIFGTRCIFRNKLDEQATNKSLCKDFSNMMKSEFEMSMMGELKFFLGLPVKQDSKGIHIHKQKYTKELRKTFKMKDYVEDGVEQKSASGGCHYVVPSMISWANKKQNSIALSTTKAEYVSTASYCSQLL

SEQ ID NO: 213065 - protein, 109 aa, Glycine max
  Coding DNA Sequence Number=SeqID_96287
MAEDIEVFEIEYHTLSEAAARLASKRNLEGNLSHQHTLNVSLARSARSLSLLVLSALGSLSQSSLSRTKCENGAKCVFEVPRGGGDIPTTVYLSIALKSLFLLVKGASL

SEQ ID NO: 213066 - protein, 92 aa, Glycine max
  Coding DNA Sequence Number=SeqID_96288
  Homolog annotation: Hit_ID=Q1T309; Match level="QueryCoverage=45%, HitCoverage=9%, E-value=2e-11, Identity=78%"; Hit description=U2 snRNP auxilliary factor, large subunit, splicing factor
  Subcellular localization annotation: CTP_CleavageSite=18; ConfidenceScore=5.02e-01
MQVYPLVVRRPIDYNPSLAATLGPRQPNPNLNQGVVSLTPGLATGLHASLISQTRAVSSDELKNDEEYDEILDDMRQECSKFGNAFKDGYYE

SEQ ID NO: 213067 - protein, 66 aa, Glycine max
  Coding DNA Sequence Number=SeqID_96289
MEKMDVHIITRGTPKASPSTSLGHLFIGKWALGAKVARPSELKLSVEAISLPRRAGARPCELVSSP

SEQ ID NO: 213068 - protein, 101 aa, Glycine max
  Coding DNA Sequence Number=SeqID_96290
MGPKSTLRLMRTLGPYLASLVQSSWSLLSNALRGGNLMLEPLVDAIKIIEEMCSNLYNNLGDMRVMKKGVNQVEKDDFLTKLGKHMQALTLNIEILMRAQA

SEQ ID NO: 213069 - protein, 77 aa, Glycine max
  Coding DNA Sequence Number=SeqID_96291
MLSGSVPHMELSDKESFTSDKLLPQLENVVQVLMQKTMPKCMKRSSSHTRLFHIRSTTSTAMAYFGERNCSDSRRFK

SEQ ID NO: 213070 - protein, 91 aa, Glycine max
  Coding DNA Sequence Number=SeqID_96292
  Subcellular localization annotation: CTP_CleavageSite=45; ConfidenceScore=5.20e-01
MSSSNLWCFVCLFTTKTTPPPLLTQPYSISLTPSLLHSVPIKMHSATHAEAERLLSMQSHIRDLGLDSSLELHTVSEDMVGQITISPAPLI

SEQ ID NO: 213071 - protein, 192 aa, Glycine max
  Coding DNA Sequence Number=SeqID_96293
MEDSIGKITKITFPSQEGPLLTVKNTLENGGSNREITKITFPSQEGPLLTVKNTYQNGRPRGGARYQLLFPLMRVNFELGVIMVIAVTFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 213072 - protein, 60 aa, Glycine max
  Coding DNA Sequence Number=SeqID_96294
MAITEATGAPNEVIPKREVDFLELWFERTRVKMKGRKESLFPARATHKGCESPLIQPGCS

SEQ ID NO: 213073 - protein, 97 aa, Glycine max
  Coding DNA Sequence Number=SeqID_96295
MKLHDLVPIGDAPRILLTVIALSEHRGGPCLHYLAKLLEPQHDARLMFGGGGDDFVVIGVVVVLGMVVHASNLGFKWGCDYGCCGFGGSGDDFVGDD

SEQ ID NO: 213074 - protein, 130 aa, Glycine max
  Coding DNA Sequence Number=SeqID_96296
  Gene Ontology: Mol. function=protein methyltransferase activity; Cellular component=cytoplasm; Biological process=protein amino acid methylation
  Homolog annotation: Hit_ID=Q9FN34; Match level="QueryCoverage=95%, HitCoverage=33%, E-value=5e-41, Identity=62%"; Hit description =Ribosomal protein L11 methyltransferase-like protein
  Pfam annotation: Domain name=PrmA; Domain location=2-129; Score= -88.4; E_value=3.6e-06; Accession=PF06325.4; Description=Ribosomal protein L11 methyltransferase (PrmA)
MICISSIFHEVEDINVSISHAADSIGLKEIPRYEVKIDDEEDWMKRSQESLHPVQVTEGLWVVPKWCTPPDVQATNIIVNPGLAFGTGEHATTKLCLLLLHGCIKGGEHILDYGTGTGILAIAALKVINC

SEQ ID NO: 213075 - protein, 210 aa, Glycine max
  Coding DNA Sequence Number=SeqID_96297
  Homolog annotation: Hit_ID=Q0KIN0; Match level="QueryCoverage=31%, HitCoverage=4%, E-value=2e-12, Identity=60%"; Hit description =Integrase core domain containing protein
MTAWNFLKQLTCTVGAHSPTLSRRLIHYSLLVPSLSAHHKIVRYQWLPHFRVNLYAAVPNAKFSTASSSQTLSDTSLAPRAPYTSVLIHCPKDTADVLAEALLCFGASSVSMDQDDVSQSTDEVIKKISSDCLVIEEYHITTDEEAITKGGPLVSGRALYSCKRPFLGASLIYFRMLITASQCLVHRELGNSLTILIAKEISGLSDSEII

SEQ ID NO: 213076 - protein, 129 aa, Glycine max
  Coding DNA Sequence Number=SeqID_96298
IAPARHPVDPEKFNRVLGFPALITGLCQFYRVPIAPNKVIRPPTNRAFIKKYCSPRQVQGETPQQPGDGRQRATDALPPPLEYLSSSTKRLEHCLRHMADQQVIMRPAQDVKEALLGGNLVPFKFLLVI

SEQ ID NO: 213077 - protein, 68 aa, Glycine max
  Coding DNA Sequence Number=SeqID_96299
MVLESILDPSLGHLHLAHSRLKVLGVREKNESHEDSTNGDFNLFSVSLTFGNSIRAVGGKTERILGNR

SEQ ID NO: 213078 - protein, 166 aa, Glycine max
  Coding DNA Sequence Number=SeqID_96300
  Gene Ontology: Mol. function=oxidoreductase activity, acting on single donors with incorporation of molecular oxygen, incorporation of two atoms of oxygen; Biological process=electron transport
  Homolog annotation: Hit_ID=Q5LKQ6; Match level="QueryCoverage=99%, HitCoverage=49%, E-value=3e-23, Identity=46%"; Hit description =Oxidoreductase, 2-nitropropane dioxygenase family
MPRPSMMPPEAITGIDTASATCGTSAMEGAAVPARLGALGHDGIHPVLFQGHGLAHGGGGADRQDAQFAAARQGVGRHVSEGEAEDRGPQEQHHLDLAGQRIGLRPGRHGRRQAQLGVVARQQVQHANGIAIEGLLGHGGEQVDGEWPVGAFADGAGGRLDLFRAQ

SEQ ID NO: 213079 - protein, 256 aa, Glycine max
  Coding DNA Sequence Number=SeqID_96301
MGDSDRCGLYIEADPAHLVAMGRVYEGSTIVHNTPLLPGQVKVAVSPAKPPPKPDPEVDDPLYLMTLTIPELFLRPYQVRWDATVFGVVNPDFPLYIKHEDLSEIAHGGQCLSISVLQLWILHLTETCMRVGNSDIYGFLDPQSIQRSAQSQFESESYIKSWMQSSQRDVYLGAYLNGFHCSGHWQMVAILPKEHLVVWFCSLHNRPDNYLKGIINSTIKGLDDGPQPKSKASARWIVVKYFNDPRPLELERLKAL

SEQ ID NO: 213080 - protein, 42 aa, Glycine max
  Coding DNA Sequence Number=SeqID_96302
  Gene Ontology: Mol. function=sugar porter activity; Biological process=phosphoenolpyruvate-dependent sugar phosphotransferase system
  Homolog annotation: Hit_ID=P69811; Match level="QueryCoverage=96%, HitCoverage=10%, E-value=4e-14, Identity=92%"; Hit description =Multiphosphoryl transfer protein (MTP) (Phosphotransferase FPr protein) (Pseudo-HPr) ...
  Homolog annotation: Hit description=[Includes: Phosphocarrier protein HPr (Protein H); Fructose-specific phosphotransferase enzyme IIA component (EC 2.7.1.-) (PTS system fructose-specific EIIA component)]
MAFLHAQRDHLHQAAPVSRLTAAVEIGHGDIAVELLDHAHQR

SEQ ID NO: 213081 - protein, 154 aa, Glycine max
  Coding DNA Sequence Number=SeqID_96303
MNGAKRSAEAVGCKKESVGERSALEGRTRASSAGRSGSENVGLSNANVGENPMPRKPKGSSARVIRGRENASSQSSSTRRYSAEVIHAILPGKARTTFNKWVPVPETDTGLRKVVRPCMGADACPVPEVKEVGGPDDRGATTEAPVNVVPYYTS

SEQ ID NO: 213082 - protein, 83 aa, Glycine max
  Coding DNA Sequence Number=SeqID_96304
FAKRNLQWLSARKNPEEDELSSEGDILTTCVFAVFHLVLLFVVKEVFELWKAKSFVGSSLGNWSDSKVFDSTGLSCCAITRNR

SEQ ID NO: 213083 - protein, 222 aa, Glycine max
  Coding DNA Sequence Number=SeqID_96305
  Gene Ontology: Mol. function=zinc ion binding; Cellular component =endoplasmic reticulum; Biological process=protein palmitoylation
  Homolog annotation: Hit_ID=Q5N9N4; Match level="QueryCoverage=67%, HitCoverage=55%, E-value=3e-57, Identity=67%"; Hit description=Zinc finger DHHC domain containing protein 2-like
  Pfam annotation: Domain name=zf-DHHC; Domain location=65-120; Score =33.5; E_value=6.3e-08; Accession=PF01529.11; Description=DHHC zinc finger domain
MGTLRDGEQNPHPCPRISCGGFFIPIPVLAGNFSRPQGPEWDSPRGIPRVLEVTFFWVLKWICMLKLLVEICDIAKSVLTISLLVHIIVGFDHHCIWINNCVGHANYKVFFIFVLYAVIACIYSLVLLVGSLASDGVQDEEKNRRSSFRTVYVVSGLLLVPLSIALCVLLGWHIYLMLHNKTTIEYHEGVRALWLAEKGGSIYKHPYDLGPYENLTSVINLR

SEQ ID NO: 213084 - protein, 41 aa, Glycine max
  Coding DNA Sequence Number=SeqID_96306
MESKKEDRRSSDQINFWRGNHVQNKVMEQLWFGIRVKHLPV

SEQ ID NO: 213085 - protein, 216 aa, Glycine max
  Coding DNA Sequence Number=SeqID_96307
  Homolog annotation: Hit_ID=Q9FFN1; Match level="QueryCoverage=29%, HitCoverage=7%, E-value=2e-09, Identity=55%"; Hit description =Selenium-binding protein-like
MELEAEMEVVEEWRAGASGDAEEEMERVVMAVLGEEVDEGGVGDDIGGREGEEEAKGVGEEVEFEVSGDEGIGEMGVFFIAFEEHGVDGLGEVGVARAKGHVEGVEEGVGLRGKGGEREELKKAEFEGEGQEVGVEREKESTEASRARRSILVRLDIPVRILWEESEDELVGLMNISPKTSSNTSFILLNNEEERFTDDEENSMRQLEMQKHSTEY

SEQ ID NO: 213086 - protein, 72 aa, Glycine max
  Coding DNA Sequence Number=SeqID_96308
MERGNEERKKEERVVGKGANRKFGGANINLLGLIESWSIISFILGPYWAWTIIVALGPYWVWLIISLYLGIA

SEQ ID NO: 213087 - protein, 67 aa, Glycine max
  Coding DNA Sequence Number=SeqID_96309
  Homolog annotation: Hit_ID=Q10M68; Match level="QueryCoverage=63%, HitCoverage=11%, E-value=2e-08, Identity=62%"; Hit description =Serologically defined breast cancer antigen NY-BR-84, putative, expressed
MEHYHIRCRTELGVEEQEHENGGSECDDTAKELAVEEILIDFRVHVEVAELAYYAVHDYCVDPKPKI

SEQ ID NO: 213088 - protein, 60 aa, Glycine max
  Coding DNA Sequence Number=SeqID_96310
  Subcellular localization annotation: CTP_CleavageSite=28; ConfidenceScore=5.25e-01
MSNNILALRSHPHNKRLVATVATLQSVLATVIASSFPSPSSLLLAFLIALIMYPSFLAAA

SEQ ID NO: 213089 - protein, 140 aa, Glycine max
  Coding DNA Sequence Number=SeqID_96311
MELQRLNQNEETDKRKRSIALKASSSMQEEEQEQEQEQEEESDDEEDFSLFVKKFHKFVKNRRMKRQWEEISRRHTVPQMNHGQKRMRRKAMKKEDPRRRILLGMTMTHPMVQKRRSTFYPRTMRAMRTSLKKIKQKAKV

SEQ ID NO: 213090 - protein, 314 aa, Glycine max
  Coding DNA Sequence Number=SeqID_96312
  Gene Ontology: Mol. function=2-dehydropantoate 2-reductase activity; Biological process=pyrimidine base metabolic process
  Homolog annotation: Hit_ID=Q3FY45; Match level="QueryCoverage=93%, HitCoverage=95%, E-value=8e-55, Identity=40%"; Hit description =Ketopantoate reductase ApbA/PanE
  Pfam annotation: Domain name=ApbA; Domain location=3-151; Score =186.8; E_value=5.2e-53; Accession=PF02558.6; Description =Ketopantoate reductase PanEApbA
  Pfam annotation: Domain name=ApbA_C; Domain location=176-296; Score =77.6; E_value=3.9e-20; Accession=PF08546.1; Description=Ketopantoate reductase PanEApbA C termin
  Pfam annotation: Domain name=NAD_Gly3P_dh_N; Domain location=1-137; Score=-58.4; E_value=0.073; Accession=PF01210.13; Description=NAD -dependent glycerol-3-phosphate deh
  Pfam module annotation: Pfam domain module=ApbA::ApbA_C::NAD_Gly3P_dh_ N; Domain location=3-151::176-296::1-137
MRILIVGAGATGGYFGARLAQAGRDVTFLVRERRQQQLQQTGLVLQTPEGSTVLQPQLALASTLTGDYDLIILTVKSFALEQAMEDIAPAVGPQTLIMPILNGMRHIDALRARFGDKVIGGLCKIHATLGEHGEVMQLSPLHMLYYGALDGNNDARLARVDAALRDAQFDSVFADNIISELWEKWLLLSTLGAVCCLARGNTQHILRSAGGEALLQGIFAEVLAVITADGYQQRPAVTAKIYETLNNPDTAMTSSMYRDLTQGYDIEADQIIGDLLVRGARHAVATPLLNAVVAIHGDRYHAGTIGFTQSWGTA

SEQ ID NO: 213091 - protein, 36 aa, Glycine max
  Coding DNA Sequence Number=SeqID_96313
MVPAGFFRQQTKDASCPDPSPSNVIATSASPRTSMP

SEQ ID NO: 213092 - protein, 45 aa, Glycine max
  Coding DNA Sequence Number=SeqID_96314
MEVTKPRANTSLVQGSTNPRFTLDGPFPLLSSIFIGTQDGSISKS

SEQ ID NO: 213093 - protein, 156 aa, Glycine max
  Coding DNA Sequence Number=SeqID_96315
  Subcellular localization annotation: CTP_CleavageSite=55; ConfidenceScore=5.09e-01
MRSGHRARQLLHGFNKKFQPNIILAFLFQAQWIFASTFQLHVDLALFRAPSPLTSCPSTSQCSGPITADPSSFPVIPPAADPTLATLMATTTAMIISKLLSSQDSNLINSLDFRAWIFILRHDGQDVTCEYFFAAMRDANDEDVANFLLWFVFFAF

SEQ ID NO: 213094 - protein, 186 aa, Glycine max
  Coding DNA Sequence Number=SeqID_96316
  Gene Ontology: Mol. function=oxidoreductase activity, acting on the CH-CH group of donors; Biological process=electron transport
  Homolog annotation: Hit_ID=Q96329; Match level="QueryCoverage=41%, HitCoverage=17%, E-value=3e-25, Identity=66%"; Hit description=Acyl -coenzyme A oxidase 4, peroxisomal
  Pfam annotation: Domain name=Acyl-CoA_dh_M; Domain location=86-138; Score=37.6; E_value=4.2e-08; Accession=PF02770.9; Description=Acyl -CoA dehydrogenase, middle domain
  Pfam annotation: Domain name=NDUFA12; Domain location=138-186; Score=- 9.3; E_value=0.0018; Accession=PF05071.7; Description=NADH ubiquinone oxidoreductase subunit NDUFA
  Pfam module annotation: Pfam domain module=Acyl-CoA_dh_M::NDUFA12; Domain location=86-138::138-186
KRYHQLLKEPTFISVAVGLLDSTDKDIPLSTVYDSMRHCNLFQAAVRDVQEACVYERNFEEYSIVWAEARKQKYLPSLAQMKAIACWAFTKLDYGNDANALKTTTTKMGGGWILDGQKRWIGTNTFAGLLVIFTRNTTTNQINGHRWVEYAEKTRYNASQVPTEWHGWVQFITDHTGYEVSSSKPK

SEQ ID NO: 213095 - protein, 149 aa, Glycine max
  Coding DNA Sequence Number=SeqID_96317
  Homolog annotation: Hit_ID=Q2QTQ5; Match level="QueryCoverage=54%, HitCoverage=21%, E-value=1e-28, Identity=70%"; Hit description =Expressed protein
GTSDEVVDCSLGKQLWGLCKEKYEPLWLKGGNHCDLELFPEYIRHLKKFITTVEKSPSQRYSFRRSINQFKQPRKSTNIFKNDDNGNDVGVNSDDDIYIGSDNGSNVNSIHNDSGDGDRGGSDCVNGSDDVGGIGGGDNNVSRVGGNGG

SEQ ID NO: 213096 - protein, 266 aa, Glycine max
  Coding DNA Sequence Number=SeqID_96318
  Gene Ontology: Mol. function=catalytic activity; Cellular component =chloroplast; Biological process=metabolic process
  Homolog annotation: Hit_ID=Q5DQ95; Match level="QueryCoverage=99%, HitCoverage=66%, E-value=1e-116, Identity=77%"; Hit description=4 -amino-4-deoxychorismate lyase
  Pfam annotation: Domain name=Aminotran_4; Domain location=6-265; Score=34.0; E_value=4.8e-12; Accession=PF01063.9; Description =Aminotransferase class IV
MYSSIFGGITTDPAAMVIPMDDHMVHRGHGVFDTAAIMDGYLYELDQHLDRFLRSASMSKIDPPFDRGSIRRILIQTVSASKCRKGSLRYWLSAGPGDFQLSPSCCHRSSLYAIVIQDLSPSSPNFRGVKVVTSSIPIKHPKFAITKSVNYLPNVLSKVEAEEAGAFVGIWLDGEGFVAEGPNMNVAFVTKDKELIMPHFDKILSGCTAKRVLTLAESLLREGKLKGIRVKTVTVEEGKQADEMMLLGSGVLVCPVVQWDEQVIGD

SEQ ID NO: 213097 - protein, 161 aa, Glycine max
  Coding DNA Sequence Number=SeqID_96319
MHCSLHSFLEIRTVIIEIIRKERTLWCPYRTHARARVMSGIEEVQEQMKADMEAMMSMRKMMEVNMATIIAASTITEVDPTQPSSLNQVNPLVSHMVGQGGEVLGSTGSPHFVHVQNKHSFPPYGLPPNYTTPNVAHPPNKNVNKSTPILIESQQPQSGQA

SEQ ID NO: 213098 - protein, 62 aa, Glycine max
  Coding DNA Sequence Number=SeqID_96320
MVNNIFTLSRYKENMVQLKPSAGLKAKIPLRHFTEHLVGVLLGTNNKKMGAMWLAPSSQNTT

SEQ ID NO: 213099 - protein, 449 aa, Glycine max
  Coding DNA Sequence Number=SeqID_96321
  Gene Ontology: Mol. function=RNA-directed DNA polymerase activity; Cellular component=chromatin; Biological process=chromatin assembly or disassembly
  Pfam annotation: Domain name=rve; Domain location=228-372; Score=0.4; E_value=0.0055; Accession=PF00665.16; Description=Integrase core domain
  Pfam annotation: Domain name=zf-H2C2; Domain location=169-210; Score =6.4; E_value=0.051; Accession=PF09337.1; Description=His(2)-Cys(2) zinc finger
  Pfam module annotation: Pfam domain module=rve::zf-H2C2; Domain location=228-372::169-210
MVQAADLARLQEEKLLDAHSLIRARQPSTLVVPPHGPYPDEEDATLNEPTQLERPPGPLDTTNPTQAQITLHSLSGHLVPTSSPTRSLVPPYSSSTTLLVLAVPCLTFLDELKKHLIRDPQFIQLWRDISAQPADYLDYSIAQDLIMKGGRIWLPRGFQFIPTLLAEYHLTASSGHMDAAKTVAQLIENFTWQGLRKDVENFVKACVDCQHAKYETKRVVGLLCPLPVPHYPWEDLSLDFITGLPLFRGNTTILVVVDRFSKGIHLGMLPMSHSALTGVILFIDIVRKIHGMPRSLVSDRDPLFPSHFWQVLFRLSVSLRVRTQETSNMGEVPSLVFRRHFKIDAVDHLLCHRAETFTNFRKKLLKAQETMKLVADSKHRDVAFNVGDWVMPFHGALGGDPQLPLSDTAIDNQPLITLLTIDWDQLHADYHLEDKVFLQVAGNASNQGV

SEQ ID NO: 213100 - protein, 117 aa, Glycine max
  Coding DNA Sequence Number=SeqID_96322
  Gene Ontology: Mol. function=ATPase activity, coupled to transmembrane movement of ions, phosphorylative mechanism; Cellular component=integral to membrane; Biological process=phospholipid transport
  Homolog annotation: Hit_ID=Q9SX33; Match level="QueryCoverage=85%, HitCoverage=11%, E-value=2e-26, Identity=67%"; Hit description =Putative phospholipid-transporting ATPase 9
MSCLKNLQGMEGSLKKTLSSTLMNMLMLVLGPSYLRIGSLMKKSTNNGTEEFMEAKNLVPECIDKVAQAGIKLWVLTADKMETTINIGQAISGLRTQEQMVTMAQLNCWAWFLALYL

SEQ ID NO: 213101 - protein, 160 aa, Glycine max
  Coding DNA Sequence Number=SeqID_96323
MNNITHLSARLLHSSNFPFSSLTITDIRLVVLLNTVVIISWPNLKDEKSTTGKQGLGIKDRPKKVDGCYFQDSADNDSLEQPANDDIIKVEKIIEGKVKLKKLCKHILQQLKVLIDEHSSSILSDFSSRRKVVAYLKQKLRGSRKFCIEGKKVRFASKRS

SEQ ID NO: 213102 - protein, 86 aa, Glycine max
  Coding DNA Sequence Number=SeqID_96324
MSNEELKLQDPRCRIQCPDILPENTGVAVHCKLKVKCRSEVAGSTMSDTIFFQKKIDLLQHKPLQPRNANCYIIMEAARVLYQVRD

SEQ ID NO: 213103 - protein, 141 aa, Glycine max
  Coding DNA Sequence Number=SeqID_96325
MNAVENLEWITNEFFDLSKFFFKHFNSHSPSWRGPKWDYAIVQVPIPKVLLPAPPPSNYVPLGTGALDAMWEKAVERERKSVNFNSIAKRVVANTNNNNDENLEKKTSEFQKFLQVSAKERDRVQRIQVINRAIAAARQLL

SEQ ID NO: 213104 - protein, 129 aa, Glycine max
  Coding DNA Sequence Number=SeqID_96326
MDSQATLENALVWVYEEEERIYDFVQKTKIPSKERLIDVSDGSFYGGWIFKHQLGPSMVIFNHGIAVEDKGEEEKLHHQESALDKKLREEALMGEENEREGGVAWELKEHMKSFLRKLEEENFLEKLEG

SEQ ID NO: 213105 - protein, 107 aa, Glycine max
  Coding DNA Sequence Number=SeqID_96327
  Gene Ontology: Mol. function=oxidoreductase activity; Cellular component=mitochondrion; Biological process=chromatin silencing at silent mating-type cassette
  Homolog annotation: Hit_ID=Q9LSQ5; Match level="QueryCoverage=91%, HitCoverage=49%, E-value=2e-21, Identity=57%"; Hit description=1,4 -benzoquinone reductase-like; Trp repressor binding protein-like
LSGKPVAIITGTNSQGGGQETTVLTGITPLVHHGMIFVPFGIRFTYSHEFGNVKEVKGGSPYGTGTYVGRGANRLRVDACIRPWLLLWQHHKAAQGSYCIMLKGCTY

SEQ ID NO: 213106 - protein, 82 aa, Glycine max
  Coding DNA Sequence Number=SeqID_96328
  Subcellular localization annotation: CTP_CleavageSite=64; ConfidenceScore=5.32e-01
MARKPRRDFSVSKPKQKKIQTALPLPHVAFLSPSFSIEAPNKASTFGAHFCSKSRKDGIFGVVKCVATSGTSKFQGLGRYDG

SEQ ID NO: 213107 - protein, 69 aa, Glycine max
  Coding DNA Sequence Number=SeqID_96329
MATARWALKHPVYGIVILRLGVYTDRPHVSKLCSFISSMNSSIFILVHSGKYTLSISPLFPEDTFALYE

SEQ ID NO: 213108 - protein, 142 aa, Glycine max
  Coding DNA Sequence Number=SeqID_96330
MSFFVLVIVVSFGVLQTLNQSHYCSQKCFSSIIKLLHTATQVRDLLRRGINLVSEALLLRQPCVPVRGEERGGVWWKRMKKKAVAVMNEVRVWSRGGVKHEVVLGGGSDGVEEEECFNQPNDASSVPNTPLDARGSSGASNP

SEQ ID NO: 213109 - protein, 147 aa, Glycine max
  Coding DNA Sequence Number=SeqID_96331
  Gene Ontology: Mol. function=oxidoreductase activity; Cellular component=mitochondrion; Biological process=negative regulation of transcription
  Homolog annotation: Hit_ID=Q9XH74; Match level="QueryCoverage=99%, HitCoverage=62%, E-value=2e-54, Identity=73%"; Hit description =Hypothetical protein p78RF
  Pfam annotation: Domain name=Flavodoxin_1; Domain location=7-146; Score=24.4; E_value=0.00021; Accession=PF00258.15; Description =Flavodoxin
MAVQVYIVYYSMYGHVERLAEEIKKGADSVEGVEAKLWQASLFIAYLKNYIKGSELDYYVAEILPEEVLGKMGAPPKSDVPIITPNELSEADGFVFGFPTRFGMMAAQFKAFIDATGGLWKTQQLAGKPAGIFYSTSSQGGGQETTA

SEQ ID NO: 213110 - protein, 217 aa, Glycine max
  Coding DNA Sequence Number=SeqID_96332
  Gene Ontology: Mol. function=transferase activity, transferring glycosyl groups; Cellular component=cytoplasm; Biological process =nucleoside metabolic process
  Homolog annotation: Hit_ID=Q9FKS0; Match level="QueryCoverage=60%, HitCoverage=24%, E-value=7e-16, Identity=39%"; Hit description =Uridine kinase-like protein
  Subcellular localization annotation: CTP_CleavageSite=56; ConfidenceScore=5.03e-01
MMSEETTSIDYVMEASSRSHFSALRLDGQVPSSATAASSTLDSTLTLNSLPNQPFVIGHYSSFFLLHTFLSFNVPIPKLKRQCDSKIKTTVGNMIIQQLHDHCVVLVNKDLFYHGLNPEELKRVHKYNFNHPGVDVILDCMGATYYQKNLDSLNFDGRLFIIGFQGKHTSAGDKEKMVPLAEVQAQTDQTQAKGVQGVQTTTNKRRMVRPAYLSDFI

SEQ ID NO: 213111 - protein, 285 aa, Glycine max
  Coding DNA Sequence Number=SeqID_96333
VYSDELHQVSQWVVSQEELQEIQQYGSTKHPRCSNKGGRTGVGEEDPKWWHSRPAIPRSARDERTSRVIVLERSDKEVVGTSPSTRRTTRWPERRPMRRKVFGAKLPDKEFKRIWAKWVKCGVWVQGWVNWVYIRQLGSLSSATRRKALEAQQCPLGYRLSQVKHNPRSRWKMGSSNVKGFTMGGKDGGGDGKRGESVMGRGGGGMIDCVANLRRQTRDEATQQEGNRNRGGVARDWCGVGHGGGRHRSKAIEKLVHFKGHRVHGIVKTSKGIIEAPEPPEEEEE

SEQ ID NO: 213112 - protein, 55 aa, Glycine max
  Coding DNA Sequence Number=SeqID_96334
MGVKYLGAVKRRLHATKQWSPDEIRCPMLGHMERLAQEVKKGAYSIEGVVSQLWQ

SEQ ID NO: 213113 - protein, 83 aa, Glycine max
  Coding DNA Sequence Number=SeqID_96335
MYYRYMGSLTAPPCTEDIIWTIDNKPHLCCTQSTSSHESPVTDIVTSLLLSPNRHAHANWFALQFASVVSSPTNVHTPIANSP

SEQ ID NO: 213114 - protein, 119 aa, Glycine max
  Coding DNA Sequence Number=SeqID_96336
  Gene Ontology: Mol. function=ER retention sequence binding; Cellular component=endoplasmic reticulum; Biological process=protein retention in ER
  Homolog annotation: Hit_ID=Q1SSF8; Match level="QueryCoverage=75%, HitCoverage=20%, E-value=2e-19, Identity=53%"; Hit description=ER lumen protein retaining receptor
  Pfam annotation: Domain name=ER_lumen_recept; Domain location=1-110; Score=-96.3; E_value=3.6e-06; Accession=PF00810.9; Description=ER lumen protein retaining receptor
MDIILAKINCNDYHFLFVVPSAILAILIHPFMTHWRLVRIVWAFSLYLEAVSVLPQLRFMQNAKMVETFTGYYVFALGVSRFVALAYLLIQLYFFEDRGHRGAALCVLSKYKASPLLRK

SEQ ID NO: 213115 - protein, 363 aa, Glycine max
  Coding DNA Sequence Number=SeqID_96337
  Gene Ontology: Mol. function=DNA binding; Cellular component =membrane; Biological process=DNA integration
VRCLSQHIGGYILCGTSRGYIYLGLTENKRGYISCGSILVEGTSTRFKENKGGYIPCGSLLVKGFLQGHSIQQNGYMLARDRIGREIKPPDRYGYADLIAIALIVASEVLEDEPTSVKVALASKEKDKWQFAMEEGMKKEGLKGVELDNFKARLVARGSTQKEAIEFNEVFSPVVKHRSIKLLLAMVIEFDLELEQIGVKRIFLFGEIDETILMRQPGDLKSEAMRIMFASFKETYLKKVLERIRMSNLKPVVISTSQQFKLSVSQSPKKIEELTYMESIPYANIAGSIMYAMASKWILRYIKGSLGRVLVYGGAKDKKGTTTIEGFVDSDYAWGLDTRKSLNVEYMVVTEAVKEALWLEGIA

SEQ ID NO: 213116 - protein, 79 aa, Glycine max
  Coding DNA Sequence Number=SeqID_96338
MAKSNTDQIQKDEFEGLTFKVELKDKADEVQGRKCVEAKLHGESKMMTKVMTKSLKINQEQFKKFKIRIKKNSRLKKKV

SEQ ID NO: 213117 - protein, 102 aa, Glycine max
  Coding DNA Sequence Number=SeqID_96339
  Gene Ontology: Mol. function=nucleic acid binding
  Homolog annotation: Hit_ID=Q1S3Z1; Match level="QueryCoverage=81%, HitCoverage=6%, E-value=4e-10, Identity=39%"; Hit description =Integrase, catalytic region; Zinc finger, CCHC-type
MGSTKYEALEGEVKLEKDKKAMLEKPHNAIILSLGDKVLIQVFKEKTIVGVWAKFDRLYMTKSLPYPCICKEAVSGFEPMTNKSPRHNFTAAPGLALTKMNE

SEQ ID NO: 213118 - protein, 152 aa, Glycine max
  Coding DNA Sequence Number=SeqID_96340
  Gene Ontology: Mol. function=nucleic acid binding; Biological process= DNA integration
  Homolog annotation: Hit_ID=Q1RXN8; Match level="QueryCoverage=98%, HitCoverage=11%, E-value=3e-30, Identity=43%"; Hit description =Peptidase S8 and S53, subtilisin, kexin, sedolisin; Integrase, catalytic region; Zinc finger, CCHC-type
MTPNKSWFEEFSDLAKGSMLLGNNKPGKIAGIGSIRFRLHDGVERLLPKVRYVLDLKRNLISLGEYYKKGYVFKGEKGMLEVAKGSMVMMRGIKKNGIYSLEGDILIGSTTVVSKKLVSKIEPWHMRLGHLSDRGLIDLGKQNLLCGDKVKN

SEQ ID NO: 213119 - protein, 109 aa, Glycine max
  Coding DNA Sequence Number=SeqID_96341
MLSGNDGSEFLPAIPKKEITIIHTKNEATIHIEHFFDIKYLEGISLNMNEPMLRYGIRGFYNHFQTIHPKLIGRFWRYVEFQNAYAIVSDVVGNKVTFSWRPLLKSLDD

SEQ ID NO: 213120 - protein, 386 aa, Glycine max
  Coding DNA Sequence Number=SeqID_96342
  Gene Ontology: Mol. function=transcription regulator activity; Cellular component=nucleus; Biological process=regulation of transcription
  Homolog annotation: Hit_ID=Q9LHQ8; Match level="QueryCoverage=98%, HitCoverage=72%, E-value=2e-35, Identity=34%"; Hit description =Arabidopsis thaliana genomic DNA, chromosome 3, BAC clone: F3H11
MSDDQFQASGNWWETARSVRFESRESQSSSGLTNNIGSYAASWQQHQQHDMATRSSSMDNNSVSGGSSVVFHDQKQLQVHDSSPAATSTNDPNFHMMALGLSSQAMDWSQASLPLRGEKGSENSFRSMLQENLSSSGTNFQQQECGSNSIGLSQHHHHHHQQVHWKPEKLFSAESSSNEFKRGFSLDQTQFSPQYSSGDSTVTSQGLPCSFQIDYVGNPSSILQGLLGQESNNNQQQPHQGGGAMNFPYSAASYGLNSNIELVPSWSKVPQFLRASPPKQPPNNQLHFTNNAPFWNANSEPAIKDSRSNFIPSLQPPFPTSNFDVQSKNISEVRDSSGVVKKSGSEAAPKRPRNETPSPLPAFKVRKEKMGDRITALQQLVSPFGK

SEQ ID NO: 213121 - protein, 111 aa, Glycine max
  Coding DNA Sequence Number=SeqID_96343
MGRAETLNPYMKCEAGQIIQIFMGWWRAGAWRGVALVPKPKEPAIAFNEFGIVDVSFDAPISSKECRLLTPPRQRPPPSPTNLAKFEHNRKMKAPMFDQNRFPVAFFARKK

SEQ ID NO: 213122 - protein, 108 aa, Glycine max
  Coding DNA Sequence Number=SeqID_96344
MEMVKCLVLIVAKWFEVGRQLSVCSFEPVDDSIEASGRSFCTKVASLERSAYLDARVDNLKMDLCCFGQRYQCKKKLDAHTAECRGLTSVVSSCPSHGTLITIARRAL

SEQ ID NO: 213123 - protein, 99 aa, Glycine max
  Coding DNA Sequence Number=SeqID_96345
  Pfam annotation: Domain name=zf-CCHC; Domain location=37-54; Score =20.5; E_value=0.00041; Accession=PF00098.13; Description=Zinc knuckle
MSLEELIGTLKNKSGSRWKISFKKVFKEKKDKEKRLIICHECKKLGHFKSECLKLEKSKEKYKDMKSLIGTWDLNDTTFDEEAKEEANLCSMADTTFEE

SEQ ID NO: 213124 - protein, 74 aa, Glycine max
  Coding DNA Sequence Number=SeqID_96346
MEKSEKKNHSEKKLKKAYITWDANDMESSEDSENEEINLCLMAKSYESDEEVTRRVWWHAETPDGNPHTLICYP

SEQ ID NO: 213125 - protein, 138 aa, Glycine max
  Coding DNA Sequence Number=SeqID_96347
MDQKTIVSKVLGKKVTMNMESIAQVIDRVREGSTYLGRPPMKSGMDDIYYEALVNKLLWEHGVYHVFNKIDEESKHQIIVKGSIIAKQQQFNKVNFKAMKLEIQLAQREVPQVDEEATRRKRQRRPCILFALQIVSTR

SEQ ID NO: 213126 - protein, 136 aa, Glycine max
  Coding DNA Sequence Number=SeqID_96348
MPLGVGLHQMSVWRIDQGRTHPGFWRDSPRVDLRFDEPLENRSETHPSLIFTRLTKDKPGGQTLGLRSLWRFDKGCARLGFGDVHVRCCCHPGYCWSDGDVIDSGKLKDKVVEVVGEMRDSRSGRKRKIEERKKGT

SEQ ID NO: 213127 - protein, 165 aa, Glycine max
  Coding DNA Sequence Number=SeqID_96349
MDNYYPVSRVITLIGATNTKSISLLPRSFPITQDEVFRHCRDLLKERNDLEGRVEHTAKEKEGLVAIVAESTKSHLKEPELEATKEKEANKELEEELLTFKKEVMEQHEKGFYKVIRQAGFFTKCFYLGLFDPFMDVKDGELLNEEEVVVAKEDIDEEQDDGVNV

SEQ ID NO: 213128 - protein, 152 aa, Glycine max
  Coding DNA Sequence Number=SeqID_96350
MGSSQKPSLKKRFYQVKIKSLEVTSLRKLGQLMGQLQRQAFRKAYGIRPPKASRKWGGRNTEKIFGAIDVFLAYHNHKESPVVAMLADLYDTFDRRCEESNARIVCYTPALYVGLVSHLFLQEGRPVYPSSLSIPSTSRGGPVPAFVPFSEG

SEQ ID NO: 213129 - protein, 118 aa, Glycine max
  Coding DNA Sequence Number=SeqID_96351
MANLDDAKVQKRLRLQLLECFGVLAIYGFNSSSYDIDIIKKYPPQVLKHSKIKLIDTVDLEGGPVGKPVVPAALMNRPTRGERRFAYWALAECILAYYVGTDEGVSEVLHVAGEKRLH

SEQ ID NO: 213130 - protein, 76 aa, Glycine max
  Coding DNA Sequence Number=SeqID_96352
MVVKLYEKIKTLKDNLGKEVMDSEEVIVFYFCGKVGHETHKCKDLPEKDNPSQGPSNAYQHPQANKEKEPKIFGYY

SEQ ID NO: 213131 - protein, 98 aa, Glycine max
  Coding DNA Sequence Number=SeqID_96353
  Gene Ontology: Mol. function=nucleic acid binding; Biological process= DNA integration
MAQSMGFESEKSSHLVCKLRRSIYGLKRASHQWYIQFHNMVSKYEFVEIVVDQCIYLKVSGNDILLASSDLGLLHDTKFFLSQNFDMQDMSEVPMSLA

SEQ ID NO: 213132 - protein, 176 aa, Glycine max
  Coding DNA Sequence Number=SeqID_96354
  Homolog annotation: Hit_ID=Q6T4Q2; Match level="QueryCoverage=48%, HitCoverage=91%, E-value=3e-41, Identity=96%"; Hit description =Putative senescence-associated protein
  Subcellular localization annotation: CTP_CleavageSite=52; ConfidenceScore=5.26e-01
MIGRADIEGSKSNVAMNAWLPQASYPCGNFSDTSSFKFRRTKGSISHAFTVCIRTGNQNQTSFYPFVPHEISVLVELILGHLRYLLTDVPPPPNSPPDNVFRPDRPAEADLGSKKRGSAPLPIHGITPTYPTPLKSFHKVGLESSSSGSSFPADSAKPVPLAVVSLDSRQGQWESR

SEQ ID NO: 213133 - protein, 75 aa, Glycine max
  Coding DNA Sequence Number=SeqID_96355
  Homolog annotation: Hit_ID=UPI00006A2901; Match level="QueryCoverage =39%, HitCoverage=19%, E-value=2e-09, Identity=96%"; Hit description =UPI00006A2901 related cluster
  Subcellular localization annotation: CTP_CleavageSite=14; ConfidenceScore=5.18e-01
VPVPNPSAVGWTARAASAARASRRMPVGDGLGRALRGLFPGVDMLLNVKVKKFNQARVNGGSNYDSLKVAKCLVI

SEQ ID NO: 213134 - protein, 46 aa, Glycine max
  Coding DNA Sequence Number=SeqID_96356
MSMCQRGFVFGGNSSMELASWTRGSNWWNSRVEMARHGPRGGSRHS

SEQ ID NO: 213135 - protein, 212 aa, Glycine max
  Coding DNA Sequence Number=SeqID_96357
  Homolog annotation: Hit_ID=Q1T0V8; Match level="QueryCoverage=99%, HitCoverage=100%, E-value=7e-55, Identity=53%"; Hit description=Heat shock protein Hsp20
MEISKHTNRSYEDFDPLFMWRREEGRDTLELHLPGMLHSMYLKLYIEGLSFRRDQIRIQINHVGLLVISGERHFEGNRWKRFKKEFEIPSYCNDDAIHGNMMQSILSVVMPKKSPQISQEEQEHKKERRANKKEDTEEASTKEGIAEEDIGHAEEYHQFEENYNYVRQLPQETTREVALKFMLVMVLILVIASYLADVSKSLMAQGASYFHN

SEQ ID NO: 213136 - protein, 70 aa, Glycine max
  Coding DNA Sequence Number=SeqID_96358
MRSRRGTGIRWRTLPHPTTMTQDMTQVLRASKHLCQVMDNDDYSPDWQMQFYVPPMPAPDRCSASSDSVS

SEQ ID NO: 213137 - protein, 155 aa, Glycine max
  Coding DNA Sequence Number=SeqID_96359
  Gene Ontology: Mol. function=electron carrier activity; Cellular component=membrane; Biological process=electron transport
  Homolog annotation: Hit_ID=Q1SR60; Match level="QueryCoverage=96%, HitCoverage=97%, E-value=2e-43, Identity=58%"; Hit description=Blue (Type 1) copper domain
  Pfam annotation: Domain name=Cu_bind_like; Domain location=34-115; Score=108.2; E_value=2.4e-29; Accession=PF02298.8; Description =Plastocyanin-like domain
MASAARLAFFAVSMVLLSSVAMATDFTVGDGTGWTVDFNYTAWAEGKVFRVGDTLWFNYENTKHNVVKVNGTQFQECSFTSNNEVLSSGKDSITLKAEGKKWYVCGVANHCAARQMKLVINVETAAPAPAPTSSAHSLLSSVFGVLIVAIAPIFA

SEQ ID NO: 213138 - protein, 124 aa, Glycine max
  Coding DNA Sequence Number=SeqID_96360
  Gene Ontology: Mol. function=zinc ion binding
  Homolog annotation: Hit_ID=Q1S5F3; Match level="QueryCoverage=53%, HitCoverage=33%, E-value=7e-11, Identity=50%"; Hit description=Zinc finger, C3HC4 type (RING finger), putative
  Pfam annotation: Domain name=zf-C3HC4; Domain location=6-51; Score =25.2; E_value=0.00023; Accession=PF00097.15; Description=Zinc finger, C3HC4 type (RING finger)
MAKKNCRICQESGSATLIELECSCKHDLAFARKHCAEKWFSTRPDKICEICRSIARNVALQGAAETTTTLSERRNAPNNHVSEMQLPEWRNVVINGEHDGFQLRHGRIMCQYIYGENVVSTAHI

SEQ ID NO: 213139 - protein, 349 aa, Glycine max
  Coding DNA Sequence Number=SeqID_96361
  Gene Ontology: Mol. function=protein binding; Cellular component =membrane; Biological process=meiosis
  Homolog annotation: Hit_ID=Q10SJ9; Match level="QueryCoverage=94%, HitCoverage=95%, E-value=1e-109, Identity=58%"; Hit description=LEM3 family/CDC50 family protein, expressed
  Pfam annotation: Domain name=CDC50; Domain location=63-337; Score =381.3; E_value=1.5e-111; Accession=PF03381.6; Description=LEM3 (ligand-effect modulator 3) family  CDC50 family
MSVENSSTSVSVAEGQSKNAMKPKYSRFSQQELHAWQPILTPSWAISIFTVIGLIFIPVGLASLFASESVVEVPFRYDDECLPPDHKNDAVAYIKDVGSNKTCTKKLTVKNKMKAPVYVYYQLDNFYQNHRRYVKSRDDKQLRSKAAENDVGSCSPEDYTPNDMGHKPIVPCGLIAWSLFNDTYKLTSNNKDLVINKKNIAWKSDQNGKFGSDVYPKNFQAGGLIGGARLNESLPLSEQEDLIVWMRTAALPTFRKLYGKIETDIEVNDVVLVIENNYNTYEFGGRKSIVLSTTTWVGGRNNFLGMAYILIGGISLLLAAAFLLLYVMQPRPLGDPSYLSWNKNPGSLR

SEQ ID NO: 213140 - protein, 148 aa, Glycine max
  Coding DNA Sequence Number=SeqID_96362
MKSLRGKEIALVKVQWRPDEGDSTWELEDRVRELYPTKPTSEPRSGSHSECFDIYIAYFRKRAPTGAEKRKGLEPEKRHANRGRILAFKSSKISSHLYSKSQGEAIFRVVKRTSTLWDIEFQVGKCEILRVREAKFGVSLGRANEKNE

SEQ ID NO: 213141 - protein, 102 aa, Glycine max
  Coding DNA Sequence Number=SeqID_96363
MVAITPARFPQPPFFRGYDSNAICAYHGGAPGHSIEHCMTLKRKDFQVYAIIINHSYNAKMDEFDILVSHPLTNTYLLIQLPPECECKPLACFLKATCAPEC

SEQ ID NO: 213142 - protein, 146 aa, Glycine max
  Coding DNA Sequence Number=SeqID_96364
  Subcellular localization annotation: CTP_CleavageSite=30; ConfidenceScore=5.37e-01
MYPLLFSVTTTQVDVPSTCTTKDVPSNVLRQSSQAVEGRHKRIQAVSPSFFWKREKRDTKRIQAKTFRKLLAKEEEEEEEEEEEEEKVQRDSKVVKEYVEKLFVRVVGVVSVLQIGTGNLWILKMRVRELFTHGEGDAILPPKGIG

SEQ ID NO: 213143 - protein, 69 aa, Glycine max
  Coding DNA Sequence Number=SeqID_96365
MWVFRQCRGFCAFQRGQCGFFGSVGGSVGSSDDNVDVEGAVSDRFQAGGEREERFQAGGEREERFQAGG

SEQ ID NO: 213144 - protein, 107 aa, Glycine max
  Coding DNA Sequence Number=SeqID_96366
  Pfam annotation: Domain name=zf-CCHC; Domain location=69-86; Score =27.3; E_value=3.1e-05; Accession=PF00098.13; Description=Zinc knuckle
MIRKKKGIALKASSSFQEESDKEDLIDLNEDDDLSLFVKRFNKFLKTRGNHRRPNFKSKRRTKDSSSTPKCFECNQPGHLRVDCPIFKKRMEKSEKKIFSEKKMKKA

SEQ ID NO: 213145 - protein, 84 aa, Glycine max
  Coding DNA Sequence Number=SeqID_96367
MLFGLSLIQQEGSEDKEVQAYNTRVQTEGRSKRAITKPFVATCPFAGERGEAHGCAFQRRKDARSRHQRLFVENVGKTEEKRSK

SEQ ID NO: 213146 - protein, 120 aa, Glycine max
  Coding DNA Sequence Number=SeqID_96368
  Pfam annotation: Domain name=zf-CCHC; Domain location=49-66; Score =32.0; E_value=2.1e-06; Accession=PF00098.13; Description=Zinc knuckle
MWDALQLTHEGTTDVKREWQPKKFIKKRRIDRRQNFTNGRKSQDDSQVLRCYKCNQIGHIKANCPSNEEWSEKSEKRRFDERRTKKAYIAWDDNDSSDGSEKEINLLTKDYESDENISQG

SEQ ID NO: 213147 - protein, 94 aa, Glycine max
  Coding DNA Sequence Number=SeqID_96369
  Subcellular localization annotation: CTP_CleavageSite=57; ConfidenceScore=5.44e-01
MEVYNVIVKLLHHNISYFHSVSFPASNLMFLTTMPPTNDVAFVSRVCRRRKFVRSVCSISVTATKLCQRWICDVNPWRHPCQRHRGSCGNEAML

SEQ ID NO: 213148 - protein, 555 aa, Glycine max
  Coding DNA Sequence Number=SeqID_96370
  Gene Ontology: Mol. function=RNA-directed DNA polymerase activity; Cellular component=chromatin; Biological process=chromatin assembly or disassembly
  Pfam annotation: Domain name=rve; Domain location=164-320; Score =90.1; E_value=6.6e-24; Accession=PF00665.16; Description=Integrase core domain
  Pfam annotation: Domain name=zf-H2C2; Domain location=105-146; Score =4.2; E_value=0.1; Accession=PF09337.1; Description=His(2)-Cys(2) zinc finger
  Pfam module annotation: Pfam domain module=rve::zf-H2C2; Domain location=164-320::105-146
MTKLLGYDYTIQYKPGASNTVADALSRVSPPSTMLLLLVPHNLFLNQLKHSCSQDPVYTDLLRGVLHTPEAHPGFTTLQNMLFYNDKIWLPEGHDLTQVLMDECHITPCGGHMGVTKTLHCIAQHFYWPKMHKDIRQYIAQCITCQQVKTETRKPAGLLQPLLVPTSLWSDLSMDFITGLLASHVYTTIMVVVDRYSKGTHFGALPAQYTAHKVALLFMDIVCKIHGFSRSIISDRDPIFVSTFWRELFRISGTKLRFSTAYHPQTDSQTEVINRILEQYLRAFVHDHPQKWFSFLSLAELSYNTSTHSGTGYSPFEVMFGQPPLVPPFYAAGTSPVEAVDALTSSRALIHQTLQRRLRKYQEMMKSHADSHHRDVHFAIGDWVYVRLRPHRQTSLQPSYTKLSRRYYRPYQIQERVGRVAYRLQLPQNSKIHSVFHVSLLKAHHGPPPLNEPALPRFRNKNHPLVQPLCFLDWKLNESTSPPTPQSSFNGPDWPLKTLHGSRGLSSPIFMTLRTRSIFRPGELIALLQINTCPIPLQTLVPRVTPHALTRGLRI

SEQ ID NO: 213149 - protein, 91 aa, Glycine max
  Coding DNA Sequence Number=SeqID_96371
MDDGFEIGAGVRLCDLMNFFKKVIITINFEFAGHTFAGWFTSVVQRASERKENSVPKGDAAVVAVADDGSGFRSSFLKSERVEDDEDGWKA

SEQ ID NO: 213150 - protein, 245 aa, Glycine max
  Coding DNA Sequence Number=SeqID_96372
  Gene Ontology: Mol. function=DNA binding; Cellular component=nucleus
  Homolog annotation: Hit_ID=Q1RWS5; Match level="QueryCoverage=73%, HitCoverage=48%, E-value=3e-46, Identity=55%"; Hit description=SBP
  Pfam annotation: Domain name=SBP; Domain location=159-237; Score =169.6; E_value=8.1e-48; Accession=PF03110.5; Description=SBP domain
MEFGENNMFSLNTHTKEENGNTGGNSNNNNIVNVWYSSWDATTTTNAPHTTTAAEGYAGGGHRLHHHQLYGGEGCHVQADPHLTCLHLGKRHYFEDATNGDDANNVTSLGNRHVCGGGGAGFVFAGNDKRARGYYGGGGGGAGGGGGGGKSAPFAMVPRCQVEGCHVALVNAKEYHRRHRVCDKHSKAPKAVVLGLEQRFCQQCSRFHVVSEFDDSKRSCRRRLAGHNERRRKSSHLSVTRNSRQ

SEQ ID NO: 213151 - protein, 95 aa, Glycine max
  Coding DNA Sequence Number=SeqID_96373
  Subcellular localization annotation: CTP_CleavageSite=20; ConfidenceScore=5.10e-01
MGLRGSLLVSGSSETGFSPVGAARQRPRQLSRQAEWRHPLNFLATADGGTHFSSVLLTGFIWTLVYTTVEEGPFQILDEPQFDYNVHLARGIIRN

SEQ ID NO: 213152 - protein, 367 aa, Glycine max
  Coding DNA Sequence Number=SeqID_96374
  Gene Ontology: Mol. function=metalloendopeptidase activity; Cellular component=proteinaceous extracellular matrix; Biological process =peptidoglycan metabolic process
  Homolog annotation: Hit_ID=Q1SSE4; Match level="QueryCoverage=76%, HitCoverage=90%, E-value=4e-81, Identity=56%"; Hit description =Peptidase M10A and M12B, matrixin and adamalysin; Peptidase, metallopeptidases
  Pfam annotation: Domain name=PG_binding_1; Domain location=56-120; Score=43.7; E_value=6.3e-10; Accession=PF01471.9; Description =Putative peptidoglycan binding domain
  Pfam annotation: Domain name=Peptidase_M10; Domain location=158-322; Score=256.6; E_value=5.1e-74; Accession=PF00413.14; Description =Matrixin
  Pfam module annotation: Pfam domain module=PG_binding_1::Peptidase _M10; Domain location=56-120::158-322
MFLSLRYSFTFFFILLLLSPSHINASTTILTQSATKIAITNHNIIQSLNNARRGTKITGISQFKRYLHRFGYLLQKSNTSFSDEFDATLELALVRYQRNLGLQVTGKLDSNTVSQMITPRCGDPDTNDTTPHNHNHHHNHVHNVHSTKNFVFFPGKPRWSRSMPMTLTYAFSRENMIHSLSKKEIIEAFQRAFMRWASVIPVSFVEVSDFELTDIKIGFYNAEHGDGEPFDGELGVLAHSFSPEIGRLHLDAAETWAVDDFRSTASEVAVDLESVATHEIGHLLGLSHSSLKEAVMYPSLRPRDKRADLNIDDIKGVQSLYGSNPNFRSEWSLESDMSANHGSGLVKHLRLASSLIIIISLIHSLCS

SEQ ID NO: 213153 - protein, 67 aa, Glycine max
  Coding DNA Sequence Number=SeqID_96375
MTKNKYEDFSTYAWGPAVLAFLYREMCSATDYKTKSIRGDYERGNPHIGHDEVLIFRRKLDIMKRHE

SEQ ID NO: 213154 - protein, 94 aa, Glycine max
  Coding DNA Sequence Number=SeqID_96376
MARMLLTWKGVAGRNGETSDAAFHNGEKLADLDATGVCRQHQLQQVLHVGKPPTTMAGHANKSNLAIASCEIAVQGSHAYSVACRGSHVWLNGR

SEQ ID NO: 213155 - protein, 53 aa, Glycine max
  Coding DNA Sequence Number=SeqID_96377
LPPFKDPEVFDYLYFEEEEDLAIGLATTLVEHRDKAPITDFFFMISRRLKQTD

SEQ ID NO: 213156 - protein, 100 aa, Glycine max
  Coding DNA Sequence Number=SeqID_96378
MDCTWIDWPNSLTKVPSGIANRCNLTFGERAHGARGCVFHGRKMRGVATNAYLRKTSKKPERCGLRTLSVKGSGVVFMHGEGCFPCSYVFLNCGKEIRPR

SEQ ID NO: 213157 - protein, 101 aa, Glycine max
  Coding DNA Sequence Number=SeqID_96379
MVNDILTLSRHKENMVQPKPSAGLKGKPYQHALTHHAFLYFKKQKLGPPRPKSCFGIYPNSRKLAASKKWHFTEHLVGALLGTNNKGMGAMWLAPSSQNTT

SEQ ID NO: 213158 - protein, 268 aa, Glycine max
  Coding DNA Sequence Number=SeqID_96380
  Gene Ontology: Mol. function=sequence-specific DNA binding; Cellular component=intracellular; Biological process=regulation of transcription, DNA-dependent
  Homolog annotation: Hit_ID=Q1H3T0; Match level="QueryCoverage=97%, HitCoverage=88%, E-value=9e-89, Identity=56%"; Hit description =Transcriptional regulator, AraC family
  Pfam annotation: Domain name=AraC_N; Domain location=25-177; Score =94.9; E_value=2.5e-25; Accession=PF06719.3; Description=AraC-type transcriptional regulator N
  Pfam annotation: Domain name=HTH_AraC; Domain location=151-197; Score= 29.4; E_value=1.3e-05; Accession=PF00165.13; Description=Bacterial regulatory helix-turn-helix proteins, araC family
  Pfam annotation: Domain name=HTH_AraC; Domain location=203-247; Score= 26.1; E_value=0.00013; Accession=PF00165.13; Description=Bacterial regulatory helix-turn-helix proteins, araC family
  Pfam module annotation: Pfam domain module=AraC_N::HTH_AraC::HTH _AraC; Domain location=25-177::151-197::203-247
MSQTVQQQTCALLRQLAPQEGYTASLLDSVRFMRADRQWARTPVLYEPSIIIICQGSKRAFLADKMYRYDAQHYLVLSVPLPFSAETEATSAEPLLGLAIRLDAATLARLVTQVAAADIPLAETPASIISTPGGAVRAALTYQGHFGRIARALQRIHADWQQPLDVPHLASEAGMSVPRFHLHFKSVTQTSPIQYLKSLRLHQARLMMIRDNLTAASAAARVGYESDSQFNREFKRMFGRTPADEARVMKRAFALLPPEQLSARLQAH

SEQ ID NO: 213159 - protein, 162 aa, Glycine max
  Coding DNA Sequence Number=SeqID_96381
  Gene Ontology: Mol. function=RNA-directed DNA polymerase activity; Biological process=RNA-dependent DNA replication
PIQQGPNIFQRTTKLEETLTQYMQVTMSDHKSTESTLKNLEVQVGQLAKQIADKFVEAEDKDSVVHKKKTADKKAVDEGVEVPYPVVPSKKEKDRHLARFLDIFRNLEITMPFEEALVVIQKILPPKHKDLGSVTIPCSIGEVNVGKALIDLGASINFMPLS

SEQ ID NO: 213160 - protein, 199 aa, Glycine max
  Coding DNA Sequence Number=SeqID_96382
MPSRHMACLPTIHHPNVAHTLDENVNNSTPILIESQQPQSDHAHVSQPMGETHEVPHHNLVDFEPRLGYVAEGQAVGGVPLPNTLEDPQFCPQPQPLHFAVGRVPPNTVERGKLDHIEERIRAIEGGGDYAFTDMAELCLMPDIFIPPKFKMPDFDKYKGTTFPKTHLKIYCQKMGTYSKDEKLLMHLFQESLTGAAFT

SEQ ID NO: 213161 - protein, 55 aa, Glycine max
  Coding DNA Sequence Number=SeqID_96383
MTKLGLCLSSGPPPLDDKRVRITIRVRITIRYLHVSWVQNDQTWSLLVIGPAASG

SEQ ID NO: 213162 - protein, 61 aa, Glycine max
  Coding DNA Sequence Number=SeqID_96384
MVTSILQLDLMNLFIKAWAWFNPIIQGMTILIANTSTTFHRDERLRNTHAMHEETARIMHK

SEQ ID NO: 213163 - protein, 103 aa, Glycine max
  Coding DNA Sequence Number=SeqID_96385
  Gene Ontology: Mol. function=RNA-directed DNA polymerase activity; Cellular component=nucleus; Biological process=RNA-dependent DNA replication
PQEVNISLPYFHGKDNVEAYLDWEMKVEQFFACHHISEERKVPLATLSFQGDPPVEYWKDLKSALRKKHIPSYYERELMDKLQRLRQGSMSVEEYRQQWDYSF

SEQ ID NO: 213164 - protein, 67 aa, Glycine max
  Coding DNA Sequence Number=SeqID_96386
MEAKNAWVVAKIRLYLISTTILFCRKQKWSLSPLQNTIHSKTPKTETGKALNRKTETEHTLNKIPGH

SEQ ID NO: 213165 - protein, 152 aa, Glycine max
  Coding DNA Sequence Number=SeqID_96387
MASKKRKSRDSRPQDQNDNKTFQSEEAWNLYIDNILDRRILPKRNVELYHSEFDEFKAELERLRSDPREMEASLCIPGKGFILNTEGQPWNLLRKGLTTLAQTWSVFSYSNLVPTSRTSNLNTDRARLVYGLITRMDMNIGGLISGQMTMMA

SEQ ID NO: 213166 - protein, 347 aa, Glycine max
  Coding DNA Sequence Number=SeqID_96388
  Homolog annotation: Hit_ID=Q8ZMU3; Match level="QueryCoverage=81%, HitCoverage=94%, E-value=5e-90, Identity=61%"; Hit description=Fels -2 prophage protein
  Pfam annotation: Domain name=Baseplate_J; Domain location=96-305; Score=270.8; E_value=2.8e-78; Accession=PF04865.4; Description =Baseplate J-like protein
MAAVYTALSRWEPRIRLSTINITIAYDGSMVVEMAGQRDDGAPLALSVPTGGNTPEIIEVPDFETLLAERKAALIALYPAEQQAAVRRVLALESDPMVKMLQESVYREILLRQRINEAAQAVMVAYALGSDLDQLAALNNVKRLTVTPANPDAVPPVDAVMESDDALRVRVPEAFEGLSVAGPTGAYEFHAKSADGRVLDVSATSPAPAEVLVTVLSREDNGTATADLLATVNAALNAESVRPVADRVTTQAATIHDYSVKAKLHLFDGVAAGPCLEAANERLTAYLTEQKKLGRSVRRESYGAVLRVAGVDWVEMIEPAEDIIMDRTQAGNCTGTDVSVAADGVAS

SEQ ID NO: 213167 - protein, 133 aa, Glycine max
  Coding DNA Sequence Number=SeqID_96389
  Homolog annotation: Hit_ID=Q6CQF3; Match level="QueryCoverage=39%, HitCoverage=56%, E-value=3e-07, Identity=72%"; Hit description =Kluyveromyces lactis strain NRRL Y-1140 chromosome D of strain NRRL Y- 1140 of Kluyveromyces lactis
GERLIDRLVAGSLRSFPQDSWSPRASSIGSKWAIFGKQNWRCGMNRKLGYGAQLRANLDPTKGVGRLRQQDGGHGSRNPLRRRGGRCKTQGASPGGAVVGADLGGTGEARLIALCARTPKGNRVKIPEPGRGG

SEQ ID NO: 213168 - protein, 263 aa, Glycine max
  Coding DNA Sequence Number=SeqID_96390
  Subcellular localization annotation: CTP_CleavageSite=33; ConfidenceScore=5.13e-01
MDMNVGAIISGQITSIAQSNSSRLGFPALITTLCKARGVNSDSLVFECLSPVINLAYIRKNYWNPDDLVVSIKGARQAKMRLTEPPSTSTAPIPACTSAAPSVPAFTGFQHLEAMLQSVHRGQIILLQSLQVVAPPGSIPSVEQEDEGPTTQVPQHVEDGSSEATILEPFVIGEEAEETQVRQVVAATPERSLEATSEPSAQGEDIPSPQPATNPSTPLLEMPEDPTTSVLAMDTSPPTTLVLHLIVEEDVQTQDTQDQSQEF

SEQ ID NO: 213169 - protein, 140 aa, Glycine max
  Coding DNA Sequence Number=SeqID_96391
MTGIFLKEKNNLESLFRDATITPTPGPPGPSTQESQHFESMLQSLYQGQARQEAATPKRSPQISPDPPSPVVDQSSPQQLADPLTPVHEMPTDPSTPLLEILEDPTTPVLGLTTTPMLHFIDKEGTQDQDTQQDDQSQEF

SEQ ID NO: 213170 - protein, 74 aa, Glycine max
  Coding DNA Sequence Number=SeqID_96392
EKGEFHLAITKHGSKLEGGGHMKENTTHGGPKKMENGEMQSAITPQGSKLEGGGHTKENAIHGAPKRVENGELH

SEQ ID NO: 213171 - protein, 47 aa, Glycine max
  Coding DNA Sequence Number=SeqID_96393
MMAHQGARATPLLTRAFAKRHTHGLSARKTLEEDELCRFAKRTASSH

SEQ ID NO: 213172 - protein, 138 aa, Glycine max
  Coding DNA Sequence Number=SeqID_96394
  Gene Ontology: Mol. function=RNA-directed DNA polymerase activity; Cellular component=nucleus; Biological process=RNA-dependent DNA replication
MARLDEVSVKHGRNLFLDFCFLEVWVSIRVDVDWGGLGKKMNVMLNVSWRRKLSGFCKNVWVASQDIGYRDWDGGVFCCGRGGWGVCAKGNVLAHVDEGHGQCLVVGSNCVEESFMMMNQVDSRSFDNDKDDDKKPKE

SEQ ID NO: 213173 - protein, 155 aa, Glycine max
  Coding DNA Sequence Number=SeqID_96395
  Gene Ontology: Mol. function=RNA-directed DNA polymerase activity; Cellular component=chromatin; Biological process=chromatin assembly or disassembly
MVSAPILSNPNFSLPFTIETDASTATTRAVLLQEDHPISFYSKVFCPRLQKALAYIRELHAITSSTPEQQTYLSKLLGFDYTIKYKPGATNVVADALSRIVPADATCLALTMPHFTFLNQLRHSLLHDPRYVSLLKDIQAKLENHSDLGLHQDLI

SEQ ID NO: 213174 - protein, 141 aa, Glycine max
  Coding DNA Sequence Number=SeqID_96396
MVVGDFINILSFPACLHFSEENTETFSSLTSYPELRRSEFLIGGYVGARASLLSTTPPFVAMTQELVARGDTLRLSAPRHSVTPSVIHEQRPIWSSAPFPEMSAFSDGDFPSLTSYPELRRSEFLIGGYVGARALLLSAAP

SEQ ID NO: 213175 - protein, 78 aa, Glycine max
  Coding DNA Sequence Number=SeqID_96397
MTNANYPQESLHLVSNGNLRFTQHEQQLFIYSKLHSTRITTFMTYKNIHDVQEHTRTSTVVCGSKGSLNCKHHGRRYR

SEQ ID NO: 213176 - protein, 127 aa, Glycine max
  Coding DNA Sequence Number=SeqID_96398
  Pfam annotation: Domain name=Transposase_23; Domain location=4-65; Score=-16.7; E_value=0.078; Accession=PF03017.5; Description =TNP1ENSPM transposase
MEDAPVSPRVALPPKGRLYEGSTTVHNIPLLHGQVKVGVEEVKDAEAPVPVPTNEVTLVGQALNTFLAWPTHLVKRLSKHAAVSPGKPPKSPDHEVNDPLYLMTLTIPQLFLKASLGYVGCFRVRAV

SEQ ID NO: 213177 - protein, 66 aa, Glycine max
  Coding DNA Sequence Number=SeqID_96399
  Gene Ontology: Mol. function=nucleic acid binding
  Homolog annotation: Hit_ID=P93486; Match level="QueryCoverage=61%, HitCoverage=28%, E-value=6e-10, Identity=75%"; Hit description =Glycine-rich RNA-binding protein PsGRBP
MLNYIRCMSSSKLFIGGLSYGVDDQSLKDASSGFGYVVDGKFYLISLLSHGAQFQPPASLTLPYVL

SEQ ID NO: 213178 - protein, 91 aa, Glycine max
  Coding DNA Sequence Number=SeqID_96400
MLDKQVVVSPAKPTDGPDAQVKWDATMFGVFNEHFSLYIKHEDLSKIAHGGQCLNISVIQLWILKLHEELDAEFKMGCPPWSLSEWARQLP

SEQ ID NO: 213179 - protein, 66 aa, Glycine max
  Coding DNA Sequence Number=SeqID_96401
  Subcellular localization annotation: CTP_CleavageSite=31; ConfidenceScore=5.06e-01
MQDSPILIGKNASRRRPGKMTNRGRLGLFVRAQPKLCCGRHRLVFICLARKTLANLGKNTCWIHRY

SEQ ID NO: 213180 - protein, 189 aa, Glycine max
  Coding DNA Sequence Number=SeqID_96402
  Homolog annotation: Hit_ID=Q47522; Match level="QueryCoverage=27%, HitCoverage=64%, E-value=6e-24, Identity=100%"; Hit description=LacZ protein
MGIGSRDIQLDLVGVIYEIIAVMLYVLSMFAIARVGAGIHPIIQMTGSTIVSWLGYVCLLPFFLSSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 213181 - protein, 224 aa, Glycine max
  Coding DNA Sequence Number=SeqID_96403
VIDTFLAFHHGKESPVVAILAMYDTFDRGCEKSDARIFCCALALYVWLVSHPFLQEGRPVYPLQGRKNQDSIFMRRMSKCSLDGTRGCINYNPVLAIRQLGYPMRGVPSDESITPFIARGFSDHNARDRELRGSSNGIIGGYHKWLRVRTQGLDWLPNLKTVRDGEVKASEESDEVQALKAELERARVVEEKFKAAIVSSSSEEVKGIITGQRHDLEGRAKGLP

SEQ ID NO: 213182 - protein, 474 aa, Glycine max
  Coding DNA Sequence Number=SeqID_96404
  Gene Ontology: Mol. function=hydrolase activity, acting on glycosyl bonds; Cellular component=amyloplast; Biological process =carbohydrate metabolic process
  Homolog annotation: Hit_ID=Q1RUL3; Match level="QueryCoverage=81%, HitCoverage=81%, E-value=1e-158, Identity=63%"; Hit description =Ribosome-binding factor A; Glycoside hydrolase, family 28
  Pfam annotation: Domain name=Glyco_hydro_28; Domain location=105-450; Score=338.5; E_value=1.1e-98; Accession=PF00295.8; Description =Glycosyl hydrolases family 28
MSLIHWSLILWITMMMLIIHNLDNVEGRYHYHRGKKKISPAPTPPEDSPSPPPSNSPSVPSDPYPNDPPGDSPSGCIFDVRSFGAVGDGSADDTDAFVAAWKEACAVESGVVLVPEDHCFKITSTIFTGPCKPGLVFQVDGTLMAPDGPESWPKEDSHSQWLVFYRLDQMTLTGKGTIEGNGEQWWDLPCKPHRGPDGKTVSGPCDSPTMIRFFMSSNLVLSGVKIQNSPMFHVKFDGCQGVLIDKLSISSPKLSPNTDGIHLGNTRGVGIYNSMISNGDDCISIGPGCSDVDIEGVTCAPTHGISIGSLGVHNSQACVSNLTVRNTIIKESDNGLRIKTWQGGTGSVTGLRFENIQMENVRNCIIIDQYYCMSKECLNQTSAVHVNDVTYRNIKGTYDVRTPPIHFACSDTVACTNITLSEIELLPYEGELLDDPFCWNAYGTQETMTIPPLDCLREGEPDTVVELSAYDCRS

SEQ ID NO: 213183 - protein, 121 aa, Glycine max
  Coding DNA Sequence Number=SeqID_96405
  Homolog annotation: Hit_ID=Q9LUU1; Match level="QueryCoverage=78%, HitCoverage=92%, E-value=3e-31, Identity=65%"; Hit description =Arabidopsis thaliana genomic DNA, chromosome 3, P1 clone: MGD8
MPSLQTALPPELANNATRLYRECLRRAKYIGHRFSFNTQLGEENKKKHNTELLVDLVRQQFKKNMHETDPEKIQKLKDDAARGLINHILYESEQMTEKEEILLQSNQAKDVGVEELVTDGQ

SEQ ID NO: 213184 - protein, 115 aa, Glycine max
  Coding DNA Sequence Number=SeqID_96406
LIEPYNGGLETEKKESTKQKLSLQGRQMEKVEAGVGPPFGLCSMSVDNESKEIKNIYIDLWTARSMSGANKKMIEALAARKKEEYLKKEEYLQQFKMNCHKFHFQSFHPIYACFQ

SEQ ID NO: 213185 - protein, 88 aa, Glycine max
  Coding DNA Sequence Number=SeqID_96407
  Subcellular localization annotation: CTP_CleavageSite=63; ConfidenceScore=5.07e-01
MYDMRGYMSDSNGRVNTSVRVRGRFNGNQRDKCPTFFFTHFPKNFNMLVNKSYGKYGAKGSFRGEYRRSRQVKIGYKPGLKKEGWTYA

SEQ ID NO: 213186 - protein, 1145 aa, Glycine max
  Coding DNA Sequence Number=SeqID_96408
  Gene Ontology: Mol. function=nucleic acid binding; Cellular component= nucleus; Biological process=translation
  Homolog annotation: Hit_ID=Q2QNI2; Match level="QueryCoverage=98%, HitCoverage=98%, E-value=0.0, Identity=55%"; Hit description=Zinc knuckle family protein, putative, expressed
  Pfam annotation: Domain name=DUF814; Domain location=558-659; Score =175.2; E_value=1.6e-49; Accession=PF05670.3; Description=Domain of unknown function (DUF814)
  Pfam annotation: Domain name=FbpA; Domain location=6-549; Score= -141.9; E_value=2.9e-05; Accession=PF05833.2; Description=Fibronectin- binding protein A N-terminus (FbpA)
  Pfam annotation: Domain name=zf-CCHC; Domain location=968-985; Score =30.8; E_value=4.8e-06; Accession=PF00098.13; Description=Zinc knuckle
  Pfam module annotation: Pfam domain module=DUF814::FbpA::zf-CCHC; Domain location=558-659::6-549::968-985
MVKVRLNTADVAAEVKCLRRLIGMRCSNVYDLSPKTYVFKLMNSSGVSESGESEKVLLLMESGVRLHTTLYLRDKSNTPSGFTLKLRKHIRTRRLEDVRQLGYDRIILFQFGLGENANYVILELYAQGNILLTDSTFTVMTLLRSHRDDDKGLAIMSRHRYPVESCRVFERTTIEKLRTSLVSSKEDDNDDAVKADGNGSNASNVAKEKQGTHKGGKSSATLKIVLGEALGYGPALSEHILLDAGLIPSTKVPKDRTWDDATVQALVQAVVRFEDWMQDVISGELVPEGYILMQNKNMGKDSSISQPGSVSQMYDEFCPILLNQFKSRDYTKFETFDAALDEFYSKIESQRSEQQQKAKENSASQKLNRIRQDQENRVHALRKEADHCVKMAELIEYNLEDVDAAILAVRVALAKGMNWDDLARMVKEEKKAGNPVAGLIDKLHLDRNCMTLLLSNNLDEMDDDEKTLPVDKVEVDLALSAHANARRWYEQKKKQESKQGKTVTAHEKAFKAAERKTRLQLNQVEYSFWLLYDIWPKEKTVASISHMRKVHWFEKFNWFISSENYLVISGRDAQQNEMIVKRYMSKGDLYIHADLHGASSTVIKNHKPAQPVPPLTLNQAGCFTVCHSQAWDSKIVTSAWWVYPHQVSKTAPTGEYLTVGSFMIRGKKNFLPPHPLIMGFGLLFRLDESSLGSHLNERRVRGEEEAADDYEETGPLEDKSDSESEKDVTDIEPATDLERNGNLSADSHKPLPEDFPADPSQTSLATTDAETAISQDFPAKETSTLNMVDREILSDVGGNGLASVTPQLEELLDQALELGPVAKSTERRKLKKEQKPGEEDSNVEHGKDESKLKDISANLPVKEDQNLKKGGGQKISRGQKGKLKKIKEKYADQDEEERSIRMTLLASSGKSITKEETSSENDALDKGKKPGSESSAHLKGLSSDPAWFIAQWQTGPSDAPKIPSDAPKICYKCKKAGHLSRDCKDQPDDLLHRNAVGEAEENPKTTAIDTSQADRVAMEEDDINEIGEEEKEKLNDVDYLTGNPLPNDILLYAVPVCGPYSAVQSYKYRVKIIPGPTKKGKAAKTATNLFSHMSEATTREKELMKACTDPELVAAIVGNVKISAAGLTQLKQKQKKGKKSSKQES

SEQ ID NO: 213187 - protein, 386 aa, Glycine max
  Coding DNA Sequence Number=SeqID_96409
  Gene Ontology: Mol. function=structural constituent of ribosome; Cellular component=ribonucleoprotein complex; Biological process =translation
  Homolog annotation: Hit_ID=P29344; Match level="QueryCoverage=78%, HitCoverage=74%, E-value=1e-137, Identity=82%"; Hit description=30S ribosomal protein S1, chloroplast precursor
  Pfam annotation: Domain name=S1; Domain location=125-193; Score=62.1; E_value=1.8e-15; Accession=PF00575.13; Description=S1 RNA binding domain
  Pfam annotation: Domain name=S1; Domain location=202-274; Score =102.4; E_value=1.3e-27; Accession=PF00575.13; Description=S1 RNA binding domain
  Pfam annotation: Domain name=S1; Domain location=37-111; Score=48.9; E_value=1.7e-11; Accession=PF00575.13; Description=S1 RNA binding domain
  Pfam module annotation: Pfam domain module=S1::S1::S1; Domain location=125-193::202-274::37-111
MYGILAILFELRRIIWASEKLWINAADVEQVVETLKNLLRLRTVKGTVFATDNNGAYVDITAKSTAYLPLHEACIHRIKNVEEAGIIPGVREEFMIIDENQADDTLILSLRSIQYDIAWERCRQLKAEDAVVKGKVVNANKGGLVAQVEGLKGFVPFSQISSKSAGEELLEHVIPFKFVEVDEEQSRLVLSHRKAVAESQGQLGIGSVVTGSVQSIKPYGAFIDIGGISGLLHVSQISHDRITDIETVLQPGDILKVMILSHDRERGRVSLSTKKLEPTPGDMIRNPKLVFEKAEEMAQTFRQRIAQAEAMARADMLRFQPESGLTLSGEGILGPLTSDLPPEGVDLSEKLVNITFATFILILKLSYHASKQQQGEYFKATGIVIS

SEQ ID NO: 213188 - protein, 115 aa, Glycine max
  Coding DNA Sequence Number=SeqID_96410
MEGEGGWEGRKEEEGEEEGGEGEVAQGEGRRREKVVAQLGTRTACGGILRDQHWTMFGASCRIIGNFFVWDQISFLKRARDEMTKQALSLISDYLVFEFVPDCILSALRADSFHL

SEQ ID NO: 213189 - protein, 107 aa, Glycine max
  Coding DNA Sequence Number=SeqID_96411
  Gene Ontology: Mol. function=ubiquitin-protein ligase activity; Cellular component=intracellular; Biological process=protein modification process
  Homolog annotation: Hit_ID=Q9LUV3; Match level="QueryCoverage=91%, HitCoverage=10%, E-value=2e-41, Identity=81%"; Hit description =Arabidopsis thaliana genomic DNA, chromosome 3, P1 clone: MGD8
MLNCQAIVNNEYGEQTEEELLPGGKNLRVTNENVITFIHLVANHRLNFQIRQQSSNFLRGLQQLIQKDWIDMCNEHELQLLTSGSLDSLDVDLRQRTNYAGGYHSVR

SEQ ID NO: 213190 - protein, 134 aa, Glycine max
  Coding DNA Sequence Number=SeqID_96412
  Gene Ontology: Mol. function=electron carrier activity; Cellular component=periplasmic space; Biological process=electron transport
  Homolog annotation: Hit_ID=Q3R011; Match level="QueryCoverage=94%, HitCoverage=54%, E-value=1e-27, Identity=48%"; Hit description=YceI precursor
  Pfam annotation: Domain name=YceI; Domain location=1-134; Score =106.6; E_value=7.5e-29; Accession=PF04264.3; Description=YceI like family
LASDKVNPEKSQVNVTLPLHTIDTHVPALTKEFLGNEYFDVKKYPQATFHSTHVESKGDNKYDVQGNLTIKGITKPVVLHATLNKQDMHPMVKKQAIGFDATGVIKRSDFKIDKYVPAVGDEVTITLSTEAYAK

SEQ ID NO: 213191 - protein, 181 aa, Glycine max
  Coding DNA Sequence Number=SeqID_96413
  Gene Ontology: Mol. function=transcription factor activity; Cellular component=chloroplast; Biological process=regulation of transcription, DNA-dependent
  Homolog annotation: Hit_ID=UPI00006DB411; Match level="QueryCoverage =60%, HitCoverage=35%, E-value=6e-31, Identity=65%"; Hit description =COG0583: Transcriptional regulator
MARRPQGRGQRAQQVAGVIGRGQPTALRQRQPGLLRHQRPHGREGEAADAHRRGQRQRGRQRQAEGAAGTGDLQGGGGPWRRGARGGPPEPGAVQCLDAPEAAGSHAGGAVVPAPEPPPGAVRAGTRAVVVCGPVAAPVGRGPGGRARWRAARPAAHRHHGKHGRGAVAADPGGVSRGLAA

SEQ ID NO: 213192 - protein, 79 aa, Glycine max
  Coding DNA Sequence Number=SeqID_96414
MLAVSLLAVALLTLAMPWFHGVLAWSLLRLAAGYGSASAFICVAASRAVGPGDPRAPAVSAITYAGVGARHRADRAGVP

SEQ ID NO: 213193 - protein, 85 aa, Glycine max
  Coding DNA Sequence Number=SeqID_96415
  Gene Ontology: Mol. function=transition metal ion binding
MGDRLEDMICDLGQESFQQAHSPMYDTLQTDSKKPLYPGCKNSLTLLSMVLSLVNVKARYGWSDKSFSSLLQVVHDMLPEETCCQ

SEQ ID NO: 213194 - protein, 59 aa, Glycine max
  Coding DNA Sequence Number=SeqID_96416
  Gene Ontology: Mol. function=protein serine/threonine kinase activity; Biological process=protein amino acid phosphorylation
  Homolog annotation: Hit_ID=Q1SMH9; Match level="QueryCoverage=76%, HitCoverage=7%, E-value=4e-19, Identity=95%"; Hit description =Protein kinase
MDVGDFGLAKMLTSDDLASSVVGTPSYMCPELLADIPYGSKSDIWSLGRIDSICTPEIA

SEQ ID NO: 213195 - protein, 73 aa, Glycine max
  Coding DNA Sequence Number=SeqID_96417
MVVTGDGELGWTLGWVDRSASGVHRSARPFCRRCAPVLNWAGRASGAVTLKKLECSKQAYALYTLAWDNTTGF

SEQ ID NO: 213196 - protein, 59 aa, Glycine max
  Coding DNA Sequence Number=SeqID_96418
MGAKHLTRTKEWSHVIEQRSPDEIRVLDGGTHILLKLNVTGSHLRRQLLQGSLVFAVEG

SEQ ID NO: 213197 - protein, 82 aa, Glycine max
  Coding DNA Sequence Number=SeqID_96419
MDKDQWTYDYAMSQEVYMDYDYDNEEECGVFGTRDDVLQWARTVAHENGFVAVIMRSDTDIGSRGRSSFVLIGCERSGFVGN

SEQ ID NO: 213198 - protein, 463 aa, Glycine max
  Coding DNA Sequence Number=SeqID_96420
  Gene Ontology: Mol. function=acyltransferase activity; Biological process=alkaloid metabolic process
  Homolog annotation: Hit_ID=Q9FID1; Match level="QueryCoverage=92%, HitCoverage=93%, E-value=2e-74, Identity=37%"; Hit description =Anthocyanin acyltransferase-like protein
  Pfam annotation: Domain name=Transferase; Domain location=7-459; Score=83.1; E_value=8.7e-22; Accession=PF02458.6; Description =Transferase family
MAESPTFKVHEVCSISPPQETPPTTLPFTLFDVLWLRFPPVERLFFYSFPNPTTTSFFDTTVLPNLKHSLSLTLHHFPPLAGTITWPNHSPLPLITYTPGNTIPFTIAQSNADFNTLSSNLSQVNHHLQNLIPHLTISHEEASVLALQLTLFPNQGFSIGITTHHAALDGKSSTLFIKSWAHFCSQLNTSPEEPLSLPKHLIPSFDRSVIRDTLGIGEIYANSWMNFGGATNDRSLNVWDSLGGSQTDLVKGLFELTPLDIKKLKKLAESKVVVGDNKKKIRVTSFTVTCAYLLSCAVKAEQPNCERVPFIFSVDCRARLDPPIPGTYFGNSVVSLLVIAKREELLGEEAFFKSVLGISEELNRIEGDVLNGADRWMPKIQSVMSERPRLFSVAGSPRFEVYDVDFGWGRPKKVDVTSVDKTGAFSLSETRDHSGGIQIGLALTKSQMEAFSTVFAQGLESLE

SEQ ID NO: 213199 - protein, 94 aa, Glycine max
  Coding DNA Sequence Number=SeqID_96421
MDPNYQANTLYKIHPNSKIMPVDEVRAAIKCPLESRITASKLNSPKADNTEASMLNFSLPLRDWMIVRGGNRSDQALKGLSLAYDEFLRPESDL

SEQ ID NO: 213200 - protein, 1118 aa, Glycine max
  Coding DNA Sequence Number=SeqID_96422
  Gene Ontology: Mol. function=protein serine/threonine kinase activity; Cellular component=integral to membrane; Biological process=protein amino acid phosphorylation
  Homolog annotation: Hit_ID=Q6YVY8; Match level="QueryCoverage=96%, HitCoverage=94%, E-value=0.0, Identity=50%"; Hit description =Putative receptor-like protein kinase
  Pfam annotation: Domain name=LRRNT_2; Domain location=39-83; Score =52.4; E_value=1.5e-12; Accession=PF08263.3; Description=Leucine rich repeat N-terminal domain
  Pfam annotation: Domain name=LRR_1; Domain location=145-167; Score =9.8; E_value=4.2; Accession=PF00560.23; Description=Leucine Rich Repeat
  Pfam annotation: Domain name=LRR_1; Domain location=169-191; Score =16.5; E_value=0.096; Accession=PF00560.23; Description=Leucine Rich Repeat
  Pfam annotation: Domain name=LRR_1; Domain location=193-215; Score =17.3; E_value=0.057; Accession=PF00560.23; Description=Leucine Rich Repeat
  Pfam annotation: Domain name=LRR_1; Domain location=217-236; Score =8.9; E_value=6.1; Accession=PF00560.23; Description=Leucine Rich Repeat
  Pfam annotation: Domain name=LRR_1; Domain location=238-260; Score =8.7; E_value=6.8; Accession=PF00560.23; Description=Leucine Rich Repeat
  Pfam annotation: Domain name=LRR_1; Domain location=263-285; Score =18.0; E_value=0.035; Accession=PF00560.23; Description=Leucine Rich Repeat
  Pfam annotation: Domain name=LRR_1; Domain location=287-309; Score =9.7; E_value=4.4; Accession=PF00560.23; Description=Leucine Rich Repeat
  Pfam annotation: Domain name=LRR_1; Domain location=311-333; Score =17.1; E_value=0.065; Accession=PF00560.23; Description=Leucine Rich Repeat
  Pfam annotation: Domain name=LRR_1; Domain location=406-428; Score =9.8; E_value=4.1; Accession=PF00560.23; Description=Leucine Rich Repeat
  Pfam annotation: Domain name=LRR_1; Domain location=430-452; Score =11.4; E_value=2.1; Accession=PF00560.23; Description=Leucine Rich Repeat
  Pfam annotation: Domain name=LRR_1; Domain location=453-474; Score =7.8; E_value=10; Accession=PF00560.23; Description=Leucine Rich Repeat
  Pfam annotation: Domain name=LRR_1; Domain location=573-595; Score =8.0; E_value=9.3; Accession=PF00560.23; Description=Leucine Rich Repeat
  Pfam annotation: Domain name=LRR_1; Domain location=598-620; Score =14.5; E_value=0.39; Accession=PF00560.23; Description=Leucine Rich Repeat
  Pfam annotation: Domain name=LRR_1; Domain location=622-644; Score =15.0; E_value=0.27; Accession=PF00560.23; Description=Leucine Rich Repeat
  Pfam annotation: Domain name=LRR_1; Domain location=646-668; Score =16.1; E_value=0.13; Accession=PF00560.23; Description=Leucine Rich Repeat
  Pfam annotation: Domain name=LRR_1; Domain location=670-692; Score =20.5; E_value=0.006; Accession=PF00560.23; Description=Leucine Rich Repeat
  Pfam annotation: Domain name=LRR_1; Domain location=694-716; Score =12.1; E_value=1.6; Accession=PF00560.23; Description=Leucine Rich Repeat
  Pfam annotation: Domain name=LRR_1; Domain location=718-737; Score =6.3; E_value=19; Accession=PF00560.23; Description=Leucine Rich Repeat
  Pfam annotation: Domain name=Pkinase; Domain location=852-1116; Score= 113.2; E_value=7.7e-31; Accession=PF00069.15; Description=Protein kinase domain
  Pfam annotation: Domain name=Pkinase_Tyr; Domain location=852-1099; Score=59.3; E_value=4.2e-16; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::Pkinase::Pkinase_Tyr; Domain location=...
  Pfam module annotation: Domain location=39-83::145-167::169-191::193 -215::217-236::238-260::263-285::287-309::311-333::406-428::430 -452::453-474::573-595::598-620::622-644::646-668::670-692::694 -716::718-737::852-1116::852-1099
  Subcellular localization annotation: CTP_CleavageSite=65; ConfidenceScore=5.79e-01
MFSSSFSHSSSAIKWNSLTQFLFLVFFLFSASRNDAVSPFSDKSALLRLKASFSNPAGVLSTWTSATATSDSGHCSFSGVLCDANSRVVAVNVTGAGGNNRTSPPCSNFSQFPLYGFGIRRTCSGSKGSLFGNASSLSFIAELTELRVLSLPFNALEGEIPEAIWGMENLEVLDLEGNLISGCLPFRINGLKNLRVLNLAFNRIVGDIPSSIGSLERLEVLNLAGNELNGSVPGFVGRLRGVYLSFNQLSGIIPREIGENCGNLEHLDLSANSIVRAIPRSLGNCGRLRTLLLYSNLLKEGIPGELGRLKSLEVLDVSRNTLSGSVPRELGNCLELRVLVLSNLFDPRGDVDAGDLEKLGSVNDQLNYFEGAMPVEVLSLPKLRILWAPMVNLEGGLQGSWGGCESLEMVNLAQNFFSGEFPNQLGVCKKLHFVDLSSNNLTGELSEELRVPCMSVFDVSGNMLSGSVPDFSNNVCPPVPSWNGNLFADGNASPRYASFFMSKVRERSLFTSMGGVGTSVVHNFGQNSFTDIHSLPVAHDRLGKKCGYTFLVGENNLTGPFPTFLFEKCDELDALLLNVSYNRISGQIPSNFGGICRSLKFLDASGNELAGTIPLDVGNLVSLVFLNLSRNQLQGQIPTNLGQMKNLKFLSLAGNKLNGSIPISLGQLYSLEVLDLSSNSLTGEIPKAIENMRNLTDVLLNNNNLSGHIPNGLAHVTTLSAFNVSFNNLSGSLPSNSGLIKCRSAVGNPFLSPCRGVSLTVPSGQLGPLDATAPATTGKKSGNGFSSIEIASITSASAIVLVLIALIVLFFYTRKWKPRSRVISSIRKEVTVFTDIGFPLTFETVVQATGNFNAGNCIGNGGFGTTYKAEISPGILVAVKRLAVGRFQGVQQFHAEIKTLGRLHHPNLVTLIGYHACETEMFLIYNFLSGGNLEKFIQERSTRDVEWKILHKIALDIARALAYLHDTCVPRVLHRDVKPSNILLDDDFNAYLSDFGLARLLGTSETHATTGVAGTFGYVAPEYAMTCRVSDKADVYSYGVVLLELLSDKKALDPSFSSYRNGFNIVAWACMLLKQGRAKEFFTAGLWEAGPGDDLVEVLHLAVVCTVDILSTRPTMKQ

SEQ ID NO: 213201 - protein, 111 aa, Glycine max
  Coding DNA Sequence Number=SeqID_96423
  Subcellular localization annotation: CTP_CleavageSite=42; ConfidenceScore=5.60e-01
MNDAKFESFANILSPLGNCCSFSLMAVESFPSASMPSQSMALASTRTSTPCGTKCKVVMVDVTDTQFDKFNTGLDNVVEAIGCGSVYALKQSNVAEKQVNISECQVIAIEK

SEQ ID NO: 213202 - protein, 315 aa, Glycine max
  Coding DNA Sequence Number=SeqID_96424
MAFLNYENKKGSGKKLKVHFDLPEDDDFPNHRHSSSSVSSESSLDSDDTDNDNSINNVDSKYGLYGSPVWSFQGGSVTQSPPVQFMNSPGYDPNRIPSSVFNKPTSPMEWSVASNESLFSIQLGNSSFSRDYAFAFNNKSGELPRTSDLPNMPATLPSVQEVPAKEKNVDMERQSVSSDSSSETADSIRGHDHDKTSHESAGSVVDLKKTENSEEIGTDEVVLDKYPDDHSKEAKIPNGEAKNYASVSYRSVESNMSTRWDILLLTIIFFLNSFRLTAEGGRTSSSTVESEKQEQQPEKPQQPPSPKTEKAPKKS

SEQ ID NO: 213203 - protein, 44 aa, Glycine max
  Coding DNA Sequence Number=SeqID_96425
MLVVAERAERVDGSVGEDILSAGGRNSNQSAIGMPPEKLPLKLE

SEQ ID NO: 213204 - protein, 120 aa, Glycine max
  Coding DNA Sequence Number=SeqID_96426
MEFTSWFIIRHDGAGTWEPWGRLEPNNSNAVGYRFEVLPGTAVLKSNGLIMLKGRKDRTGLDVEALKKLNKNKKLVKNLAKKYHASFASEAVIKQDSSPFGSWSQQSKHVLPLCFSGLGL

SEQ ID NO: 213205 - protein, 95 aa, Glycine max
  Coding DNA Sequence Number=SeqID_96427
MVKAATPLHKAMEYETAPAEVPPVRAVPSTPGALIYDGSQNRVRSKLREQTIARSRTRRNEDLKRWRRNWRMKGEKENPNAKSKATCFFSFVSLG

SEQ ID NO: 213206 - protein, 223 aa, Glycine max
  Coding DNA Sequence Number=SeqID_96428
  Gene Ontology: Mol. function=amino acid-polyamine transporter activity; Cellular component=membrane; Biological process=amino acid transport
  Homolog annotation: Hit_ID=P44747; Match level="QueryCoverage=37%, HitCoverage=20%, E-value=3e-31, Identity=82%"; Hit description =Tyrosine-specific transport protein 2
  Pfam annotation: Domain name=Trp_Tyr_perm; Domain location=1-205; Score=-183.3; E_value=4.1e-06; Accession=PF03222.4; Description =Tryptophantyrosine permease family
  Subcellular localization annotation: CTP_CleavageSite=29; ConfidenceScore=5.09e-01
GFCFYQLSSCSATDGVVRNGKSTAGTSALASVAAAQLLGRAIGAGLFAITPAGERGMCCKAIKLGIRSAIPLVAYLVWQLATHGVLSQNEFVQVLQADPTLNGLVNATRQITNSHIMGEIVRVFSALALITSFLGVMLGVFEGGARYQLLFPLVRVNFELGVIMVIAVSFGKPVVPAALMNRPTRGERRFAYWALAECILAYYVGTDEGVSEVLHVAGEKRLH

SEQ ID NO: 213207 - protein, 79 aa, Glycine max
  Coding DNA Sequence Number=SeqID_96429
  Gene Ontology: Mol. function=hydroxymethylglutaryl-CoA lyase activity; Biological process=metabolic process
  Homolog annotation: Hit_ID=Q2PF06; Match level="QueryCoverage=71%, HitCoverage=13%, E-value=1e-17, Identity=73%"; Hit description =Putative hydroxymethylglutaryl-CoA lyase
MGQLWRMGRLVLITTYIPDFGNAGCGQITWAWETARLKDEVAAHLTAAMKMMKSIPHRHYHGKDTQETYLETTSSVKRL

SEQ ID NO: 213208 - protein, 74 aa, Glycine max
  Coding DNA Sequence Number=SeqID_96430
  Homolog annotation: Hit_ID=Q677B5; Match level="QueryCoverage=61%, HitCoverage=23%, E-value=1e-07, Identity=65%"; Hit description=60S ribosomal protein L10A
MVKFQLKKELCMGVAVGNVNMEEKQIFQNFASLLNLLPIDFGNIWQCSLMRILKLVKYRLKTQVEKDEGPSGEG

SEQ ID NO: 213209 - protein, 122 aa, Glycine max
  Coding DNA Sequence Number=SeqID_96431
MMRPWIGTHRRTSDRISTFLSFEHFYVEAKLHDESRLIQRCFDDNKDDDKGDDKKLKGQSKNEFKMFKIESRTLQDSRRKLKNTSRFKRKVDFKNQDSRIKLSRIKIRLNQDKYEKVFSKTE

SEQ ID NO: 213210 - protein, 166 aa, Glycine max
  Coding DNA Sequence Number=SeqID_96432
  Gene Ontology: Mol. function=oxidoreductase activity, acting on the aldehyde or oxo group of donors, disulfide as acceptor; Biological process=metabolic process
  Homolog annotation: Hit_ID=Q6A612; Match level="QueryCoverage=47%, HitCoverage=23%, E-value=3e-37, Identity=98%"; Hit description =Pyruvate dehydrogenase E1 component, beta subunit
  Pfam annotation: Domain name=Transket_pyr; Domain location=8-163; Score=-5.1; E_value=3.7e-06; Accession=PF02779.14; Description =Transketolase, pyrimidine binding dom
MHSARPQGETTLAKALNAGLSDALAADDRVVLMGEDVGTLGGVFRITDGLKAQFGGRRVIDTPLAESGIVGTAIGMAMRGPGDPLVLERPPPRWSSNSPYSESYYNSLAVVLQRRDWENPGVTQLNRLAAHPPFASWRNSEEARTDRPSQQLRSLNGEWDAPCSGA

SEQ ID NO: 213211 - protein, 278 aa, Glycine max
  Coding DNA Sequence Number=SeqID_96433
  Gene Ontology: Mol. function=hydrolase activity, hydrolyzing O -glycosyl compounds; Cellular component=cell wall; Biological process= beta-lactam antibiotic catabolic process
  Homolog annotation: Hit_ID=UPI000066CF06; Match level="QueryCoverage =99%, HitCoverage=33%, E-value=2e-49, Identity=34%"; Hit description =putative hydrolase/beta lactamase fusion protein
  Pfam annotation: Domain name=Glyco_hydro_3; Domain location=1-217; Score=141.2; E_value=2.8e-39; Accession=PF00933.12; Description =Glycosyl hydrolase family 3 N terminal domain
MDAEWGLYQRIAAAHKFPWAMTLGAIQDKNLIYQMSSKIAEDCKRMGINWDFAPVVDVNTNPNNPIIGNRSFGSEVDNVISSALAYSNGLQDNNILAAIKHFPGHGDTSTDSHLDLPVVPHQLERLNAVELAPFKALMTKGIGGVMVAHLYVPTLESGKGIPASVSKNIITGLLKEKLGYKGLIITDALNMGAVANKYKPGELDALAFKAGLDKYNSKNPENINNDLNNDSHKLLVQNLYSNALTLLKDEQKLLPIAGKQVYYVPLEEAPYQTFANQL

SEQ ID NO: 213212 - protein, 125 aa, Glycine max
  Coding DNA Sequence Number=SeqID_96434
  Subcellular localization annotation: CTP_CleavageSite=36; ConfidenceScore=5.53e-01
MRVHCNQASRRPSMITDSPPLLMFPRTRSPVESPTVATYPSAGGRRVTRGMRVPRKEYARSRHQRLFEENVGKTGKDAIYELLSEKGSGVVFTHGEGISTPHVRPKGRQPLIECANMTLIFYVPF

SEQ ID NO: 213213 - protein, 71 aa, Glycine max
  Coding DNA Sequence Number=SeqID_96435
MQWLKEDDNDYSYEVKREHNRDMVVEMVGTIKTCPQCSLTYLEKKPISDIPTYFPTVRDLKVFPMLAYALV

SEQ ID NO: 213214 - protein, 66 aa, Glycine max
  Coding DNA Sequence Number=SeqID_96436
MEEGCTSIAATMLLNQFAKEINRKKRKREKERERRINNSTMFRWTLRWYMLYTSRKMSSRDKGKSP

SEQ ID NO: 213215 - protein, 138 aa, Glycine max
  Coding DNA Sequence Number=SeqID_96437
MVVEKGESLPSYSRFARLRPDPQELATQLCIPRRGFVLDAEVLLWKLLRKDLTTLAQTWSVLSYSNLAPTSHTSYLNLDRAKLVYGLVMKMNMNLGSLISSQISFIAQSNSSRLRFPALITALCRPEESPQILLPSRH

SEQ ID NO: 213216 - protein, 218 aa, Glycine max
  Coding DNA Sequence Number=SeqID_96438
  Gene Ontology: Mol. function=chitin binding; Cellular component =extracellular region; Biological process=chitin metabolic process
  Homolog annotation: Hit_ID=UPI00006A17C9; Match level="QueryCoverage =98%, HitCoverage=100%, E-value=5e-19, Identity=34%"; Hit description= UPI00006A17C9 related cluster
VDPWVLVPITFRGLHVLANRGLHALTSRGLHVLALRGLHALTLEGYTPSPWVLVTLTVRGLPSRLVRTTCLTFRGLHVLAIGGLHVLAIRGLHALTSRGLPVLALRGLHALTLGLHVLTIRGLHALTSRGLHVLALRGLHALTLGLHVLALRGLHVLTIRGLHALTSRGLHVLTLRGLHALTLGTSYPHRQRTTRPRLERTTRSQHQRAARPYLQRTT

SEQ ID NO: 213217 - protein, 231 aa, Glycine max
  Coding DNA Sequence Number=SeqID_96439
  Gene Ontology: Mol. function=chitin binding; Cellular component =extracellular region; Biological process=chitin metabolic process
  Homolog annotation: Hit_ID=UPI000044A8F0; Match level="QueryCoverage =83%, HitCoverage=100%, E-value=7e-33, Identity=32%"; Hit description= PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
LHALAFRGLLVLAFRGLHALAFRGLHVLAFSGLHALALRGLHVLPFRWLHTVAFRGLHVLAIRGLHALALRGLLVLAFRGLHALALRGLHVLAFRGLHALAFRGLHVLTFRGLHALSFWGLHVLTFRGLHAHAFRGLHVLAYRGLHGLAFRGLLVLAFRGLHALAFRGLHLLTFRGLHVLAIRGLHVLTIRELHVLNNASSTLKFMFSYHLGWKNFMYINTKIWNKKRGWK

SEQ ID NO: 213218 - protein, 217 aa, Glycine max
  Coding DNA Sequence Number=SeqID_96440
  Homolog annotation: Hit_ID=Q2A994; Match level="QueryCoverage=87%, HitCoverage=35%, E-value=3e-28, Identity=37%"; Hit description =Pentatricopeptide (PPR) repeat-containing protein
MPSPASVILRLMLDKGLTMRSRSSWMDILVYLVLDACVRFKLSLKGILEMNGLRNEMKELKDHIDGVLAFYVCHYCQFYDSLLSLHFKFSNIDAAAKLVMDMTSSHNYDVKKECEKHMQKPCFIAIGSPFLRTVLKIHIKSELLHKDSILKVESRQDLIFYDDGKLVLSNSALAKFIGGYKKDGRISELSKVLLSIQGELNSVAGSSLCSDVIGARV

SEQ ID NO: 213219 - protein, 137 aa, Glycine max
  Coding DNA Sequence Number=SeqID_96441
  Gene Ontology: Mol. function=ATPase activity, coupled to transmembrane movement of ions, phosphorylative mechanism; Cellular component=integral to membrane; Biological process=phospholipid transport
  Homolog annotation: Hit_ID=Q1RSD6; Match level="QueryCoverage=99%, HitCoverage=11%, E-value=7e-51, Identity=71%"; Hit description =ATPase, E1-E2 type
MPKVNEETGKFSYEAESPNEAAFVIVARELGFEFYDRTHATISLRQLDTISDQKINKSYKLLNILEFTSARKRMSVIVKDVEGKLLLLSKGADSVMFEQIAKNGRDFEEKTKQYISEYADSGLRALILAYRELNDEE

SEQ ID NO: 213220 - protein, 89 aa, Glycine max
  Coding DNA Sequence Number=SeqID_96442
  Subcellular localization annotation: CTP_CleavageSite=30; ConfidenceScore=5.29e-01
MVLPFTKFILFRNHLFRKVSPLPRIFQGHVCFNRFNPFPQTFSTSDHCERLSWERSTEEILLRKLKFALRNHQIVREKSGLLHGDTIGE

SEQ ID NO: 213221 - protein, 165 aa, Glycine max
  Coding DNA Sequence Number=SeqID_96443
  Gene Ontology: Mol. function=calcium ion binding; Cellular component =membrane; Biological process=abscisic acid mediated signaling
  Homolog annotation: Hit_ID=Q5EE13; Match level="QueryCoverage=84%, HitCoverage=65%, E-value=1e-63, Identity=85%"; Hit description =Calcineurin B-like protein
  Pfam annotation: Domain name=efhand; Domain location=104-132; Score =27.5; E_value=4.8e-05; Accession=PF00036.22; Description=EF hand
  Pfam annotation: Domain name=efhand; Domain location=23-51; Score =15.8; E_value=0.16; Accession=PF00036.22; Description=EF hand
  Pfam annotation: Domain name=efhand; Domain location=60-88; Score =15.9; E_value=0.14; Accession=PF00036.22; Description=EF hand
  Pfam module annotation: Pfam domain module=efhand::efhand::efhand; Domain location=104-132::23-51::60-88
MIRKYLGSLLKTSITRKELDPNRDMQIFDLFDVKKKGVIDFEDFVRSLNVFHPNASLEDKIAFSFRLYDLHNTGFIERPEVKQMLIALLFESDMKLADDVIETILDKTFVEADLNQDGKIDTEEWETFVKKNPSLLKIMTLPYLRDITTSFPSFIFNSNVDEITA

SEQ ID NO: 213222 - protein, 74 aa, Glycine max
  Coding DNA Sequence Number=SeqID_96444
MLRIPKPLLTRIPTLKSTITTVFHKPHRKKAEVDLDHRSTTAEPGYRSTTEALSTNREELLLFQGGGAGGVRRE

SEQ ID NO: 213223 - protein, 232 aa, Glycine max
  Coding DNA Sequence Number=SeqID_96445
MLNNGVPHTFTVGICEIIVTERETGITQDSTSGGFNPFSVSPMFGNSIGAIREKNWRNLREPLKMLLSLAKDTRNKEIRSKQVIPHAGGSKVNPRRRNELEQIEVGLTQSIVEEYEVSPLDVVGRVLGLEHSGRVRCMGLGAVPSNTFRNTRLRAFSLSSSSSGVAFPSSNQWQEKYNNLESAFKAYMIMKEGRIPEELASYFTPDQTHPNDASSVPNTPLDARGSSGASNP

SEQ ID NO: 213224 - protein, 98 aa, Glycine max
  Coding DNA Sequence Number=SeqID_96446
  Homolog annotation: Hit_ID=Q1T251; Match level="QueryCoverage=63%, HitCoverage=21%, E-value=6e-08, Identity=43%"; Hit description =Multicopper oxidase, copper-binding site
MENAEFYKKLWKLQIPSKGKGFIWKLSHKRLPSKDDLQRRNILAGGSDTNCVFCNLGLETADHILFECQFTYEVDDTYGEVRLECYLRRFRIILGSLK

SEQ ID NO: 213225 - protein, 128 aa, Glycine max
  Coding DNA Sequence Number=SeqID_96447
  Gene Ontology: Mol. function=microtubule motor activity; Cellular component=microtubule associated complex; Biological process =microtubule-based movement
  Homolog annotation: Hit_ID=Q9C7B9; Match level="QueryCoverage=98%, HitCoverage=11%, E-value=5e-26, Identity=51%"; Hit description =Kinesin heavy chain, putative; 55116-47986
MDEKSLIKKYQKEISELKQELQQLKRGMVENPNMATSSQEDLITLKLQGCADAYILDYLISVTLEAVQSKLKSRLQEEEQAKAALMRRIQRLTKLILVSTKNAMSSSIAERPSHRRRHSFGEDEVCFS

SEQ ID NO: 213226 - protein, 279 aa, Glycine max
  Coding DNA Sequence Number=SeqID_96448
  Gene Ontology: Mol. function=protein serine/threonine kinase activity; Cellular component=nucleus; Biological process=protein amino acid phosphorylation
  Homolog annotation: Hit_ID=Q84XZ6; Match level="QueryCoverage=98%, HitCoverage=72%, E-value=1e-141, Identity=85%"; Hit description =Mitogen-activated protein kinase 4
  Pfam annotation: Domain name=Pkinase; Domain location=2-232; Score =175.5; E_value=1.3e-49; Accession=PF00069.15; Description=Protein kinase domain
  Pfam annotation: Domain name=Pkinase_Tyr; Domain location=1-232; Score=-92.0; E_value=7.9e-07; Accession=PF07714.7; Description =Protein tyrosine kinase
  Pfam module annotation: Pfam domain module=Pkinase::Pkinase_Tyr; Domain location=2-232::1-232
IIAIKDIIRPPKKETFNDVYIVYELMDTDLHHIIHSDQPLSEEHCQKLVQYFLYQLLRGLKYVHSANVLHRDLKPSNLLMNANCDLKIGDFGLARTTSETDFMTEYVVTRWYRAPELLLNCSEYTSAIDVWSVGCILGEIMTREPLFPGKDYVHQLRLITELLGSPDDASLEFLRSDNARRYIRQLPQYRKQKFSTRFPNMLPKALDLLEKMLIFDPNKRITVDEALCHPYLSSLHNINDEPVCPRPFSFDFDQPTCTEEHMKELIWKESVKFNPDPPC

SEQ ID NO: 213227 - protein, 394 aa, Glycine max
  Coding DNA Sequence Number=SeqID_96449
  Gene Ontology: Mol. function=hydrolase activity, acting on acid anhydrides, catalyzing transmembrane movement of substances; Cellular component=integral to membrane; Biological process=copper ion transport
  Homolog annotation: Hit_ID=Q9SH30; Match level="QueryCoverage=99%, HitCoverage=39%, E-value=1e-173, Identity=79%"; Hit description =Putative copper-transporting ATPase 3
  Pfam annotation: Domain name=Hydrolase; Domain location=57-288; Score= 123.1; E_value=7.9e-34; Accession=PF00702.16; Description=haloacid dehalogenase-like hydrolase
MDSFQLALQFGISVMVIACPCALGLATPTAVMVGTGVGASQGILIKGGQALENAHKVNCVVFDKTGTLTIGKPVVVNTKLLTNMVLREFYELVAAAEVNSEHPLAKAIVEYAKKLRDDENPIWPEARDFVSIAGHGVKAMVRNKEILVGNKSLMEDHNVALPIDAEEMLAEAEAMAQTGIIVSINREVVGVLAVSDPLKPAAQEVISILKSMKIRSIMVTGDNWGTANSIAREVGIETVIAEAKPDQKAEKVKDLQASGYRVAMVGDGINDSPALVAADVGMAIGAGTDIAIEAADIVLMKSNLEDVITAIDLSRKTFSRIRLNYIWALGYNLLGIPIAAGALFPSTRFRLPPWIAGAAMAASSVSVVCCSLMLKYYRRPKKLDNLEIRGISIE

SEQ ID NO: 213228 - protein, 199 aa, Glycine max
  Coding DNA Sequence Number=SeqID_96450
  Gene Ontology: Mol. function=DNA binding; Cellular component=nucleus
  Homolog annotation: Hit_ID=Q1RY59; Match level="QueryCoverage=95%, HitCoverage=53%, E-value=8e-44, Identity=53%"; Hit description=HMG-I and HMG-Y, DNA-binding
  Pfam annotation: Domain name=DUF296; Domain location=10-129; Score =161.1; E_value=2.8e-45; Accession=PF03479.5; Description=Domain of unknown function (DUF296)
  Subcellular localization annotation: CTP_CleavageSite=48; ConfidenceScore=5.15e-01
MDGLYNWKSLNAHMDGVVIDWDIVAKLLSLSQQRSRALCIMSGTGTVSSVTLRQPASTNASVTFEGRFQILCLSGSYLVAEDGGPSNRTGGISVSLSSHDGHVIGGGVAVLIAGGPVQVMLCSFVYGGSKTKSKLGTTIKDESSEPPPQHNDKLASPASAPAPPGQNYLPLSATNLWPGSRPAELKSTHMHTGIDLTRG

SEQ ID NO: 213229 - protein, 208 aa, Glycine max
  Coding DNA Sequence Number=SeqID_96451
  Gene Ontology: Mol. function=transferase activity; Cellular component= nucleus
  Homolog annotation: Hit_ID=Q1RY55; Match level="QueryCoverage=96%, HitCoverage=100%, E-value=1e-65, Identity=60%"; Hit description =Glutathione S-transferase, N-terminal; Glutathione S-transferase, C- terminal-like
  Pfam annotation: Domain name=GST_N; Domain location=2-80; Score=28.4; E_value=2.5e-05; Accession=PF02798.10; Description=Glutathione S -transferase, N-terminal domain
MGKLKVYADQMSQPSRAVLIFCRFNGIDFEEIKVDISKRHHLSPEFREINPLQKVPAIVHGSFNLSERSTPPFTANYVINTVLGPATGRPLSPKAAAEAEKVLLSSLSKLENIWLNGDGHFLLGVSQPSIAYLSMVCELMQLEDHSRILSPYKKVLQWIEDTRTATNPHFEEVHNILYRAKKKFEQQRSRVAETGTEPSNKMGGHSKM

SEQ ID NO: 213230 - protein, 115 aa, Glycine max
  Coding DNA Sequence Number=SeqID_96452
  Gene Ontology: Mol. function=metal ion binding; Biological process =metal ion transport
  Homolog annotation: Hit_ID=Q1SWG9; Match level="QueryCoverage=98%, HitCoverage=98%, E-value=5e-22, Identity=44%"; Hit description=Heavy metal transport/detoxification protein
  Pfam annotation: Domain name=HMA; Domain location=3-64; Score=37.7; E_ value=3.9e-08; Accession=PF00403.16; Description=Heavy-metal -associated domain
MKVVVKLDLHDDKAKQKAMKSVSSISGIYSISMDMKEKKLTVEGDINPVNVVSKLRKTWHPEIVTVGPAKEPENKKDPNQQIEELVKLYKAYNPHMTTHYYVQSAEENPNACAIC

SEQ ID NO: 213231 - protein, 321 aa, Glycine max
  Coding DNA Sequence Number=SeqID_96453
  Gene Ontology: Mol. function=DNA binding; Cellular component=nucleus; Biological process=regulation of transcription, DNA-dependent
  Homolog annotation: Hit_ID=Q43524; Match level="QueryCoverage=99%, HitCoverage=100%, E-value=2e-91, Identity=55%"; Hit description =Transcription factor
  Pfam annotation: Domain name=Myb_DNA-binding; Domain location=14-61; Score=47.1; E_value=5.8e-11; Accession=PF00249.21; Description=Myb -like DNA-binding domain
  Pfam annotation: Domain name=Myb_DNA-binding; Domain location=67-112; Score=50.8; E_value=4.5e-12; Accession=PF00249.21; Description=Myb -like DNA-binding domain
  Pfam module annotation: Pfam domain module=Myb_DNA-binding::Myb_DNA -binding; Domain location=14-61::67-112
MGHHSCCNQQKVKRGLWSPEEDEKLIRYITTHGYGCWSEVPEKAGLQRCGKSCRLRWINYLRPDIRRGRFTPEEEKLIISLHGVVGNRWAHIASHLPGRTDNEIKNYWNSWIKKKIRKTSSVSSTTIAQSIDHNSSDQFNYNSNLVLDHFPNHDNNLQTKPPVQETLFSSTCPLFMFDTTSSLEAGTAIDCNSTTVRAEHFQDAVGLSTETWNLSHHQVHALPPLTVSVGLDTTNYLPPLIENVDNMVPIEVQSCTMDEQGDIALECLQRRGLNEWMVETQQQCPNFLFWDSVEGQLGGEELAPNSSNVEANMLSPFPSSL

SEQ ID NO: 213232 - protein, 67 aa, Glycine max
  Coding DNA Sequence Number=SeqID_96454
MVNPFSKFHNNPTVNESGIVVLLGQILGLYGKGEGNLKQLIFMRKGVQNEMHQEELRHINLQFLKLS

SEQ ID NO: 213233 - protein, 44 aa, Glycine max
  Coding DNA Sequence Number=SeqID_96455
MPSSSNKPTEGGLGGLKGAKGTGQYKDSLKRDNRKVKLREKMES

SEQ ID NO: 213234 - protein, 167 aa, Glycine max
  Coding DNA Sequence Number=SeqID_96456
  Gene Ontology: Mol. function=nucleic acid binding; Cellular component= intracellular
  Homolog annotation: Hit_ID=Q10SE5; Match level="QueryCoverage=84%, HitCoverage=38%, E-value=4e-36, Identity=56%"; Hit description =D111/G-patch domain-containing protein, putative, expressed
  Pfam annotation: Domain name=G-patch; Domain location=15-59; Score =59.5; E_value=1.1e-14; Accession=PF01585.13; Description=G-patch domain
MAAPESPLCYVGVARQSAAFRLMKQMGWEEGEGLGKEKQGIKGHVRVKNKQDTIGIGLEKPNNWAFDTTQFDNILKRLKVQAPQSHDIEEKVETKASVPVDNEEDSVPKTTRPQGRYARRERGKLVSQYSLKDLEGILLLDSVNKFASAFDSMNQEQLVLLKIVSGL

SEQ ID NO: 213235 - protein, 244 aa, Glycine max
  Coding DNA Sequence Number=SeqID_96457
  Homolog annotation: Hit_ID=Q10SE5; Match level="QueryCoverage=34%, HitCoverage=23%, E-value=1e-10, Identity=42%"; Hit description =D111/G-patch domain-containing protein, putative, expressed
MLKTSEIQKFEDEGSKYPAIPPDWWGYKYGFVSGGFLGAESKKKKSMISGKAERTAFFEEDQENLYNLVQDMVMLNLRSMAAAAQGRVPRRNRTRYLFRHDSHSTWCRVHLSFAGHGWAVGHAQLDPSGCEHVQSSSLPHAKHAVTALRPLSLCVDREKSTTGKQGLGIKDRPKKVAGCYFQGKKKSFDDSDEDSADNDSLEQAANDDLIKVEKIVEGKVKLKKLCKQILQQVPGESLKLKQLK

SEQ ID NO: 213236 - protein, 91 aa, Glycine max
  Coding DNA Sequence Number=SeqID_96458
EDRKAREKEEKEKEGDEDKRSREKIRDSVRESQIQDPSNCCRFDLARLEVVGRPWKAKLGKESSLSKNLSNLSEKRFKEHLWDPFKGAVGE

SEQ ID NO: 213237 - protein, 299 aa, Glycine max
  Coding DNA Sequence Number=SeqID_96459
  Gene Ontology: Mol. function=sequence-specific DNA binding; Cellular component=nucleus; Biological process=regulation of transcription, DNA-dependent
  Homolog annotation: Hit_ID=Q9SUS1; Match level="QueryCoverage=76%, HitCoverage=74%, E-value=3e-27, Identity=38%"; Hit description =Probable WRKY transcription factor 29
  Pfam annotation: Domain name=WRKY; Domain location=143-203; Score =137.1; E_value=4.9e-38; Accession=PF03106.6; Description=WRKY DNA -binding domain
MDEFACLRDWDLEAIVRGSTGEAITMDDPNADFSYFFSEQDELLDSFPEFSETTRVLDDLEELYKPFYPVLHPLSPHTIVTTSLPINMEPKQVIKASEQKVAALQGLKVPAAPKCKKRGMCSSANKKSQNKSVVKQVTTAEGLDDAWAWRKYGQKPIKGSPYPRSYYRCSSSKGCLARKQVERSHLDPAVFLVTYTAEHSHPHPTRRNSLAGTTRKNNSLVPPPTTHRHQKNTNCSSKSIEVQQSMNLKKEEDFTDWLDDDSAQFVDGWIPSSDLEKLIGLECQHFALDGGFTDDFPHP

SEQ ID NO: 213238 - protein, 39 aa, Glycine max
  Coding DNA Sequence Number=SeqID_96460
MYTTHRGMQDVLPHREVMIAYGCLHGRILEYGVACLEED

SEQ ID NO: 213239 - protein, 1374 aa, Glycine max
  Coding DNA Sequence Number=SeqID_96461
  Homolog annotation: Hit_ID=Q86L37; Match level="QueryCoverage=10%, HitCoverage=10%, E-value=5e-12, Identity=31%"; Hit description =Similar to Homo sapiens (Human). TGF-beta resistance-associated protein TRAG
  Pfam annotation: Domain name=WD40; Domain location=49-102; Score =21.5; E_value=0.0029; Accession=PF00400.22; Description=WD domain, G- beta repeat
  Pfam annotation: Domain name=WD40; Domain location=525-572; Score =45.6; E_value=1.7e-10; Accession=PF00400.22; Description=WD domain, G-beta repeat
  Pfam annotation: Domain name=WD40; Domain location=576-620; Score =4.8; E_value=9.9; Accession=PF00400.22; Description=WD domain, G -beta repeat
  Pfam module annotation: Pfam domain module=WD40::WD40::WD40; Domain location=49-102::525-572::576-620
  Subcellular localization annotation: CTP_CleavageSite=15; ConfidenceScore=5.38e-01
ADRWRAYGPTRPSLTASPPSPLYPNLRLRPFTPPDPMAPSSGGPSPLPHRAVGVLCGHAAPITDLAVCSPVADAEHVYGPSGRSKFSALISACCDGFLCVWSKNSGHCRCRRKLPPWVGTPRIIRTLPSTPRYVCIACSFEGNEGVIDRETQPRKPPKCTILIVDSYSLSITQTVFHGSLSIGPISFMALVLGDDEKRNSVFVADSAGRQQTVLISEDRGESLVSSLGDKGQSESSFCYEGLSGVEQIVSVLTYGNAVAFILKDRCVFRLLNGDSVIGEVSFVDSLFGLDRGSTQMYAIGGIFLESDDVGNMCNANEYGNSITVQFVVWNNVGHAVIYNVLYQNDVFKCEPHSEIPGTHYQPDMRLSVFFLQVNQHLVCVKSVCLNHEEPLLWRPLATIWSTHDCDDEPGRLYRQCRMISDGVSFINWFEKSTQLQGLDGLETTPTFGVSPSSDDVDNTHVDSMSNYYAYKGKVVSSSMIISENLFTPYAVVYGFLSGEIEVVRFDLFHGICLDDASSNPDEKSTACKQCFSGHTGAVLCLAAHQMMGRAKSWNFKQVLVSGSMDCTIRIWDLDTGSLIMVMHHHVAPVRQIILPPSLTVYPWSDCFLSVGEDACVALVSLETLRVERMFPGHMNYPSKVLWDGARGYISCLCQTHYGTSDATDLLYIWDVKTGSRERVLRGTAAHSMFDHFCKSISMNSISGTLLNGNTSVSSLLLPIVDDAKFSNSPLNRSDNLLTSSRSSPSISNMTELNSSKTNAGKGNSVMQNSSSLIGLLSSKLPIKCSSPFPGIVSLCFDLASLMLSYPKNESMENGGGKPVNINMKQQGVQEQNPSYHNPETVEGHDLVSLFEEYLLRFSLSFLHLWSVDRELDNLLISEMKLRRPENFIVASGLQGDKGSLTLTFPAQSATLELWKSSSEFCAMRSLTMVSLAQRLISLSHSGSAASRCYGSSAQFLYVLPLLVAFWQDESEHVRMAARSIFHCAASHAIPLPLCYSKPTDSNNMGSQTGSRDKHLGNMAEESISPKAENQGISQDEESKILAWLESFEVQDWISCVGGTSQDAMTSHIIVAGALAIWYPSLVKPSLGMLVVHPLMKLAMAMNEKYSSTAAELLAEGMESTWKECIVSEIPRLIGDIFFQVELSGPSSKLVKEISDASFSIKKTLVEVLLPSLAMADIPGFLTVIESQIWSTASDSPVHMVSLLTLIRIMRGSPKNSAQYLDKVVNFILQTIDPSNSVMRKACFQSSMTTLKEVVRVYPMVAVTDSWTKLAVGDVIGEINNARIRVLISWYQSLSPCLGLVKGQVHSQPTWGTGAAEHGGMLGSNCKCDNGKGFGCKWASWTSNSAPSSNFRNNVDYCNFSTELFTRWRGTNILC

SEQ ID NO: 213240 - protein, 189 aa, Glycine max
  Coding DNA Sequence Number=SeqID_96462
MDPVELPLPVDVAAAPKLMGSEDVASIKTAAEFPSCNKFVETQLSKNSSLLPHLKGEEASKNMPSGNGRNCPVINSRLEGVPFQRKSAKSNRSNSSCSKRPRMSQPEDSLSPNGIEESKDISDKLGSHNLNCTSPEKNQLPKQKSNSSKRGDKRNFKVPSAKAKFESSSMKMGASIFSSTSGGNNFFGM

SEQ ID NO: 213241 - protein, 368 aa, Glycine max
  Coding DNA Sequence Number=SeqID_96463
  Gene Ontology: Mol. function=phosphoprotein phosphatase activity; Cellular component=nucleus; Biological process=carbohydrate metabolic process
  Homolog annotation: Hit_ID=P48488; Match level="QueryCoverage=85%, HitCoverage=98%, E-value=1e-178, Identity=92%"; Hit description =Serine/threonine-protein phosphatase PP1
  Pfam annotation: Domain name=Metallophos; Domain location=54-249; Score=157.2; E_value=4.4e-44; Accession=PF00149.18; Description =Calcineurin-like phosphoesterase
MDENVLDDIIRRLLAAKNGRTTKQVLLTEAEIRQLCVSSKEIFLSQPNLLELEAPIKICGDVHGQYSDLLRLFEYGGYPPEANYLFLGDYVDRGKQSIETICLLLAYKIKYKENFFLLRGNHECASINRIYGFYDECKRRFNIRLWKTFTDCFNCLPVAALVDEKILCMHGGLSPDLKHLDQIRSIARPIDVPDHGLLCDLLWADPDKDLDGWGENDRGVSFTFGADKVAEFLEHHDLDLICRAHQVVEDGYEFFAKRQLVTIFSAPNYCGEFDNAGAMMSVDDTLTCSFQILKSSEKKGKCGFGNNTSRPGTPPHKSNITGETIMIAEAMQSRVGRINIPELYKAYRSAAWHSQHIKHDAFPPWQRN

SEQ ID NO: 213242 - protein, 224 aa, Glycine max
  Coding DNA Sequence Number=SeqID_96464
  Gene Ontology: Mol. function=translation initiation factor activity; Biological process=cellular metabolic process
  Homolog annotation: Hit_ID=Q84YD9; Match level="QueryCoverage=82%, HitCoverage=79%, E-value=7e-29, Identity=42%"; Hit description =Hypothetical protein 15C
  Pfam annotation: Domain name=DUF567; Domain location=38-218; Score =189.0; E_value=1.2e-53; Accession=PF04525.3; Description=Protein of unknown function (DUF567)
MRVFSRFKFLSRAVHEEQEGEHDGGEKIKYPLTEGNLCTSLTLTVWRKSLVISCKGFTVIDPYGNLVYRVDNYIVHPNEVILMDASGNSVLTLRRSRKLGLVDSWFVYEGEMGKQKVKSRDSPVCCVRKRVNILDGKPKVQAYVYRVTSDSDKRHAAFTIEGSYAHRTCKVLDEYKKAVAEIKRKEANTKDVSFGIEIFQLVVHPGFDTSFAMALVLLLDQMFS

SEQ ID NO: 213243 - protein, 35 aa, Glycine max
  Coding DNA Sequence Number=SeqID_96465
MSEGQSCIVNVDWIKVQMRLDGTNNHHEETKWRTE

SEQ ID NO: 213244 - protein, 386 aa, Glycine max
  Coding DNA Sequence Number=SeqID_96466
MLPGLYGLKHDFHDVTKLIDEPPLDELLRGTFECPILSKDKGKKTSSVSDSFLNSVRKACSILQCPKPVQSQNMTEMDYSSNMKMSTCQLSSVCAVESVGNGDKEQSCTLDMSSCQKDHCSEVESTTSPLDFPLHQPKDVLERIALHPFQDLESLLLDVSKPAVTTKNGIDQRSGKQVSRRPSLPTFPWSHAFGGHSRTNSDTEFGGPADTKENDERCPRVLTAAQTLCEIATHSQRQNSDGILRWQRKTSQKTMKACHYKSNEKLEETSSRPISMIGSDMVARSVEQIMPSKKPRLSIVENKNSGYSNIAKKGHIVWPISKSSRSFPSKQVRDSFVENKRTNASILKQHCMMPPPARGLDKTRDGQQQVGKLVVMDWKRGRDNTD

SEQ ID NO: 213245 - protein, 909 aa, Glycine max
  Coding DNA Sequence Number=SeqID_96467
  Gene Ontology: Mol. function=oxidoreductase activity; Cellular component=integral to membrane; Biological process=electron transport
  Homolog annotation: Hit_ID=Q9XEG2; Match level="QueryCoverage=99%, HitCoverage=96%, E-value=0.0, Identity=69%"; Hit description=NADPH oxidase
  Pfam annotation: Domain name=FAD_binding_8; Domain location=618-734; Score=202.1; E_value=1.3e-57; Accession=PF08022.2; Description=FAD -binding domain
  Pfam annotation: Domain name=Ferric_reduct; Domain location=420-577; Score=161.8; E_value=1.7e-45; Accession=PF01794.9; Description =Ferric reductase like transmembrane component
  Pfam annotation: Domain name=NADPH_Ox; Domain location=158-257; Score= 220.0; E_value=5.4e-63; Accession=PF08414.1; Description=Respiratory burst NADPH oxidase
  Pfam annotation: Domain name=NAD_binding_6; Domain location=740-909; Score=197.0; E_value=4.6e-56; Accession=PF08030.2; Description =Ferric reductase NAD binding domain
  Pfam module annotation: Pfam domain module=FAD_binding_8::Ferric _reduct::NADPH_Ox::NAD_binding_6; Domain location=618-734::420 -577::158-257::740-909
MNGIPRHERRWASDSVPGKATVSAGTSPGTESNSAAEEFVEVTLDLQDDDTIVLRSVEPASVISIDDSVAGSGNQTPASVSRSPTIRRSSSRGFRQFSQELKAEAVAKARQFSQELRRFSWSHGHASRALSSSSAPNGAGAGFETALAARALRKQRAQLDRTRSGAHKALRGLKFISNRSNGVDAWNEVQSNFDRLAKDGFLNRTDFAQCIGMKDSKEFALELFDALSRKRRLRTDKISREELFEFWSQITDQSFDSRLQIFFDMVDKNEDGRITEEEVKEEQAEEYAALIMEELDPEGLGYIELPSGLSASSPVRRTHLIEHLWQLETLLLQKDTYLNYSQALSYTSQALSQNLQGLRKKSPIRRMSRRLVYYLQENWRRLWVLTLWVSIMIGLFTWKFIQYKNKDAFQIMGYCLLTAKGAAETLKFNMALILLPVCRNTITWLRSTKLGYVVPFDDNINFHKTIAGAIVIGIILHAGDHLACDFPRLVSTSEERYEKYLKGVFGDHKPSYVDLVKGVEGVTGILMVFLMIIAFTLATKWFRRNLIKLPKPFSRLTGFNAFWYSHHLFVIVYVLLIIHGIKLYLVHKWYHKTTWMYLAVPVLLYASERILRLFRSGLYTVRLGKVAIYPGNVLTLQMSKPPQFRYKSGQYMFVQCPAVSPFEWHPFSITSAPGDDYLSVHIRQLGDWTQELKRVFSEACEPPVSGKSGLLRADETTKKSLPKLKIDGPYGAPAQDYKKYDVLLLVGLGIGATPFISILKDLLKNIIKMEEMADSISDISRGSDLSVGSTTDSPSLNKNAPKRKKTLKTTNAYFYWVTREQGSFDWFKGVMNEVAELDQRGVIEMHNYLTSVYEEGDARSALITMVQALNHAKNGVDIVSGTRVRTHFARPNWKKVFSKMCSKHCNGRI

SEQ ID NO: 213246 - protein, 147 aa, Glycine max
  Coding DNA Sequence Number=SeqID_96468
MKRSIEAKDRMLSVLSEKISSYVALFDSIEKEAFSIKQIVDKVQNVVNDREEVVAGLRNKMDWVSAFEKEFVENISDLRNKLENNESELRRKDRIISELEAKLDVAKVCNHNQAQMEDISIPALNIYLSNTKILFALSSMGSFLIFS

SEQ ID NO: 213247 - protein, 124 aa, Glycine max
  Coding DNA Sequence Number=SeqID_96469
MQFTSVVELPHLINIVDLLAEALVHVDVALVDRDSGAVKDGLGDVVVVVGAADDIEADVVDDDDERVGVRRQFDKGGDGAGASKGADEGGDEGKEGEGVGRCGGGGFRWRREGREKGKKVMTWC

SEQ ID NO: 213248 - protein, 156 aa, Glycine max
  Coding DNA Sequence Number=SeqID_96470
GQKQGNVALPAGLRKHLGKARSAAVPPPPPPALVSSKRRDDSLLQQHDWIQGAILLCKNSFNASPECEISQLPRSVSDGSPELSENSKNDRVPLRYNIINFHVPGTHRRNITIVSRDDGKCGQRSGKDGDMSSESEIFWVKGREGKVLLTVAQFTK

SEQ ID NO: 213249 - protein, 231 aa, Glycine max
  Coding DNA Sequence Number=SeqID_96471
  Gene Ontology: Mol. function=helicase activity; Biological process =viral genome replication
  Homolog annotation: Hit_ID=Q1SN45; Match level="QueryCoverage=99%, HitCoverage=13%, E-value=1e-47, Identity=43%"; Hit description=AAA ATPase
MFTTWMHSNKIYSYGRDLTYHQYISRFVYVARKRCWQPIKQGNTIGRLIWVPPSAGELFYLRMMLSTAKGAQSYSDIRTINGLVYPTFREACFAKGFLGSDQEFISALQEANNWGTAHYLRKLFVKLLFMNTMDRLEYVWQQTWQWMADDIIFNHRKQGIRITEKETIHLCLTEIENMLQANRRSLRDFPSMSYPIGYARNQHHNNLIHNEMAYDKEMLAEQYNTTYQLLT

SEQ ID NO: 213250 - protein, 86 aa, Glycine max
  Coding DNA Sequence Number=SeqID_96472
MTIEESIHVFFDETNYIRQRKDILDDITDTLEDTHIHEEVHKDKEDGNSIDSQSKENQINMDLQREWRTSRYHPLDNITGEKEAKS

SEQ ID NO: 213251 - protein, 124 aa, Glycine max
  Coding DNA Sequence Number=SeqID_96473
MTKLGLCLSSGPPPLDDKRVRITIRMTKLGLCLSSGPPPLDDKRVRITIRMTKLGLCLSSGPPPLDDKRVRITIRMTKLGLCLSSGPPPLDDKRVRITVRYLRVSWVQNDQTWSLLVIGPAASG

SEQ ID NO: 213252 - protein, 52 aa, Glycine max
  Coding DNA Sequence Number=SeqID_96474
MNPKPEGPDEVGLATSPSTLSKTALPVNILIAISQTSTNHSSSGKTLPFTGS

SEQ ID NO: 213253 - protein, 84 aa, Glycine max
  Coding DNA Sequence Number=SeqID_96475
  Gene Ontology: Biological process=cell adhesion
  Homolog annotation: Hit_ID=Q8RWC5; Match level="QueryCoverage=80%, HitCoverage=16%, E-value=6e-13, Identity=53%"; Hit description =Fasciclin-like arabinogalactan protein 16 precursor
MLDVGRAIHLRHALREDDRDSNKVTTTVEILLDGLRDNEALDTMDDAVDTKYLNGVDDYLARGLRGQMQVVVGESVGRSTTSQW

SEQ ID NO: 213254 - protein, 116 aa, Glycine max
  Coding DNA Sequence Number=SeqID_96476
MLSTSSYSVFTRSFLPNPIKGIPRPATLRPFPGILESHAKSPKNRLSILCFRHDHHSPETPQPEVIEHYLHEELVQSEFNDSSVTKRDWKSTIQKKFHEKRVSEDNNNNNNNALSH

SEQ ID NO: 213255 - protein, 53 aa, Glycine max
  Coding DNA Sequence Number=SeqID_96477
  Homolog annotation: Hit_ID=Q9SEH1; Match level="QueryCoverage=61%, HitCoverage=6%, E-value=5e-10, Identity=90%"; Hit description=Gamma -glutamylcysteine synthetase precursor
MNFFYYAVLSFMRPSSCFFVVCMKGVTPAERLLELYHGKWEQSVDHVFEELLY

SEQ ID NO: 213256 - protein, 273 aa, Glycine max
  Coding DNA Sequence Number=SeqID_96478
  Gene Ontology: Mol. function=protein-tyrosine kinase activity; Cellular component=integral to membrane; Biological process=protein amino acid phosphorylation
  Homolog annotation: Hit_ID=Q1RY61; Match level="QueryCoverage=96%, HitCoverage=53%, E-value=1e-118, Identity=75%"; Hit description =Protein kinase
  Pfam annotation: Domain name=Pkinase; Domain location=9-256; Score= -22.8; E_value=3.3e-07; Accession=PF00069.15; Description=Protein kinase domain
  Pfam annotation: Domain name=Pkinase_Tyr; Domain location=9-256; Score=-63.6; E_value=1.4e-08; Accession=PF07714.7; Description =Protein tyrosine kinase
  Pfam module annotation: Pfam domain module=Pkinase::Pkinase_Tyr; Domain location=9-256::9-256
MWSIKGNLIIRCELLSNGSTEMLGLKRNHFCVEKKVLALFPDSDPSFEEARAVGQLRNQRLINLLGCCCEGEERLLVAEYMPNDTLAKHLFHWETQPMRWAMRMRVALCLAQALEYCTSKGRALYHDLNAYRVLYDDEYNPRLSCFGLMKNSRDGKSYSTNLAFTPPEYLRTGRVTPESVTYSFGTLLLDLLSGKHIPPSRALDLIRDKNLQMLSDSCLEGELTNDDGTELVRLASRCLQSEPRERPNPKSLVAALIPLQKDSEVSWFESGSA

SEQ ID NO: 213257 - protein, 248 aa, Glycine max
  Coding DNA Sequence Number=SeqID_96479
  Gene Ontology: Mol. function=glutamate-cysteine ligase activity; Cellular component=chloroplast; Biological process=glutathione biosynthetic process
  Homolog annotation: Hit_ID=Q9SEH1; Match level="QueryCoverage=97%, HitCoverage=40%, E-value=1e-109, Identity=81%"; Hit description =Gamma-glutamylcysteine synthetase precursor
  Pfam annotation: Domain name=GCS2; Domain location=1-186; Score=-1.4; E_value=3.6e-08; Accession=PF04107.4; Description=Glutamate-cysteine ligase family 2(GCS2)
MIRKFRAGLALQPIATALFANSPFKEGKPNGFFSMRSHIWTDTDKDRTGMLPFVFDDSFGTTHEDFMETKEYGERTRFQQYVDYALDVPMYLVYRKHRYIDCTGKTFRDFLAGRLPCIPGELPTLNDWENHLTTIFPEVRLKRYLEMRGADGGPWRRLCALPAFWVGLLYDEVSLQSVLDMTADWTPEERQMLRNKQRSLFMLDVYTKLLTTSLWQVPVTGLKTPFRDGLLKHVAEDVLKLAKGIQLF

SEQ ID NO: 213258 - protein, 134 aa, Glycine max
  Coding DNA Sequence Number=SeqID_96480
  Subcellular localization annotation: CTP_CleavageSite=17; ConfidenceScore=5.40e-01
MSASNPLSHFGTFTTPKARLIGNVPKVLLKATSKIIRVFFFNTFTSAIRYLVYVRKHLIEVEGGVYTQRRGRSLELEGRASGKMTEEEGIDWCNLWNCYVPAKVTTFVWKLLQNRIPTKDNLAQRGVIQQGDKM

SEQ ID NO: 213259 - protein, 232 aa, Glycine max
  Coding DNA Sequence Number=SeqID_96481
  Gene Ontology: Mol. function=glutamate-cysteine ligase activity; Cellular component=chloroplast; Biological process=glutathione biosynthetic process
  Homolog annotation: Hit_ID=Q9FVM6; Match level="QueryCoverage=91%, HitCoverage=67%, E-value=1e-96, Identity=84%"; Hit description=Gamma- glutamylcysteine synthetase
  Subcellular localization annotation: CTP_CleavageSite=61; ConfidenceScore=5.55e-01
MVVFSRSATTTTTTTTTYTRHNLIRQTKTCVGNNNSLCYSATKKAPPQRILGGARGSRVILAASPPTEDALVATDPLTKQDLVDYLASGCKPKDKWRIGTEHEKFGFEFGTLRPMKYDQIAELLNGIAERFDWDKVMEGDKIIGLKQGKQSISLEPGGQFELSGAPLETLHQTCAEVNLHLYQVKAVAEEMGIGFLGIGFQPKWGIKDIPIMPKVVFFSLLVFQDLELLNTC

SEQ ID NO: 213260 - protein, 117 aa, Glycine max
  Coding DNA Sequence Number=SeqID_96482
  Gene Ontology: Cellular component=chloroplast
MGDKLHRREGNSPDHQLRPLNDRSVIKEMNGAKRSAEAVGCKKESVGERSALEGRTRASSAGRSGSENVGLSNANVGENPMPRKPKGSSARPKGVVDGQQVNIPVLPFVGPEGRRRL

SEQ ID NO: 213261 - protein, 94 aa, Glycine max
  Coding DNA Sequence Number=SeqID_96483
ANIEKKKEAPPIECKEKLEITLPFGEALQQMPFYAKFLKDMLTKKNLYIHSDIIVVEELCMSRVSRERKFQVPESFERFCCVKICRDQSLKQEQ

SEQ ID NO: 213262 - protein, 85 aa, Glycine max
  Coding DNA Sequence Number=SeqID_96484
MEEEKAAAYYDKVTRKGERAARFKQGLEFSSSAPNDDVAKPSSSFLSKFIKASSESKMEAQLQSIHDRLKEKPSFESRVSSRDRD

SEQ ID NO: 213263 - protein, 57 aa, Glycine max
  Coding DNA Sequence Number=SeqID_96485
MASDPGRLFKYFYAIILHKHCAAREAKRWLHSFKGNSLKTWDEVVEKFLKKYFQSLR

SEQ ID NO: 213264 - protein, 102 aa, Glycine max
  Coding DNA Sequence Number=SeqID_96486
MKFPTNNLADFEPCIGYATEGQAVGGIPLQNTLEGPQYHPQPQPSHSTVVKNPHAMAEMGKRKGSGLLKEVLDFDKYKGTTFPKNHPKMYCRKIRAYAKMRN

SEQ ID NO: 213265 - protein, 160 aa, Glycine max
  Coding DNA Sequence Number=SeqID_96487
MKILKRYTKNLHYPEASIVERYIAEEVIEFCSKYIEKEKLVGLSKSRHDEKVRVCHETLVRESNPKMNKNRVLKKHNKTFLNLFKDTLFGNNNVSETLRKWLVVLHGKTIGINLEGDDSTLDTCFTPFSTQMPNINGEEEVDEIHANRNDHDEGELINNI

SEQ ID NO: 213266 - protein, 73 aa, Glycine max
  Coding DNA Sequence Number=SeqID_96488
  Subcellular localization annotation: CTP_CleavageSite=49; ConfidenceScore=5.43e-01
MARKPRQDFSVSKPKFQTALFSLSLTLPFFPPSFSIEAPNKSPPFGIISAPIAKGGHFRSREVCVYEWDFEIS

SEQ ID NO: 213267 - protein, 258 aa, Glycine max
  Coding DNA Sequence Number=SeqID_96489
  Homolog annotation: Hit_ID=UPI00005274EB; Match level="QueryCoverage =48%, HitCoverage=27%, E-value=7e-22, Identity=40%"; Hit description =major facilitator superfamily MFS_1
PGAEAVNAAHHAEVEQRVEQVFLVLHPFQEVAQRDFRAGFGAAGVAHQPGLFLHVQITNVLGRVLDEERDQQADDDRRQPFEDKQQLPGGEPEPVMLNIENKAGNRRADGVGQRLDDDEHAENFGAEIADKENPGGEAEGRGGQAQRQFPDSAAFNILRLAYFHFDISNVVNRNNRGPAHYPELNTLLFHLAGGFDRAPADDRRREEKLAGRLRIIVDAADQALDHQLRHLRQRRPDGRQPRFGQAGQRDIVDADYRD

SEQ ID NO: 213268 - protein, 38 aa, Glycine max
  Coding DNA Sequence Number=SeqID_96490
MASLMTCGGTLWFYFHHPETFKPDDAQDSSLLGRDDRV

SEQ ID NO: 213269 - protein, 165 aa, Glycine max
  Coding DNA Sequence Number=SeqID_96491
  Subcellular localization annotation: CTP_CleavageSite=33; ConfidenceScore=5.44e-01
MNVGALISGQITSMAQSNSSRLGFPTLITTLCRSRGVASDSLVFERLSPVINLAYIRKNCWNPDDLTVTIKGARRARARLAEAPSTSATPPPARTLAAPSTPSSTDSQHLEAMLRSIHQGHIVLLQSLQLVAPPDSIPSIEQFNEWVAWPGTQPPFHREDEGLTA

SEQ ID NO: 213270 - protein, 351 aa, Glycine max
  Coding DNA Sequence Number=SeqID_96492
  Gene Ontology: Mol. function=binding; Cellular component=microtubule cytoskeleton; Biological process=establishment and/or maintenance of cell polarity (sensu Fungi)
  Homolog annotation: Hit_ID=Q94FN2; Match level="QueryCoverage=61%, HitCoverage=10%, E-value=3e-87, Identity=74%"; Hit description =Microtubule organization 1 protein
MPTSPSENQTRWRKHKRDSQISQRHQKHEEEDDGDKENPNEKEDLTKCDYDSEDQMHHNHPNSQPHVETEVLSDHGVQMSQFPIVIKRFVNLPHSSVTAIVSLERALESGENKARSALEHKPPPSNNDNKGLFNHPWVTCPVIPVLRMSDAMEKAIKNKVAKAVVPTIDVMFQALSDFGAKIVPPKRILKMLPELFDHQDQNVRASSKGLTLELCRWIGKDSVKSILFETMRDTMKKELEAELVNVTGTTKPTRKIRSEQDKEPNQEAVSEVVGPGPSEESGNDAPQEIDEYELVDPVDILTPLEKSGFWDGVKPTKWSEQKEVVADLTKLASTKRISPGDFSEVCRTLKK

SEQ ID NO: 213271 - protein, 188 aa, Glycine max
  Coding DNA Sequence Number=SeqID_96493
MDMVAIMVGEDMVGVMACQRQQQAKQQQPVFETSQDGAHHKQPLVQPTVAEFATFHLHDVARGCVRDNREREFETLVQIDQMSVMEYNVQFMVIAGHGDMTYDEALNRALTIEAMVVEILEIILINIGEANMEVDCRSGVATPMVQMGQSSGCRSRALNGPHRGGRGSGGRGQGQTSGGQAHVFILTH

SEQ ID NO: 213272 - protein, 62 aa, Glycine max
  Coding DNA Sequence Number=SeqID_96494
  Subcellular localization annotation: CTP_CleavageSite=66; ConfidenceScore=5.08e-01
APTTTAHTRPATKREKAHFFSSLKKHELRVCLFLSHSPLSFLQGAERRSSSCSSSLLEGYVP

SEQ ID NO: 213273 - protein, 236 aa, Glycine max
  Coding DNA Sequence Number=SeqID_96495
VERPLVNVDPFTEKVPDAQKDLIWEDIQLDLTSKWALAQWKDKWNQFCQSSKDPSWEDVRKKAQSIQKQNTAPHMLSCGVVVDPLSPIRRHMKWKLASTKKSGQMTSEEARQIANKIGSFVAHGRQDMLTTAIRRTEHLDRVRVAGVDLNTDASDKHWLYVNDNTPRHIALGIINGGSTIVHHLPMGNDMVKLGVEEVPDSDARIPIPTEDVQLVGQALTPSLLRRNILYKPFGKK

SEQ ID NO: 213274 - protein, 149 aa, Glycine max
  Coding DNA Sequence Number=SeqID_96496
  Pfam annotation: Domain name=WRKY; Domain location=1-35; Score=-10.2; E_value=0.013; Accession=PF03106.6; Description=WRKY DNA -binding domain
MAKGNPCPRANYRCTMAAGCPVPKQSVNNYHKQLLILLRMILCVYVNLFGPLGWSTLSIEDVMGLTIEEDRAKDHMGRVVRVAEALDANVKRWSRTLHHTYGEGKSFEVISINFGVETKGWKVETKNGSRGVLTSPWSTPCYAMKVWLQ

SEQ ID NO: 213275 - protein, 117 aa, Glycine max
  Coding DNA Sequence Number=SeqID_96497
MTPHLGKQCSNYQGHPVVHCNSPSPSVISLGHKGVPYQGHPTRSAHPPMNIHNIQRINMGVIKYMAMDELKLLASPQKCLNSLTTLVSHARDIRQGHCTPYEHIEHPTYETWVSSSR

SEQ ID NO: 213276 - protein, 179 aa, Glycine max
  Coding DNA Sequence Number=SeqID_96498
  Homolog annotation: Hit_ID=Q47336; Match level="QueryCoverage=19%, HitCoverage=40%, E-value=8e-15, Identity=100%"; Hit description=LacZ- alpha peptide
DAGSRQARQGASAGVGGCRGWLNYAASEQIVLRVHHMRAIGAGLFAITPAGERGMCCKAIKLGNARVFPVTTLIPGFEHSQIELKSEQKAGSNYLVKKQPKKPLARASQEPVGSDFSSGATLATIADVQPTSHLMQGGRCERSGNLDVGKPVVPAALMNRPTRGERRFAYWALFRFLAH

SEQ ID NO: 213277 - protein, 180 aa, Glycine max
  Coding DNA Sequence Number=SeqID_96499
MAFFQSYLDYKAQNAQGVTLITNLCKARGVQSDSRSLESLSPSINLAYIKKNYWNLDDPIVTFRGPRKVAWPSAQPSLSGGGGASATQEPEPEEPAAAAEGEDELTPPEPFYFDSGVQMAQKDETSTDQIRKPSPVPIPDESMPSSPASELEQHIPQNSPAAQLLDLNEHAQEQSQEQDI

SEQ ID NO: 213278 - protein, 70 aa, Glycine max
  Coding DNA Sequence Number=SeqID_96500
MGSDGIVQFSIIIVVRSTRNCVFVHVSSTREFGAISSDCLVQFSIFNLFSEPHELRFRSCVLHPRVRSHA

SEQ ID NO: 213279 - protein, 253 aa, Glycine max
  Coding DNA Sequence Number=SeqID_96501
  Subcellular localization annotation: CTP_CleavageSite=48; ConfidenceScore=5.42e-01
MDVWGANTFPVRKYNSRTFHLKVRRSRLFRFFRRFPQINVGGDSVRIPFMEHASRESRVALPPKVPTAAICSSKGMIPLETIKRDMSTLGITAKSLGHGANTLRAIFHTAMHEYHIPFCLCSALHMGSVLIPSINKPTEGPCRLLKNVRWGILLPLDVVSKKGTNSPDPRIPKLHLCHMHSIMHSSISPRRYRSFDLHQLLSHFSKHGNKSNRQEVLPSQGQKPRYHQHQGIRAVDGTPPNATFRKTYGKILE

SEQ ID NO: 213280 - protein, 56 aa, Glycine max
  Coding DNA Sequence Number=SeqID_96502
NTNGNDADVALEFSPLKTVQFGNPSQDTVDPRDGGFGDGNGKNESRQYIEGLMDLE

SEQ ID NO: 213281 - protein, 173 aa, Glycine max
  Coding DNA Sequence Number=SeqID_96503
MAPAVMHTGQDFARDRCREPGADRAHQHDHFDPDVDDTTAQQCMPPTRHPLEPDKSNRALGFLALITGLCQSFGVPVSPSKVIRPPITRAFIEKYCTPRQAQGDAHQTANAPPPPRQADPAGSLGMERYLQHLVRQQAANHRGQVQIHECLYRFSLSQQGQVSQPTLQREGDA

SEQ ID NO: 213282 - protein, 137 aa, Glycine max
  Coding DNA Sequence Number=SeqID_96504
MLRNFTDCATILFLTSGMLRSFTDCATMLVLTSRMLRDFTDYTTMGVKNFEVVKRRSHANKQWSPDEIRGDLLEAPNLLPMKGLFVTKFESNEMLLSPIALKLVFTLLLDSNSSRDGTNPPFQFPIWQLASKETKRQ

SEQ ID NO: 213283 - protein, 79 aa, Glycine max
  Coding DNA Sequence Number=SeqID_96505
MDNHSWYYPACAQCHRKTDIQTGPFTCGCDKDNDQPVLRYRVEVMVTQNNESGKFLLWDRECAKLIGQTADGVNRVKIE

SEQ ID NO: 213284 - protein, 75 aa, Glycine max
  Coding DNA Sequence Number=SeqID_96506
MWVQAIGLFAQATCTPEFGLPRPFNQKLLMLHICRFFHSSLLQGCENKTTIDTSKPYTGAMRGTMHKPQANLGAD

SEQ ID NO: 213285 - protein, 82 aa, Glycine max
  Coding DNA Sequence Number=SeqID_96507
MSSHQLDGSIKESHFIYSTVVQLLPRMKVHNHHRYQPHGNNLNVSTRHSHLEKLDNKCRGYPVMHKQLPSMVIRLSLKGVLN

SEQ ID NO: 213286 - protein, 157 aa, Glycine max
  Coding DNA Sequence Number=SeqID_96508
MVRTRGIGRALARVIGRGRQDEHEAVDVTWRRRPTASAHRQRVHIAVDKGVSQVTEDVPHMAEDVLQMTEDVPHMADDVPQMSEDAPQMTADVDATVVEDLGCDGVEGHVAHAIWIGQERPELKLVSHGRKVAFVGFEEEIIKKTEERRKTIRMQRK

SEQ ID NO: 213287 - protein, 173 aa, Glycine max
  Coding DNA Sequence Number=SeqID_96509
  Gene Ontology: Mol. function=dipeptidyl-peptidase activity; Biological process=proteolysis
  Homolog annotation: Hit_ID=P27509; Match level="QueryCoverage=56%, HitCoverage=36%, E-value=1e-23, Identity=62%"; Hit description =Hypothetical protein in pqqA 5'region
  Pfam annotation: Domain name=Peptidase_M19; Domain location=4-173; Score=-113.1; E_value=0.00014; Accession=PF01244.11; Description =Membrane dipeptidase (Peptidase family
MLIKTFDGHNDLLLNLWLHHRDDPAAAFFTGIEKGHLDFPRMQQGGFAGGLFALFVPPQRYVSEVAPQLAGEAWQPLEILWQQLEILKTLVARSDGRARLCLSTADIAACRRDGVLAMVAHIEGADGFDGDGADLAAFWQAGVRSIGPFWIWKIALALASPAHFPVRRIAVRD

SEQ ID NO: 213288 - protein, 55 aa, Glycine max
  Coding DNA Sequence Number=SeqID_96510
MATPMSTTCYLDKDETGLWYHNFSTLAPPLNELVWELSCCKVGVTTRLVATISTL

SEQ ID NO: 213289 - protein, 84 aa, Glycine max
  Coding DNA Sequence Number=SeqID_96511
  Gene Ontology: Mol. function=DNA binding; Cellular component=nucleus; Biological process=regulation of transcription
  Homolog annotation: Hit_ID=Q0PJJ9; Match level="QueryCoverage=52%, HitCoverage=15%, E-value=1e-20, Identity=100%"; Hit description=MYB transcription factor MYB92
MEQGVGILGALLQYLLPFYKGREKRGPFSCIVQVSESAKKWEGLLVVPKWGCTKVHGLLKKMHCLPSISKLMEKANGNHYPKKQ

SEQ ID NO: 213290 - protein, 167 aa, Glycine max
  Coding DNA Sequence Number=SeqID_96512
KTDLTPSCMLHSARGDIAQLVELRSCNWVVAITEDRNMPLKDSTETKTGCPERRGVGGSPRVSSFGILGREIKLALANSLMPYLPFNPLSEMWQKEKRIHGPTPSSPPRKNYEITPKDTFGIQGSRTDHRTLFKKAERISYPLSGGRGKLSVPGSPVAGSSGTTRIL

SEQ ID NO: 213291 - protein, 316 aa, Glycine max
  Coding DNA Sequence Number=SeqID_96513
  Gene Ontology: Mol. function=N-acetylglucosamine kinase activity; Cellular component=cytoplasm; Biological process=N-acetylglucosamine metabolic process
  Homolog annotation: Hit_ID=Q2K3Z6; Match level="QueryCoverage=98%, HitCoverage=95%, E-value=1e-64, Identity=44%"; Hit description =Putative transcriptional regulator protein, ROK family
  Pfam annotation: Domain name=Glucokinase; Domain location=16-316; Score=-226.4; E_value=0.02; Accession=PF02685.6; Description =Glucokinase
  Pfam annotation: Domain name=ROK; Domain location=17-207; Score=81.6; E_value=2.4e-21; Accession=PF00480.10; Description=ROK family
  Pfam module annotation: Pfam domain module=Glucokinase::ROK; Domain location=16-316::17-207
MHDRSTRQSQRSGTVLAADVGGSFIRLARSTHPGNIELLEKLPTPADSWEEFGRALETALRTHASKEEWPLALSIAGLVDPDTTTALSANIPCITGHKLSLELGERLQRRVIAANDADCLTLAEAIEGAGKGHDIVFCAVLGTGVGGGLVVDGRLVRGKGGLTGEWGHGPILNTSVDLDGQTVLVPRFSCGCGQSGCVDTVGGARGIERLHRLLNAADATSHEIIQDWLDGCQMAGRTISAYLQLVADPLAAVVNVTGTSIIPVGGGLATASELISAIDEAVRARILRKTEQPIVVPGIFGSDGGLVGAAILGHQA

SEQ ID NO: 213292 - protein, 144 aa, Glycine max
  Coding DNA Sequence Number=SeqID_96514
MGKTHEFTHHNLADFEPCLGYATEGQAVGGIPLQNPSMEKWWVTNLQALWNWSLPAKGSKWVWKEANLIIPLMNAKTGANEEDENEGETFAMTGIPTRSNFPSAQQCHYSANNSPSHPIIHKSHPQISHKACLLTTRPMPKHHL

SEQ ID NO: 213293 - protein, 286 aa, Glycine max
  Coding DNA Sequence Number=SeqID_96515
  Gene Ontology: Mol. function=chitin binding; Cellular component =extracellular region; Biological process=chitin metabolic process
  Homolog annotation: Hit_ID=UPI000044A8F0; Match level="QueryCoverage =97%, HitCoverage=99%, E-value=3e-39, Identity=28%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
RAACPRLQRTTHLRHQRATRPHLQGTTRPRHQRAVALTFRGLHVIALRGLHVLTFRGLHVLTFRGLHASAFRGLHVLVFRGILALAFRGLHVLAIRGLHALTFRGLHVLAIRGLHALTFRGLQVLAIRVLHALTFKGVHILSFRGLHVLTFRGLHVLTFRGLHALAFRGLHVLVFRGLLTLAFRGLHVLTIRGLHALTFRGLHILAIRGLHALTFGGLHVLAIRGLHVLTFKGLHILTFRGLHALAFRGMHALAFRGRHILSLEGCMSSPLEGYASSLSVGSISTP

SEQ ID NO: 213294 - protein, 61 aa, Glycine max
  Coding DNA Sequence Number=SeqID_96516
  Gene Ontology: Mol. function=RNA-directed DNA polymerase activity; Biological process=RNA-dependent DNA replication
  Homolog annotation: Hit_ID=Q1T2D5; Match level="QueryCoverage=91%, HitCoverage=3%, E-value=8e-16, Identity=64%"; Hit description=Chromo
MEPELAMILYTYRTVFDLPSGLPPSRTHNHSIPLVEGAGPVKVKPYRYPHSRKDQIEITGP

SEQ ID NO: 213295 - protein, 252 aa, Glycine max
  Coding DNA Sequence Number=SeqID_96517
  Gene Ontology: Cellular component=membrane
MGEWIVGAFINLFGSIAINFGTNLLKLGHNERERHLLGSDGVNGKMNLKPIIYFQSWRIGIVFFFLGNCLNFISFGYAAQSLLAALGSVQFVSNIAFAYFVLNKMVTVKVLVATAFIVLGNVFLVAFGNHQSPVYTPEQLTEKYTNISFLLYLLALISIVALHHSIYKRGELLLGVSGHDLRPYWSMLLPFSYAVVSGAVGSCSVLFAKSLKSNPLHHLETPWGMGSTYKTRPSLDNWSFEPWVIAYCWGTI

SEQ ID NO: 213296 - protein, 266 aa, Glycine max
  Coding DNA Sequence Number=SeqID_96518
  Pfam annotation: Domain name=DUF247; Domain location=37-266; Score= -132.8; E_value=0.00033; Accession=PF03140.6; Description=Plant protein of unknown function
MTSNFTIEQRLEQLQKAKEEAQPQPPKKAMQNPTCSTSSPRPKAFHQALRAETDIILGPIHHGAPKLQLGEQYKQRWAARYIDTTGQTPQDLHNKVLKDIGNLNNLFDDDLLTASAQERQDYILIMPWKVPEARRCNHRRKDLLDDGRRALVEEPASVPVAAAAVERHRTRVDGKNEKFSSLPEIVVDDTTAATVLNLIAYEMCPDFENDYGICSYVSFLDSLIDHPDDVKALRSEQILLNSLGSDEKVANLFNTISTDLVPDMGK

SEQ ID NO: 213297 - protein, 274 aa, Glycine max
  Coding DNA Sequence Number=SeqID_96519
  Gene Ontology: Mol. function=transcription factor activity; Cellular component=nucleus; Biological process=regulation of transcription, DNA-dependent
  Homolog annotation: Hit_ID=Q9M644; Match level="QueryCoverage=86%, HitCoverage=91%, E-value=5e-28, Identity=35%"; Hit description =AP2/EREBP-like transcription factor LEAFY PETIOLE
  Pfam annotation: Domain name=AP2; Domain location=29-93; Score=111.9; E_value=1.9e-30; Accession=PF00847.10; Description=AP2 domain
MKPYTSSPSSSRSKKKQTTTQQDHETAWGGRYLGVRRRPWGRYAAEIRDPSTKERHWLGTFDTAEEAALAYDRAARSMRGSRARTNFVYPDTPPGSSVTSILSPDEQTQTQIHQAQEELSSLFNPNPFAQPDPNPHFSLCGYSGVTNTPTFSATEEIAPSGGYSYNYGYTEGGTSMESSHFKLFDDGETELPPLPPDITSSMGYEMGNGFYGNDAGFSDPSFGANATGSGYPYSGFGSGDYVVHSPLFSAMPPVSDNVSTGHEGFDLASSSFFF

SEQ ID NO: 213298 - protein, 137 aa, Glycine max
  Coding DNA Sequence Number=SeqID_96520
  Gene Ontology: Mol. function=protein serine/threonine kinase activity; Biological process=protein amino acid phosphorylation
MGSEIDMADVTVNAISFSFSWAVDSAIRSDESETASNLGASPAHSFGSVLDSAIRRTVAAQLFSLTELKAATDNFSFHNRILRAGSIGDVSSGKPIDGREVAIKRESCLYEYMKNGALFDHLHDKKNVDKGSRVLNY

SEQ ID NO: 213299 - protein, 88 aa, Glycine max
  Coding DNA Sequence Number=SeqID_96521
  Gene Ontology: Mol. function=transporter activity; Cellular component= integral to membrane; Biological process=transport
  Homolog annotation: Hit_ID=P93004; Match level="QueryCoverage=83%, HitCoverage=26%, E-value=1e-25, Identity=74%"; Hit description =Aquaporin PIP2.7
MGNVIRYTFAPERATRNVGSAVDKDKDHAIEGLCNAEKANAVTWSGFFFVTNDDGDGAVEEEKCDDKLDNEGFVEGLELNLSQVNEGR

SEQ ID NO: 213300 - protein, 316 aa, Glycine max
  Coding DNA Sequence Number=SeqID_96522
  Gene Ontology: Mol. function=potassium ion transporter activity; Cellular component=integral to membrane; Biological process =potassium ion transport
  Homolog annotation: Hit_ID=Q9LD18; Match level="QueryCoverage=98%, HitCoverage=45%, E-value=1e-92, Identity=59%"; Hit description =Potassium transporter 4
  Pfam annotation: Domain name=K_trans; Domain location=16-298; Score= -480.6; E_value=0.00091; Accession=PF02705.7; Description=K+ potassium transporter
MVLGWPCLYDGYVCDYISDGTSHNVCLAEKHSDSYNIPFVLLGDRGCISICSIGKSVSRRMGSSCLIFHLYACNVCVALWHLYQVQLRPMQQSFIEMVTGFGPYSLIYTELATGIPAIFSHFVTKLPAFHMVLFFVCVKTVPVPHVSHEERYLIWRVCPRPCQMYRCTVRYGYKHIRRDDRDFDNHIIRCIAEFIQMEAQELQLSFSETSSFDGGTAIISVRSLESVSSRKVSENEDVGVDKNNASGRSFSVRRPLSTYNEENPHSRRRHISFRVPNDPVLDHEVKQELLDLAQTMEAGVQLWLLTFLTSVSLKLE

SEQ ID NO: 213301 - protein, 143 aa, Glycine max
  Coding DNA Sequence Number=SeqID_96523
  Gene Ontology: Mol. function=protein serine/threonine kinase activity; Cellular component=integral to membrane; Biological process=protein amino acid phosphorylation
  Homolog annotation: Hit_ID=Q9LY50; Match level="QueryCoverage=94%, HitCoverage=18%, E-value=5e-25, Identity=48%"; Hit description =Receptor kinase-like protein
MRIKIALDAYRGIEYLHNNYVVPSIIHRNIKSSNILLDATWTAKVPDIESSSISLETDRVYHDMVRLGTLGSFDPGYLCTSLFKAKSDVYGLGIVLEILTGKPTIFKYGKHGSTNMVNFARRAISAGEMLKILDPKGWTTGCE

SEQ ID NO: 213302 - protein, 528 aa, Glycine max
  Coding DNA Sequence Number=SeqID_96524
  Gene Ontology: Mol. function=ATP-dependent helicase activity; Cellular component=RNA-induced silencing complex; Biological process= multicellular organismal development
  Homolog annotation: Hit_ID=Q3EBD3; Match level="QueryCoverage=91%, HitCoverage=94%, E-value=1e-176, Identity=63%"; Hit description=DEAD- box ATP-dependent RNA helicase 41
  Pfam annotation: Domain name=DEAD; Domain location=152-324; Score =200.4; E_value=4.1e-57; Accession=PF00270.19; Description=DEADDEAH box helicase
  Pfam annotation: Domain name=Helicase_C; Domain location=394-470; Score=84.7; E_value=2.9e-22; Accession=PF00271.21; Description =Helicase conserved C-terminal domain
  Pfam annotation: Domain name=ResIII; Domain location=148-319; Score= -37.4; E_value=0.063; Accession=PF04851.6; Description=Type III restriction enzyme, res subunit
  Pfam annotation: Domain name=zf-HIT; Domain location=40-69; Score =39.1; E_value=1.5e-08; Accession=PF04438.6; Description=HIT zinc finger
  Pfam module annotation: Pfam domain module=DEAD::Helicase _C::ResIII::zf-HIT; Domain location=152-324::394-470::148-319::40-69
MTDSDANHNDPSLATDTDAPNDAEDEVKLRSRDQRLALPGEPKCIICGRYGEYICDETDDDVCSLECKQALLCRIAKSSSPPPKRIPAADECFYVKDADYESGTASMASDLRKKLDIHVKGDVVAPVLSFSACNLPDKLLHNIEAAGYEMPTPVQMQAIPAALTGKSMLLLADTGSGKSASFLIPIVSRCAIHRRQYVSDKKNPLALVLTPTRELCMQVEEHAKLLGKGMPFKTALVVGGDAMAGQLHRIQQGVELIVGTPGRLVDLLTKHEIDLDDVMTFVVDEVDCMLQRGFRDQVMQIYRALSQPQVLMYSATMSNDLEKMINTLVKGTVVISVGEPNTPNKAVKQLAIWVESKEKKQKLFEILESKKHFKPPVVVYVGSRLGADLLANAITVSTGIKAVSIHGEKSMKERRETMQSLLVGEVPVVVATGVLGRGVDLLGVRQVIVFDMPNNIKEYVHQIGRASRMGEEGQGIVFVNEENKNIFAELIEVLKSGGAAVPRELANSRYATGVFSGGKGSKKRKHTG

SEQ ID NO: 213303 - protein, 246 aa, Glycine max
  Coding DNA Sequence Number=SeqID_96525
  Homolog annotation: Hit_ID=Q9FFY5; Match level="QueryCoverage=26%, HitCoverage=25%, E-value=8e-14, Identity=59%"; Hit description =Arabidopsis thaliana genomic DNA, chromosome 5, P1 clone:MAC12
  Subcellular localization annotation: CTP_CleavageSite=43; ConfidenceScore=5.32e-01
MKNNRASGILKLIAALRSMAKSKSLALKSKTNAIKARLVIFSLVMNKRYVMSTISDKFQSLLGHHHSHLKEVEDGNDSVEDKCTVVINDNAHLHEDFVSTSSLQASIGSSIVSTSERCEIFGHTRKAVSNVNPSETQMVVEDNDGADDDDGCECFYTYGDDDDDDDDGGGGGNKYPDLTHTMFESDDLEIGGSVIDLVKSSKEEAGQEFKMEDEIDHMADLFIRKFRRQIMLQKQDSLKRNEMQIQ

SEQ ID NO: 213304 - protein, 155 aa, Glycine max
  Coding DNA Sequence Number=SeqID_96526
  Homolog annotation: Hit_ID=Q2QVF9; Match level="QueryCoverage=85%, HitCoverage=58%, E-value=9e-10, Identity=29%"; Hit description =Expressed protein
MDESGSASSPTRPVTIEGGECDAALSKSRVLTREEVLRRRLRRVRQLGRCYRAHYWALMEELRSKYRDYCWTYGKSPFKEDHDDNNNNNDQNGVVSGGDDIVRCRFSGCKTKAMALTNYCHAHILGDSKQKLYQGCKAVAKKFVLVQIEIEDSVK

SEQ ID NO: 213305 - protein, 64 aa, Glycine max
  Coding DNA Sequence Number=SeqID_96527
MDDFIKQGNNTNPKVSQDRKTNLPRRRLMVECSRKIGKGQQGVTNIDNGNNDKCKWEEREMFRT

SEQ ID NO: 213306 - protein, 64 aa, Glycine max
  Coding DNA Sequence Number=SeqID_96528
  Gene Ontology: Mol. function=glyceraldehyde-3-phosphate dehydrogenase (NADP+) (phosphorylating) activity; Cellular component=chloroplast; Biological process=reductive pentose-phosphate cycle
  Homolog annotation: Hit_ID=P19866; Match level="QueryCoverage=92%, HitCoverage=14%, E-value=5e-15, Identity=70%"; Hit description =Glyceraldehyde-3-phosphate dehydrogenase A, chloroplast precursor
  Pfam annotation: Domain name=Gp_dh_C; Domain location=1-62; Score= -64.2; E_value=0.0083; Accession=PF02800.10; Description =Glyceraldehyde 3-phosphate dehydrogen
MTVTKKTFAEEVNAAFRESAENELKGILSVFDEPLVSVDFRCSDVSSTVDSSLTVVMGDDMVGQ

SEQ ID NO: 213307 - protein, 52 aa, Glycine max
  Coding DNA Sequence Number=SeqID_96529
MIMRDVFTVKSEKNFFEDLESGDPPVDEVIEMLNSEKGKADNADSEEIDPNV

SEQ ID NO: 213308 - protein, 229 aa, Glycine max
  Coding DNA Sequence Number=SeqID_96530
  Gene Ontology: Mol. function=metal ion binding; Biological process =metal ion transport
  Homolog annotation: Hit_ID=Q84WQ7; Match level="QueryCoverage=41%, HitCoverage=22%, E-value=6e-12, Identity=47%"; Hit description =Putative copper chaperone (CCH) protein
  Pfam annotation: Domain name=HMA; Domain location=10-71; Score=42.3; E_value=1.6e-09; Accession=PF00403.16; Description=Heavy-metal -associated domain
MANEVDFKIELKVSANCCEGCKRKVKKALRNLEGVLSIDIDPMEPKITVLGNVNPHILIKKLHKVGKRAVLWSYEEVEEETTKQDTMWEQEKQPHPCDIKIEKTKDVTRKKKTSKEDKKMSYNSCSTQEMKKEEHYVPHQEGNFMVHGHPSMMNPYYSNSIKTHPQCCYIAQPCAVAVPYYAIPSSYSAPPQACVEDHIPRFFQPPFLRPTERVGDYFSDENTMGCLVM

SEQ ID NO: 213309 - protein, 191 aa, Glycine max
  Coding DNA Sequence Number=SeqID_96531
  Gene Ontology: Mol. function=glyceraldehyde-3-phosphate dehydrogenase (NADP+) (phosphorylating) activity; Cellular component=chloroplast; Biological process=reductive pentose-phosphate cycle
  Homolog annotation: Hit_ID=P09043; Match level="QueryCoverage=88%, HitCoverage=52%, E-value=1e-56, Identity=62%"; Hit description =Glyceraldehyde-3-phosphate dehydrogenase A, chloroplast precursor
  Pfam annotation: Domain name=Gp_dh_N; Domain location=72-185; Score =106.4; E_value=8.6e-29; Accession=PF00044.14; Description =Glyceraldehyde 3-phosphate dehydrogen
  Subcellular localization annotation: CTP_CleavageSite=55; ConfidenceScore=5.44e-01
MATSFTICRLAVSGPANGKGFSEFSGLRNSSIGYLSFSSRKSSEDFHSVIAFQTSAVGGREGNTKGVVEAKLKVAINGFGRIGRNFLRCWNGRKDSPLHIIAINDTTGGVKQASQASLSQGLGNRLLIEGTGVFVDRDGAGKHIQAGAKKILITAPGKGDIPTYVVGVNAGIYDPDEPIISNASSTLRQGP

SEQ ID NO: 213310 - protein, 155 aa, Glycine max
  Coding DNA Sequence Number=SeqID_96532
  Homolog annotation: Hit_ID=Q2QVF9; Match level="QueryCoverage=83%, HitCoverage=56%, E-value=6e-09, Identity=29%"; Hit description =Expressed protein
MDESGSASSPTRPVTIEGGECDAALSKSRVLTREEVLRRRLRRVRQLGRCYRAHYWALMEELRSKYRDYCWTYGKSPFKEDHDDNNNNNDQNGVVSGGDDIVRCRFSGCKTNAMALTNYCHAHILGDSKQKLYQGCKAVAKNFVLVEIEIEDSVK

SEQ ID NO: 213311 - protein, 106 aa, Glycine max
  Coding DNA Sequence Number=SeqID_96533
  Gene Ontology: Mol. function=peptidase activity
  Homolog annotation: Hit_ID=Q655R7; Match level="QueryCoverage=78%, HitCoverage=37%, E-value=4e-23, Identity=57%"; Hit description=OTU -like cysteine protease-like
  Pfam annotation: Domain name=OTU; Domain location=12-100; Score=66.6; E_value=7.8e-17; Accession=PF02338.9; Description=OTU-like cysteine protease
LNVYGLCEVKVSGDGNCQFRALSDQLYRSPEHHKHVRKEIVKQLKDHRSLYECYVPMKYKKYHKKMAKTGEWGDHVTLQAAADKVCGAVFKELVTFIGCYQVPIDQ

SEQ ID NO: 213312 - protein, 89 aa, Glycine max
  Coding DNA Sequence Number=SeqID_96534
MAVESFDCFRLKLGVPAQDIMMNGNGTQTEYWGESSGSTSHSSQQDVEDDRMIALVLSEEYAKLDGAVGRRLTNLEPVPVRIPSFQLFP

SEQ ID NO: 213313 - protein, 224 aa, Glycine max
  Coding DNA Sequence Number=SeqID_96535
VKLPAFIVDHRVVPGDMSRGSGDLGDVRRAPGSQQIKGTKTTKQGGLWWLASCEFCVICGLWPLVIDYQGWVIDYQGCVIDYQRWKALKYPFYLHIVMAAQLIRDRVEMECLEGAWETLEGNTRCRFRDTIRFTATSLVHPDELARTLQRTVEWILPTPTPYRLVEPVQVIEVTSSEEDPEEDPEELPPEPAVDSPEEVMSASEADSKEDDGPGEMAISGGSSS

SEQ ID NO: 213314 - protein, 274 aa, Glycine max
  Coding DNA Sequence Number=SeqID_96536
MSGGDGKDSRGPTGGIKGGASDQGPNVGHGGSMDTNIPGMGDVHIDGVHGLNPGQDNSTNWEGGNGKGGRDSSSSGDSQGAAIRRQVNAIKNDPKVSNILKELQKKVRAVTAYAKVALKSVEADGKIQVQVGEIRTRDEAAVSRAITSVSQVKNVLGVGLPAQGGIVFAGNIDTNHRIGNYQNVPNGNNNGNNSAAEDKASLATYSEVLNGKIPPGFWLDNNRVMTEITEQYEINGGGKGSDRTGYRQRNVEVPSLTSAYQQFKQVEREVAEEA

SEQ ID NO: 213315 - protein, 111 aa, Glycine max
  Coding DNA Sequence Number=SeqID_96537
  Homolog annotation: Hit_ID=Q5QGM8; Match level="QueryCoverage=97%, HitCoverage=28%, E-value=1e-33, Identity=70%"; Hit description =Klebicin D phage-associated protein
SSDARMKTDITQIEGALDKLASIGGYTYLKQGVPEAGVIAQEVESVLPQSVTQTELKLNDGTVLQDARSININGVVALLVEALKEERSLRDAEREEFEARLVALEKAIAIA

SEQ ID NO: 213316 - protein, 73 aa, Glycine max
  Coding DNA Sequence Number=SeqID_96538
MADMKTIAFSIVAVVLIVIAAVGFYEYSVANSRYINAYNEYQSENSQYMALQGNYTKLNQTYSQLASQYKVLE

SEQ ID NO: 213317 - protein, 134 aa, Glycine max
  Coding DNA Sequence Number=SeqID_96539
MKGGRYTLWIQAGSLGGVTVNHEFIPRSARARSGITLMEAPGSISTRGSLLSFADVTGEKKRPLMYASSCPARCLLSRSKTRGIRYGSFSVSFAGAKQRGRTFGRRRRPLMILRLGGRSGGELMLVDSPLKLLT

SEQ ID NO: 213318 - protein, 205 aa, Glycine max
  Coding DNA Sequence Number=SeqID_96540
  Gene Ontology: Mol. function=chitin binding; Cellular component =extracellular region; Biological process=chitin metabolic process
  Homolog annotation: Hit_ID=UPI00006A17C9; Match level="QueryCoverage =95%, HitCoverage=100%, E-value=4e-26, Identity=33%"; Hit description= UPI00006A17C9 related cluster
  Subcellular localization annotation: CTP_CleavageSite=37; ConfidenceScore=5.01e-01
MSSPLEDYTSSPSKDYTSSPSEGCTPSPSQGCMPSPSYDHTSSPSEDYMSSLLEDYTSSPSEHYMSSPSEGSMPSLSEGLHVLAFRRLHVLAFRWLHALAFRGLHVVAPRGLHVLPFRGLHVIAFRVLHALALRGLHVLPFRGLHVLPFRGLHILTFRGLHVLTFRGLHVLAVRGLHALSFIGLHVFPFRALHVLPFKGLHVLTF

SEQ ID NO: 213319 - protein, 136 aa, Glycine max
  Coding DNA Sequence Number=SeqID_96541
  Homolog annotation: Hit_ID=Q6CQF3; Match level="QueryCoverage=41%, HitCoverage=59%, E-value=4e-08, Identity=72%"; Hit description =Kluyveromyces lactis strain NRRL Y-1140 chromosome D of strain NRRL Y- 1140 of Kluyveromyces lactis
IAGARGRVYRPRHGIESSKWAIFGKQNWRCGMNRKLGYGAQLRANLDPTKGVGRLRQQDGGHGSRNPLRRRGGRCKTQGASPGGAVVGADLGGTGEARLIALCARTPKGNRPAHPGNGSAGGRVQRLEEHRTSRGV

SEQ ID NO: 213320 - protein, 134 aa, Glycine max
  Coding DNA Sequence Number=SeqID_96542
DGSGLIEVIWVYDPSKLVFWVDDPAWVGDPEEVDDFLVVGSGRASLDPLPVLHPPLREIPDALGGITTFLDEAGCYTSGRGRTTTTLAGLFDWTTELRAGQGFAPFVCPTLEQFRAEVAWPEDWPDAQTGEEPA

SEQ ID NO: 213321 - protein, 84 aa, Glycine max
  Coding DNA Sequence Number=SeqID_96543
MALTISELFLRPYQRTLADGGHCAQGTPSCQCNRQKGSTECDYYVMHWMSTIILGSFRNNWETTIGAREIKGASNPVGTILSLS

SEQ ID NO: 213322 - protein, 142 aa, Glycine max
  Coding DNA Sequence Number=SeqID_96544
  Homolog annotation: Hit_ID=Q2XHR9; Match level="QueryCoverage=64%, HitCoverage=85%, E-value=2e-46, Identity=97%"; Hit description =Hypothetical protein precursor
MALATGTGAEVQRPLATVVIGGILSSTALTLLVLPALYHWAHRKDEDGDEAEVANTFSESKQLQYTKEHQTAVAKYAEKNGKPMPEIQDYKYGMKIDVAKFVRQSQDPRTCQVYPRLMTFEDSQGTLKTVRYSMYSQCINNK

SEQ ID NO: 213323 - protein, 83 aa, Glycine max
  Coding DNA Sequence Number=SeqID_96545
  Homolog annotation: Hit_ID=Q2XHR8; Match level="QueryCoverage=95%, HitCoverage=7%, E-value=1e-36, Identity=100%"; Hit description=Heavy metal efflux pump CzcA
  Subcellular localization annotation: CTP_CleavageSite=59; ConfidenceScore=5.64e-01
MKPRDATKAVIRTGRRRVNAPSSTACLSVRPSSLSPRMKAIITRPFSTATPDSAMKPTPAEIDSGMSRSHNATTPPVSANGYR

SEQ ID NO: 213324 - protein, 47 aa, Glycine max
  Coding DNA Sequence Number=SeqID_96546
MGQFCQTRRDPSWEDSLEEQASQGSFVPHGRQDLLTAAIGRPEHLGR

SEQ ID NO: 213325 - protein, 50 aa, Glycine max
  Coding DNA Sequence Number=SeqID_96547
MEHTNLGIPRSCGSACHWTLGTRLTKSGVVDKSRAFAPSYPQFVNEELRP

SEQ ID NO: 213326 - protein, 142 aa, Glycine max
  Coding DNA Sequence Number=SeqID_96548
  Subcellular localization annotation: CTP_CleavageSite=51; ConfidenceScore=5.39e-01
MAEPSKKRKGVATSSAVTGTRSHGTSKVHTYQIPPSISSPTLFSSEEQRIRYNSLFSSRSIIDPKFVDLAFFDDEVFDCFQAFQNSGLIQFISMKLPFYPELVKVFYSNLEIQKDSLISEVYGIKMVIDQSLFFDLTQLSSD

SEQ ID NO: 213327 - protein, 166 aa, Glycine max
  Coding DNA Sequence Number=SeqID_96549
  Subcellular localization annotation: CTP_CleavageSite=38; ConfidenceScore=5.67e-01
MAESSKKRKGSSSSAVTHQTSRSGATGASPTPIPPSLSSSTLFSSDEQHIRYSSLFQSRQILDPKYLELEFFDGETFDCYQVFQNTGLIPFMSLKLPYYPELVRVFYSNLKIQDGTLISKVHGIPMIIDESLFFSLTQFPSQGEPFEGTLVDDWKFDYSSHDARRM

SEQ ID NO: 213328 - protein, 168 aa, Glycine max
  Coding DNA Sequence Number=SeqID_96550
  Homolog annotation: Hit_ID=Q9XEG1; Match level="QueryCoverage=61%, HitCoverage=6%, E-value=2e-17, Identity=50%"; Hit description =Putative callose synthase catalytic subunit
MERPKGSHKCSSILYTKSASSLLSSWQTCFFHQSCGSTEEILTKKIFDKEKILKPSRGLACSKLDLEAAIGCELSPKAHAQADLKLTYGKQKEEQKPEAANIALIMQRNEALRVIFVVVVETSKKGKVKAHINGKHNIVEMSKTLKMSKYYHKSSLDSGQPPNLRISH

SEQ ID NO: 213329 - protein, 411 aa, Glycine max
  Coding DNA Sequence Number=SeqID_96551
  Gene Ontology: Mol. function=binding; Cellular component =intracellular; Biological process=metabolic process
  Homolog annotation: Hit_ID=Q1S316; Match level="QueryCoverage=90%, HitCoverage=66%, E-value=0.0, Identity=86%"; Hit description =Pentatricopeptide repeat
  Pfam annotation: Domain name=PPR; Domain location=133-167; Score =31.3; E_value=3.4e-06; Accession=PF01535.11; Description=PPR repeat
  Pfam annotation: Domain name=PPR; Domain location=168-202; Score=9.6; E_value=0.54; Accession=PF01535.11; Description=PPR repeat
  Pfam module annotation: Pfam domain module=PPR::PPR; Domain location =133-167::168-202
  Subcellular localization annotation: CTP_CleavageSite=25; ConfidenceScore=5.40e-01
SQGFPNPNQFQNPNNQLNNNQTSVQSQASPAPPPQPPSITDLTRLCREGKVKEAIELMDKGVKADAGCFALLFDSCGQSKSLEDAKKAHDHFLQSTFRSDLTLNNKVIEMYGNCKSMTDARRVFDHMPNRDMDSWHLMMRGYANNTNGDEALQLFEQMNELGLEITSETLLAVLSACASAEDVEDAFLHFESMKSKYGIEPVVGHYMGLLDVLGQSAYLKEAEEFIDQLPFEPTVAVWEKLKHYARAHGDFDLEDYTEELIVSLDPSKAVANKIPMPPPKKYTAINMLDGRNRIIEYKNPTLYKDDEKLKALSGMKEAGYVPDTRYVLHDIDQEAKEQALLYHSERLAIAYGLISTPPRTPLRIIKNLRVCGDCHNAIKIMSRIVGRELIVRDNKRFHHFKDGKCSCGDYW

SEQ ID NO: 213330 - protein, 170 aa, Glycine max
  Coding DNA Sequence Number=SeqID_96552
  Subcellular localization annotation: CTP_CleavageSite=55; ConfidenceScore=5.43e-01
MFATNAASNLFFPGNPSSFRCRAAAGDLSAGPSFFQSVAGGLRIGQFPDGAGLVVEGRRGGGNEPIRVKKWSRKNESYLDNDTEPLPLPMTYPDSSPVSQEEIDKRLQCDPQIQDCKEVVYEWTGKCRSCQGSGYVSYYGKRGKAVTCKCIPCMGIGITFAFNMPCLFYS

SEQ ID NO: 213331 - protein, 327 aa, Glycine max
  Coding DNA Sequence Number=SeqID_96553
  Gene Ontology: Mol. function=protein binding; Cellular component =integral to membrane; Biological process=protein amino acid phosphorylation
  Homolog annotation: Hit_ID=Q1S313; Match level="QueryCoverage=78%, HitCoverage=46%, E-value=1e-124, Identity=78%"; Hit description =Leucine-rich repeat, plant specific
  Pfam annotation: Domain name=LRRNT_2; Domain location=158-197; Score =17.8; E_value=0.012; Accession=PF08263.3; Description=Leucine rich repeat N-terminal domain
  Pfam annotation: Domain name=LRR_1; Domain location=203-225; Score =9.3; E_value=5.3; Accession=PF00560.23; Description=Leucine Rich Repeat
  Pfam annotation: Domain name=LRR_1; Domain location=227-248; Score =14.0; E_value=0.56; Accession=PF00560.23; Description=Leucine Rich Repeat
  Pfam annotation: Domain name=LRR_1; Domain location=250-272; Score =12.3; E_value=1.4; Accession=PF00560.23; Description=Leucine Rich Repeat
  Pfam module annotation: Pfam domain module=LRRNT_2::LRR_1::LRR_1::LRR_ 1; Domain location=158-197::203-225::227-248::250-272
MFICGPSFPDDKLNRMWQPYKDQNLVVESHSNVTSSDFWNQPPVKAFSSAMTTSRGKTLEIQWPPMSLPSTYYYISLYFQDNRNPSPYSWRIFDVSINGHTFFSSLNATTKGVTVYAAKWPLSGQTKITLTPGSGIPVGPVINAGEIYQVLPLGGRTHTRDVIAMEDLARSIQNPPADWHGDPCLPKGNSWTGVTCSNGFHARVTTLNLTNAGVSGSLPPTLGRLSALEHLWLGENKLSGTIPDLSGLKELETLHLEKNNFEGPLPPSTKKLPKLRIIESDFENKSPNTNLKQSEVKVEQRFIRENEHKPLQIRQVLYVTEEALIQS

SEQ ID NO: 213332 - protein, 70 aa, Glycine max
  Coding DNA Sequence Number=SeqID_96554
  Homolog annotation: Hit_ID=Q1SP37; Match level="QueryCoverage=98%, HitCoverage=20%, E-value=2e-08, Identity=47%"; Hit description =Bacterial adhesion
MKDIMLASIILHNMIVEDERDTFNGNVDADYDHLENDISNVEVSRGTPPNFATFLQRRRIMHTRRIHQQL

SEQ ID NO: 213333 - protein, 145 aa, Glycine max
  Coding DNA Sequence Number=SeqID_96555
MAYLLFDLHEFNAFISPPRKLHVFKGVSNACGWRTPLIGWYKVNVDGVVWLKDNEAACGGAIRDHNGVFMLALDRGFCNIMIESNSVEVVDSMSKDWNGSHPFSSYIRKFVHLLEGFLIPHILRRVNMVADLFAKNAFAFRCCKD

SEQ ID NO: 213334 - protein, 1739 aa, Glycine max
  Coding DNA Sequence Number=SeqID_96556
  Homolog annotation: Hit_ID=Q9LJL0; Match level="QueryCoverage=88%, HitCoverage=94%, E-value=0.0, Identity=38%"; Hit description =Arabidopsis thaliana genomic DNA, chromosome 3, P1 clone: MVI11
MFPWRAFAKSAEATFSRWALKRVCKFFLKKKLGQFILGEIDLDQLDVQLSQGTIQLSDLALNVDFVNSKFGKTSSLMVKEGSIGYLLIKMPWSGKGCEVEVNGLEIVVSPCTDQMSTSEGETCGLDGSDNQHLKSSMRTEREISDDAQKLTSMDVHEGVKTIAKMIKWLLTSLHVTITNIIVAFDPSLDNEENKTHCRHTLVLQISEIQCGTSLSEDADSNVDVLGISRLTNFVKFHGAVIELLKIDNEDIYQHESGAGRGEPVLGSNIATCPVITGNQGGFSGNIKLSIPWKNGSLDVCKVDADVCVDPIVLKFQPSTIKWLLQSWETLKNLNKGGKGFTNHNSRGSGQLNSALFCHSSTSVSITNAPSDMMTANGSSTADYTSLTQPETLAEDLLPVAHLISNWVPLSTHINHKDGIQEPDFGASVDQFFECFDGMRNSQSALGSSGMWNWTYSVYSAITAASSLASGSLHIPSEQQHTETNLRATFAGISVVLSFCVDEQNNFSEPEIGHKVGLQIDYLGAECNDIFIALQVCPQGMTLDGKVKHVEVANFLNIGIDAKNQSASVKHLQAKVLDALPSSTSYNVDSHSLIEPVATDFPFGNNDCLLKVTLFRTFGVTNCKCSTQSSSSDGCRTGMTSFSLNLPPFVFWVIFSVINVLMNLLKEVEKSLEMHNKEKEILSEVSDNKCGSSQSDMEEASGPRVTSFSTTECLHGDISISNARVILCFPFGSDGDHKNSFSWEQFIALDFTSSSPLNKGCTPDYSQTSNASSKKRFPSVAAQSLQLSFCDLDIYLITSSNENGRIISYDVQNEKFSASCFFSIFHRRGCFSVVLVVWQGGQVTGPWIAKKARLFANSGQTRGKDDIGGRGYEFASASTVKDLEDWKSQTQQEMILSSSFLMHVRLSQVVINLNDSQYKGIHHLLHQMLNALACVTSKEANIEKESSVSQSSVFLECDSLEILISRDTYVSIESSIKSELPGMWNQFRLKVQKFELLSVTNTGGVKAASFFRLTHGEGKLWGFVTGVPDHEFLLITCSNSSVKRGDGGGSNALSSKCAGSDVIYFSDPEISHSVISITVSCGTVLAVGGRLDWFDAILSFFSFPASNTKDAGDTSISKKEHNISYTTYFVLCLIDIALSYEPFMKNLVVQSELSSLSGCSSTKEDMSEQCVSCLLAASSLTLSNSSSADTVESVFQIRVHDLGLLLHLMSELNSLSGIYSVEHLQKTGYIKVAQEAFMEAILKTNCASGLLWELELSKSHLSVETCYDTTATLIRLAAQLQQLFAPDVEESIVHLQNRWDNAQQAQQRNEFKNENKNLRFDSMSATSEQCSPQTFSTDGSSIAGLMDEICEDAFQLNNNNTHQSYPFESGFCMPLDGSLIEVGQMNLDEPEVLSQELTWTESVPVIGPEGSHTSFLQEGCFPEIIESYCLSDLSPLSELSLSIHSDELSGHKLRNVEHREIERGSGGWYGSTSLKVLENHILEESKQAGVIKAVDHHVMLSSDGSSSHGETCGRVILKKIDIRWRMYGGSDWLDSEKSGQHSGRDTSVCMELALSGMKFQYDVFPVGGLRVSKMSVSVQDLFLYDRSQDAPWKLVLGYYHSKGHPRESYSRAFKLDLEAVRPDPLTPLEEYSPHHVDLAALRHGKYVELVNLVPWKGVELNLKHVHASGIYGWASVCETTVGEWLEDISQNQIHKILRGLPTVRSLIAVGAGAAKLVSSPVQSYKKERRVLKGVQRGRLD

SEQ ID NO: 213335 - protein, 156 aa, Glycine max
  Coding DNA Sequence Number=SeqID_96557
  Homolog annotation: Hit_ID=Q1RYI2; Match level="QueryCoverage=34%, HitCoverage=8%, E-value=9e-07, Identity=40%"; Hit description =Ribonuclease H
MVMAQRLRVIMADLDIGLCEKFVDVVWYCISTSSTRLGRQGPKLSHLMAADDSILFVKVFMDQVGVLKSCLDFFYESFGEKDLTPLANSKKEGLNLWSGLKENWSTIQNNMGCMLGDGSHILFWTNDWVPDIGPLLDLATDSLDGHDLRLNFCYRN

SEQ ID NO: 213336 - protein, 85 aa, Glycine max
  Coding DNA Sequence Number=SeqID_96558
IQNKLPPNQTIRSKSKPPTHKFSQIEIPNSRFCPKLTSKPIVKFGEEGEEVGDEGVGDKVGVEEEDLGVVGVVYQAYSLGLERTS

SEQ ID NO: 213337 - protein, 134 aa, Glycine max
  Coding DNA Sequence Number=SeqID_96559
  Gene Ontology: Mol. function=RNA-directed DNA polymerase activity; Biological process=RNA-dependent DNA replication
  Homolog annotation: Hit_ID=Q1STT2; Match level="QueryCoverage=97%, HitCoverage=31%, E-value=7e-23, Identity=40%"; Hit description =Lipocalin
MTMEKEFSGLGFCHLHDFNLSMLGKQGWKVSTNEDAIVTKVFKVKYFSNRSFLDVPLRHNPMNIWSQPWIQNNPNYYITIAPPLGLEQLTVGALINHENSNWRWEMLNQFFNDHNVKAIQSIPLLNGSNKDQQF

SEQ ID NO: 213338 - protein, 111 aa, Glycine max
  Coding DNA Sequence Number=SeqID_96560
  Gene Ontology: Mol. function=2'-5'-RNA ligase activity; Biological process=RNA metabolic process
  Homolog annotation: Hit_ID=Q5PD37; Match level="QueryCoverage=97%, HitCoverage=74%, E-value=3e-27, Identity=66%"; Hit description=2'-5' RNA ligase
  Pfam annotation: Domain name=2_5_RNA_ligase; Domain location=3-78; Score=38.7; E_value=2e-08; Accession=PF02834.6; Description=2',5' RNA ligase family
DALQQQLVQWRADCFAADAGKPVAAANLHLTLAFLGEASTETADQLQQLAARIRQPGFTLDLDDAAGQPAARPGRASWLCAEYAAVPSPHHPAAPRCAGRGAAAARFSLAR

SEQ ID NO: 213339 - protein, 144 aa, Glycine max
  Coding DNA Sequence Number=SeqID_96561
  Gene Ontology: Mol. function=DNA binding; Biological process =phosphorylation
  Homolog annotation: Hit_ID=Q7N864; Match level="QueryCoverage=99%, HitCoverage=60%, E-value=4e-59, Identity=75%"; Hit description=Sugar fermentation stimulation protein homolog
  Pfam annotation: Domain name=SfsA; Domain location=13-144; Score =83.6; E_value=6.3e-22; Accession=PF03749.4; Description=Sugar fermentation stimulation protein
MQFDPPLQSARLITRYKRFLADVITPEGDTFTLHCANTGAMTGCATPGDTVWYSTTASATRKYPHSWEITQTAQGHWICVNTLRANQLVREALLRDAIPELSAYSHCQAEVKYGTEKSRIDFLLQAEGKVNCYIEVKSVTLLQN

SEQ ID NO: 213340 - protein, 214 aa, Glycine max
  Coding DNA Sequence Number=SeqID_96562
  Gene Ontology: Mol. function=oxidoreductase activity; Cellular component=cytosol; Biological process=metabolic process
  Homolog annotation: Hit_ID=Q1SZJ6; Match level="QueryCoverage=60%, HitCoverage=20%, E-value=2e-60, Identity=86%"; Hit description =Alcohol dehydrogenase superfamily, zinc-containing; Short-chain dehydrogenase/reductase SDR
  Pfam annotation: Domain name=ADH_zinc_N; Domain location=20-156; Score=-11.3; E_value=0.046; Accession=PF00107.16; Description=Zinc -binding dehydrogenase
MRNTIRTRRKSNETITGQFRECPILSQALTKFQPPSLTLHLPLIFPLLLSLPLTRAHLMPLLPGMQVLREEFPKGIDIIYESVGGDMLNLCLNALAVHGRLIVIGMISQYQGEKGWTPSKYPGLLEKLLAKSQTVSGFFLVQYGHLWQEHLDGLFNLYSTGKLKVAVDPKKFIGLHSAADAVEYLHSGKSVGKLLCKQCCRMFLKLAASAQCGS

SEQ ID NO: 213341 - protein, 46 aa, Glycine max
  Coding DNA Sequence Number=SeqID_96563
MNHIRITDKWFLRDGYISFRYADSVGRCGAAMQKVCCFIGVKGITK

SEQ ID NO: 213342 - protein, 148 aa, Glycine max
  Coding DNA Sequence Number=SeqID_96564
  Gene Ontology: Mol. function=unspecific monooxygenase activity
  Homolog annotation: Hit_ID=O04892; Match level="QueryCoverage=63%, HitCoverage=17%, E-value=8e-23, Identity=63%"; Hit description =Cytochrome P450 like_TBP
LPTLETAQPEVGSSGWKSTARRVVSGAPPAALENPEDRVPPTPGRTHNRIRSPRQGKSAKWIRNLGKRIGSEGWARGSQSRTRRLSVDCSSCFRGESGSSRAGRGTDWERALRGPLPRASNSQLRTGTDKGNPTVLIKTKHCDGPCGC

SEQ ID NO: 213343 - protein, 91 aa, Glycine max
  Coding DNA Sequence Number=SeqID_96565
  Subcellular localization annotation: CTP_CleavageSite=69; ConfidenceScore=5.08e-01
MVGDLDAPEKGKSMIVIVGGIKGVVLIFESESGNRGTPTTAVMFGTSSAPPSSYFSITRERKRTESTSRLESKVALTILFLLACNPGPVAK

SEQ ID NO: 213344 - protein, 421 aa, Glycine max
  Coding DNA Sequence Number=SeqID_96566
  Homolog annotation: Hit_ID=Q2R179; Match level="QueryCoverage=86%, HitCoverage=99%, E-value=2e-77, Identity=42%"; Hit description =Expressed protein
  Pfam annotation: Domain name=DUF829; Domain location=93-361; Score =139.8; E_value=7.2e-39; Accession=PF05705.5; Description=Eukaryotic protein of unknown function (DUF829)
LKFARFGYWVGLRAMRGAEGGDGGFAVRGGNIYWGRKEETDFRGIVVIFAWVSVPQNLFRDESAMPLAFCVLDELIEELRTRSCPVVFATFSAGSKACLYRVFQPNYQLLRNCLSGHIYDSGPIDITSDFGFRFALRPSIAKVPGPSKLVSWVAKSVTSGLDALYLTRFESQAAEHWQALYSSVNFGAPFLILCSENDDLVRYRSIYDFAQQLRNLNGDVNLVNFSSSSHLGHYKHHPIQYRAAVNQLLEKASSIYSQKMLLERERTGMDGTQDEISELICDLQKVAINSNKSLRRVAVGPTDHFFLPSSAGHYGDRESGTPQDEQKEKSVCVPSFPSISAHSVLGQFLFDVCVPKNVEGWDVKSSGNLNRKSCASAPRHSLFRGTKRIVPSLLIALRKNHTTVVSERRASDSSNWLMPGY

SEQ ID NO: 213345 - protein, 296 aa, Glycine max
  Coding DNA Sequence Number=SeqID_96567
  Gene Ontology: Mol. function=cyclin-dependent protein kinase inhibitor activity; Cellular component=nucleus; Biological process =cell cycle arrest
  Homolog annotation: Hit_ID=Q1SZJ0; Match level="QueryCoverage=61%, HitCoverage=97%, E-value=4e-18, Identity=38%"; Hit description =Cyclin-dependent kinase inhibitor
  Pfam annotation: Domain name=CDI; Domain location=220-268; Score =67.7; E_value=3.7e-17; Accession=PF02234.9; Description=Cyclin -dependent kinase inhibitor
MSFSGHCSWRRTKGRETRGTHLLINKLNLNRPRIDSLRSVNILCDHPLFKLPLPLSLSLPHLKIEKRNSPTIQTQTQRKKRIMGECKRCCSLTVLAMEEPSSSQHSIFKKRKTTATAAHSTSFQLCSSDMQFPHTIVSPEVSFSSACTVVSGEFCSDRSCCSSSHVKDLHSVPSDLQTKGFETVEDSTSLNFKSFSLLSEFSGDSEESAMIPAKSSAAVLKVKTPPKAEIEEFFAMAEKYEQKRFTEKYNFDIVRDLPLEGRYQWPLEYTGEEANLTRGKTKTSMQLLLVALKRRC

SEQ ID NO: 213346 - protein, 92 aa, Glycine max
  Coding DNA Sequence Number=SeqID_96568
MAVTCRKMQCRDKETAVSQNASEGERKFGKDRCCEYLIKISLIPTCAGFSEKALKSALISRSVAAYLLEQVYYWQKVDGLKRKKFMVVNMGR

SEQ ID NO: 213347 - protein, 35 aa, Glycine max
  Coding DNA Sequence Number=SeqID_96569
MIQQPRVPSSGLMPASDVLIPAKCKGGDHIQEQSC

SEQ ID NO: 213348 - protein, 276 aa, Glycine max
  Coding DNA Sequence Number=SeqID_96570
  Gene Ontology: Mol. function=metal ion binding; Biological process =metal ion transport
  Homolog annotation: Hit_ID=Q1RSM5; Match level="QueryCoverage=85%, HitCoverage=58%, E-value=3e-24, Identity=56%"; Hit description=Heavy metal transport/detoxification protein
KPGEGCATGKAGVQIQEPKPEVIRQTVVLPPAGPVTEKVSIAVQVPNDNEATGNENITGGTGGGGAGKKKKKKASVKGSTNNNANEGAGAATVTVEHAKANDGSGPSSGNQSHGQGHVHVHGSWLPFSSPANESPPRHHNIYRQYPPHYYAPPPPPPPPTTPAVHTVMSYHTAHPSSSYGTAYYTSPQPYSYAHVVRPGNEMEPPPPYTYERESYASSQPSDSFELFSDENPNACSVMDHMLLRHRVVEGYWFIAFIGGVMWAKRNNFLKKRRDMS

SEQ ID NO: 213349 - protein, 66 aa, Glycine max
  Coding DNA Sequence Number=SeqID_96571
MAATETIIAEPHEAEEQQQQHHVYVEAEPLSYKTVVLRVSIHCQGCKRKVQKILQAVHGNVTISKT

SEQ ID NO: 213350 - protein, 919 aa, Glycine max
  Coding DNA Sequence Number=SeqID_96572
  Gene Ontology: Mol. function=actin binding; Biological process=actin cytoskeleton organization and biogenesis
  Homolog annotation: Hit_ID=Q1RSM0; Match level="QueryCoverage=95%, HitCoverage=96%, E-value=0.0, Identity=60%"; Hit description=Actin -binding FH2
  Pfam annotation: Domain name=FH2; Domain location=494-893; Score =501.1; E_value=1.3e-147; Accession=PF02181.13; Description=Formin Homology 2 Domain
MGCGGSEHVTMIFIITILILLSSQSTNILTVAGSVFNAVGNFQVHGLPEMYFIEENDEKLVKKISGIDENEKKQALIVEKFRSLLGLKSFHTKVPFNGDLEFLSPSPSPSPIIEETQAPAPSPSPLPHVHHHSHHPPHHKNPSLHQTHHEDRGRAKRILIAVLVSAGVAILIGACGLFLVWRKFSNHTKKTKRTMPLYNSKSKGSGGVYQSSSSKVSLNSELDLFYLNALGEDIEQHSCSFKKTREDGLEYDIVSGSSMKDIASVHEDEEAVKGEGEGESDGGNSSSGDKIIPKDCHSSDNESFHSFVNDSHSNSNRLSNASACSLSDTNSLSRQNSSSLPNPQFPSSQHNLMSNIQPHQSPNSAKHDQEKEIETSLQCPKTFTSPPPPPPPPPPPPLRMPLFSLHSLTSSSRLSSHSPLSLTSNNLSSLVNSDTSSCSNQSPEKELPSPNRPYPTQSPPNIPPPPCPPPFLKGNSVKTPPPPPSQLPQFTPLGKDGAPLPKLKPLHWDKVRAAPNRTMVWDKLRSSSFELDEEMIESLFGYNLQNSIKNDEAKSKTPSPGKHVLEPKRLQNITILSKALNATAEHVCEALMQGKGLSLPQLEALVKMVPTKEEESKLFNYKGDINELGSAERFVRAMLDVPFAFQRVEGMLFRETFDDEVVHLRNSFSMLEEACKELRSSRLFLKLLEAVLKTGNRMNVGTTRGGARAFKLDALLKLADVKGTDGKTTLLHFVVQEIVRSEGIRVSDSIMGKISQRSKNRTEEEKEEDYKRMGLELVSGLSTELYNVKKTATIDLDVLASSVSNLSEGMNKLQHLVDKELHKDERSMNFVQCMKSFLNYADGNLKELRGDEDIVLARVKEITEYFHGDVISKEDANPLRIFVIVRDFLGSLDNVCKELRRSKAPRSLNPLAILPLDRS

SEQ ID NO: 213351 - protein, 134 aa, Glycine max
  Coding DNA Sequence Number=SeqID_96573
MDLGKIVFAIIGFSTSFLFCVPNIKKWQKKQVAGEKLKIVSEALEAAEERAVRFQQRHDRILSQICASYLTNTEVVEALAGARATMNQALDFAVELRKIQFRIIASFPDAIDVLLDTSKQTPTNIRILGPSRGA

SEQ ID NO: 213352 - protein, 439 aa, Glycine max
  Coding DNA Sequence Number=SeqID_96574
  Gene Ontology: Mol. function=acyl-CoA binding; Biological process =lipid transport
  Homolog annotation: Hit_ID=Q10B01; Match level="QueryCoverage=65%, HitCoverage=46%, E-value=4e-52, Identity=41%"; Hit description=Acyl -CoA binding family protein, putative, expressed
MSCTKAMHLFVKISKEEENPGRYSRASNSAVDPVVDVLMNHNSKVDPIIENGNTYPEIKTISTENGSQVRTQDKDVVIESFGSIGVYDQWITPPVPGQRPKARFEVVESADSSLVTFPCAGHSLNEKGSMLMLDAKEVLIGSGVPPSPRSDYVATVHVEQYLLIFGGEKSSSSNHLCELHRWNGLDQHNWVIVGENWFIVGGGDNKSGVSETVVVTSVQGRVPIASEGSSLVVSSYDGEDTLLSFRGYNGRYNNEVYVLKSSHISTLQSKLIENSIPNSVYGVHNATNATRNLESETGHKWIKELAVDNVDSIAEKEELKSSLHKDKLQTLQLKQELSEAETRNSDLCKGAIMLLVHIEYNAWELQSIHGQLASEQSKCFKLEVVELSQKLQTIGTLQKELELLQRQKNASEQAALNAKQKQGSGGVWGSSDRVIELTG

SEQ ID NO: 213353 - protein, 75 aa, Glycine max
  Coding DNA Sequence Number=SeqID_96575
  Subcellular localization annotation: CTP_CleavageSite=34; ConfidenceScore=5.13e-01
MSTPARVTRRSAFDSVKPSLASSPSEESKNIKIASASASNLGIPPSSLMSFLEKMLDRYYFFFLPLNNDIVKRVG

SEQ ID NO: 213354 - protein, 1045 aa, Glycine max
  Coding DNA Sequence Number=SeqID_96576
  Gene Ontology: Mol. function=protein binding
  Homolog annotation: Hit_ID=Q1RSL1; Match level="QueryCoverage=64%, HitCoverage=82%, E-value=1e-145, Identity=50%"; Hit description=IMP dehydrogenase/GMP reductase
  Pfam annotation: Domain name=PWWP; Domain location=84-160; Score =66.2; E_value=1e-16; Accession=PF00855.8; Description=PWWP domain
  Subcellular localization annotation: CTP_CleavageSite=40; ConfidenceScore=5.11e-01
MSQHHNNHATLTVSTGDANPDNRLQPVDAPISTAEHVRVRVSSEDNAAPASESARFSNSEVNSLLSEFDGYVAAGGASRNVGHGFEIGDMVWGKVKSHPWWPGHIYNEAFASSAVRRTKREGHVLVAFFGDSSYGWFEPSELIPFDANFAEKSRQISSRNFLKAVEEAVDEASRRCGLGLVCRCRGPGNFRPTDVEGYYSVQVPDYEPGVYSNAQIRRAMSEFGTVEMLSFVKQLAMNPHGGDPRSIDFTKNRATAFAFRRAVFEQYDETYAQAFGVQPRRPSDSIGNRLDQPVRLPAKAPLSGPMVIAETLGGEKKSATKSVKAKDNSKTDKYLFMRRDEPSNTFQLSSRETSDAAGSYVLQKRPLAVSAVPEALEKHEDTGIMSQDIAASTVKAEIAVADQVQSDGIGHASPEMTRSIEPVEVASKSMGRPHLSGEMALPNIVNETSQSTNMESKTYIDVKNDGNLTPSGPHEDFQQIEQGFLATSDEVKQVKHHKLNVDGVPKKIKVHKRPANDLKSETSGIEGKKKKKMKKGLNLQPTSGHLEKISTSEKAVQLSGQSEKSEPMQVDASTSNLMPMDSMAEVNIELPHLLGDLQALALDPFHGVKRGIPAVTRQFFLRFRSLIYQKSLPVSPPIVTENEAAEVRRPPSSVGTSDGPDDHARASSLIKPVKHIVRPDDPTKAGRKRALSDRQEEITEKRWKKIKNIKALAAEKKAGGQKTSEARQGDGKESMAQAPPKVVKPELTRKVERPAKAVEPTILVIKFPLETSLPSVAELKARFARFGPIDQSGLRVFWKTSTCRVVFLHKVDAQSAYKYALANQSLFGNVGVKCFLREFGDASSEVSEAAKARGDNGANESPRVKNPAVVQRQSSAQQPLPQPTIQLKSILKKSTADEPGQLTGNGGSSKGTPRVKFMLGGEESSRGEQLMVGNRNSFNSVSFADGGAPSSVAMDFNSKNVQKAISQPPLPNTPPPPTQFTKILQHNLHNSEMAPRNTPNFINATTSATAPTVDISQQMISLLTRCNDIVNNLTSLLGYVPYHPL

SEQ ID NO: 213355 - protein, 148 aa, Glycine max
  Coding DNA Sequence Number=SeqID_96577
MGKLFYGKPRPERGDKKSLNTFFRIINLTYLCRMIHSVLLNIVMPGVGSRDYVEILETPTPLPSPSLALPSQPTPKSASPHPRKAKVSTITKAKQHFVENAKRKAKAEKAMKKVKAEVAKKVVTLKGWASKEIHQEAIIEFLKTSVIP

SEQ ID NO: 213356 - protein, 76 aa, Glycine max
  Coding DNA Sequence Number=SeqID_96578
  Subcellular localization annotation: CTP_CleavageSite=51; ConfidenceScore=5.61e-01
MATPPSSPPPPPPTGAASQSPSSLKRTRKATRLRPLMTRLVGAERLLVHVDLATRKADDPHRKKLRTYLGIFTCDK

SEQ ID NO: 213357 - protein, 67 aa, Glycine max
  Coding DNA Sequence Number=SeqID_96579
MVEKMDGKVDDEDIQEVLREAALIPDINRQQWAKAIKWLADDPKQLAIVKALPIHQKTDYVLTHLGE

SEQ ID NO: 213358 - protein, 129 aa, Glycine max
  Coding DNA Sequence Number=SeqID_96580
  Gene Ontology: Mol. function=hydrolase activity; Biological process =metabolic process
  Homolog annotation: Hit_ID=Q0ZPW4; Match level="QueryCoverage=40%, HitCoverage=16%, E-value=1e-11, Identity=61%"; Hit description=CXE carboxylesterase
  Subcellular localization annotation: CTP_CleavageSite=3; ConfidenceScore=5.44e-01
MIRSSSSFSGHQPLALKYLNIPTKSNFPFINLTSYSFLPSLPLKAHNHLPIPSQKLAKPLNSTPPSSTMASTTTDDSEEVTYDLSPILKVYKSGRIERLAGTAVLPPGLDPETNVKSKDIVISEEHRIS

SEQ ID NO: 213359 - protein, 155 aa, Glycine max
  Coding DNA Sequence Number=SeqID_96581
  Subcellular localization annotation: CTP_CleavageSite=33; ConfidenceScore=5.18e-01
MKQNLPPHLFPKQFQSSKNFLKGKVISWFSLKACSKLQNKERETRLKRAIKGINSRKHQEESSQGNCASNQWGKTHQTIIMMDGSNSHKVISPNSIDSVPAYTTILVLEVFITGLPRMMGTDPLENPSPIFQIYQLIGKISSPTLTKTSSMKPTG

SEQ ID NO: 213360 - protein, 275 aa, Glycine max
  Coding DNA Sequence Number=SeqID_96582
  Gene Ontology: Mol. function=ATP-dependent helicase activity; Cellular component=proteasome core complex (sensu Eukaryota); Biological process=ubiquitin-dependent protein catabolic process
  Homolog annotation: Hit_ID=Q1RSK4; Match level="QueryCoverage=78%, HitCoverage=36%, E-value=2e-85, Identity=74%"; Hit description =Helicase, C-terminal
MFHGESACSPKPVINFEMPQSVAGYVHRIGRTGRAYNSGASVSLVSTDEMDTLEEIRSFVGDDENKGTNSIAEFPLLTKNAVESLRYRAEDVAKSVTRIAVRESRAQDLRNEILNSEKLKTHFETNPKDLDLLKHDKILSKNAPPPHLRDVPEYLLDKPTKEAREMVKLARDAMGNNNRRKGSKRKLRKEGDPLKAIYATASSKRPHKARKTGGSDSLNSSDRHKHKKNKGPNIVKRKTVQISLSSMSLVSHGMWHAEDHIGDTRMSSHSKIVVA

SEQ ID NO: 213361 - protein, 534 aa, Glycine max
  Coding DNA Sequence Number=SeqID_96583
  Gene Ontology: Mol. function=nucleic acid binding; Cellular component= intracellular; Biological process=regulation of transcription
  Homolog annotation: Hit_ID=Q1RSK1; Match level="QueryCoverage=99%, HitCoverage=100%, E-value=1e-158, Identity=59%"; Hit description =Zinc finger, C2H2-type
  Pfam annotation: Domain name=RS4NT; Domain location=153-190; Score =15.6; E_value=0.028; Accession=PF08071.2; Description=RS4NT (NUC023) domain
  Pfam annotation: Domain name=zf-C2H2; Domain location=168-190; Score =19.5; E_value=0.012; Accession=PF00096.16; Description=Zinc finger, C2H2 type
  Pfam annotation: Domain name=zf-C2H2; Domain location=195-216; Score =17.5; E_value=0.05; Accession=PF00096.16; Description=Zinc finger, C2H2 type
  Pfam annotation: Domain name=zf-C2H2; Domain location=92-114; Score =25.6; E_value=0.00018; Accession=PF00096.16; Description=Zinc finger, C2H2 type
  Pfam module annotation: Pfam domain module=RS4NT::zf-C2H2::zf -C2H2::zf-C2H2; Domain location=153-190::168-190::195-216::92-114
  Subcellular localization annotation: CTP_CleavageSite=75; ConfidenceScore=5.07e-01
MSNITSCDSGSFSTENTREDAAVKQQQSEMLGQFHSPHSHTSTTTTNNSNGSNTNSQPPAPVKKKRSLPGNPDPSAEVIALSPTTLMATNRFICEICNKGFQRDQNLQLHRRGHNLPWKLKQRTSTEIRKRVYVCPEPSCVHHNPARALGDLTGIKKHFCRKHGEKKWKCDKCSKKYAVQSDWKAHSKICGTREYKCDCGTIFSRRDSFITHRAFCDALAEENNKANEGQLPKIGPNLQCQQIPNLVSSLPINTNSIVPNPAQMGGTTSEFNHADHKHPLSLPHELMPMPAQKPFNNNMAAGTVFTRSLSSTSSPSLQLSSNMFDENGLHLAAGSPHMSATALLQKAAQMGATLTEKSTFATNMAPPSFGVLQQHHHHQQPNGQPFTNQYMHSGHHHQQQEVNISTQYSFGSANGMGGGSVGMNGVDMFNAILDQSKALSKIIEQNNNRSSSGGTTNGGSSSAINNVAGSKGSGDVMTLDFLGIGGGGSGSGGGAHGNFYGGAQQGETGAPDEVWRNWSSKNAGFESFSTTSSI

SEQ ID NO: 213362 - protein, 103 aa, Glycine max
  Coding DNA Sequence Number=SeqID_96584
MVWKAQNNLKILDSLPKVCEPSSTVIQEGHDMKTLMLDKLLGVHKVHEVHLQKRDKLKMKDPLALKIGESSLKKHEKIWVYTVALAGAAKLDHTVDDSMRLPL

SEQ ID NO: 213363 - protein, 701 aa, Glycine max
  Coding DNA Sequence Number=SeqID_96585
  Gene Ontology: Mol. function=nucleic acid binding; Biological process= DNA integration
  Pfam annotation: Domain name=zf-CCHC; Domain location=201-218; Score =24.3; E_value=9.9e-05; Accession=PF00098.13; Description=Zinc knuckle
  Pfam module annotation: Pfam domain module=RVT_2::zf-CCHC; Domain location=447-626::201-218
PPADVNASESSTPETPATPVVTPLPAETKKADEEAKKKYEKDNKTARGHLLTHMADNLFDLFINQKSAKTIWDTLLKRYGDDDAGRKKYVAGNWLRFQMMDDKPIMEQIHEYENLVGDILNEGMKMCEILQANVLLEKFPPSWSDYRNQLKHKKRDLSLQELINHMKTEEANRLKDKHKKGQKKTHTNINKGDNKIQKRKGECYVCGKTGHKAYECKLRKGQQSNNSKPAAPHAPQAHLAENEEVIAAVVVEANMVDNKVDWILDTGASKHLCANKELFHQIEDTDDGKCVFMGNSATAGVLGKGKILLKLTSGKTLSLSDVLVPHKRLDKTPYELWKGFAPNLNFLKVWGCLAKVALPDFKRTNVVPLHLHTSSFVTNEQVNEPRRSKRKRIKSSFGPDFVTAFVVENNDVDKINDVFVSTFLIEEDPKTYNEAVTSIDANFWKETINSELDSIMYNHTWDLVDLPKGSKPIRCKWIFRKKLRTDGTIDKFKARLVVVGYTQKKEIDYFDTYSPVTKISTIRSLVALAAIHGLIVYQMDVKTAFLNGDLREEIYVEQPEGYVIQGQENKVWSVMFLMNCTRPDIAYAVSRLSRYTHNPGQEAEWLRNLLADVPLWGKRSIPVSLHCDSEAAIGIAKNSVYNGKRRHIRIRHSSVRELLKNGVISLQFVRSENNLANPFTKGLTKKVVLESSRGMGLKPLC

SEQ ID NO: 213364 - protein, 84 aa, Glycine max
  Coding DNA Sequence Number=SeqID_96586
MSTKKNKECPKNKADKPYEKDALVPVEWLPSLAVELRSTQLSQNTAMSVTADTMVSVRRTWGSEMMVSDDTEEVRVAMRVGLRD

SEQ ID NO: 213365 - protein, 196 aa, Glycine max
  Coding DNA Sequence Number=SeqID_96587
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=99%, HitCoverage=16%, E-value=7e-72, Identity=57%"; Hit description=Chromo
DGTWRFCTDYRALNAITIKDSFLIPTVDELHGPVYVSKLDLRSGYHQIVVNEEDMHKTTFRTHQGHYEWLVMPFGLTNAPTTFQSLMNEVDYLGHTVSGKGVTMDQEKVQAVLNWPYPTNLKQLRGFLGLTGYYRKFIKGYASIAAPLSNLLKKENFHWNDHTFMAFDNLKAAITKAPVLALPDFSKAFTLETDAS

SEQ ID NO: 213366 - protein, 128 aa, Glycine max
  Coding DNA Sequence Number=SeqID_96588
MTCGDKVWSFRTPLPFRHSRVRWRAETKFGYSAPFVIQRRWPDDMRRQNLVIPHPFAIQTQSCPMARRDKIWSFCTLCHPEAAGPMTCGDKIWSFRTPLPFRHSRVRWRAETKFGHSAPFVIQRRRAR

SEQ ID NO: 213367 - protein, 233 aa, Glycine max
  Coding DNA Sequence Number=SeqID_96589
  Homolog annotation: Hit_ID=Q39HS2; Match level="QueryCoverage=47%, HitCoverage=27%, E-value=8e-40, Identity=75%"; Hit description=Major facilitator superfamily (MFS_1) transporter
PGGAGGAVDHGAGRGRDVHAVHLRGADPGGTDRRITQFRDGDAGADRPGLHHRQYRGRSLRRPFARWQPDRLPGAGDRRPAGLPLAGADPGGRRDRPLDLRFRHVRRGAAAADAGDARRDRRARPGVVGQRGRLQPGQRGGRGGRWRRDLGRAGLRRGAGGRRGDRRGRPGAGAVATRRQPAPAQAGGARLLNVRTRTSRPVRTCAPAPAAPGWWRGRRSRRRACRSGCARGK

SEQ ID NO: 213368 - protein, 160 aa, Glycine max
  Coding DNA Sequence Number=SeqID_96590
DRRRVGRYQTKSKAKGASTSRYWAHDRQVIVLRPAQDVKEALPGATLGQNLNPSTLSLDPGELSMKKESGSAPESKQCAKREVSSLSEPSITCQAQRNIGTKPKSTYSLMQAPLELVGLGSSSSMDSFASWKINGSGMEKEETEETPLQGEDESRRSSPP

SEQ ID NO: 213369 - protein, 95 aa, Glycine max
  Coding DNA Sequence Number=SeqID_96591
  Homolog annotation: Hit_ID=Q1S6U1; Match level="QueryCoverage=60%, HitCoverage=11%, E-value=7e-12, Identity=63%"; Hit description=GRAS transcription factor
  Subcellular localization annotation: CTP_CleavageSite=67; ConfidenceScore=5.59e-01
MSLGPPPPSPLPSPATTSHCLSIENSHQMPQSKPYNTSSTLQTLSQTQTTQIPCPNQPPPLSDNMVRKEEIKKLTTELDRLRSDSANKSGKIKEL

SEQ ID NO: 213370 - protein, 94 aa, Glycine max
  Coding DNA Sequence Number=SeqID_96592
MEGSQRDTHYPKEKLPKIITHKWKFGNLLEAPNTLPMKGLFVTKLESNEVLLSPIALKVVGPLLLDSNSSRDGTNPPSNFLYGNPQTRKQRDKQ

SEQ ID NO: 213371 - protein, 139 aa, Glycine max
  Coding DNA Sequence Number=SeqID_96593
MTMVEALKQETKRARKEEWSRNKFRGALWGSSNELKLRRAERDKSRVENMVLEDKLKACQRSKRSLTEQLSKTEENMLTIIDQYKEKVNLAASHGQRLEDEHVKVLTRGSLREGDRIIARGSMREGDRIIARGSYEMDG

SEQ ID NO: 213372 - protein, 259 aa, Glycine max
  Coding DNA Sequence Number=SeqID_96594
AFLGKTNFPNVCLRRKWPRGSLPQRGLGRIRRPKELVPLRSMIVTALGVLYINSAFEAIKGWSFLRDRRVQLRDDEYTDFQEEIGRRRWASLVTPMAKFDPEIVLEFYANAWPTEEGGQECEYGQRRNRSDGFDEEAIAQLLCIPGQDFARTAAGRRVRIMRTNMTTLTQIWMTLLLSNILPTDHNSDLPMPKCQLVYAILTRMSIHVAQLIADAIYIFAGMAPTRHPLDPDKSNKGPGIPRTDHRTLPVVRSPRCNYQ

SEQ ID NO: 213373 - protein, 151 aa, Glycine max
  Coding DNA Sequence Number=SeqID_96595
  Gene Ontology: Cellular component=membrane
  Homolog annotation: Hit_ID=Q0TH27; Match level="QueryCoverage=88%, HitCoverage=68%, E-value=5e-50, Identity=71%"; Hit description=Outer membrane lipoprotein, Slp family
  Pfam annotation: Domain name=Slp; Domain location=22-151; Score =160.7; E_value=3.7e-45; Accession=PF03843.4; Description=Outer membrane lipoprotein Slp family
  Subcellular localization annotation: CTP_CleavageSite=66; ConfidenceScore=5.41e-01
MLIRTASKKLSLLAVACGALVLSGCVTVPDAIKGSTPSPVTQLSSVQNAPNLFTGAEARFGGTVVNVANEQGRTVLEIAAVPLDSGARPILGEPSRGRLLATVNGFLEPVDFKGQLVTVVGPITGLKEGRIGMTPYRFVTMNVTGFKRWHL

SEQ ID NO: 213374 - protein, 395 aa, Glycine max
  Coding DNA Sequence Number=SeqID_96596
  Gene Ontology: Mol. function=nucleoside-triphosphatase activity; Cellular component=type II protein secretion system complex; Biological process=protein secretion by the type II secretion system
  Homolog annotation: Hit_ID=Q8DDT1; Match level="QueryCoverage=93%, HitCoverage=74%, E-value=1e-137, Identity=66%"; Hit description=Type II secretory pathway, ATPase EpsE
  Pfam annotation: Domain name=GSPII_E; Domain location=92-370; Score =490.0; E_value=2.8e-144; Accession=PF00437.11; Description=Type IIIV secretion system protein
SYAKDNGVLFYNNDVFIREDTPAFALLEVRRVLGRTFVPVTLTPEAFDELLAKIWQQSSGVSQQLVDDMDADIDLMALTEEIPDNEDLLDNDENSPVIRLINAILGEAVKDGASDIHIETFERTLSIRFRVDGVLRPVLQPARKLAPLLVSRIKVMSKLDIAEKRVPQDGRMALKVGGRAIDVRVSVMPASHGERVVMRLLDKQGVRLELPSLGMAPAHQQALLRLIRQPHGIILVTGPTGSGKSTTLYTLLSQINDEQRNIMTIEDPVEYELAGIAQTQVNPKVDMTFARGLRALLRQDPDVVLIGEIRDGETAQIAVQASLTGHLVLSTLHTNTAIGAVTRLRDMGVEPFLLSSSLSGVLAQRLVRRLCPQCREPYALSDAQRRLLGLPPTQR

SEQ ID NO: 213375 - protein, 135 aa, Glycine max
  Coding DNA Sequence Number=SeqID_96597
MPHNCGLVCSADLFLGLLAQLGPPKIPFQPGFIQADSFGIPEGALSSAGIHAEIRGLLAQLVEQRTLNPLVECSNHSGPTTNTQNKALGATALSAFSCCIPSAQTYCCCQPWPPTPGQSAPPPNPACGAGPPMAR

SEQ ID NO: 213376 - protein, 203 aa, Glycine max
  Coding DNA Sequence Number=SeqID_96598
  Gene Ontology: Mol. function=catalytic activity; Cellular component =integral to membrane; Biological process=metabolic process
  Homolog annotation: Hit_ID=Q0X0J4; Match level="QueryCoverage=84%, HitCoverage=52%, E-value=5e-90, Identity=92%"; Hit description =Guanosine monophosphate reductase
MVALSRARVPPGAQPQKRRPRPPLGCWRAARLHQQMFACVVTAQDHVVDLADVHQLLAAGVADRALHVLLHLDQGVGQKALDRLEDALALHVLVLALVEVRGRAVVLLEALAVFLDGLARRFLVAREQRADHHHGGAKAHALGDVAVAADAAIGNDGLGRHARAPLERRQLPATRAKARLELGDADLAGADADLGGVSAPVLQ

SEQ ID NO: 213377 - protein, 218 aa, Glycine max
  Coding DNA Sequence Number=SeqID_96599
  Gene Ontology: Mol. function=DNA binding; Biological process=DNA recombination
  Homolog annotation: Hit_ID=UPI00005F755E; Match level="QueryCoverage =99%, HitCoverage=54%, E-value=9e-74, Identity=59%"; Hit description =COG0582: Integrase
DTSKAKDKAYKLSDGGGLYLLVNTNGSRYWRLKYRVAGKEKLLALGVYPDVSLADARAKRDEAKRTLAAGGDPGEVKQTEKQAKILAVSNSFEALAIEWHEHKRPNWSLGYASDILEYLQKDVFPFIGKRAIAEIKAAEMLLVLRKMEQRGVLDKLKKTRQACRQIFTYAVITGRAEHNPVTDLAGALKAPKQKHFPHLLTEQIGGFLRALSEYTGSK

SEQ ID NO: 213378 - protein, 98 aa, Glycine max
  Coding DNA Sequence Number=SeqID_96600
MSEWRKSERNDHNFSACHMTPGISFLNDHLEETLGSTKIEENHSKCINLTQGKVYDELGLWLTACRTDGHDICQGVGLARGLGIKGMSHIISMTHMQQ

SEQ ID NO: 213379 - protein, 135 aa, Glycine max
  Coding DNA Sequence Number=SeqID_96601
WLRRGNQHIGNDDVKVFRRKLDIMKRHEFVWEPYPSTVISLLPPVCLVGSIAWRKTKMFVDPENAKTATLGEVAEALQYMVSPQGRKTCTFDDLVPYVEKITILSEEQERVTEPVSHGPASERQFPPQQFHMLQS

SEQ ID NO: 213380 - protein, 233 aa, Glycine max
  Coding DNA Sequence Number=SeqID_96602
  Gene Ontology: Mol. function=transporter activity; Cellular component= membrane; Biological process=transport
  Homolog annotation: Hit_ID=Q11EU0; Match level="QueryCoverage=83%, HitCoverage=69%, E-value=9e-46, Identity=46%"; Hit description =Binding-protein-dependent transport systems inner membrane component
  Subcellular localization annotation: CTP_CleavageSite=23; ConfidenceScore=5.39e-01
MTIDTRPAPTAAPRRATAPPPVSARRRRRASDVFAGGGVHLLLIVMGLFSVVPILIVLMNSFKTTQGIFGAPFALPDAETFNVQGYINVFTRGNFLLNYQNSLIVTLATIVLTIVLGTLAAWALVEYKVPITPVLAGFFVVGIMLPIRLGTVPLIKIMTSWGLMDTLTALILVYTAMQLPLAIALMTTYFRAVPNELKEAARIDGAGEWRTLGITLPIVRVGIAAVAFITMLP

SEQ ID NO: 213381 - protein, 66 aa, Glycine max
  Coding DNA Sequence Number=SeqID_96603
  Gene Ontology: Mol. function=transmembrane receptor activity; Cellular component=membrane; Biological process=defense response
  Homolog annotation: Hit_ID=Q1SGR7; Match level="QueryCoverage=92%, HitCoverage=5%, E-value=1e-16, Identity=67%"; Hit description=TIR; Disease resistance protein; AAA ATPase
VPGKHVLPIFYDGDPSEVGKQTGDYGKAFTKHEERFKDDGEKMEEVKRWRRALTQVANLSGWDMMN

SEQ ID NO: 213382 - protein, 166 aa, Glycine max
  Coding DNA Sequence Number=SeqID_96604
MTLLLINVLPSDHNSDLPPPKCQLVYAILTRMSVHVAQLIDDAIYLFARLAPTRHPLDLEKSKRALGFSALIRGLCQSYGVPVTPSKVIRPPITRAFIGKYCTPRQVQGDAHQATGASPPPRQADPAGPLGVERYLQHLVRQQAANHRGQVQIHECLYRFSLSQQG

SEQ ID NO: 213383 - protein, 319 aa, Glycine max
  Coding DNA Sequence Number=SeqID_96605
  Gene Ontology: Mol. function=transferase activity; Cellular component= integral to membrane
  Homolog annotation: Hit_ID=Q13ML3; Match level="QueryCoverage=88%, HitCoverage=18%, E-value=1e-46, Identity=38%"; Hit description=YD repeat protein
  Pfam annotation: Domain name=RHS; Domain location=89-129; Score=52.2; E_value=1.7e-12; Accession=PF03527.4; Description=RHS protein
RALTTRREYDCLGRLHRRDVYTVNAQRPSPRRQMLGGQPTGKPVTTRFVWEGFRLLQEVNGDVPLTYVYSDQDSYDPLARVDGVDAPEIFWFHCQPNGTPERMTDIEGQVRWEGVNSAWGKLLRESETQVSGYSQNLRMQGQYLDRETGLHYSLFRYYDPDCGRFTQQDPIGLAGGINLYQYAPNALGWIDPWGLTKCSSGGPNKETSYEGVSRRDAFRQAKRDAGIPMNQHPRTISRPDLLDGEGNKILNSKGLPIKTRQYEFRDSNNKPVFIQEHSLGHDKATSGHGAEPHFNVRPPQNLNTGSVPGTHGHYNFEGL

SEQ ID NO: 213384 - protein, 114 aa, Glycine max
  Coding DNA Sequence Number=SeqID_96606
  Gene Ontology: Mol. function=nucleic acid binding
MTLQLADRSITRPYGVIEDVLVRVKHFIFPADFVVMDISEDTDIPVILGRPFMLTASCIVDKGKRKLELGFEDQKIDFDLFVEDKPAPEHNVCSRGSESRNQNIRSPSEVKTSS

SEQ ID NO: 213385 - protein, 108 aa, Glycine max
  Coding DNA Sequence Number=SeqID_96607
  Gene Ontology: Mol. function=protein binding; Cellular component =anaphase-promoting complex; Biological process=regulation of mitotic metaphase/anaphase transition
  Homolog annotation: Hit_ID=Q9ZPW2; Match level="QueryCoverage=51%, HitCoverage=29%, E-value=1e-20, Identity=85%"; Hit description =Anaphase-promoting complex subunit 10
  Pfam annotation: Domain name=APC10; Domain location=15-108; Score= -61.2; E_value=0.00056; Accession=PF03256.7; Description=Anaphase -promoting complex, subunit 10 (APC10)
KSLARTHRTSYRRKVEENPTLLLELCVSKKPYTALGTVVGAQSSKLSTLPVNKLIVLYVVFKLDESYTPSKVSIRAGDGFHNLKEIKTVELVKATGWVYLSLSGADPR

SEQ ID NO: 213386 - protein, 80 aa, Glycine max
  Coding DNA Sequence Number=SeqID_96608
TGDSTVLKIGNSAKVVIKQDMKGRRHKYGFNNNKREKAEMKRVVDDETGDKHQLDEHQERLRKKLALEEGRIFAANEQLS

SEQ ID NO: 213387 - protein, 153 aa, Glycine max
  Coding DNA Sequence Number=SeqID_96609
MMREIRFMEDDETKQRGGIIVKPEWRMKVRWRGKLILELNSSSETLLFFIFFISTKEKLKHFPTEYFPSVFSVDNRKIFIDNNDFSSTSGDATPPSPKTTRLMAEMIKPSDQMRRMSYDNEERMERMRKENEENLGIIHGSSEALIVRIENIV

SEQ ID NO: 213388 - protein, 76 aa, Glycine max
  Coding DNA Sequence Number=SeqID_96610
MRGIVHEPQVNIGADQKFSPVDVFKHTKKGGDKPWNFYGLIKRQTTPLPSLQNGQVTKSNRTNTLREFPERLAKIG

SEQ ID NO: 213389 - protein, 209 aa, Glycine max
  Coding DNA Sequence Number=SeqID_96611
  Subcellular localization annotation: CTP_CleavageSite=41; ConfidenceScore=5.28e-01
MAESLKKRKGTSSTTAATGHRRHGPSEAPRAPIHPSLSSPRSSTLFSSDDQRLQYNSQFSSRIILDPKYLDTDLFNDETFDCYQVFQNSGLVDFMSLKLSYYPELVKFFYINLKIQDGIISSEVHGISMIIDQSLFFSLTKLPSQGAPFEGTIVDDWKFNYSSHDARCMVFHDRILLPRSSNLAQASEEYLILMWAFLTGRQIDWAHLV

SEQ ID NO: 213390 - protein, 358 aa, Glycine max
  Coding DNA Sequence Number=SeqID_96612
  Gene Ontology: Mol. function=catalytic activity; Cellular component =integral to membrane; Biological process=electron transport
  Homolog annotation: Hit_ID=Q46927; Match level="QueryCoverage=57%, HitCoverage=88%, E-value=9e-75, Identity=63%"; Hit description =Hypothetical protein ygdL
  Pfam annotation: Domain name=DAO; Domain location=10-285; Score= -55.5; E_value=0.029; Accession=PF01266.14; Description=FAD dependent oxidoreductase
  Pfam annotation: Domain name=ThiF; Domain location=7-142; Score =207.2; E_value=3.8e-59; Accession=PF00899.11; Description=ThiF family
  Pfam module annotation: Pfam domain module=DAO::ThiF; Domain location= 10-285::7-142
EALQRFADAHFCVIGIGGVGSWAAEALARTGIGKITLIDMDDVCITNTNRQIHALQGNVGQAKTEVMAQRIHAINPECEVICIDDFITPDNTAELMAAGFDYVIDAIDSVRPKAALLAWCRRNKIPLITTGGAGGQIDPTQIQQGQTGDRLRVFYRGAGVSAAGRQRMRFAQHRGRPKRMDCAAGFGAATMVTATFGFVAVSHALKNSSRARRVSLPDARGRHAVPPLPAPGRGRFSFHRCQQHRQQSAHNAPLTVAVKMQRAVGPLLAAEPDAVFAAGELNVRRFQRFRQRRQLAAELNQLAIAIFPLMKMGKLLRQAGFDAQRAADAKRRHQRLGTVLAGAQRDALFRQQRHDIAV

SEQ ID NO: 213391 - protein, 52 aa, Glycine max
  Coding DNA Sequence Number=SeqID_96613
MGQAISGPREFMKRPKTKVESKEMNGGNRILLSKLLNVNENDVCGSTAIKLF

SEQ ID NO: 213392 - protein, 111 aa, Glycine max
  Coding DNA Sequence Number=SeqID_96614
MVEIEQRKLSRYSIGHNFSLGCPIQAHNISRRLKLNMEAQCNFKRPIDEDMTKSKGKDPLEGLGGHMTRPRARKAKEALQQVLSILFEYKPKFQGEKSKVVSCIMAQMEED

SEQ ID NO: 213393 - protein, 235 aa, Glycine max
  Coding DNA Sequence Number=SeqID_96615
  Gene Ontology: Mol. function=glycerone kinase activity; Cellular component=cytoplasm; Biological process=glycerol metabolic process
  Homolog annotation: Hit_ID=Q1H2B5; Match level="QueryCoverage=98%, HitCoverage=73%, E-value=3e-88, Identity=71%"; Hit description =Dihydroxyacetone kinase DhaK, subunit 1
  Pfam annotation: Domain name=Dak1; Domain location=2-235; Score =101.9; E_value=1.9e-27; Accession=PF02733.7; Description=Dak1 domain
MLAAAEAVHAGDVMNFEMAAEMLPFEHATVYTSDDCAVINSTYTTGRRGVAGTVIVEKCVGSLAETGAELAACKTLGEKINQRTSSIGVALTSCTVPAAGRPTFEITDTELEMGVGIHGEPGRRRETMREADAIVADMVAAIVHDFETKQLPAQGEILLLVNGLGATPLMELYLMYNTAAKLLQEKGFSVARSLVGNYITAIDMAGASITACLLDDDIRQHWDSPVHTPALRRGV

SEQ ID NO: 213394 - protein, 93 aa, Glycine max
  Coding DNA Sequence Number=SeqID_96616
MGSDSKRSLGTFFPIVLRWFYQLAGSCHLLDEVFQQTHLRKDTGQFVDDRSRRTHEEFEARLSQARSNATSSVGESQVTPLDPTEEQRLRSWC

SEQ ID NO: 213395 - protein, 90 aa, Glycine max
  Coding DNA Sequence Number=SeqID_96617
MPHHNLADFEPCLRYATEGQEVGGIPLQNTLEGPQYHPQAHLLHFAAGKLDHLEERLRAIEGGIDYAFTDVEELFLVPKHGHSQVQGAGL

SEQ ID NO: 213396 - protein, 143 aa, Glycine max
  Coding DNA Sequence Number=SeqID_96618
MLMCNHEFSFVGPIELLCSIARTPDGILNLLQATITPTHDALLYYNGRWNMSRQNEFVGYSFTGKNLKKFDIPSGFTMDELKDLIKQVAPTGIPPYGIDETQMVLIESSYWKKIEPIEILVVFSKPVPKMEETSCPCRKINMS

SEQ ID NO: 213397 - protein, 232 aa, Glycine max
  Coding DNA Sequence Number=SeqID_96619
  Gene Ontology: Mol. function=transporter activity; Cellular component= integral to membrane; Biological process=transport
  Homolog annotation: Hit_ID=UPI00005F7CB4; Match level="QueryCoverage =89%, HitCoverage=58%, E-value=3e-15, Identity=45%"; Hit description =COG0477: Permeases of the major facilitator superfamily
  Subcellular localization annotation: CTP_CleavageSite=44; ConfidenceScore=5.01e-01
MLNFVARTTYDNDTFMTALDAAQPNKLHQRVNLGTRLVFLIAGLSMSAWAPLVPFASQRLQLTGASLGGLLLCLGIGSLAAMPVTGALVARFGCRRVMLCSTLVVLAVLPLLATLDVMWLMAATLMVFGAGLGMLDVAMNVQAVEVEKAAAKPMMSGFHGFFSLGGSRRYHAADGAAVAVQPADADDRAPASARSTLAGDPARLGRLPRLPVLYSVPCGRRGTRLERPAAAA

SEQ ID NO: 213398 - protein, 377 aa, Glycine max
  Coding DNA Sequence Number=SeqID_96620
  Homolog annotation: Hit_ID=UPI00003CC99A; Match level="QueryCoverage =29%, HitCoverage=71%, E-value=4e-44, Identity=75%"; Hit description =COG3558: Uncharacterized protein conserved in bacteria
  Pfam annotation: Domain name=TetR_N; Domain location=207-253; Score =56.0; E_value=1.2e-13; Accession=PF00440.13; Description=Bacterial regulatory proteins, tetR family
MIYMILAITAGTIRRAGVKALHQCRASCITSALAQCNKAATGHVALRAVAWHELCSVDSGLNISETQLAQARMIVRASASRPVKQPRFSADRQIVDAGEALNHQTIGTKVPVFIAVAAEPVAAVIAPLIGKTHRQLIVVPRPQLFNQPIIQLAGPFALQKCHDVRAAVNEFAAIAPADNPVYPRKQEFFLMLAPLLFDASASARDRILLSAQQLFYAQGIRATGIDKVIAAAGVTKVTFYRHFPAKNDLILAFLQQRHQRWMSGFRSALAQQPAINVALPAALLSWFQEEDFRGCAFINSAAELADTLPEASALIRQHKREMAAAIAERLSTAQQDKTGQIVLLVDGAIVQVQMGEAAQQVTATLQAALNALLESRA

SEQ ID NO: 213399 - protein, 119 aa, Glycine max
  Coding DNA Sequence Number=SeqID_96621
  Gene Ontology: Mol. function=adenosylmethionine decarboxylase activity; Cellular component=integral to membrane; Biological process=spermidine biosynthetic process
  Homolog annotation: Hit_ID=Q9WZC3; Match level="QueryCoverage=91%, HitCoverage=84%, E-value=8e-48, Identity=78%"; Hit description=S -adenosylmethionine decarboxylase proenzyme (EC 4.1.1.50) (AdoMetDC) (SamDC) [Contains: ...
  Homolog annotation: Hit description=S-adenosylmethionine decarboxylase beta chain; S- adenosylmethionine decarboxylase alpha chain]
  Pfam annotation: Domain name=AdoMet_dc; Domain location=1-95; Score =179.5; E_value=8.3e-51; Accession=PF02675.6; Description=S -adenosylmethionine decarboxylase
MLDNIDAIEFHMKQAAYETGATIVNSSFHRFLPYGVSGVVVISESHLTIHTWPEYGYAAVDLFTCGDHVDPWKAFSYLKKIFKSQRAHVVEHLRGKYDEVGIPENAPHKAVEAEMAEIF

SEQ ID NO: 213400 - protein, 130 aa, Glycine max
  Coding DNA Sequence Number=SeqID_96622
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=73%, HitCoverage=6%, E-value=6e-31, Identity=68%"; Hit description=Chromo
MDQGKGSSSPELAISYKSEAIESFLRLTGYYSKLIKAAITKAPVLALPDFSKAFTLETDASGIGIRAVLSQEQHPIAFFTKKFTPRMQRQSAYIRESYAITEAVAKFRHYLHGHRFVIKTDQRSLKSLTE

SEQ ID NO: 213401 - protein, 120 aa, Glycine max
  Coding DNA Sequence Number=SeqID_96623
MIETSMRAGNVDVYGFLEPQSIQRSRPDNYLKGIINRSILFFNTFLLALVGNISILIVQYASMFVLNNALKGLDDTSQSKSKAAAKWIVIKGNRQKGSTECGYYVMHWMSTIILGSFKNN

SEQ ID NO: 213402 - protein, 61 aa, Glycine max
  Coding DNA Sequence Number=SeqID_96624
MTSLSYLLLHFSLLSQFKEQGIVIVTAIRFHHQCFGRSSASSIRGRSGEAYSIFNIFFYPR

SEQ ID NO: 213403 - protein, 75 aa, Glycine max
  Coding DNA Sequence Number=SeqID_96625
MPAILMKHTLLAAARELFRIAQLRLTMPTKKKVDKKTSMQINREEKDPRGEQRNAPANKFDNNYRQSAKNSVAML

SEQ ID NO: 213404 - protein, 170 aa, Glycine max
  Coding DNA Sequence Number=SeqID_96626
MEAIERTDVRPYHLERVLRKFGHQHIIPLGKVVLPGGPWAYTSNYLLWLYKVSHPYVIPSEEGQPPHGPVWLPPIPIQPLADYVPEGDYSCQLLIVIVITISILVGIKSYVELTRPQSCARGHKSSLGHTSSFVIVVGGLSIWMQLGHTETTERIVKDGGKGGKKGGRCG

SEQ ID NO: 213405 - protein, 128 aa, Glycine max
  Coding DNA Sequence Number=SeqID_96627
  Homolog annotation: Hit_ID=Q1T1Y0; Match level="QueryCoverage=38%, HitCoverage=12%, E-value=6e-08, Identity=60%"; Hit description =Ankyrin
MQKLEPEIATKLQLRPATNRIIGPPFGGGLIDLSFIRSCKNHCVGHVWICQEWPKLKFVSHDAQVLALFTHLLVRAHVDRLGLSTLVTMHYIAANKGLVNAYLVRWHQEISFFHLPVEEMTIIMDDVT

SEQ ID NO: 213406 - protein, 50 aa, Glycine max
  Coding DNA Sequence Number=SeqID_96628
MNFAGEGEGKVKNRALVGSDSDVVESDQGRGGRGRARRVDDDNGCNNRNL

SEQ ID NO: 213407 - protein, 1103 aa, Glycine max
  Coding DNA Sequence Number=SeqID_96629
  Gene Ontology: Mol. function=RNA-directed DNA polymerase activity; Cellular component=chromatin; Biological process=chromatin assembly or disassembly
  Pfam annotation: Domain name=RVP_2; Domain location=283-406; Score= -31.0; E_value=0.00026; Accession=PF08284.2; Description=Retroviral aspartyl protease
  Pfam annotation: Domain name=zf-H2C2; Domain location=910-951; Score =13.9; E_value=0.0052; Accession=PF09337.1; Description=His(2)-Cys(2) zinc finger
  Pfam module annotation: Pfam domain module=RVP_2::RVT_1::zf-H2C2; Domain location=283-406::470-654::910-951
MADGTRSKASSERLEDAIAKLTTSQLAMNSKIDYLLQRMSQLEANQQQPQSSPSSSAGHTPQTQTSFHRMKLDVPRFDGSNPIGWTFKITQFFEFHSMPDHKRLTIASFYMEGPALAWFQWMHRNAQLSSCYFISGLNPTIRREVQVLQPISLTQAVSYARLQEEKLLDARRPPPYRPLVSTGPSNTRSSSSNSTQPLLPTPVRTPSSIPFKRLTPKELASRREKGLCFHCDEKFSRGHKYASSLFLLVMDDEDTTIEAESIRDYTPTQELLPESPPVQLSLHALSGHLAPETLQLKGFINDRPINILIDGGSTHNFLHNRVVLSLGLKTTETTPLRVTVGNGEEIHCNQLCTAVQVHIQQHSFTIDFHVLPLCGVDVVFGVQWLKTLGPVLTDYGALTMKFITGGKLIELHGDREKGIEPMSPSQLHRFVHTNPTTTFFHIRVETATTHNSSPNHPLPAINTLISKYTSLFQPPATLPPSRSTDHTINLLPNSTPEIEEQVATMLEKGFIQPSSSPFSSPVLLWMSYSMSWVEHGSSLSLISCKDHQILMNTSDICKTSFRTHQGHYEFRVMPFGLCNAHSSFQATMNQLFQPYHRKYIIVFFDDILIYNRTIHDHLLHLEKAFQVLVEGKFSLKLSKCTFAQEQLEYLGHMVSSSGVTSVLEKVQAVSQWPTPRTPRALRGFLGLAGFYRQFIKGYAALASPLTKLLCHDQFEWSHEAEIAFQNLKRALTEAPVLELPDFTTSFVVETDASGSGMGTVLTQKGHPLAYYSKQFCPKLINASTYSLRELMNQTIQTPEQHRYLARLLGFDYSIQYRARKTNVVADALSRSQEDHTVSLFFLSMPRFVFLDDLRKELASLETFQDLHSRIQENPASYPDYALIEGLNMYKKRIWLPSNSSFIKQLLEEFHQSPTGGHMGIQKTLQRLNDNFTWASIKEDIRKFVTACATCQHTKYDNRKPTGLLCPLPVPTLPWEDLSMDFIMGLPSYRDNTCIFVMVDRFSKAALKLIIPSAVRWTNGGRKSPSNIYELSCMKNQQRGKDTCLGPNGPIISLAIQLRREEVFAMLRRKLLKAQSRMKTNADCHCRDQEFQVGDWVLVKLRPQ

SEQ ID NO: 213408 - protein, 316 aa, Glycine max
  Coding DNA Sequence Number=SeqID_96630
  Gene Ontology: Mol. function=protein serine/threonine kinase activity; Cellular component=membrane; Biological process=protein amino acid phosphorylation
  Homolog annotation: Hit_ID=Q93XL9; Match level="QueryCoverage=99%, HitCoverage=35%, E-value=2e-79, Identity=49%"; Hit description=CTR1 -like protein kinase
MMEMPARRSNYSLLSQIPDDQFSASAAPSSSGDGKSARAGKSDRAAFDWDLVADHRAANRIGNLYSSIGLQRQSSGSSYGESSLSGGGDFYAPTLSTAAVSDVDAFGYLHDERSKFSEVAPARIAGSSSGKSWAQQTEESYQLQLALALRLSLHATCADDPNFLDPVPDDAAPRLSSSAEAVSHRFWVFVVCVKGRINQIVLDDRKLLEVHSHWLVNGCLSYSDKIPDGFYLIHGMNSFVWTLCTDLHENGRIPSVDMLKSVNPCVVSSLEVVMVDRRSDPSLRDLQNNVHNISCTSITTTDVVDKLSKLVCNRMG

SEQ ID NO: 213409 - protein, 50 aa, Glycine max
  Coding DNA Sequence Number=SeqID_96631
MSKDLLVGLSIDVEVGGNNSASIRGDYVLVDDSARDEPLLHRLHHHTPHV

SEQ ID NO: 213410 - protein, 168 aa, Glycine max
  Coding DNA Sequence Number=SeqID_96632
MEIGMLLILGEWVLMNNPIKRDKDVGSNTKRFSLRERRKNSMGQMGENLPPKGRGELTSSTKYSIWWRDFKANIEGLQLKEDEQVVEMDFQFAQSMCVVQTCDPLNHLQQHYIEGLSKEANDAWMVTWFAVVWFLWIQRNAIIFNNEQKDEGKVWETYQNQSVAMAGS

SEQ ID NO: 213411 - protein, 140 aa, Glycine max
  Coding DNA Sequence Number=SeqID_96633
MRRGVKRKEWEVVGGVRILKGCEGGGGWRDDGGGRERPLHSESDVGVNDCIGDDMLNEIDNITKNIVAHYRDNDGGVDSVEGDVVAHKFGEVVHPLYDIQLDYGGLNVKKDVATKVMTDFFGDVGDDNQDDVRKNEDGRG

SEQ ID NO: 213412 - protein, 413 aa, Glycine max
  Coding DNA Sequence Number=SeqID_96634
  Gene Ontology: Mol. function=protein serine/threonine kinase activity; Cellular component=membrane; Biological process=protein amino acid phosphorylation
  Homolog annotation: Hit_ID=Q5YKK5; Match level="QueryCoverage=84%, HitCoverage=39%, E-value=1e-148, Identity=76%"; Hit description=CTR1- like protein kinase
  Pfam annotation: Domain name=Pkinase; Domain location=119-393; Score =217.3; E_value=3.3e-62; Accession=PF00069.15; Description=Protein kinase domain
  Pfam annotation: Domain name=Pkinase_Tyr; Domain location=119-393; Score=270.1; E_value=4.3e-78; Accession=PF07714.7; Description =Protein tyrosine kinase
  Pfam module annotation: Pfam domain module=Pkinase::Pkinase_Tyr; Domain location=119-393::119-393
MEILDSPFQNSLMGSAKTAVTLGQFRLIAIEVLTFLCIRKILIQAHVNKNIVDSTLGKYPPPIKHKRPAGIPTPLALTNTNDDMIEGKRFVEGSQLIPSKHARELNFDMEDLDIPWSDLVLREKIGSGSFGTVHRAEWNGSDVAVKILMEQDFHAERFKEFLREVAIMKRLRHPNIVLFMGAVTQPPNLSIVTEYLSRGSLYRLLHRSGAKEVLDERRRLGMAYDVAKGMNYLHKRNPPIVHRDLKSPNLLVDKKYTVKVCDFGLSRLKANTFLSSKSAAGTPEWMAPEVLCDEPSNEKSDVYSFGVILWELATLQQPWVNLNPAQRVAGNRNLRMIARSGYWLKHVVAAVGFKRKRLEIPHDVNPQVAALIEACWAYEPWKRPSFASIMDSLRPLLKPPTPQPGRPSMPLLT

SEQ ID NO: 213413 - protein, 199 aa, Glycine max
  Coding DNA Sequence Number=SeqID_96635
VRITIRYLRMSSDLPSLDDECADDDVWITIGYLRMSSDLPSLDDKGADDDLAKGVDMHKYLHMSSDLPSLDDKGADDDVQMTTLVSACQQARLPLADKRITNNTFSQSWPKDADISKKGRLRLPPDPQVMIEKGGVVDKSEAFAPTYPQFVMRNSDLPRRGWKFSSRVKVHGEFGFWLRACRTTGHDICQGVGLVNSPG

SEQ ID NO: 213414 - protein, 109 aa, Glycine max
  Coding DNA Sequence Number=SeqID_96636
  Gene Ontology: Mol. function=growth factor activity; Cellular component=extracellular region; Biological process=cell proliferation
  Homolog annotation: Hit_ID=Q7PCB2; Match level="QueryCoverage=58%, HitCoverage=72%, E-value=3e-25, Identity=84%"; Hit description =Putative phytosulfokine peptide precursor
  Pfam annotation: Domain name=PSK; Domain location=31-109; Score=54.9; E_value=2.7e-13; Accession=PF06404.3; Description=Phytosulfokine precursor protein (PSK
MKRGYYMTKVGAIVGFDLKTKMQPIVLFFFVLLLSSFLASSRLLEPLKGKGPRQGEKEVEVNENAIPQSSDMEELIGSEECYMKDEECTSRRMMVEAHLDYIYTQHHKH

SEQ ID NO: 213415 - protein, 233 aa, Glycine max
  Coding DNA Sequence Number=SeqID_96637
  Homolog annotation: Hit_ID=Q9FUL4; Match level="QueryCoverage=48%, HitCoverage=61%, E-value=3e-55, Identity=92%"; Hit description=60S ribosomal protein L24
  Pfam annotation: Domain name=Ribosomal_L24e; Domain location=72-142; Score=169.6; E_value=7.8e-48; Accession=PF01246.10; Description =Ribosomal protein L24e
MKTTSLENENKEQNEFSVKMVHEEGKGRSYQGYFWNLENLLGAQQVLWVHKAIPKTLSFGPAQEFIYEVLLYRTELCRFSGAKIYPGKGIRFVRGDSQVFLFANSKCKRYFHNRLKPSKLTWTAMYRKQHKKDIAQEAVKKRRRATKKPYSRSIVGATLEVIQKKRTEKPEVRDAAREAQLREIKERIKKTKDDKKAKKAEVAAKSQKSQGKGSISKGAMPKGPKLGGGGGKR

SEQ ID NO: 213416 - protein, 121 aa, Glycine max
  Coding DNA Sequence Number=SeqID_96638
  Gene Ontology: Mol. function=peptidyl-prolyl cis-trans isomerase activity; Biological process=protein folding
  Homolog annotation: Hit_ID=O81864; Match level="QueryCoverage=55%, HitCoverage=29%, E-value=1e-15, Identity=63%"; Hit description =Peptidyl-prolyl cis-trans isomerase
  Pfam annotation: Domain name=FKBP_C; Domain location=2-74; Score =24.3; E_value=2.1e-05; Accession=PF00254.18; Description=FKBP-type peptidyl-prolyl cis-trans i
MVVGDSTYKTNRYKLSFVFFIGSGKVIAGIDVAVRSMKEGGIRRVIIPPSFGYQNTSQEPIPPNVRTFFFSRLIACLCLYTMSSEQVFSLHTLLLLDQGHTMCHMAVRVIEEKQKQQKKGH

SEQ ID NO: 213417 - protein, 135 aa, Glycine max
  Coding DNA Sequence Number=SeqID_96639
  Subcellular localization annotation: CTP_CleavageSite=83; ConfidenceScore=5.44e-01
MAKNKKCFSPKDRSKHHNKAGFERFSKGRRSVWLLVRRPKARFPRANGSRQLHFFKMAHRSRHGRAHYVYSQCELNNGRWSFRERERGSDNGSRHVDDVHQGERARFEGERDLGYRASGREGFKLRHNNGCWSCG

SEQ ID NO: 213418 - protein, 121 aa, Glycine max
  Coding DNA Sequence Number=SeqID_96640
MAICRAIGNRQSNWRVPTAEGACHGSEGQSASRQSRPNRQWQWRFALGMDRQPCWRVAPKYASSIIKAQSESAPATLPSWLSPRVHQLASFVPLLPLILPLLCFHCCAIFFISFSVRFCYF

SEQ ID NO: 213419 - protein, 115 aa, Glycine max
  Coding DNA Sequence Number=SeqID_96641
MAICRAIGNRQSNWRVPTAEGACHGSEGQSASRQSRPNRQWQWRFALGMDRQPCWRVAPKYASSIIKAQSESAPATLPSWLSPRVHQLASFVPLLPLILPLLCFHCCAIFFISFS

SEQ ID NO: 213420 - protein, 182 aa, Glycine max
  Coding DNA Sequence Number=SeqID_96642
  Gene Ontology: Mol. function=transcription factor activity; Cellular component=nucleus; Biological process=regulation of transcription, DNA-dependent
  Homolog annotation: Hit_ID=Q9SJR0; Match level="QueryCoverage=84%, HitCoverage=86%, E-value=5e-21, Identity=39%"; Hit description =Putative AP2 domain transcription factor
  Pfam annotation: Domain name=AP2; Domain location=16-80; Score=134.1; E_value=3.9e-37; Accession=PF00847.10; Description=AP2 domain
MYSGNATSSSRGSSESGRYRGVRRRNSGKWVSEIREPKKPNRIWLGTFPTPEMAAVAYDVAALALKGKDAGLNFPDSASSLPVPASLSARDIQVAAAAAAAAAGAAKDSMRTQTGNYNISEGQENPTGMGNQFVDEDLIFDMPNVLVNMAQGMLLSPPPFDIGLEPNSPENTEQETSLWNFP

SEQ ID NO: 213421 - protein, 51 aa, Glycine max
  Coding DNA Sequence Number=SeqID_96643
MTVDEIVIDDDDYDDDSDDNECHNIRGGDGDDYDSDYKGGHGNSNNIGDEI

SEQ ID NO: 213422 - protein, 208 aa, Glycine max
  Coding DNA Sequence Number=SeqID_96644
  Gene Ontology: Mol. function=transcription factor activity; Cellular component=nucleus; Biological process=regulation of transcription, DNA-dependent
  Homolog annotation: Hit_ID=Q3L8J2; Match level="QueryCoverage=93%, HitCoverage=88%, E-value=2e-37, Identity=43%"; Hit description=CBF -like transcription factor
  Pfam annotation: Domain name=AP2; Domain location=29-93; Score=113.4; E_value=6.4e-31; Accession=PF00847.10; Description=AP2 domain
HAKYIRRKTRRDEMQKRRAGRKKFHETRHPVYKGVRQRNGKWVCELRQPNNKNARVWLGTFTHPDMAAIAYDVAALAFKGDNASLNFPHAATSLPRLNSRTCSVRAIQFAATQAAEKHFSCAESQQLQREGSLEGSGSGSFSLDEDSSEFSSKEGGSERFFWDEEEVFNMPELLNSMAEALIITPPALERGFNWVGGETTVDLTLWSN

SEQ ID NO: 213423 - protein, 100 aa, Glycine max
  Coding DNA Sequence Number=SeqID_96645
MVSCKCSGGGDAHSSTMVLLNYISSYAWHAKVVLTLAAFAVIFGLFWLVAQLSAENTLAKYVALLKQLPNISENFMSLKPYFEALIRLVKPAIIYSSSQS

SEQ ID NO: 213424 - protein, 214 aa, Glycine max
  Coding DNA Sequence Number=SeqID_96646
  Subcellular localization annotation: CTP_CleavageSite=50; ConfidenceScore=5.48e-01
KMTTPPRSPPPPIDATSYSPSTLKRTRKATRLRSLATRPVGAERPLVHVDPATGKADGPHRKKLRTYLGIVACDKVDVTYENWKQVTTAQKDLIWEDIQSNLTLKLALAANKNSVNDTICEKYNISKEKWTQFCQSRRDPSWVDVRKKAHVIRKQNAVPHVLSHGGYEFLEKKLMDEKKKKQLEEANDDSLEDQALQDSFIAHGRQDVLTAAIG

SEQ ID NO: 213425 - protein, 145 aa, Glycine max
  Coding DNA Sequence Number=SeqID_96647
MTTAEALERKTKKAQKEEWSRNKFRWALWGSSNELKLRKAERDKSRMESMVLEDKLKSCQRSKRSLTEQLSKIEENMLIIIYQYKEKIEKEAREGVIELLHKEAMKWMNRFALTLNESQELPRLLARAKAVADTYSAPDELHGSF

SEQ ID NO: 213426 - protein, 153 aa, Glycine max
  Coding DNA Sequence Number=SeqID_96648
  Gene Ontology: Mol. function=structural molecule activity; Cellular component=extracellular region; Biological process=keratinization
  Homolog annotation: Hit_ID=UPI0000D66BFF; Match level="QueryCoverage =60%, HitCoverage=83%, E-value=4e-13, Identity=38%"; Hit description =PREDICTED: similar to SPT transcription factor family member (spt-5)
  Subcellular localization annotation: CTP_CleavageSite=41; ConfidenceScore=5.05e-01
KARTCSPLKARTCSPLKARTCSPLEARTYNPIKVRTCSPLEARMYNPLKARTCSPLKSRTCSPLNARTYNPLEARTYNPLKARTCGPLKSSTRIARCRNVPFCRRAKARLTGALSKGGKMRGVATKVYLWKMLGKPKETGQMKNSKFGSCIYA

SEQ ID NO: 213427 - protein, 80 aa, Glycine max
  Coding DNA Sequence Number=SeqID_96649
MLREEADADRAINWLIKKSRNLPIGVLVKSTYVRCNALFNERGREATRMLAFDQVYTKVLSKVIEDALKKANTHNVLEFD

SEQ ID NO: 213428 - protein, 155 aa, Glycine max
  Coding DNA Sequence Number=SeqID_96650
MAVCTLYYGVSHLVGNSLVAQADHRRAIPLVLDTVCIAFHLRVKDDISRVQEVRSVEEPPSRRDGAGRYNAYRLDFPEQYGVNTTFNISDLIPFVGEADIQEEEPIDLKSNPLQGGGDDAILPRKGPVARAMSKRLQEDWARAAKEDPRVLMNLG

SEQ ID NO: 213429 - protein, 150 aa, Glycine max
  Coding DNA Sequence Number=SeqID_96651
MTVPPLPAQYLSFHLCFCKLHYIELVDEEEAQIGADHSSATSNKSEIYKEEERNAAQKHKPKRVGSVNADSEAFAEAMEHTKKRDTVHQSVSLENKTSDSTVLKIGDSAKVVIKQDMKGRKHKYGFNNNKREKTEKKKVVDDETGNKHEL

SEQ ID NO: 213430 - protein, 53 aa, Glycine max
  Coding DNA Sequence Number=SeqID_96652
MVYKSSHRTSPVGSDLEWQSQRKNHFRKWVFPLPAVIYLAENLSGPKIVCSLS

SEQ ID NO: 213431 - protein, 63 aa, Glycine max
  Coding DNA Sequence Number=SeqID_96653
SYFHKETGFRCRSLKEIKNYEKYGSPPRRHKVKTQAKEESNDKTKNETEFTDNYKLMSRTESD

SEQ ID NO: 213432 - protein, 119 aa, Glycine max
  Coding DNA Sequence Number=SeqID_96654
MTKHGLCVPSDTTASEWQRGADNRKNDQTWSLRVIGHAAFGRPKGMTKLGLCVPSDTTVSEWQRGADNRKVSPRIMGISAYHGCRMTKLGLCVPSDTTVSEWQRGADNRKVSPRIMGAE

SEQ ID NO: 213433 - protein, 84 aa, Glycine max
  Coding DNA Sequence Number=SeqID_96655
  Subcellular localization annotation: CTP_CleavageSite=38; ConfidenceScore=5.30e-01
MVNKSSLLHLDPKSPEAQAFNQIGQKSNGGSISPSPTTSAEGSSQNGRNQGIDETATAKNSASYIGKRLLESLVAVAGLLIWLS

SEQ ID NO: 213434 - protein, 202 aa, Glycine max
  Coding DNA Sequence Number=SeqID_96656
  Homolog annotation: Hit_ID=Q6D7X0; Match level="QueryCoverage=62%, HitCoverage=32%, E-value=4e-08, Identity=29%"; Hit description =Putative membrane protein
MVSETVKKAKIATQLIFLVCGLGIASWAPMVPFAKDRLRLDEADLGLLLLLLGGGALLMMPLSGLLINKIGSRKIIAVSVLLSALLLPFLLIISDVYIMGAVLFAFGCSIGTIDVAMNAHGVQVQNQYGKPIMSSLHGLFSVGGLFGSLGLGFLMKLGLNPIYAAVNIYLIVKRKEKALSSFPMWILKVKRLPVFNGWIREF

SEQ ID NO: 213435 - protein, 72 aa, Glycine max
  Coding DNA Sequence Number=SeqID_96657
MVKEVIHGPNSATPRLHFFSSYSSYAFFSLKTTIECKGIHPSELQLTQASLLRAEGIYSPRRVVARPGEWLA

SEQ ID NO: 213436 - protein, 101 aa, Glycine max
  Coding DNA Sequence Number=SeqID_96658
MNVLNGATLFGKITQASDIFMIHIHRDSLGVPMNPKRIKVIPERLTPPSVEGRSPEFHEPRDLRSNPFQGEVMMQSYPQGHWIEDFKMIGPRMQEKALGFS

SEQ ID NO: 213437 - protein, 99 aa, Glycine max
  Coding DNA Sequence Number=SeqID_96659
MGYIQTVPPPPVRDSLTGGPRLHAVVFQISHPFVTPTEDTGEPRPAPPPPTHDDDFVEPPVAEVPVASDPPTHYVVDCTACIRIGRIAEHLERVINLRM

SEQ ID NO: 213438 - protein, 100 aa, Glycine max
  Coding DNA Sequence Number=SeqID_96660
MVHCYQASRRSSMTTDLPPLLMFPRTQNIRKKTKKKEQKGSHGKESRLIDWSNSLTKVPSGVTNCHNRVRLPRKENARSRHQRIFEENFGKTGKGVVYEL

SEQ ID NO: 213439 - protein, 64 aa, Glycine max
  Coding DNA Sequence Number=SeqID_96661
MAKKFSCRLRRLEPPYGEEKTHVKVLSWSYLSQPSKGVLLHPLGHQPRLGHLLRSPKKKGHRPK

SEQ ID NO: 213440 - protein, 282 aa, Glycine max
  Coding DNA Sequence Number=SeqID_96662
  Gene Ontology: Mol. function=hydrolase activity, acting on carbon -nitrogen (but not peptide) bonds; Biological process=nitrogen compound metabolic process
  Homolog annotation: Hit_ID=Q39JH5; Match level="QueryCoverage=88%, HitCoverage=81%, E-value=1e-120, Identity=82%"; Hit description =Nitrilase/cyanide hydratase and apolipoprotein N-acyltransferase
MSMVADVAQRADDERAAIDERALRIPARHVQAQFGGRRLHLARADDEAAALVGDVTHRALPDVAFVDGGCAPDLHALGVHGGAQQRHVVFPADGAADAARGGFHHGQGGAVALAPDQAFGAGGHELAMPGGQAGGRIEVQRGAVQRAAGAFDDADHQAGAGALRQRGQRVGLGAGHVDGVLVIAGIGLAAFGQAVAEARAEYLALGIAAEQGFGHDHERGARGGDLGLEGQDPFQGGFLALGRGADLQRGNGLGGHAGSLAGADGVSGAASVGASLKSINPI

SEQ ID NO: 213441 - protein, 114 aa, Glycine max
  Coding DNA Sequence Number=SeqID_96663
  Gene Ontology: Cellular component=integral to membrane; Biological process=photosynthesis
  Homolog annotation: Hit_ID=P49179; Match level="QueryCoverage=94%, HitCoverage=61%, E-value=7e-49, Identity=81%"; Hit description =Photosystem I assembly protein ycf4
  Pfam annotation: Domain name=Ycf4; Domain location=1-105; Score=55.0; E_value=3.1e-15; Accession=PF02392.7; Description=Ycf4
MAFYGIAGGGFDIFNKKGKKVRFVPWGFPGKNRRIILEIPMNELHSIRIITEVKEEGIFTRTSTFESIVYLETIEQGFIPLTRIEDNLNGTQIAHKAGELSGIFGCTTFVTDEN

SEQ ID NO: 213442 - protein, 70 aa, Glycine max
  Coding DNA Sequence Number=SeqID_96664
MEFMHKAPVPPWSLIVTVFGVSSTSSASRPSRDDLSTGRDKYPDFQGDISCRHWARLVTPMAKFDPEIVI

SEQ ID NO: 213443 - protein, 212 aa, Glycine max
  Coding DNA Sequence Number=SeqID_96665
MEAMKDQMAAMMEVMLSMKKIMESNTAAVATTSAATEVDPTHPSSLNQVNPPISDMVGQGEEALGSTGSPHVMQSKNSFPPYGLPPNYTPPNVAHALDENVNNSTPMLIESQQPQSVPPAMVERERFDHIKKRLRVLEEGEDYAFADMTELCLMLDVVISLKFKVLDFDKYKGTTCPKNHLKMYSRKMGTYSKNEILLMHFFQERLNGAAVT

SEQ ID NO: 213444 - protein, 305 aa, Glycine max
  Coding DNA Sequence Number=SeqID_96666
  Gene Ontology: Mol. function=chitin binding; Cellular component =extracellular region; Biological process=chitin metabolic process
  Homolog annotation: Hit_ID=UPI000044A8F0; Match level="QueryCoverage =98%, HitCoverage=99%, E-value=8e-33, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=92; ConfidenceScore=5.44e-01
MKVRTCIPLKAKACSPQMARTYSPLKAMACSLLKVRTYSPLMTKACSPLKVRARSPQKVRTYSPRLARTCSPLMASTCCPLTARMCSPLKVRAHGPQKVRTCSPLLVRTCSPLMARTCSPQTVWVCSPLKVRTCSPLKVRARSPLMARTCSPLKVRRCSPLLARTCCPLMARTCSPLKARTCRSLKVRASPLKVRACSPMKVRTCGPLKARACSPLMARTYSPLKARVCSPLKVRTCSPLLARMHSPLKARACSPPKVMACSPRIARTYSLLKARACSPLKVRTCSPLLARTYSPLKARACSPLK

SEQ ID NO: 213445 - protein, 152 aa, Glycine max
  Coding DNA Sequence Number=SeqID_96667
  Gene Ontology: Cellular component=integral to membrane; Biological process=transport
  Homolog annotation: Hit_ID=P0AA70; Match level="QueryCoverage=72%, HitCoverage=35%, E-value=9e-36, Identity=69%"; Hit description=Inner membrane transport protein yedA
  Pfam annotation: Domain name=DUF6; Domain location=1-103; Score=43.9; E_value=5.5e-10; Accession=PF00892.11; Description=Integral membrane protein DUF6
MAGIRFLSAGVLLLAFLLLRGHKLPPLRPLLNAALIGLLLLAVGNGFVTIAEHQNVPSGIAAVVVATVPLFTLCFSRLFGIRTRKLEWLGIGIGLAGIILLNSGGNLSGNPWGAVIILIGSMSWAFGSVYGSRIELKNDLMAGAIEMLAAGI

SEQ ID NO: 213446 - protein, 305 aa, Glycine max
  Coding DNA Sequence Number=SeqID_96668
  Gene Ontology: Mol. function=chitin binding; Cellular component =extracellular region; Biological process=chitin metabolic process
  Homolog annotation: Hit_ID=UPI00006A17C9; Match level="QueryCoverage =99%, HitCoverage=100%, E-value=1e-43, Identity=32%"; Hit description= UPI00006A17C9 related cluster
GLHTLNFRWLHAFAFKGQHVLTFRGLHVFAFRGLHALAFRGLHVLAIGGLHALTFRVLHILAFRGLHIPAFRGLHVLPFRGLFVRTFRGLHVLAFRGLQYLAFRGLHAVAFRGLHVLTFRWLHALAFRGLHVLSFRGLHVLAFTRLHVHAFRGLHALTFRGLHVLTLRGLHALVFRGLHAVTFRVLHAVTFRGLHVFAFRGLHVLAFKGLHALPIRGLHALTFRELHVLAFRGLHLLAFRGLHILTFRGPHVLTIRGLHVLAFRGLHVLAFRGLHVLTIRGLHVLAFRGLHVLTFRGLHALAFRR

SEQ ID NO: 213447 - protein, 249 aa, Glycine max
  Coding DNA Sequence Number=SeqID_96669
  Gene Ontology: Mol. function=cytochrome-c oxidase activity; Cellular component=integral to membrane; Biological process=cytochrome c oxidase complex assembly
  Homolog annotation: Hit_ID=Q8G258; Match level="QueryCoverage=88%, HitCoverage=87%, E-value=1e-108, Identity=84%"; Hit description =SurF1 family protein
  Pfam annotation: Domain name=SURF1; Domain location=1-235; Score= -7.9; E_value=2.3e-09; Accession=PF02104.6; Description=SURF1 family
MASAIALVILLALGTWQVERLQWKEALIASTEQRIHEPPLPLSEMEKVYKQEGSVEYRPVTVSGTFMHQGERHFLATYEGAAGYNVYTPLMLEDGRFVLVNRGFVPYEKKDPSTRVEGQVDGPVSVTGLARDPLSVKPGFFLPDNDIAKNIFYWKDWTAMAETADLPNLDEVVPFFVDADNKSNPGGLPIGGVTIIDFPNNHLQYAMTWYGLALALIGVVGTWLWRYRCLRKSGDRFSVRDSENKDEER

SEQ ID NO: 213448 - protein, 194 aa, Glycine max
  Coding DNA Sequence Number=SeqID_96670
  Gene Ontology: Mol. function=helicase activity
  Homolog annotation: Hit_ID=Q2R0W4; Match level="QueryCoverage=98%, HitCoverage=13%, E-value=1e-38, Identity=40%"; Hit description=AT hook motif-containing protein, putative
MYTIEFQKRGLPHVHLLLFLHPGNKYPSSDEIDQIISVEIPSQQDDPELYSLVKNHMVHGPCGTLNLGSPCMEEGKCSRFYPKMFQPHTILDADGFPVYRRRNNGHAIEKNGVIIDNRVTVILIHEDNDETHNGGTHNDEIKEYLDCRYICPCESTWRIFGFPIHGRKHVVERLHFHLPAQHSVLYVDHGDIDD

SEQ ID NO: 213449 - protein, 147 aa, Glycine max
  Coding DNA Sequence Number=SeqID_96671
VKADMEAMKEKMATMMEAMMSMKKIMEANAVAIAATSVVAKVNPMLPFGLKQMNHPTSNMVGKDLGSTDDPMMCKFKTSTPSRHMACLPNYTPPNVAYILNKNVNNSTPIPIESQQPRTDHAHEWEIGSSRGKAQAIEGGEDYAFAN

SEQ ID NO: 213450 - protein, 103 aa, Glycine max
  Coding DNA Sequence Number=SeqID_96672
MTILRRFGPPLPWNVVVLDKGIGDKYVTLPWYKFIQEGDFSHGDKLSFNYRRAEKIWEVVDMNGNGMEKEEREETPLQGKDESRRSSPPWKAMDKSLEEEEDE

SEQ ID NO: 213451 - protein, 104 aa, Glycine max
  Coding DNA Sequence Number=SeqID_96673
MQKHVGDKKGKKDRKQKKAYIAWEDNASTTFDSSSDEEIANVCLMEKSMDNSSTIEETEVNREFEEVLEAFNEMHEEAQRFVVLNIKMKSDLKLHITKLGFNTK

SEQ ID NO: 213452 - protein, 152 aa, Glycine max
  Coding DNA Sequence Number=SeqID_96674
AFRLTDSKKIYTDNHSGISARQRDSKVSMTDLVSAEDDAFRLTDSKKFYTDNHSGISARQRDSKVTKTELVSAEDNAFRITDSKKVYTDNHSSISARQRDSKVSMTDLVSAEDYAFRLTDSKKVYTDNHSGISARQRDSKVSMTDLVSAEDD

SEQ ID NO: 213453 - protein, 81 aa, Glycine max
  Coding DNA Sequence Number=SeqID_96675
MTNDGTYEFGDPTVMWLRMPPDSWVTTYVVLDECEAKNSLGVFFTKMRTCFSTETKLPTDQSNICFLDEKQCVYRGRRVCR

SEQ ID NO: 213454 - protein, 119 aa, Glycine max
  Coding DNA Sequence Number=SeqID_96676
MGKVEEAQEQMKANMETMKEQMATMMEAMMSMKKIMEANAVTVAAISAIAKAKIWEVRAAPHYAQIQNKHAFPPYGWPPNYTPPNVAYIPNEGVNNSAPILIEMSLNPWGRHMKFPTTI

SEQ ID NO: 213455 - protein, 94 aa, Glycine max
  Coding DNA Sequence Number=SeqID_96677
  Gene Ontology: Mol. function=sequence-specific DNA binding; Cellular component=intracellular; Biological process=regulation of transcription, DNA-dependent
  Homolog annotation: Hit_ID=P54794; Match level="QueryCoverage=100%, HitCoverage=41%, E-value=1e-42, Identity=92%"; Hit description =Monoamine regulon transcriptional regulator
MAAMTPRLCDRNRHYYHEFMLPNNVRDMTEIFIRRERRIVAGISLMRDVPFSSEERLRAQAVLHLVELAIRDFLQEEDELPAIMTAKERELVGM

SEQ ID NO: 213456 - protein, 57 aa, Glycine max
  Coding DNA Sequence Number=SeqID_96678
MACSVFASCPYLRDLHGRELKRAFSDNSQGGHMSLDAVGTTSNNTLSKRKTLDEGSL

SEQ ID NO: 213457 - protein, 102 aa, Glycine max
  Coding DNA Sequence Number=SeqID_96679
MGIQKNSQAGEGRHKRIQAVSPSFIWKREKRDTKRIQAEKGMKKMNNTVFKVWKTKKLWKAFGKKEEEEEEEEVQGDSEINWQKFVVKVVSVIQMQIKVLLL

SEQ ID NO: 213458 - protein, 216 aa, Glycine max
  Coding DNA Sequence Number=SeqID_96680
MRGAPTEESLSPFLVRDLGAQGLKVIQRVHKAWRSPLRKDKEIRGIRNGVIDGYHGWLKVHTRGLNWLSKLKVIDEENFEAPEEDEEVQALKLELGKVRLAKEKFKSAATHIRKECTELREENVATARALEQETKRARKEEYGREKFQGALWGSNNELKLRREERDWSQVHDMILKEELAACARSKRSLAHTWTHGAKHANYHRAIQGRVEPVCDP

SEQ ID NO: 213459 - protein, 185 aa, Glycine max
  Coding DNA Sequence Number=SeqID_96681
  Gene Ontology: Mol. function=transmembrane receptor activity; Cellular component=membrane; Biological process=signal transduction
  Homolog annotation: Hit_ID=Q5PM58; Match level="QueryCoverage=87%, HitCoverage=28%, E-value=3e-39, Identity=61%"; Hit description =Methyl-accepting chemotaxis protein I, serine sensor receptor
  Pfam annotation: Domain name=MCPsignal; Domain location=1-144; Score =145.9; E_value=1.1e-40; Accession=PF00015.11; Description=Methyl -accepting chemotaxis protein (MCP) signaling domain
TNILALNAAVEAARAGEQGRGFAVVAGEVRSLAQRSAQAAKEIKGLIEDSVSRVNTGSVLVESAGETMSEIVNAVTRVTDIMGEIASASDEQSRGIDQVGLAVNEMDRVTQQNAALVEESATAAAALEDQASRLKQSVAVFNIGKEFVAQAVNVTTAPKIARPSAPQALAPAAGARGADDNWETF

SEQ ID NO: 213460 - protein, 339 aa, Glycine max
  Coding DNA Sequence Number=SeqID_96682
  Gene Ontology: Mol. function=transporter activity; Cellular component= integral to membrane; Biological process=cell division
  Homolog annotation: Hit_ID=Q9HWH4; Match level="QueryCoverage=94%, HitCoverage=31%, E-value=1e-123, Identity=72%"; Hit description =Probable Resistance-Nodulation-Cell Division (RND) efflux transporter
  Pfam annotation: Domain name=MASE1; Domain location=84-328; Score= -53.2; E_value=0.031; Accession=PF05231.5; Description=MASE1 domain
MVVDSDLDYNNPLAEVHIDRAKANSLGIRMSDIGESLAVLVGENYLNRFGMDGRAYDVIPQSLREQRLTPQALARQYVRTQDNTLVPLSTVVSVAVKVEPNKLTQFNQQNAATLQAIPAPGVSMGEAVAFLERQANALPAEFSHDWQGDSRQYTQEGSALAFAFLAALVIIYLVLAAQYESLKDPLIILITVPLSICGALLPLALGYATMNIYTQVGLVTLIGLISKHGILMVEFANELQMHQGLTRRAAILQAAQIRLRPVLMTTGAMVFGLIPLLFASGAGAASRFGLGLVIVSGMLVGTLFTLFVLPTVYTLLARDHAVASPRQRELAAAQKALAE

SEQ ID NO: 213461 - protein, 206 aa, Glycine max
  Coding DNA Sequence Number=SeqID_96683
  Gene Ontology: Mol. function=oxidoreductase activity, acting on NADH or NADPH, NAD or NADP as acceptor; Biological process=electron transport
  Homolog annotation: Hit_ID=Q2SGY7; Match level="QueryCoverage=96%, HitCoverage=99%, E-value=8e-72, Identity=62%"; Hit description=FMN -dependent NADH-azoreductase 2
  Pfam annotation: Domain name=FMN_red; Domain location=6-181; Score= -26.5; E_value=0.0033; Accession=PF03358.6; Description=NADPH -dependent FMN reductase
  Pfam annotation: Domain name=Flavodoxin_2; Domain location=6-206; Score=109.3; E_value=1.2e-29; Accession=PF02525.7; Description =Flavodoxin-like fold
  Pfam module annotation: Pfam domain module=FMN_red::Flavodoxin_2; Domain location=6-181::6-206
MRNHCMNVLHIKVSPDLAGSASRIASARLIEKLRSRHHDLHETVLDLAQQPLPHLDAFTIRAFFTPPEARDEAQRNAIRTSEQLMDQLFACDTLVISSPMWNLGLPSVLKAWFDHITRAGRTFAFTPEGTKVGLVSGKKVYCVMASGSVFAHGPFMQDDQFTPYVRAALAYIGISDVQFIRVDGTHDPLNRARALPEALETIERLF

SEQ ID NO: 213462 - protein, 51 aa, Glycine max
  Coding DNA Sequence Number=SeqID_96684
MQAGLERSTAMVYLQQRLAVNDPFMIVLIPKRSPIAAGRTSSGLNRGPHKL

SEQ ID NO: 213463 - protein, 66 aa, Glycine max
  Coding DNA Sequence Number=SeqID_96685
MYYKNLKLLYHHGPHVSKANTNGNDADVAPEFSPLKTVQFGNPSQDTVDPRDGGFGGRLWRWKWEK

SEQ ID NO: 213464 - protein, 86 aa, Glycine max
  Coding DNA Sequence Number=SeqID_96686
  Subcellular localization annotation: CTP_CleavageSite=42; ConfidenceScore=5.47e-01
MARVRVPKVRTCSPLKVRACSPTKARTYSLLKARACSPLKVRARSPQKVIGTSTQGSILMRKQEIDSSRGSVIPNSKDLDIIRKSM

SEQ ID NO: 213465 - protein, 109 aa, Glycine max
  Coding DNA Sequence Number=SeqID_96687
MLHRPQAHHHHLIKLARLGHLTWSSIYGIWFASRRPTTGHMYRLMISQGFASFSCPTPDQFRTEVAWPRDWPEAQAGEAPPEAPDDGEEAHEDEEMADLLDFLGGSEAT

SEQ ID NO: 213466 - protein, 180 aa, Glycine max
  Coding DNA Sequence Number=SeqID_96688
  Gene Ontology: Mol. function=transferase activity; Cellular component= integral to membrane; Biological process=carbohydrate metabolic process
  Homolog annotation: Hit_ID=Q0XQA8; Match level="QueryCoverage=89%, HitCoverage=32%, E-value=7e-30, Identity=41%"; Hit description =Putative pentose kinase protein
MAELAGAQRRTPPAQGVATGIEQGKTAPGRVGQVQVVDAGGEQRVFRDHGEQRGGAGAVGGDAGLIDAGAEQGSGHIRRARHHRHPRRQIGNACRCGRNVANHLAGEMDGGQLIGAQPELPQRLWRPLQRGAVHQVIAGGFAVVGGAYAAEPEIDVILRHQHRGKCAPTAMDDARAARPA

SEQ ID NO: 213467 - protein, 79 aa, Glycine max
  Coding DNA Sequence Number=SeqID_96689
MVFGVGMGCCVLLIGKPQWLVRMVGGQLNKKVKWKTRMRANENECLLAHLPVEIQFCLVGKQNLRARTLSHCIAYACEI

SEQ ID NO: 213468 - protein, 106 aa, Glycine max
  Coding DNA Sequence Number=SeqID_96690
MEEEVAAQLAQESWVASSLSNPASKMFWKAQIRKFENCYLRPHLDKFTPSFVIYGKQYQVKYAYPRFSEILQKHYESPGSPRSHFLTKRGRWLPPSSPRRARLLPP

SEQ ID NO: 213469 - protein, 68 aa, Glycine max
  Coding DNA Sequence Number=SeqID_96691
  Subcellular localization annotation: CTP_CleavageSite=58; ConfidenceScore=5.20e-01
MVTSAMAMSHAGRCPHVPTIFPCSPKSRRGENHCDRDRLLGRGSSRRLRPPTKEKVTSTNMTRSPHPL

SEQ ID NO: 213470 - protein, 159 aa, Glycine max
  Coding DNA Sequence Number=SeqID_96692
MDISTKRLYARLPNGGPIARTVWRKERPKVEPPTSSKVGSVLAKLLCTWLDYDELFTRCKGLLEEKKDLADRVEGIVAEKDELAKVVADLEVRLKELKSKLEAFELWATKLLHRAIAIGDKWGCIVVQNFRTPLQFPSIIEESASSLNGGTFDFGAPSL

SEQ ID NO: 213471 - protein, 114 aa, Glycine max
  Coding DNA Sequence Number=SeqID_96693
MNDFDHNPSIPNNDTDSTTTTTTTTQIQHRFKTCNKKGGQGAHEFGVRCMDIDGTGWRMDLDIKVVGATQINDNNAWWNEGGVALDRDGQGVGSHHGDDQWGWEAKKFGEGEEL

SEQ ID NO: 213472 - protein, 71 aa, Glycine max
  Coding DNA Sequence Number=SeqID_96694
MCTTTWPRHFQPWKMLVVRPYDLNKGDGGISYLRALLSPNCASNRPSIWQPPSLRTTPCVEPLGANVHSPS

SEQ ID NO: 213473 - protein, 84 aa, Glycine max
  Coding DNA Sequence Number=SeqID_96695
MNDPLPALDDEVPNLAPVLCLRNYGQLHLEPLVKQVRPVGGIVPPSTVAPTTGEEGQPTGEVGPIAAIVEVTPGAPSSVLAKRK

SEQ ID NO: 213474 - protein, 77 aa, Glycine max
  Coding DNA Sequence Number=SeqID_96696
MVTREVLLTRWQMHQFVSNIGIRCVGIDISFNFHVTSRLALAFALSASLNFFMGLLRSKRELAAKQGDVMALPCTLS

SEQ ID NO: 213475 - protein, 108 aa, Glycine max
  Coding DNA Sequence Number=SeqID_96697
MAEQAKQVFYVQDPCDERWSVVLHGKTIGVNVEDDDSYIDNYVSPLSTQMSPNIIGEEETDDIHNWKQVLAAHKDLIWKDIQAEFDIHEASDWRTKKKILQTVGEWWR

SEQ ID NO: 213476 - protein, 175 aa, Glycine max
  Coding DNA Sequence Number=SeqID_96698
  Homolog annotation: Hit_ID=Q1SH13; Match level="QueryCoverage=91%, HitCoverage=27%, E-value=4e-66, Identity=73%"; Hit description =Nodulin-like
MVLVHYMKLIEETKTIPRTVWMTCTQTVMLIVYLLFAYAINGTLYPAIAFLGVCYGVQVSVMLPTVSELFGLKHFGVLSSFMSLGNPIGAFLFSALLAGNIYDNEAAKQHGIGLLLDSGVSCIGPNCFKLTFFILAGVCIAGIVFSVILTLRIKPVYQMLYAGGSFRLPQTSSNQ

SEQ ID NO: 213477 - protein, 284 aa, Glycine max
  Coding DNA Sequence Number=SeqID_96699
  Homolog annotation: Hit_ID=Q1SH12; Match level="QueryCoverage=99%, HitCoverage=100%, E-value=3e-55, Identity=48%"; Hit description=C2; Sterile alpha motif homology
MDWFSWLSRTSLEPSLIYEYGLAFARNELQLEDAIYFNHEFLQSMGVSIAKHRLEILKLAKKEDGGVVVRSSIKFSIKKCLRKCFSKLVSREDHHEAMIMLKDMPPEPNWYQGKWRRARHNGNNEELKGENNNNNNKGVQRNRTIALSGPLDGNGRIIHEKMVNNNKVMKLSGPLDGKMNGGNNERVNVYANANRSPLMGATTPTRALDGRFMGSTKSPRLSGPLDARPTMVNSRSPRLPRPLDDRADSPMGYSPYNIKVRADAADYDDDYAMWPTLFEDLKPT

SEQ ID NO: 213478 - protein, 107 aa, Glycine max
  Coding DNA Sequence Number=SeqID_96700
MSAFIYSCTSSTSPITLTLAQVRNGFMIPTWLAHEKNARIKHEQNMKTKGMHFVEQKCPMCAVRRVLWIFQLPVTKDETNIQRVRDDMMQTRKSTTWGCTQYGNIHK

SEQ ID NO: 213479 - protein, 100 aa, Glycine max
  Coding DNA Sequence Number=SeqID_96701
  Gene Ontology: Mol. function=catalytic activity; Cellular component =peroxisome; Biological process=metabolic process
  Homolog annotation: Hit_ID=Q84P23; Match level="QueryCoverage=86%, HitCoverage=17%, E-value=4e-17, Identity=48%"; Hit description=4 -coumarate-CoA ligase-like protein
MVDSDPHLVSLFMLPLFHVFEFFMLRFNFEGMLKVMERYRIIYMLELSSLMVTLAKSELVKKYDLSSLRYLGCGGVLLEKEVVEDFKVKFPNMKIGHVNK

SEQ ID NO: 213480 - protein, 137 aa, Glycine max
  Coding DNA Sequence Number=SeqID_96702
  Gene Ontology: Mol. function=binding
  Homolog annotation: Hit_ID=Q9LV73; Match level="QueryCoverage=79%, HitCoverage=8%, E-value=1e-33, Identity=64%"; Hit description =Arabidopsis thaliana genomic DNA, chromosome 5, P1 clone:MJE7
MEGSRPEPSDGTAKSKQELSLHLKEEYENVIKCVKVLRESANGNDEHSSLSVLAMKAWLGLGRHGEAKKELRGMVIDKGISERVWVSTMEAYFVAVGTTRVEIVKGVFLGLLGRCHVSVGLTVRVVHNIYNKENSIE

SEQ ID NO: 213481 - protein, 62 aa, Glycine max
  Coding DNA Sequence Number=SeqID_96703
MVIFPYESESFTSRCSPPSSTVGQGERYIQRYPDTQNPHRVTPTQPHACLRFLRYSSKILAI

SEQ ID NO: 213482 - protein, 235 aa, Glycine max
  Coding DNA Sequence Number=SeqID_96704
MGERVNLPEVIFFYWLQAFKDLFHAKDKKNLVPYGMFFTQIMRNSGVDVFVLKPFAGGTQHRATPTTHFQIIISQHVLYQNVKCYKGKQLLTKDDEDAESIRLVKARLDHLFKHELEAFQHKYVLITLYRYAMKRFYRMWKCCSGLESKEKPHANAYHHEALAHALKDYAHAEKEAHRWSLNGDDFYRKAIGWKPHRPPMPLGSLVHLSINFEDSGDEFLRNLDEEVVKQKEEKM

SEQ ID NO: 213483 - protein, 63 aa, Glycine max
  Coding DNA Sequence Number=SeqID_96705
MPNSLLREYLSQRNQASQERTIHIGKTKWRSLGYTFPKAWINLKIPYNFPKGVGTKNNNYPRN

SEQ ID NO: 213484 - protein, 284 aa, Glycine max
  Coding DNA Sequence Number=SeqID_96706
  Homolog annotation: Hit_ID=Q1RX21; Match level="QueryCoverage=30%, HitCoverage=28%, E-value=2e-35, Identity=81%"; Hit description =Fibrillarin
  Pfam annotation: Domain name=Fibrillarin; Domain location=162-284; Score=22.6; E_value=1.5e-09; Accession=PF01269.8; Description =Fibrillarin
MGSKIYLKVHENPRAFFSSSSPSLLESSIQYPWGPPPQCHKVVSQYSTLLAPLTIDIILFVVDVAKPNMVDLYDVKIVKKLDDIVDNTELMKDLMFYKVLVVLVVAVGSRVVVGKGRGSRGGGGDRGTPFKVRGSVRGGGGRGRGRGGGRGGGRGGMKGGSKVVVQPHRHDGIFIAKGKEDALVTKNLVHGEAVYNEKRIIVQNEDGSKDEYRVWIPFRSKLVAAILGGVYNIWIKPRAKVLYLGTASGTDVAPCGACRPWILFINEVLCFLKFNGSRMKKEER

SEQ ID NO: 213485 - protein, 114 aa, Glycine max
  Coding DNA Sequence Number=SeqID_96707
MFILTPIVINSSLTSKRAHGFQALERRGRDCSLHFTVTCETNFSLQKHYFASPNGASVRKWVPKVVSKFHKDPTLEDSGIVVLLRQMNGSGMEKEEREEMPLQEEDESRRSSPP

SEQ ID NO: 213486 - protein, 249 aa, Glycine max
  Coding DNA Sequence Number=SeqID_96708
  Gene Ontology: Mol. function=cysteine-type peptidase activity; Biological process=ubiquitin-dependent protein catabolic process
  Homolog annotation: Hit_ID=O22207; Match level="QueryCoverage=94%, HitCoverage=30%, E-value=3e-31, Identity=35%"; Hit description =Ubiquitin carboxyl-terminal hydrolase 5
  Pfam annotation: Domain name=DUF1055; Domain location=68-169; Score =3.4; E_value=3.9e-07; Accession=PF06337.3; Description=Domain of Unknown Function (DUF1055)
MWLMSVMISNFRLWEQMSSNQTNTSYEASSLSEHCDLANSSALKRPNGIDNSDLIDDAMSEDFGTGIEIHDTLLEGCDYVLLPQEVWKQLFRWYGGDLHWQGKLFSSGLSQTELAVEETIGQLHIKACGIFNLQPDQNVPLACAYTLQFITIVFILINDNIQFGSEHREVNYALVEPSKSSLSIVGGLSASRGASRGYNMDLSTSRNLNSPVRDVENPYGTIGVTTRGSFGGLIGLLNLGNTCYMNSAI

SEQ ID NO: 213487 - protein, 89 aa, Glycine max
  Coding DNA Sequence Number=SeqID_96709
MSFSIIFLNAVHLVICSPEHKVQDHHRIQTQTTNRESLSLSKIIGRPVRVTMFCENAPTIWDQHRLKGALKPSDPQGLHSEESVRVSPS

SEQ ID NO: 213488 - protein, 574 aa, Glycine max
  Coding DNA Sequence Number=SeqID_96710
  Gene Ontology: Mol. function=molecular_function; Cellular component =nucleus; Biological process=protein modification process
  Homolog annotation: Hit_ID=UPI0000E476FA; Match level="QueryCoverage =93%, HitCoverage=80%, E-value=3e-27, Identity=23%"; Hit description =PREDICTED: similar to NEDD8 ultimate buster-1
  Pfam annotation: Domain name=UBA; Domain location=304-343; Score =37.6; E_value=4.4e-08; Accession=PF00627.21; Description=UBATS-N domain
  Pfam annotation: Domain name=UBA; Domain location=376-415; Score =29.6; E_value=1.1e-05; Accession=PF00627.21; Description=UBATS-N domain
  Pfam annotation: Domain name=UBA; Domain location=436-474; Score =18.2; E_value=0.025; Accession=PF00627.21; Description=UBATS-N domain
  Pfam module annotation: Pfam domain module=UBA::UBA::UBA; Domain location=304-343::376-415::436-474
MAKLKIGGTWAGVLEEVDLQAWTLATLRDHVAARSNTPSDSINLICAGKILKDDTVPPQTLAQLGVKSNAKILATRASTPQQGHSFLAQEERSSRLARIRAAANAMAERHADGALPVEDFNIEVEDQNGQKVRLGSETDQRAVMMGLMLHAKGKRLIRQGNYKDALEVLSMGECRGNVDQTIKRNYYREKRKESFSLCDPKVIELIDNVPILQIDMVWCYFMIRDIKWLSDAGKRLEMAREGIERAHGKDSFRLRLLQGGRYPELALHLRLELLEGVVAYHTGQFEKSKQTLASARTKFIQLQVPDEALSLVMSMGFAERDAKRALRMNNQDVGGAIDFLAEEKTKKLRKREEDIRRRNEIKEQKRYGMTPLKKAVDLERLKELVSIGFDKELAAEALRRNENDTQKALDDLTNPETNSALQVNIESRKRKRQKAARDSEIEKVVQMGFERSRVVAAFEAGGSLDEVLQRLTAQPGTDPMQPRENSASASHGGASSSAPLPDNVDADLAMYKVEDHSKTEQRDVEMEDELSADIAKADALADYDIEVTVEGEAITEYLALVESASCRGETVPSQ

SEQ ID NO: 213489 - protein, 105 aa, Glycine max
  Coding DNA Sequence Number=SeqID_96711
  Subcellular localization annotation: CTP_CleavageSite=24; ConfidenceScore=5.05e-01
MESNTPRSTSFRSANSLSRKWRPRVTTLRSLKNLDTMSLEELVRTLKVHEQDKGIKKGKSLALGGQKVKKASSTKESSSRPLSKSASKALSIDNSSNEEFEEESN

SEQ ID NO: 213490 - protein, 295 aa, Glycine max
  Coding DNA Sequence Number=SeqID_96712
  Homolog annotation: Hit_ID=Q1STT2; Match level="QueryCoverage=26%, HitCoverage=24%, E-value=8e-12, Identity=51%"; Hit description =Lipocalin
MGMGGNGKRVCWMRRERLTLRKKHGGMNFQDLHDFNLVLLGKQEWRLLKHLDSLVSRTHILLMVADGALEMEPQQGSRKTHGSGDLIDQDKGNWNLDILNSILDWEDDNAYLVCTTYHGDRALIDMHYLKEIVYPPGYISNIEVFLALPLVSLVKQTWRISMWKALGNLFFVLITAADNNQVARLTRCIVSGGMRKKPSLKLSSLPLLPNLKPIGPFQLLALLKCNVDATFFEDRRAFGMVFCLCDDNGSFVQACIQTENFLLFVAEGEAIAVLEAIKWLLNLGVENVIVESNCI

SEQ ID NO: 213491 - protein, 92 aa, Glycine max
  Coding DNA Sequence Number=SeqID_96713
MEGGAAVRVFIETDGEGGGGGRGCGSGSGGGGRGAFGAEELAEGLNGFDDSTEDEAEDVLERAAIGGGRGGGTVAVEDHVVDADDDVFDLRD

SEQ ID NO: 213492 - protein, 207 aa, Glycine max
  Coding DNA Sequence Number=SeqID_96714
  Homolog annotation: Hit_ID=Q9ZSJ7; Match level="QueryCoverage=32%, HitCoverage=18%, E-value=6e-08, Identity=48%"; Hit description =Putative type 1 membrane protein
  Subcellular localization annotation: CTP_CleavageSite=30; ConfidenceScore=5.12e-01
MARAREGGHMPQKGAGAFEPTLKTRTNLTRGSTIFRSCCSCTYADFARLLTSCNFGVYAMDWIVLMFNNACCREHAGHQSVGGEQQLQPSMLLQEVGVVVLVLLGFAPPSTFFAASSSKVIEIISDVLFLLEVNGINDKVGIELPDETDVSVVSLDEQLEDWTDKEISDFSSLIGGSYAPDALEPLNGVLTIPLTNDASVNLHMSKV

SEQ ID NO: 213493 - protein, 96 aa, Glycine max
  Coding DNA Sequence Number=SeqID_96715
MKIQNEKCTQHCNEAPKRKKRGESYLRLAHVQEQQLRKMVEPRVRFVRVFKVGSNAPAPFCGMCPPSRARAIAASNASLAKEAAQPRWRGGTNEGE

SEQ ID NO: 213494 - protein, 118 aa, Glycine max
  Coding DNA Sequence Number=SeqID_96716
  Gene Ontology: Cellular component=intracellular; Biological process =signal transduction
  Homolog annotation: Hit_ID=O82458; Match level="QueryCoverage=82%, HitCoverage=20%, E-value=1e-33, Identity=75%"; Hit description=Rac GTPase activating protein 1
  Pfam annotation: Domain name=RhoGAP; Domain location=1-92; Score= -32.0; E_value=0.0016; Accession=PF00620.17; Description=RhoGAP domain
MALMCTAWQAWFRELPTRVLDPFSPEQVMQSQSEEECAQLVRLLPPTEVALLDWAINLMADVTQMENLNNMNARNIAMVFAPNMTQYTVLLLAPIFVIEFIPVKFILLDIASMSKKTF

SEQ ID NO: 213495 - protein, 129 aa, Glycine max
  Coding DNA Sequence Number=SeqID_96717
  Gene Ontology: Mol. function=structural molecule activity; Cellular component=extracellular region; Biological process=keratinization
  Homolog annotation: Hit_ID=UPI0000612705; Match level="QueryCoverage =94%, HitCoverage=92%, E-value=4e-14, Identity=30%"; Hit description =UPI0000612705 related cluster
MIDTSNPYTGAMRGTVHEPQANLGAEGCTPSPSESCMPSPSKDCASSPSKGYTPSPLEGCTPSPLEDYMSSPQEGCTSSPSEGWTSSPLQNYMSSPLEGYMPSPLEDHTSSPQEGCTSSPSEGYTPSPS

SEQ ID NO: 213496 - protein, 123 aa, Glycine max
  Coding DNA Sequence Number=SeqID_96718
MRVPNINSQSHLLAASSLARSGAAISINEGKRRCVCIAANGRPLCQISESYCMLCHKRLVLFLVSSSTPAPMCTMGTLTRKRRESMRGSAEWRQEGSRIRVRERRRGRTHFAFFCFSITMGFY

SEQ ID NO: 213497 - protein, 160 aa, Glycine max
  Coding DNA Sequence Number=SeqID_96719
  Homolog annotation: Hit_ID=Q1S667; Match level="QueryCoverage=45%, HitCoverage=20%, E-value=1e-07, Identity=36%"; Hit description =Cyclin-like F-box; F-box protein interaction domain
MPFNKILTPETKNPDLKNPSREEEACDGFHVVEEVCGDELGRKIMRLRMSWCIGSRTLLAMEVVVEKEVPKEGEHEPLIAPSVLGHCPFHHYKTIHFVVWLMREFRVEKSWTQLLNVSYEYLQTPGRCLCPMRLLYMSEHDNSCCWQTIEAEEFVLYNKR

SEQ ID NO: 213498 - protein, 233 aa, Glycine max
  Coding DNA Sequence Number=SeqID_96720
  Gene Ontology: Mol. function=3-deoxy-7-phosphoheptulonate synthase activity; Biological process=aromatic amino acid family biosynthetic process
  Homolog annotation: Hit_ID=Q00218; Match level="QueryCoverage=37%, HitCoverage=18%, E-value=7e-28, Identity=62%"; Hit description =Phospho-2-dehydro-3-deoxyheptonate aldolase 2, chloroplast precursor
  Pfam annotation: Domain name=DAHP_synth_2; Domain location=60-233; Score=-277.9; E_value=0.008; Accession=PF01474.7; Description=Class -II DAHP synthetase family
MVFQEATSGGIVKLEVEYIVGTYASCQAIWLDFLLKEIKVEVKRPLYFMINNKFAINHAKNLVAHGRSKHIETRFHFLREQVKKRIIEVTHCPTQDQPANVLTKPITINHFLQLVLTNPRPRPIQDVHAADNNSMNVGRMMGQFAKLRSKEMKETDGMKLSSYKGDNVNGDAFEEKMRIPDPERLIRAYNKSVVTLSLLKAFAMGCQWNLDFSQHNEQGDKYSWVIEIHTDLK

SEQ ID NO: 213499 - protein, 467 aa, Glycine max
  Coding DNA Sequence Number=SeqID_96721
  Gene Ontology: Mol. function=nucleic acid binding; Cellular component= chromatin; Biological process=DNA integration
  Homolog annotation: Hit_ID=Q1T010; Match level="QueryCoverage=83%, HitCoverage=38%, E-value=1e-107, Identity=40%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
  Pfam annotation: Domain name=rve; Domain location=201-365; Score =94.7; E_value=2.7e-25; Accession=PF00665.16; Description=Integrase core domain
  Pfam annotation: Domain name=zf-CCHC; Domain location=61-78; Score =17.3; E_value=0.0014; Accession=PF00098.13; Description=Zinc knuckle
  Pfam module annotation: Pfam domain module=rve::zf-CCHC; Domain location=201-365::61-78
VLDVFEKGIKALSESATKAQITAYMEELKIDGRALFLIHQLCFKGDERVKKVRLQSLRRKVQCSNCEKYGHYANECWFKKGKTSRNNSEEANVAQEHESNSDPVLLMMTTSEGESHSENWYLDTRCSSHMTGKDDKASMIEEVLFVPDMKCNLMSVGQLIEKGFPVVMKDNDLEFFDSRQRLMLKSPLPRNRTLQTSIKYAQVECRLVAKTDEGLPRITSLDKSCESCMLGKQARGNQYFVTFVDDYSRMMWLYMIKHKSDVFEILQKFKTMAERQSEKKLKILRIDGGGEYTSREVECFYEKMGIQHEVVALYTPQHNGLVERRNRTILKLCRSMMKQKQLPKSFWGEVPKEVWNGKKPMISHLKVFGSLCYKHIPDAKRKKLHYKSECMILIGYHSTGAYRLFNPIKKKDWEKQKGQLKSVIPEADSHQEVETRNEEHNDLDIEGANDTNLMPESSEVIEGTSAN

SEQ ID NO: 213500 - protein, 308 aa, Glycine max
  Coding DNA Sequence Number=SeqID_96722
  Gene Ontology: Mol. function=receptor activity
  Homolog annotation: Hit_ID=UPI00001971B2; Match level="QueryCoverage =72%, HitCoverage=23%, E-value=5e-50, Identity=45%"; Hit description =transferase, transferring glycosyl groups
MIMVATAAINSNGRWPRWHWLWQCGHWLVLWWVVVMTSMMIGSCGTMVTVVYLVGNSVVKIFVEGGLEASLYGLGTELEFHSLLDEANSPLSKHIPNVLASGIIYLENGSYTNLSWDGKGIPDVIVENNMIRKKCSIDGFSFGVWGKKQLEYRNAGMPVDGSVSLAGNSSIWPYMITKRCEGNMFAELRDRLTWEDTTNLASFLGEQLFHLHLLSYPPLNVSSFSDIEHELSLGEANGCIATVHCKSNSAAEWRLFTRTLTKMRKDVSGRLTKWGDPIPSKLIEKIDEYIPPDFAELLNISEVLLYLA

SEQ ID NO: 213501 - protein, 99 aa, Glycine max
  Coding DNA Sequence Number=SeqID_96723
MARGMTVVARGKGHDGGGVMVVTQWWCCEDEHKENEGSERGMWVWRRKERRRVCMWRSGGEKREDGWGGGGECVGKWERQRVGKGENSREVAKLNGEVE

SEQ ID NO: 213502 - protein, 124 aa, Glycine max
  Coding DNA Sequence Number=SeqID_96724
  Gene Ontology: Mol. function=3-deoxy-7-phosphoheptulonate synthase activity; Cellular component=chloroplast; Biological process =aromatic amino acid family biosynthetic process
  Homolog annotation: Hit_ID=Q0GGT0; Match level="QueryCoverage=75%, HitCoverage=45%, E-value=1e-42, Identity=86%"; Hit description=3 -deoxy-D-arabino-heptulosonate 7-phosphate synthase 3
  Pfam annotation: Domain name=DAHP_synth_2; Domain location=1-106; Score=-205.5; E_value=1.1e-06; Accession=PF01474.7; Description =Class-II DAHP synthetase family
YLELAHRIDNTLGFMAAAGLTVDHPIMKTTEFWTSHECLLLPYEQSLTRLDSTSGLYYDCSAHMLWVGERTRQLDGAHVEFLRGVIIPLALRLNASQSLELAFNISERLKKNRIGSDLNSIFSL

SEQ ID NO: 213503 - protein, 82 aa, Glycine max
  Coding DNA Sequence Number=SeqID_96725
MNVQIFAPNKLRLEYLEPPDSMVEVRSLQMMENGVEVDEMVAETPLTYIMGSSFLCHKSSFNDCNNLKAEPMTFSNSHTRSK

SEQ ID NO: 213504 - protein, 98 aa, Glycine max
  Coding DNA Sequence Number=SeqID_96726
  Subcellular localization annotation: CTP_CleavageSite=41; ConfidenceScore=5.30e-01
MGKFAGEGTMTVMLVATTVAMVAFTILVVMVVMVATMVMLVAATVVMVAITVLVVVVAVVDGHGGCCSGGHGRFGENDHDNDDGHGDDRFEIFYDGIN

SEQ ID NO: 213505 - protein, 300 aa, Glycine max
  Coding DNA Sequence Number=SeqID_96727
  Homolog annotation: Hit_ID=Q2QM63; Match level="QueryCoverage=31%, HitCoverage=29%, E-value=4e-25, Identity=61%"; Hit description =Transducin family protein, putative, expressed
  Pfam annotation: Domain name=WD40; Domain location=42-78; Score=5.1; E_value=9.2; Accession=PF00400.22; Description=WD domain, G-beta repeat
  Pfam annotation: Domain name=WD40; Domain location=82-130; Score =26.6; E_value=9.1e-05; Accession=PF00400.22; Description=WD domain, G-beta repeat
  Pfam module annotation: Pfam domain module=WD40::WD40; Domain location=42-78::82-130
MGEGCCTQPYPCICKEAVSGFEPMTNKSPRHNFTTESTSYQWILTSLQVEFTSQVYETLTSNGLLYTGGEDRNITAWDIKTGKVAYCLEEAHTARVKGIVALTDSDGATGDDNPYLVASASSDGIIRVWDVRMAAREKPLTEHNTRSRLTCLAGSSLKFCLISLQKTKKSNDPRMERVNQRWSNNNVPSLERVYQRIMILIRSPSFAPLVTSNVGIESFLCCYPHKFCSYFSLAYDLFLNKYSELKQEMVITKLASPSALIMSFPSLDMPKSFQTCVYLNGTSIQLHWCLGKDKENMKPE

SEQ ID NO: 213506 - protein, 231 aa, Glycine max
  Coding DNA Sequence Number=SeqID_96728
  Gene Ontology: Mol. function=protein binding; Cellular component =nucleus; Biological process=negative regulation of signal transduction
  Homolog annotation: Hit_ID=Q2QM63; Match level="QueryCoverage=79%, HitCoverage=58%, E-value=4e-32, Identity=45%"; Hit description =Transducin family protein, putative, expressed
  Subcellular localization annotation: CTP_CleavageSite=45; ConfidenceScore=5.00e-01
MGDSIHDLSLPLLPQASSQPSNFLKLQGVNVIYSLINDANLVFNKCSTENRLGAFKFEQNPRILGLVDGDLLLHHHEELIPSGIKLYQTCLLAEAQTAVPAPSDEIDDGEAIVTGDGEGALAGGVEGKVVDGGVAVDGDGREVDEAIGVEDGDVAGGVGGDEVAGEGEVGRGVEGEGGNGGRVGVEGAEGGGGGEVVELDGVVLAAGGNDGTGDGDGFDGGEVGRIRKQRG

SEQ ID NO: 213507 - protein, 124 aa, Glycine max
  Coding DNA Sequence Number=SeqID_96729
MASLLCNAHVAWKPPPRVASCLQVETASMTGESAPGFGNRQSNWRIFPHKQTASQAGGSFSNQFAIRIGDSAAAAPPFCTIAAPPARLVPSPQPRNSPVKLAVPYAWSYRHCKQRFLQNDQTRQ

SEQ ID NO: 213508 - protein, 120 aa, Glycine max
  Coding DNA Sequence Number=SeqID_96730
PKPQNPLSPFSSNPLATDYLLSGFNAALESWGVEGLELKKLNPIFAAGFREDLHHIVEEGGGEEWLEIAVRGERKIGERDRRQQGTKWEKGEKWTKLDGYVQDRMNEGVTPNGQMGNFGI

SEQ ID NO: 213509 - protein, 287 aa, Glycine max
  Coding DNA Sequence Number=SeqID_96731
  Pfam annotation: Domain name=VQ; Domain location=71-101; Score=46.2; E_value=1.1e-10; Accession=PF05678.4; Description=VQ motif
MDKSCDPSADSTSTSLPANPNNNSRDQYLRHLNKLSQKISKPLIKKPTFDPPQAQAQAPNPNNQVQAQQNLQHQPPVYNINKNDFRDVVQKLTGSPAHDRISTPPPIQPPKPPSSRLQRIRPPPLPQITNRPPPLLNPTTLPRPQLPNAVTFNNFSVFSRPPAPLSPLPPFPTVHAPAESPISAYMRDLQTLVDSNARHFSGFSPFPPPPQPQQEQQQQQAMLPSQAPSSFQLPSSPVPFGCLNSQLASYPLLSPGLLFSPTSGQLGFPQLPLSPTVPVPSPRWKGI

SEQ ID NO: 213510 - protein, 113 aa, Glycine max
  Coding DNA Sequence Number=SeqID_96732
MAKFGMSSSIDMFATIGDEDGVDVGTGDSPHASIGDEDSIYVGIRDDPRASIGDGDGLTSVGGGDGVGAISEDLTGTYTIDRDEVDDGRLSLGDSSLTTSFFLPTCPFSTRVM

SEQ ID NO: 213511 - protein, 68 aa, Glycine max
  Coding DNA Sequence Number=SeqID_96733
MPKLIETFGVTVKPYLPKSVLTFQNKAVDESRIIQKGDDGQMADFTPNFVSPRQDIPSPQNTVVPFIQ

SEQ ID NO: 213512 - protein, 106 aa, Glycine max
  Coding DNA Sequence Number=SeqID_96734
MKNLRLEYLKLVVGPKRKGCLYGTGDLGHTYKCGDDNFVQHMQESSSRAQDSTKINQLREELRQSKEEMHRETLFININNFTSSNNKTMTNQMTNNKTMTVETLSQ

SEQ ID NO: 213513 - protein, 421 aa, Glycine max
  Coding DNA Sequence Number=SeqID_96735
  Gene Ontology: Mol. function=translation initiation factor activity; Cellular component=chloroplast; Biological process=translational initiation
  Homolog annotation: Hit_ID=Q8W4A5; Match level="QueryCoverage=87%, HitCoverage=84%, E-value=1e-145, Identity=65%"; Hit description=APO protein 2, chloroplast precursor
  Pfam annotation: Domain name=DUF794; Domain location=39-421; Score =734.3; E_value=7.9e-218; Accession=PF05634.2; Description =Arabidopsis thaliana protein of unknown function (DUF794)
  Subcellular localization annotation: CTP_CleavageSite=68; ConfidenceScore=5.10e-01
MSMTKGITPRDSLLLKPNPLSSLSSLHSLQHGNNTIRVPVTIRIQPERFCHGALTIRNEVPQNADFPRQYSRKEKKPFPVPIVELRRAARERMKKMKDEPRKPMSAPKNGLLVKSLIPTAYNVYNARITLINNLKKLLKVVPVHACGWCSEIHVGPVGHPFKSCKGTQANIRKGLHEWTNAHVEDILIPIEAYHLFDRLGKRITHEERFSIPRIPAVVELCIQAGVEIPEFPTKRRRKPIIRIGRKEFIDADESDLPDKISEGPLKPLLAEIHDSEIVAPLDNEVAPLAEETLQAWERMRKGAKRLMRMYNVRVCGYCPEIHVGAQGHKAQNCGAHKHQQRNGQHGWQSAVLNDLIPPRFVWHVPDVNAPLERELRNFYGQAPAVVEMCIQAGAGLPEQYKSTMRLDVGIPSTLKEADMVV

SEQ ID NO: 213514 - protein, 1445 aa, Glycine max
  Coding DNA Sequence Number=SeqID_96736
  Gene Ontology: Mol. function=RNA-directed DNA polymerase activity; Cellular component=chromatin; Biological process=chromatin assembly or disassembly
  Pfam annotation: Domain name=Chromo; Domain location=1353-1401; Score= 28.1; E_value=3e-05; Accession=PF00385.14; Description='chromo' (CHRromatin Organisation MOdifier
  Pfam annotation: Domain name=RVP; Domain location=345-450; Score= -9.7; E_value=0.034; Accession=PF00077.10; Description=Retroviral aspartyl protease
  Pfam annotation: Domain name=RVP_2; Domain location=336-464; Score= -43.3; E_value=0.0024; Accession=PF08284.2; Description=Retroviral aspartyl protease
  Pfam annotation: Domain name=RnaseH; Domain location=818-944; Score= -26.3; E_value=0.016; Accession=PF00075.14; Description=RNase H
  Pfam annotation: Domain name=rve; Domain location=1050-1206; Score =118.2; E_value=2.3e-32; Accession=PF00665.16; Description=Integrase core domain
  Pfam annotation: Domain name=zf-H2C2; Domain location=991-1032; Score= 9.3; E_value=0.021; Accession=PF09337.1; Description=His(2)-Cys(2) zinc finger
  Pfam module annotation: Pfam domain module=Chromo::RVP::RVP_2::RVT _1::Retrotrans_gag::RnaseH::rve::zf-H2C2; Domain location=1353 -1401::345-450::336-464::589-925::110-200::818-944::1050-1206::991 -1032
MADHATRKTTTDRLEEAINRLSNSQATLLDKHADLFDKYSELSGKVDTLLDHLHLRSPAREHHGSSSHFHQRNSVKLDVPRFDGRDPMGWIFKISQLFEYQNTPEEERITVASFYLDGAALSWYQWMFRNGFITSWSGFLQALESRFAPSYYDDPKGALFKLTQRGTVNEYLTEFERLANRVIGLPPPFLLSCFVSGLTQDIRREVLALQPISLPQAMALAKLQEDKLRDRRQAPPRNHNTPSASYAPPTRKPHSTYVQRTPDEMALRREKGLCYNCEEKWSSTHRCKGRVLLFIADNPSPTSDEPISEPPLLPLPAPTPACPPDLDSTSELTPPHVSLHALSGLPSSETFRLVGIINHSPLTILIDSGSTHNFLQPRLAQFLRLKTQPTNPLNVLVGNGSVLKCDQVCHDISLLLQDHHFLVTFHLLPISGADAVLGIEWLKQFGPIITDYTAFSMKFTHMGQPIELHADVSTGPTPISAPQVKRLLQTGAASALFHLKVIPNPQPDPLLHLPHPIPAVQALLTQFHTLFQQPSSLPPPRSIVHHITLLPNTAPINVRPYRYPQFQKSEIEKQVSELLESGLIQPSMSPYSSPVLLVKKKDGTWRMCVDYRALNAATVRDRFPIPTIDELLDELGSANWFSKLDLRQGFHQIRMHGPDVEKTAFRTHQGHYEYRVMPFGLCNAPSTFQAAMNTLLKPFLRKFAAGQYYLKKTKCLFAQKHIEYLGHIVSGQGVKPEPSKVQTMVQWPTPSSAKELRSFLGLTGFYRKFIQNYAMIAAPLTSLFTKDVFEWSLDAQSAFEKLKTAMTSAPVLALPDFDEPFTIETDASGTGMGAVLMQKGHPLAFFSKQFGPRMIHASAYVRELHAIVAAVRKWRQYLLGHPFTIFTDHQSLRELMSQYKKGSSNAVADALSRSSPSGQFLLLSVPHLDFMHDLRNTLLSSNAFQELLTKIRDKPHDYPDYRIHQGLILFKNRIWLNNDHPSIPNLMLEFHSTPLGGHLGVSKTTHRLESNFFWPSLRKDVKRFVKECTICQQTKPTTQRPAGLLQPLPPPTGVWEDISMDFITQLPSSHGYTVILVVVDRYSKGVHLGALPTNHSAFKVASLFIDIVCKHHGFPKSIVSDRDPIFLSSFWRELFRLSGTRLRMSTAYHPQSDGQTEVMNRVLEQYLRSFVHNQPATWYRYLTMAEWCYNTSIHSSSGMTPFEVIYGKPPTTLPQYLPGASTNDAVDSMLHSRQEIHRKLQHRLQKAQDSMKKATDKHRRDVNYNVGQWVYVKLRPFRQRSVAGPIHPKLSKRYFGPFQIIGCVGHVSYKLELPEAARIHPVFHCSLLREHHGPPPPRQDTWPLEFITHQPVPRPLCILDSKLDISSSPPNKLVLVQWTGQPPEDTTWEPWSEIRDLYHLEDEVVLAGDGIDNSNQEDTKIEPTTTKTKPKRTTSRPCYLNDYET

SEQ ID NO: 213515 - protein, 217 aa, Glycine max
  Coding DNA Sequence Number=SeqID_96737
  Gene Ontology: Mol. function=DNA binding; Cellular component=beta -galactosidase complex; Biological process=DNA integration
  Homolog annotation: Hit_ID=Q1SS72; Match level="QueryCoverage=85%, HitCoverage=14%, E-value=2e-46, Identity=45%"; Hit description =Integrase, catalytic region
MEPQTTPINLSPTTPNLRMSSKTHKNPAYLDDFVCNTSYPIKSHLTYTKLSPTYHNYILQVSSIYEPQFYHQDCKSVEWCQAMQEEISALEANNTWSIQPLPAGKKSIGCRWIFKFKYKADGSLDRYKARLVAKGYTKKLGLDFVDNFSPVATLTTLPLDINNVFLNGDLFEEVYMQLPLGYPNKGNNMVIKEMTDGGVDYCFECIGFGLLMADAFN

SEQ ID NO: 213516 - protein, 110 aa, Glycine max
  Coding DNA Sequence Number=SeqID_96738
MYEKRGQPGPTRDDATGLENPSCLTQKIAWPKGNHHGGWCAAPGTASTRPDNTRSPQGRRQRDDGGGFKVVQTKKREKKQKKNKDGRALNATNEGLTSAKLPQVSGKWWR

SEQ ID NO: 213517 - protein, 264 aa, Glycine max
  Coding DNA Sequence Number=SeqID_96739
MKKARREELSRKRFQGALLGSSNELKLRKAERDKSMMENIMLKDELRNCRESKDILKGQLSKTKKNMLIIIDQYKEKAREEVIKLLHEEGMKWMDRFAFTLNESQELPKLLAKAKAMNDVYSTPDETALYDTLTRHVKARIMSDIEQVQEQMKDDMKAMKEQMTTMIEAMMSMRKMMEVNVVTTVVASTATEMDPIHRPISINKYTFPPYGLPPDYTPLTVVYTPGENIAPQDHTLACFGVYPRYTTEGHAFSGVPMLNAPGGP

SEQ ID NO: 213518 - protein, 97 aa, Glycine max
  Coding DNA Sequence Number=SeqID_96740
MNYGREIHSKLEGSAARTHSVKLNKGEKLSLKKRSVHKTLMEVRPSSRISPIEKARPSSRAYVAWVAYLAKGRSGTLACIASGNDSTVHVITYRQWK

SEQ ID NO: 213519 - protein, 547 aa, Glycine max
  Coding DNA Sequence Number=SeqID_96741
  Gene Ontology: Mol. function=aminoacyl-tRNA ligase activity; Cellular component=extracellular space; Biological process=tRNA aminoacylation for protein translation
  Homolog annotation: Hit_ID=Q2R1C1; Match level="QueryCoverage=97%, HitCoverage=97%, E-value=0.0, Identity=63%"; Hit description=Seryl -tRNA synthetase family protein, expressed
  Pfam annotation: Domain name=Seryl_tRNA_N; Domain location=69-187; Score=63.7; E_value=5.9e-16; Accession=PF02403.12; Description=Seryl- tRNA synthetase N-terminal domain
  Pfam annotation: Domain name=tRNA-synt_2b; Domain location=279-450; Score=206.3; E_value=7.2e-59; Accession=PF00587.15; Description=tRNA synthetase class II core domain (G, H, P, S and T)
  Pfam module annotation: Pfam domain module=Seryl_tRNA_N::tRNA-synt _2b; Domain location=69-187::279-450
  Subcellular localization annotation: CTP_CleavageSite=55; ConfidenceScore=5.71e-01
MMGLHGCTLKLASVPNFSSPTFLFKTPTLRFQKSPLSRPIRALSSSALVQTSTTKATEDQGVKPQWKATIDFKWIKDNKEAVAANLKNRNSDADLNLVLHLYDKMFTLQKEVERVRGERNAVANKMKGKLEQSERQRLIEEGAFGAKFQPIGILSKNLKEGLAALEEDLAKLNDELQQEAQCIPNMTHPDVPIGGEDCSTIRKMVGSSPKFSFPVKDHLQLGKELDLFDFDAAAEFGCSKELEYYWHLTSVLSQMHLTYAASQVSGSKFYYLKNEAVLLEMALVNWTLSEVMKRGFTPLTTPELVRSSVVEKCGFQPRANNTQIYSIADSDQCLIGTAEIPVGGLHMDSILSDSLLPLKYVAFSHCFRTEAGAAGTATRGLYRVHQFSKVEMFIFCRPEESEHYHQELITIEEDLFSSLGLHFKTLDMASEDLGAPAYQKFDVEAWMPGLERFGEISSASNCTDYQSRRLGIRYRPASEAQATSAKKSKGNLAPPQFVHTLNATACAVPRMIICLLENYQQEDGSVLIPEPLRPFMGGLSVIARKSL

SEQ ID NO: 213520 - protein, 341 aa, Glycine max
  Coding DNA Sequence Number=SeqID_96742
  Gene Ontology: Mol. function=nucleotide binding
  Homolog annotation: Hit_ID=Q67X84; Match level="QueryCoverage=87%, HitCoverage=53%, E-value=1e-114, Identity=72%"; Hit description =Putative auxin-independent growth promoter
  Pfam annotation: Domain name=DUF246; Domain location=2-257; Score =352.2; E_value=8.6e-103; Accession=PF03138.5; Description=Plant protein family
MDYYENEIAALWDNFKVIRASKSDSRLANNNLPPEIQKLRCRACYDALRFSPHIEKMGKILVERMRSFGPYIALHLRYEKDMLAFSGCTHELSAVEAKELWIIRQNTTYWKRKYINPIEERSKGFCPLTPKEVGIFLTALGYPSNTPIYIAAGEIYGGESHMTDLQSRYPLLMSKEKLASIEELEPFSSHSSQMAALDYIVSVESDVFVHSYPGNMAKAVEGHRRFLGSGRTISPDRKALVRLFDKLANGSMTEGKTLSNKIIDLHKKRYVIEEALIICEAWLQKEKRTRFWNKGLGQVGQDKAKAFSFNRSILVKELPHASSLYQRFNTNQLEGAKRLLA

SEQ ID NO: 213521 - protein, 92 aa, Glycine max
  Coding DNA Sequence Number=SeqID_96743
MYCPGSIKYTCQATWHSETHVNPPCQPWHKSTNVTPLTVKLLTDKYSIIYKGYALWHEKYRRYISEIDGPDFQIADWTKCQGPHRQHGHQIP

SEQ ID NO: 213522 - protein, 64 aa, Glycine max
  Coding DNA Sequence Number=SeqID_96744
  Gene Ontology: Mol. function=ribonuclease H activity; Biological process=DNA integration
MSQMPGIRRQCQRSAFAPEYVIGAIEPKAANGHHFILVAIDYFTKWVEAASYASVTRSAVVRFI

SEQ ID NO: 213523 - protein, 163 aa, Glycine max
  Coding DNA Sequence Number=SeqID_96745
MDEIEKVQEQMKADPEALKEKMATMVEAMMSIKEIVVVSAAYQTRARAKIMDEIEKVQEQMKADPESLKEKMATMVEAMMSIKEIVVVSAAYQTRARTKIMGEVEKVQEQMKADMEAMKEQMVGKDLGSTGGPPLCANSKQACLPTIWLASQLYTTQCGIHSQ

SEQ ID NO: 213524 - protein, 196 aa, Glycine max
  Coding DNA Sequence Number=SeqID_96746
MKSKRWPESKKKLPSSEHQEVLIQKFNHEPFNPMTLYGESETKLEKIPEQESLDLTALNARHRLSRNNTLSTSRIIQERRLIQERVPLSSSYVLSARRTAILAKHNKRAQCKGSNNPMSALGESRFSKGSSNPSSFLGESRISKGSQNLRSILGESRISKDLSNPRFVLGETNFSKGSSNPRSALGEPFCRKVPSP

SEQ ID NO: 213525 - protein, 164 aa, Glycine max
  Coding DNA Sequence Number=SeqID_96747
  Homolog annotation: Hit_ID=Q9SK88; Match level="QueryCoverage=51%, HitCoverage=18%, E-value=3e-16, Identity=44%"; Hit description =Similar to auxin-independent growth promoter
  Subcellular localization annotation: CTP_CleavageSite=7; ConfidenceScore=5.15e-01
MKNPTLRERRGGSMQRRNNTVVPLGMLRRFLGASVFSIVVTSFFFVHVHVSPSPSDHKFNDKILSFRDPQSWTRELVPPHLSKAPLSVPKLKDSRKDSDYEKLWKPPSNHGFIPCTKPTPNYSILKSSVTVHPAPGRSRGYLSVHTNGGLNQMRTGMLESSPSV

SEQ ID NO: 213526 - protein, 442 aa, Glycine max
  Coding DNA Sequence Number=SeqID_96748
  Gene Ontology: Mol. function=nucleic acid binding; Cellular component= chromatin; Biological process=DNA integration
  Homolog annotation: Hit_ID=Q1RWN2; Match level="QueryCoverage=88%, HitCoverage=52%, E-value=9e-78, Identity=45%"; Hit description =Peptidase S8 and S53, subtilisin, kexin, sedolisin; Integrase, catalytic region; Zinc finger, CCHC-type
  Pfam annotation: Domain name=rve; Domain location=218-352; Score =64.5; E_value=3.5e-16; Accession=PF00665.16; Description=Integrase core domain
MTSESTFVQPAIPKFNGHYDHWAMLMENFLCSKEYWSLVENGIPVAVEGEEFTKAQRKSIAEQQLKDLKSNDLDTLTIDELQSSMLVHEQRMKRHGGDEQALKQLDHFQYECPRWEEKANYVELEEEGEILLMSFVEPNQYDKEVKEKALTCFQATLEDNTHLWHRRYEHLSYKGLRTLQYKEMARGLPHLNASSKVCTDCMVGKQHRDAISKKSLWKASQRLQLEHSDICGPIKPVSNSKKMYFVSFTDDYSCKMWIYFLVEKGGECMSLEFKDICGVNGIIRQLTTAFTPQQNGVAKHINRTIMNMVRSMLLKKQIPKRFWPEVANWIVHVLNRSPTLAIKDRTPKEAWSGVKPNVDYFRVFGCIGHVHVPDSKRTKLDDKSFKCVLLGEKVGIGGSALKKQNLIFLSGKKSTLMKVENKLKNESSMRGKKLKKEPRRKG

SEQ ID NO: 213527 - protein, 219 aa, Glycine max
  Coding DNA Sequence Number=SeqID_96749
  Gene Ontology: Mol. function=binding; Cellular component =intracellular; Biological process=protein kinase C activation
  Homolog annotation: Hit_ID=Q2QVE3; Match level="QueryCoverage=83%, HitCoverage=30%, E-value=3e-37, Identity=40%"; Hit description =Pentatricopeptide, putative, expressed
  Pfam annotation: Domain name=PPR; Domain location=17-51; Score=14.8; E_value=0.13; Accession=PF01535.11; Description=PPR repeat
  Pfam annotation: Domain name=PPR; Domain location=54-88; Score=14.6; E_value=0.14; Accession=PF01535.11; Description=PPR repeat
  Pfam module annotation: Pfam domain module=PPR::PPR; Domain location =17-51::54-88
MARKLFDEEKSIHRDIIAWNSMINAYSKHGEWFICFQLYTYSQMKISNINPDQVTFLGLLTACVNSGLVSKGKEIFKEMVEIYGYQPSQEHHVCMVYLLECAGQIDEANEIIKTVPLESDARVYGPLLSASGKWDKVAKLRSFLRDRGLKKTPGCSWLELNGQVHEFRVADQSHPRWEDIYSILKVLELEAGDMEDDLELFDPSVVKGCELHMNQLNQI

SEQ ID NO: 213528 - protein, 455 aa, Glycine max
  Coding DNA Sequence Number=SeqID_96750
MSSFISGFAIGMGGSDSEGSIQQPLVDREVISIDSSTSKETRHGASDNESSSSERLRVLCRAGGDTSHLHRRVQPSIAFPIRETVPCWVAIVPPTIAGFEWVSDDVLKYRSSITSTMKLTSKIGWVSLNNMSKKLFECDSNVFHCFKENFFKVQATDIMADGLPLMFNEDGEPRFPFYWQSNPTRFKSFNKDLLTLVKKVDKAILEQLSVSLDAWAILSLPSPNTCCVIAVCFASIMGDFSWRPLVKKVGPTTEVVEVSPSVPSSVMAKRKQDDNIEAVGLTPGSGHPSSLQDLPPTSSAIQASTPNAATIVVASTSPPPSVVFVQEVAPTAEVSAPIALVGPVVAPSSTVVASLLSASVTTASAPKISPPPSLALPVPLSAKAIDSAKAEVAKWRVTTRIVWRVECPKVANATVTFVEVVKSNHQLSFKIGGIFAKLLCIRLDGDELFEHYKGL

SEQ ID NO: 213529 - protein, 381 aa, Glycine max
  Coding DNA Sequence Number=SeqID_96751
  Homolog annotation: Hit_ID=Q1SNE2; Match level="QueryCoverage=54%, HitCoverage=71%, E-value=2e-27, Identity=37%"; Hit description =Expressed protein, putative
MPSGAKKRKAAKKKKEKETEINTNPSTTNPQDGYLLIVLFLHSGGNIQLANLFHSIKIRFYCVTVNDLMIDCVLGGNDEVKSQSQDEKGSDGGEGGSPAHGEHDPAFNEEEEERDPSAAQPSHAASSSKDLEEAPGDAKIDETEGRKEGIVVIQWDMKSEGSESKDVIVGHVESAKESDHGNGNRNYSSSSSSDETGTLKNSKNESHNSVNETVGFDELVKTMDSLHAKMTSITQNVLVEETGDSVVESSADIAKVVAAVPEVQTIDNNNALLEKSTGSQVEATYLAVEKNEDKEHSSSDENVRTISLEEPKPREFDSEVSASVSQSPIPESTIDAEHVKDSDTPECSDNQPLVASVPPVVQKTSWLSCCGLFDVLSGSNR

SEQ ID NO: 213530 - protein, 137 aa, Glycine max
  Coding DNA Sequence Number=SeqID_96752
  Homolog annotation: Hit_ID=Q1S9I4; Match level="QueryCoverage=41%, HitCoverage=5%, E-value=1e-10, Identity=59%"; Hit description =Integrase, catalytic region; Zinc finger, CCHC-type
MSKGTNHVGPKKIWVPKSQIVLVVDILGRKRPRFKLLLHMDLFGPTRTLSLGRKKYGYVIVDDYSRYTCVYFLANKHESFKICREDHSYLLKRRRSNSLKKFFLRLKYLQIISLKRRTRSFFIIIHKIISLEIRLKE

SEQ ID NO: 213531 - protein, 126 aa, Glycine max
  Coding DNA Sequence Number=SeqID_96753
  Homolog annotation: Hit_ID=Q9LUJ9; Match level="QueryCoverage=96%, HitCoverage=94%, E-value=2e-31, Identity=56%"; Hit description =Arabidopsis thaliana genomic DNA, chromosome 5, P1 clone:MUD12
MPLGLILGIGRAFRRKRPSSLDILSSKRAPRGYYKGKNCKPTGFHTRKGGYVVMQEKLPNYVVPDLTDFKYSSLIPESLFLASPFLGNSVPFRGLIHIIPSFMQLKPYVSQCPIEANTSEASQTAK

SEQ ID NO: 213532 - protein, 199 aa, Glycine max
  Coding DNA Sequence Number=SeqID_96754
MTHIPNDNVAFNIIMASLRIRPPSKDKDIIGRFMPNNGCCKKHPNHRQSPGVCSLCLRHKLSQLSSASMRKTTLISSCRSSSTSSSLSSYCSSSSSSCASPTLPFPFHKDSKSGSNSVSIFLLSAKHGGVLKTGSMSVLATRRRTKGGVVGDGDGDDRNKKKTGFWSKLLHPKTKSKRMDEIKGTKLVHSRSLIETRHS

SEQ ID NO: 213533 - protein, 104 aa, Glycine max
  Coding DNA Sequence Number=SeqID_96755
  Homolog annotation: Hit_ID=Q1T010; Match level="QueryCoverage=40%, HitCoverage=3%, E-value=4e-09, Identity=69%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MDEAIELIVDSKSAIDLAKNPVAHGRSKHIGTKFHFLIDQVNGRGAVAAKNRTFDPEEVIVDDKEEALGREPRQRSTKYWPEPVAVPKVRGDLAERWWKSMARR

SEQ ID NO: 213534 - protein, 119 aa, Glycine max
  Coding DNA Sequence Number=SeqID_96756
  Gene Ontology: Mol. function=nucleic acid binding; Biological process= DNA integration
  Homolog annotation: Hit_ID=Q1T010; Match level="QueryCoverage=89%, HitCoverage=16%, E-value=9e-12, Identity=51%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MDVRRLDGRQAMITDVLYVPGMKNNLISMGQLLEKGFSMKMSNRSLEVYDTTKKMIMKAPLARNRTFKVKSEVFNTFKGFKALVENQSRKCIKTLRTDGGGEFTSSELEDFLQGAWNCA

SEQ ID NO: 213535 - protein, 381 aa, Glycine max
  Coding DNA Sequence Number=SeqID_96757
  Gene Ontology: Mol. function=transferase activity, transferring glycosyl groups; Cellular component=transcription factor TFIID complex; Biological process=queuosine biosynthetic process
  Homolog annotation: Hit_ID=Q6K4A3; Match level="QueryCoverage=94%, HitCoverage=86%, E-value=0.0, Identity=86%"; Hit description =Putative queuine tRNA-ribosyltransferase
  Pfam annotation: Domain name=TGT; Domain location=96-332; Score =390.1; E_value=3.2e-114; Accession=PF01702.8; Description=Queuine tRNA-ribosyltransferase
MREGSLGTIKGLTNSQLEEIGCQIILGNTYHLALRPTSELLDEVGGLHNFMNWKRALLTDSGGFQMVSLLHLADITEKGVTFQSPVDGKPMLLTPEESIQIQNRIGADIIMALDDVVKTTITGPRIEEAMYRTLRWIDRCIAAHKRPHDQNLFGIVQGGLDPILRDICVKGLVERNLPGYAIGGLSGGEDKNSFWRVVAQCTAALPEDKPRYVMGVGYPLDIVVCSALGADMYDCVYPTRTARFGTALVPEGVLKLKHKAMADDTRPIDPTCPCMVCKNYSRAYIHCLVTKDAMGSQLLSYHNLYYMLQLSRNLHSSIVEGRFPEFVCDFLHKMFPKGDVPEWVCDAMEVAGIDISSCCAPFPSCQEDDSKNMPEEVSLVR

SEQ ID NO: 213536 - protein, 211 aa, Glycine max
  Coding DNA Sequence Number=SeqID_96758
  Gene Ontology: Mol. function=nucleic acid binding; Biological process= DNA integration
  Homolog annotation: Hit_ID=Q1T010; Match level="QueryCoverage=99%, HitCoverage=15%, E-value=2e-47, Identity=43%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MTAAHVLNRCPSKRLNLMVPEEAWSGNKPSVKHFIIFGSLCYRHVPDQKRKKLDDKNEPMIFVGYNSTGSYKLYNPKTKEVLFSKDIYFDESKSWSERQAITETIPRLQLDWEEFDSRKEATQGTLNTEQQIVNNRPRRNKSFLSRLSDYHLYPDNAIFDDGDLVQHLALMADAEPIDLDEAIASEVWRSAMEEELKSIEKNQTWEMAELP

SEQ ID NO: 213537 - protein, 144 aa, Glycine max
  Coding DNA Sequence Number=SeqID_96759
  Gene Ontology: Mol. function=nucleic acid binding; Biological process= DNA integration
  Homolog annotation: Hit_ID=Q1SRA2; Match level="QueryCoverage=97%, HitCoverage=67%, E-value=6e-14, Identity=32%"; Hit description =Peptidase S8 and S53, subtilisin, kexin, sedolisin; Zinc finger, CCHC- type
MRRQYELMQMENNEKIGDFFNRIITHINAMKNCESKKLEEITVEELQGSLEAHEQRLIEREIEKLGDHQALQAHTSKKVGNNSKECVAAPSSTNHRGNQSHSDYQAHMVKEENEAKSEEQPLILMMITDSESHNNEIWYIDFGC

SEQ ID NO: 213538 - protein, 78 aa, Glycine max
  Coding DNA Sequence Number=SeqID_96760
MIAPPSPLILPKTTVRKSDVVESGGSTAKTGVMTIKEHHHDLLDYAILSLLASISYFVLQALAFFTFFSTKHKPSSDN

SEQ ID NO: 213539 - protein, 61 aa, Glycine max
  Coding DNA Sequence Number=SeqID_96761
MENFEVNANRDVIGELAKIVQWDLDSKLKKDIFVLKDKVCGYYYDMYFVGDICSKAEILFR

SEQ ID NO: 213540 - protein, 58 aa, Glycine max
  Coding DNA Sequence Number=SeqID_96762
MSFHVAISMSVIKNRCKKYAHEEKRGASCEVAGREGRRGRPAVVVLSEKKPSRPHDTE

SEQ ID NO: 213541 - protein, 215 aa, Glycine max
  Coding DNA Sequence Number=SeqID_96763
  Gene Ontology: Mol. function=acyltransferase activity; Cellular component=integral to membrane; Biological process=lipopolysaccharide core region biosynthetic process
  Homolog annotation: Hit_ID=Q0Z3T3; Match level="QueryCoverage=94%, HitCoverage=70%, E-value=1e-86, Identity=75%"; Hit description=Lipid A biosynthesis acyltransferase precursor
  Pfam annotation: Domain name=Lip_A_acyltrans; Domain location=1-203; Score=-57.2; E_value=7.8e-06; Accession=PF03279.4; Description =Bacterial lipid A biosynthesis acyltransferase
MWMGRQPSCEMHNEECVRRAYAAGRGIIFLTPHLGCFELSVQHAARQWSAEHGEITILYRPARQPWLARVMETARNRPGVQAVPTTLAGVRQMIKALRKGAAVGLLPDQVPPEGQGVWSPFFGRDAYTMTLAARLALQTGAAVIVARCERLSWGRGYALYLEELPVPLSENLEAAVQQINEAMEQTIRQCPQQYLWGYARYKQPRREAAAGEVGA

SEQ ID NO: 213542 - protein, 212 aa, Glycine max
  Coding DNA Sequence Number=SeqID_96764
  Gene Ontology: Mol. function=[glutamate-ammonia-ligase] adenylyltransferase activity; Cellular component=intracellular; Biological process=regulation of transcription, DNA-dependent
  Homolog annotation: Hit_ID=Q8PPY3; Match level="QueryCoverage=99%, HitCoverage=70%, E-value=1e-85, Identity=61%"; Hit description =Glutamate-ammonia-ligase adenylyltransferase
HVGLRIAQHLQAVFQPAQEQVGLAQRAAIFGGDLPGGDQRVQRHQQAAFAQCRFATTADQLQRLAQELDFADATGATLDVLVQFTARDFGGDGRLHLAQAIERGEVQVAAVHERAQGLQPRFTGLDIAGHRARLQPGVAFPVAAFALEVLIHRCERQRDAAGAAERAQAQVDAVAEAIDGGFVQQLGQALAEPGEILFGGQRARAVGFAAVR

SEQ ID NO: 213543 - protein, 102 aa, Glycine max
  Coding DNA Sequence Number=SeqID_96765
MNHLLQKLHQFDPRKSHVKRTSCIRSPIGHILCMMIKIHVRNKTRLKNQRRNGPQRGQATERKEKKSRRELYGHLRMIDHAYLANVSGATATYLIHKIHGAM

SEQ ID NO: 213544 - protein, 214 aa, Glycine max
  Coding DNA Sequence Number=SeqID_96766
  Subcellular localization annotation: CTP_CleavageSite=42; ConfidenceScore=5.18e-01
MEPWQIYKTVKGGISGNSRNSTVGCTKSKNHTNTPLYITIPLSDSESNLSLSLSLSLCNAPNGQQQRRTTEQLNKIIDHGVEADASTSPNRRNTHPQAPPEAMAEGGRTHQQPHSVERDPNRFNPQRDHHPLHLLLPLPLHHPHAPLQLLVTLFLSQIVGPFAVLSVILAGPNMGLALQERRGGPRGEDAAAGEGGQRVAGEVRGGVEEERVGV

SEQ ID NO: 213545 - protein, 118 aa, Glycine max
  Coding DNA Sequence Number=SeqID_96767
  Gene Ontology: Mol. function=electron carrier activity; Cellular component=anchored to membrane; Biological process=electron transport
  Homolog annotation: Hit_ID=Q41001; Match level="QueryCoverage=93%, HitCoverage=65%, E-value=6e-24, Identity=51%"; Hit description=Blue copper protein precursor
  Pfam annotation: Domain name=Cu_bind_like; Domain location=2-53; Score=46.2; E_value=1.1e-10; Accession=PF02298.8; Description =Plastocyanin-like domain
GHTVDEVKESEYKSCTAGNSISTDSSGETTITLKTAGTHYFICSVPGHCSGGMKLVVTVKSGKATDSSSTSTGKASPSDVTPNTTKSNSSSASGVSPIVAMFIVSWISYNVLYDLSEY

SEQ ID NO: 213546 - protein, 367 aa, Glycine max
  Coding DNA Sequence Number=SeqID_96768
  Gene Ontology: Mol. function=sequence-specific DNA binding; Cellular component=nucleus; Biological process=regulation of transcription, DNA-dependent
  Homolog annotation: Hit_ID=Q2HRQ1; Match level="QueryCoverage=47%, HitCoverage=74%, E-value=3e-35, Identity=45%"; Hit description =Transcription factor, MADS-box
  Pfam annotation: Domain name=SRF-TF; Domain location=20-73; Score =41.7; E_value=2.5e-09; Accession=PF00319.9; Description=SRF-type transcription factor (DNA-binding and dimerisation domain)
MNAQFNVIDQKMGRARITLKLISNERSRRLTFKSRREILIKKTSEFSTLCGVEACLIVYDNGNGDVAPVTWPKEPVLVHPILQKYESQKNERPPKTFGIEDFLENRKNMVEADISKVHKQISNIKYPTWDPSFTNMEEKQLKAFITQVNAKIMACDHVLQNKHQSKANNIMQNMAWGSASSSHIPSQITPTPNNNGRVYVTNPINQFDGASNHGMNMQQVDACYGYIPTMAQESTNSTSSYPRQFNCLQNIPQSQPIFEDLKPLDYKNEMVDFSYQVDVPLDSTNQLGVYADWTNNQFGDFEDWINRPIDGSNQPVNGDLVGLDNKPNESILQNIPVQYQNKQQGGALHVLPPPLNGFQTDCYNVNF

SEQ ID NO: 213547 - protein, 203 aa, Glycine max
  Coding DNA Sequence Number=SeqID_96769
MGIPVEVDIDWGSVITVARRRCECGRAHSHSGFEVNVVIGEDSRPRMHVGISLELDKLAFVNELHRATLGIDLDCHANLRALHFTTIADEDPECPMGHHLQSKGRSVRSSGGRGGGGFAGEGSKGKGEGGEGAEMESGVDGEEGKDGAWTSRRIAGLRPEIKQLRSEEVDKPVIRFAKASNCGTLSMWVAGDFWPSTGTRQAR

SEQ ID NO: 213548 - protein, 81 aa, Glycine max
  Coding DNA Sequence Number=SeqID_96770
  Subcellular localization annotation: CTP_CleavageSite=46; ConfidenceScore=5.23e-01
MASCSKGNLSRSIGRAISLKAKKLSTNAKLRISYNHQSESYSFTKRATSVPPANSNKLPDANIPAPNKVYDPSFHFLEQSS

SEQ ID NO: 213549 - protein, 35 aa, Glycine max
  Coding DNA Sequence Number=SeqID_96771
MSEEELEECQGTFRDVVIAAGTHVSPLRGIRRRSN

SEQ ID NO: 213550 - protein, 327 aa, Glycine max
  Coding DNA Sequence Number=SeqID_96772
  Gene Ontology: Mol. function=RNA-directed DNA polymerase activity; Cellular component=chromatin; Biological process=chromatin assembly or disassembly
  Pfam annotation: Domain name=zf-H2C2; Domain location=223-260; Score =12.2; E_value=0.0087; Accession=PF09337.1; Description=His(2)-Cys(2) zinc finger
MADSQSTRALRGFLGLSGFYQRFIKGYATLAAPLTALLAKDKFNWTPEADRAFHLLKDALCQAPVLRLLDFNSEFVIETDASGIGMGAILSQHHHPLAFFSKPFCSKLLRASTYVRELAAITTAVKKWRQYLLGHWFVILTDHRSLKELMAQAVQTPEQKVYLARLMGFDYTIQYRAGKANGAADALSRLPEPPSDQLYGRIWLPPRLKLLPTIIAKFHSTPTDRHMGVMKTLARVRENFVWPSMKQDIHQFIMSCATCQQIKIDHRRSPDLLSPLPIPAQPWEDLSLDFIVGLLSYHVTQLSWWLLTIFRRVSTSVHFHSTTPSPV

SEQ ID NO: 213551 - protein, 540 aa, Glycine max
  Coding DNA Sequence Number=SeqID_96773
  Homolog annotation: Hit_ID=Q5KS41; Match level="QueryCoverage=83%, HitCoverage=94%, E-value=3e-41, Identity=27%"; Hit description =FOLDED PETALS
  Pfam annotation: Domain name=DUF1298; Domain location=381-534; Score =32.8; E_value=4.5e-12; Accession=PF06974.4; Description=Protein of unknown function (DUF1298)
  Pfam annotation: Domain name=UPF0089; Domain location=84-332; Score= -73.5; E_value=5e-05; Accession=PF03007.7; Description=Uncharacterised protein family (UPF0089)
  Pfam module annotation: Pfam domain module=DUF1298::UPF0089; Domain location=381-534::84-332
METQMTSREKSAYLDNVDELKKKKKKKKNKATGQEAEEKTTPHNGTGPQGRRRRKKVAEQEEEAQKKNEGIMERFHEEEIEEPVSPTGQYLTSSSLSVYILGVLESEVPIDDSQTVPLLQNLFLPINSRFSSIMIRDKNGEKKWKKVEVKLEDHIKVPTFPNGKSSNLFLYDEYLDEYMSTIAVEHLPQNRPLWELHIIKYPTSNAKGTLVFKLHHALGDGFSLMGALLSCMQRADNTSLPFTLPSSQRPKASSISNTKGFFKKLPSIFFQTISEFGWSFLKSKLIEDDQTPIRSCAEDFKTRQMTISDVTFSLDLIKDVKSKLGVSINDVLAGVIFFGIRLYMQEINLKSSQTQSTALVLLNTRNIEGYKSVKEMIEKTNSRSAWGNQYAFLHVSIPELSDSKYANPLEFIREAHKDMTKKKNSLATPLTGMLLDMLRKLRGPEAAASYLRSTLRNSSTTISNIIGPVEQMAVANHPIKGFYFMVAGSPESLTMTIMSYMGKIRIAFGVEKNFIDKQLFKSCLENSLEMIKEAAKKISA

SEQ ID NO: 213552 - protein, 84 aa, Glycine max
  Coding DNA Sequence Number=SeqID_96774
  Gene Ontology: Mol. function=electron carrier activity; Biological process=electron transport
  Homolog annotation: Hit_ID=Q41001; Match level="QueryCoverage=64%, HitCoverage=29%, E-value=4e-16, Identity=76%"; Hit description=Blue copper protein precursor
MAFSSALVLGSLLAINMGLPTLATDYTVGDTSGWAIGADYSTWTGDKTFVIGDSLGKLRRILILLQRESFLTVQDLWENASRWC

SEQ ID NO: 213553 - protein, 183 aa, Glycine max
  Coding DNA Sequence Number=SeqID_96775
  Gene Ontology: Mol. function=chromatin binding; Cellular component =chromatin; Biological process=chromatin assembly or disassembly
  Homolog annotation: Hit_ID=Q1SAV4; Match level="QueryCoverage=78%, HitCoverage=39%, E-value=3e-32, Identity=47%"; Hit description =Integrase, catalytic region
  Pfam annotation: Domain name=Chromo; Domain location=93-144; Score =21.3; E_value=0.003; Accession=PF00385.14; Description='chromo' (CHRromatin Organisation MOdifier
MKEVADRRRRELQYAEGDQTSASGTTHSKLAKRFYGPFQITKRIGSVAYQLQLPPDSRIHPLFHCSLLKLYLPSNDSVPLSLPPKSIDNQPCIFPLAILDTKWDETASRKQLMVLVQWAGLFPEDTSWELWDTLKQDYNLEDKVVLEACRDDMNREATEHNAGIIKGKRRSIKPRYLEDYVAK

SEQ ID NO: 213554 - protein, 115 aa, Glycine max
  Coding DNA Sequence Number=SeqID_96776
MIKETKPIKSSSSVPYRMLVTVIFRHIGVPMEDEPRGDKLLQKKEFSEQIKKVVEEAREEVSKEDPSKELLDFGSFYDNSKHHYEEEKKDEETIMSLKMRSLQLMKVAQNEVDLE

SEQ ID NO: 213555 - protein, 95 aa, Glycine max
  Coding DNA Sequence Number=SeqID_96777
MTDEPDWTKNGYTVVPILPKSHLVETVVKIMPECLLIPMGFLPKSFGLGLVGLYTHASTDDLAEFSPNFPCLAILKFFNLMKFVVNHMINSVSRC

SEQ ID NO: 213556 - protein, 91 aa, Glycine max
  Coding DNA Sequence Number=SeqID_96778
  Gene Ontology: Mol. function=DNA binding; Biological process=DNA integration
  Homolog annotation: Hit_ID=Q1T035; Match level="QueryCoverage=95%, HitCoverage=14%, E-value=4e-18, Identity=44%"; Hit description =Integrase, catalytic region
MASPGIVDTALFKKAQKGYLLIIQIYVDGIIFGATSKRMCKEFSKLMKEKYTKDLLKRFRMDEAIPMATHTHPSTIIGKDEKGNDTPEKYK

SEQ ID NO: 213557 - protein, 96 aa, Glycine max
  Coding DNA Sequence Number=SeqID_96779
MKVRPGFVFNRNYEASLEDSASVEGFLLKLGTLEMVLEERRRRKWRFSKATRKAKAETLKCFCSRERKRSSHARRCIEDRNGQIVYKCSVKLQTKC

SEQ ID NO: 213558 - protein, 134 aa, Glycine max
  Coding DNA Sequence Number=SeqID_96780
GRREGSDKGLKVNMEREDAKDGDRMGGSSSNTGDDKVTNMHDDGVFRGATRRGEGKIMVDRLKQKEDKDEQGLRNARGEGEDCEKISATRRGTSYVYSRDQERYGGQGALLNVVGRWRHVLGRFAIDACIDGTS

SEQ ID NO: 213559 - protein, 122 aa, Glycine max
  Coding DNA Sequence Number=SeqID_96781
MMRVERERGEDGNTFGRWGIVWGIFISTKRDKRGNSYGFVKFLVVQKKRFLDKQFDGIYIGKMKIDVNIPKFLKFDGYKLDDPGGGRERTIGSVGEGKRNRVNRGQGGGDRNEGFVAEISLT

SEQ ID NO: 213560 - protein, 97 aa, Glycine max
  Coding DNA Sequence Number=SeqID_96782
MEQATLTRMITREERILWWKKVAVTGWKIAGLEDVAGNVKLKYVGDNIVLLHGISKDMVMEELKSEEDGLLSIFHFVYEWNKESILRWIKLQQIGRG

SEQ ID NO: 213561 - protein, 49 aa, Glycine max
  Coding DNA Sequence Number=SeqID_96783
  Subcellular localization annotation: CTP_CleavageSite=33; ConfidenceScore=5.01e-01
MAPQTQTSTWTCTSPRVRPFIGSHDYPPPPPPPAQTVDSFNTVVSRFRT

SEQ ID NO: 213562 - protein, 142 aa, Glycine max
  Coding DNA Sequence Number=SeqID_96784
  Gene Ontology: Mol. function=RNA-directed DNA polymerase activity; Biological process=RNA-dependent DNA replication
MSSYLRDEKSLKCEGGSKTSRQDSLLVKVPRIFERAKPIMNLFMKAKKFLWDEDYEEAFRQLKVTLATPFVLSKPDTSKKLIVYLSVLIEVISAVLVQEEGSELRSVYFVSRVLQDPETRYQVMEKVALAHVNVVHHLLQYF

SEQ ID NO: 213563 - protein, 91 aa, Glycine max
  Coding DNA Sequence Number=SeqID_96785
  Homolog annotation: Hit_ID=Q10QG2; Match level="QueryCoverage=48%, HitCoverage=11%, E-value=3e-09, Identity=68%"; Hit description=COP9 signalosome complex subunit 4, putative, expressed
MRDLGSNIPFKVRIRQVDMLIREKLAELYESEKQWSKAAQMLSGIDLDSGMSLKACPTCSCSTSAYSRSGYKFFTRGKGKNEEIVAESNKA

SEQ ID NO: 213564 - protein, 434 aa, Glycine max
  Coding DNA Sequence Number=SeqID_96786
  Homolog annotation: Hit_ID=Q1T1Y0; Match level="QueryCoverage=34%, HitCoverage=44%, E-value=7e-19, Identity=33%"; Hit description =Ankyrin
  Pfam annotation: Domain name=DUF1723; Domain location=101-150; Score =49.2; E_value=1.4e-11; Accession=PF08330.1; Description=Protein of unknown function (DUF1723)
MVRTRGLGRALGHVTGSVPVTAAHDESVVPAPDVQADVFLDDPMAPTDVEDIVADIPAEDEHEGFPGGPSDPSVLTQSVLAIEGLVAGTGLSSLIACLVDTGDRGLLSSFVERWHWETSSVHLPVGELTITLDDVSSLLHLPVVGDLHSFQPLHVDDTVQMLVDILMVSAESTRTETAQCRGLATNVHVVYLEALRDLSQTGRYAWGVAALVHMYDQLNDASISSSRQLGGYITLLVGFSSTFPQSQSPLLIRNMTRIPYVRGAPGLTSDSGCLLDPGPVAVYYRPERVVRQFGYTQTIPAPPVSVPVTKWTGSSASRISHPFMTPDHALDPLPDGHAPQPRVVPQAPQTDISHVLEPGALSTSARPAVEEPRHAVEVCDEIAERLERHLSLGVVTSGSSTHEASREWMQHSTPWNPTASPTDSSEQPLTVSSK

SEQ ID NO: 213565 - protein, 239 aa, Glycine max
  Coding DNA Sequence Number=SeqID_96787
  Gene Ontology: Mol. function=carbohydrate binding; Cellular component= anaphase-promoting complex; Biological process=regulation of mitotic metaphase/anaphase transition
  Homolog annotation: Hit_ID=Q8LEY9; Match level="QueryCoverage=95%, HitCoverage=73%, E-value=1e-105, Identity=50%"; Hit description=UVB -resistance protein-like
  Pfam annotation: Domain name=RCC1; Domain location=128-171; Score =3.7; E_value=0.28; Accession=PF00415.9; Description=Regulator of chromosome condensation (RCC1)
  Pfam annotation: Domain name=RCC1; Domain location=174-223; Score =27.2; E_value=5.7e-05; Accession=PF00415.9; Description=Regulator of chromosome condensation (RCC1)
  Pfam annotation: Domain name=RCC1; Domain location=2-53; Score=1.3; E_ value=0.51; Accession=PF00415.9; Description=Regulator of chromosome condensation (RCC1)
  Pfam annotation: Domain name=RCC1; Domain location=56-125; Score =10.6; E_value=0.051; Accession=PF00415.9; Description=Regulator of chromosome condensation (RCC1)
  Pfam module annotation: Pfam domain module=RCC1::RCC1::RCC1::RCC1; Domain location=128-171::174-223::2-53::56-125
MLFTWGWNQRATLGHPAETKSENKTENTPSQVKALSSVKIVQAAIGGWHCLAVDDQGRAYAWGGNEYGQCGEEPERKDGTGRPLRRDIEIPQRCAPKLVVRQVKFMRCALPIGRVAAGGTHSVVLTREGHVWTWGQPWPPGDIKQISVPVRVQGLENVRLIAVGAFHNLALQEDGTLWAWGNNEYGQLGTGDTQPRSQPIRVQGLSDLTLVDIAAGGWHSTALTDEGEFWWPLTNYQAR

SEQ ID NO: 213566 - protein, 153 aa, Glycine max
  Coding DNA Sequence Number=SeqID_96788
  Homolog annotation: Hit_ID=Q0GPG8; Match level="QueryCoverage=26%, HitCoverage=17%, E-value=3e-15, Identity=95%"; Hit description=BZIP transcription factor bZIP94
MNLPRDVDDYFKQTLDDTLGIPVSSRTLESKLQASQESQWRLREHLLSLFPQLKRKDQLIDRFKYEAGMNARALKKFVEENQRLATDCEKLLARCHQLENDRALYDKDREALMEFGNDADERAREAQTRVLDLERDLLFMGNELNKYKNQHQL

SEQ ID NO: 213567 - protein, 142 aa, Glycine max
  Coding DNA Sequence Number=SeqID_96789
MGFNLELAKGPRLPVQKQPERGMPLVSSLATRKIISEGSGPRDICHGGGSTTWGRTALVEKKKASILSGSGLRNSKVKVSKSTPWASQSVIIRAGKPSLDASPIHVEGGRVGGKSEVKIGKHALSGYGGTRSMRSAAPPPGR

SEQ ID NO: 213568 - protein, 158 aa, Glycine max
  Coding DNA Sequence Number=SeqID_96790
  Homolog annotation: Hit_ID=Q1SKC8; Match level="QueryCoverage=42%, HitCoverage=15%, E-value=2e-16, Identity=61%"; Hit description =Integrase, catalytic region
LRLFPGKLKPKWFGPFIIKEVKPYGAVELVDPALSEPERSWIVNGQRLKIYNDDYIERLTTVIHLQDPYVRRAKPHHLAKREYKIMRGKTKGLRPLGAKCVIWPRGSAKQDLISHKGDFTWDSSCFALQMEFYSNIYDPEDGSLKQCRVWGQTIKFNA

SEQ ID NO: 213569 - protein, 179 aa, Glycine max
  Coding DNA Sequence Number=SeqID_96791
  Gene Ontology: Mol. function=metal ion binding; Cellular component =intracellular; Biological process=protein amino acid phosphorylation
  Homolog annotation: Hit_ID=Q84WG8; Match level="QueryCoverage=78%, HitCoverage=26%, E-value=3e-51, Identity=58%"; Hit description =Putative selenium-binding protein
MKNLYGIDPGREHYGCMLDLLGRAGKLDDMVKLIHEMNCEPDVVMWRTLLDACRVNQNVDLATWNDVAEVRSAMKKRGIRKEPGCSWIEVNKQIHAFILGDKSHPQIDEINRQLNQFICRLAGAGYVPGTNFVPQDLKGNREKTLFDTTLNQGEGAGPAPALYPVFCVPTSVFFTPVTL

SEQ ID NO: 213570 - protein, 73 aa, Glycine max
  Coding DNA Sequence Number=SeqID_96792
MEHTNLGIPRSCGSACHRSLGTRTSFLNDHLEETLGPTKIGENHSKCINLTQCVARKSLAHRILSAIKGRGPL

SEQ ID NO: 213571 - protein, 332 aa, Glycine max
  Coding DNA Sequence Number=SeqID_96793
  Gene Ontology: Mol. function=cysteine-type endopeptidase activity; Cellular component=integral to endoplasmic reticulum membrane; Biological process=proteolysis
  Homolog annotation: Hit_ID=Q6Z6K3; Match level="QueryCoverage=76%, HitCoverage=49%, E-value=3e-90, Identity=69%"; Hit description =Putative GPI-anchor transamidase
SYKSTSQVYGAPTSLRKLLSLITLVDYRGYEVTVENFLRVLTGRHETSVPRSKRLLSDEGSHILLYMTGHGGDEFLKFQDSEELQSHDLADAVKQMKEKRRRIMSPPYAYALEEEITGTKLIVSLTNRLTNKDSDFLCLCIGLRTHFWLILIMGIVRFKELLIMVDTCQASTLFSQLHSPGVLAIGSSMKGENSYSHHLDSDVGVSVVDRFTFYTLAFFERLNMYDNASLSSLFNSYNPNLLMSTAYYRMDIYQRYLKEVPVTNFFGSVMKTIHTDSAYRSRSNKKIEEAKSNMSLDESISDSDSDDEDQFNNLTAECWTTMECYSQQCQYF

SEQ ID NO: 213572 - protein, 64 aa, Glycine max
  Coding DNA Sequence Number=SeqID_96794
MVRMFVVHETWWLIYIRFFFNETIEEGKVLCVCFGQAASLTVVRRQVVVVVVVGVAVNGGGIVS

SEQ ID NO: 213573 - protein, 135 aa, Glycine max
  Coding DNA Sequence Number=SeqID_96795
  Gene Ontology: Mol. function=cysteine-type endopeptidase activity; Cellular component=integral to endoplasmic reticulum membrane; Biological process=proteolysis
  Homolog annotation: Hit_ID=Q8GYI6; Match level="QueryCoverage=74%, HitCoverage=25%, E-value=5e-42, Identity=81%"; Hit description =Putative GPI-anchor transamidase
MALGVSKLPMNMIMEVLLLIFLSYSVAYSSSAFESTMHTNNWAVLVCTSRFWFNYRHMANTLSLYRTVKRLGIPDERIILMLADDMACNARNKYPAQVFNNENHILNLYGDNVETIIEKIFIVKLISASWLSVQT

SEQ ID NO: 213574 - protein, 208 aa, Glycine max
  Coding DNA Sequence Number=SeqID_96796
  Homolog annotation: Hit_ID=Q1T4R7; Match level="QueryCoverage=24%, HitCoverage=9%, E-value=3e-08, Identity=54%"; Hit description =Ovarian tumour, otubain
MVKQRNILLTLKEHNVNSYRTIKQVYNARNAYRSSIRDSTYKTNRYKLSLLDIVGVTPTRMTFFVTFSYLKRERLNNVVWALEQFRGSHSEHFDIYIYCLLSKTGPDGCRETRGTGTTEVARKSRYDFSIQKGSIFFFLMAEYDVKSKEKEISAASSSLPRCFFSSSSPPLLPPLKLQIPLPFYPKLQGKAIFGVLEHTSTSWGFKFQ

SEQ ID NO: 213575 - protein, 310 aa, Glycine max
  Coding DNA Sequence Number=SeqID_96797
  Gene Ontology: Mol. function=chitin binding; Cellular component =extracellular region; Biological process=chitin metabolic process
  Homolog annotation: Hit_ID=UPI000044A8F0; Match level="QueryCoverage =76%, HitCoverage=100%, E-value=8e-45, Identity=31%"; Hit description= PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MSSAIRGLHALTFRGLHVLAFKGLHVLTLRGLHVLTFRELHTLTFRGLHILFFRGLHLLAFRGLHILAFRGLHALAFKGLHALAFRGLHVFAFRGLHALAFRGLHVLAFKGLHARAFRGLHVLTFRGLQVLTFRGLHALAFRGLHALTFRGLHVLAFRGLHALAFKGLHILTFRGLHVLAFRGLHALTFRGLHVLTFKGLHDLAFKGLHVLAFKGLHVLTFRGLHVLAFRGLHICAFRGLKGPVLSLYNSLGHPPDLRGGPTMQAQLEGGYRAATMHTGARFLPCRYKEMSVDHAHQHDHSYTDMDDTAT

SEQ ID NO: 213576 - protein, 113 aa, Glycine max
  Coding DNA Sequence Number=SeqID_96798
MAGEGGIVERLHVAQRNLKHLDVSEFTTTHYPVRPNELDRLAFGRIFYFCGDDGAWRLSVEQVQGTGDEVAHDGEGNQRFSSCHHGILGLFVCCSFLFIYDSLILKTTTGTVA

SEQ ID NO: 213577 - protein, 44 aa, Glycine max
  Coding DNA Sequence Number=SeqID_96799
FPYHAKHAEVALSSGCTLSPNGEVTMDKWMNITDMGYVIASRYF

SEQ ID NO: 213578 - protein, 108 aa, Glycine max
  Coding DNA Sequence Number=SeqID_96800
MNSLSFRLRKRGITFCEKVENEVFVNEENDYGLGQALSRIIKNALGREVSRDADEAPQWQKPIGSTRRQREATPVAEGVQHVDHAADEIYEQLEEVAAADVVNDAEGF

SEQ ID NO: 213579 - protein, 235 aa, Glycine max
  Coding DNA Sequence Number=SeqID_96801
  Gene Ontology: Mol. function=binding; Cellular component=membrane; Biological process=photosynthesis
  Homolog annotation: Hit_ID=Q7EY18; Match level="QueryCoverage=84%, HitCoverage=12%, E-value=1e-100, Identity=68%"; Hit description =Putative tetratricopeptide repeat(TPR)-containing protein
  Pfam annotation: Domain name=TPR_1; Domain location=127-160; Score =3.0; E_value=2.4; Accession=PF00515.18; Description=Tetratricopeptide repeat
  Pfam annotation: Domain name=TPR_1; Domain location=169-202; Score =6.8; E_value=0.82; Accession=PF00515.18; Description=Tetratricopeptid e repeat
  Pfam annotation: Domain name=TPR_1; Domain location=85-118; Score =17.6; E_value=0.043; Accession=PF00515.18; Description =Tetratricopeptide repeat
  Pfam annotation: Domain name=TPR_2; Domain location=127-160; Score =8.3; E_value=3.6; Accession=PF07719.7; Description=Tetratricopeptide repeat
  Pfam annotation: Domain name=TPR_2; Domain location=169-202; Score =15.8; E_value=0.16; Accession=PF07719.7; Description=Tetratricopeptid e repeat
  Pfam annotation: Domain name=TPR_2; Domain location=85-118; Score =23.8; E_value=0.00062; Accession=PF07719.7; Description =Tetratricopeptide repeat
  Pfam module annotation: Pfam domain module=TPR_1::TPR_1::TPR_1::TPR _2::TPR_2::TPR_2; Domain location=127-160::169-202::85-118::127 -160::169-202::85-118
MEMGRKLPSEEVGLELVPRDYEMDTASPFRKTDIHVACSSADGRTLLESSKTSLDKGKLEDAVNYGTKALSKLVSVCGPYHRMTAGAYSLLAVVLYHTGDFNQATIYQQKALDINERELGLDHPDTMKSYGDLAVFYYRLQHTELALKYVNRALYLLHLTCGPSHPNTAATYINVAMMEEGLGNVHVALRYLHEALKCNKRLLGADHIQFKFIQQQQQQRLIPLGGVGYMNQLPP

SEQ ID NO: 213580 - protein, 138 aa, Glycine max
  Coding DNA Sequence Number=SeqID_96802
  Gene Ontology: Mol. function=receptor activity; Cellular component =integral to membrane; Biological process=response to sucrose stimulus
  Homolog annotation: Hit_ID=Q84N34; Match level="QueryCoverage=65%, HitCoverage=25%, E-value=9e-28, Identity=63%"; Hit description=HHP2
  Pfam annotation: Domain name=HlyIII; Domain location=5-116; Score= -48.3; E_value=0.0034; Accession=PF03006.10; Description=Haemolysin -III related
DSHLRHILVQPIIHELRDDGAKTIPIWPWFVFLAGGMGCLASSVIPAVHTLATHYDHPHVVVALGYELLMAILYTTGAVFYVTRIPERWKPGAFDIAGHSHQIFHVFVVLGALAHTLATLLVMEFRQGSPTCNTQHCQ

SEQ ID NO: 213581 - protein, 49 aa, Glycine max
  Coding DNA Sequence Number=SeqID_96803
MAPKTGKTKPHKAKGEKKKKEEKVLPTVIEITVETPDESQVTLKVWDTE

SEQ ID NO: 213582 - protein, 188 aa, Glycine max
  Coding DNA Sequence Number=SeqID_96804
MDHVADEVHEQPEEAAVDDEVVDAEECPELKLPSHGRKVQKFGRPAAEIEGLVVTITLDDVASLLHLPITSVFYSFKTLHIDEAVLLLVELLEIVTHVHVVFLNVFRDLTQSGSYAWGTTTLVHMYDNLNDASKSSVRQLAGYITLLQAIDVEDYHERKPRVCRWKSDQCKRNGEGGKVIGDATSRRR

SEQ ID NO: 213583 - protein, 676 aa, Glycine max
  Coding DNA Sequence Number=SeqID_96805
  Gene Ontology: Mol. function=binding
  Homolog annotation: Hit_ID=Q7EY18; Match level="QueryCoverage=98%, HitCoverage=36%, E-value=1e-145, Identity=43%"; Hit description =Putative tetratricopeptide repeat(TPR)-containing protein
MKQACARRRLKDTVEIVSLKPCHLTIVQEDYTEELAVAHIRRLLDIVACNTSFASAKPPAGKSKDPTEPGSENGSETNPKSKPVDPNSDPANAKSDKADADISMCPPPRLGQFYDFFSFSHLTPPFQYIRRSNRPFLEDKTEDDFFQIDIRVCSGKPTTIVASRIGFYPAGKRPLVTHTLVGLLQQISRVFDAAYKALMKTFTEHNKDVFTIIVVSFQFGNLPYGFRANTWVVPPVVSDNPSVFPPLPMEDETWGGNGGGQGRDGKHENRQWARDFAILAAMPCQTAEERQIRDRKAFLLHSLFVDVSVFKAVSAIKHLVDIKQNSFSNSALPTSYEERIGDLTIKVTRDVSDASLKLDCKNDGNRVLGLSDEELAQRNLLKGITADESATVHDTPTLGAVLIRHCGYTAVVKVSGDRDLEGSPNSLEIDIEEQPEGGANALNVNSLRMLLHRPSTPQSSNAIQRIQSTDIECSHSTRSLVRKVLEESLLKLKEETTRHSKSIRWELGACWVQHLQNQATGKTEPKKAEEGKVEPAVKGLGKQGGLLKELKKKIDIRNSKAEVGKDISPCNGNDINKPEATKQELERQDEEKATIWKKLLSDAAYTRLKESKTDLHLKSPDELMEMAHKYYVETALPKLVADFGSLELSPVDGRTLTDFMHTRGLQMSSLGRVVRF

SEQ ID NO: 213584 - protein, 143 aa, Glycine max
  Coding DNA Sequence Number=SeqID_96806
  Gene Ontology: Mol. function=structural constituent of cell wall
  Homolog annotation: Hit_ID=Q9FG54; Match level="QueryCoverage=93%, HitCoverage=43%, E-value=2e-36, Identity=54%"; Hit description=Root cap protein 2-like protein
  Pfam annotation: Domain name=Root_cap; Domain location=51-107; Score =104.6; E_value=2.8e-28; Accession=PF06830.2; Description=Root cap
MGRGEGCSDVNVERVAAKNSVIITVEDVAQILLNVVQVTKEDDTIHNYQVQFKFFGLSPKVDGVLGRTYRDDFENPTKPGVAMLVVRGEDKHKTTSLLSPNCASCVFSQQNLHKNEPTKVSAKLMGTLDCSKFSYGLGIVCKK

SEQ ID NO: 213585 - protein, 49 aa, Glycine max
  Coding DNA Sequence Number=SeqID_96807
MSKNISPSKKEAAFALVASVEIPSNIKQPWNLEYSDYNSILVLIHFGEL

SEQ ID NO: 213586 - protein, 227 aa, Glycine max
  Coding DNA Sequence Number=SeqID_96808
MGTLQAFRASCRFFCMESTIGLFLYHFMTRPIDQASYSPIIWHGLDFANVYREVSDTAGNAFVIQPTDPLPPPCSSPIDVVPFTDKNKKKRDEVQPPRKLQQPTLHQLFPSPFGSLDALPMVLGDVLQSAGLVDDHRSTNDPFQLLDRPRGNEVVADVKFFEGREASWGRKFKKENDSVIALRSEVATLKESMMKAKGEIKHRQEQYQILMCGARDKVIDRGRTRIT

SEQ ID NO: 213587 - protein, 79 aa, Glycine max
  Coding DNA Sequence Number=SeqID_96809
FLNNLVSQPTNPWWVRLGWYFHDSLKGESGWLDPFNSQPMVGQPMWTGLTHFDTLSFVSQVASAPKISKLERLFERILG

SEQ ID NO: 213588 - protein, 225 aa, Glycine max
  Coding DNA Sequence Number=SeqID_96810
  Gene Ontology: Mol. function=RNA-directed DNA polymerase activity; Biological process=RNA-dependent DNA replication
MVAKGLLFTTSFTKRKEMKARWCIVGDFNSVRNRNERVGSSNNGGGNSGNKEIEEFNAFTENFEALDVPMIGRPQMEERSLSEEGKTRKIHPQGEFQRLAKLNESLLIQKSRITWAKEGDCNSKLFHSTINSRRRKNGLNGIKMNEESIEEPCRVKTEVKKYFEWHFQEKIYGRPKLTGLEFPSLSNEDNAMLIQDFEVEEIKKVILDCESSKSLRPDSYSFLFI

SEQ ID NO: 213589 - protein, 275 aa, Glycine max
  Coding DNA Sequence Number=SeqID_96811
  Homolog annotation: Hit_ID=Q1RVN3; Match level="QueryCoverage=50%, HitCoverage=20%, E-value=4e-07, Identity=24%"; Hit description =Nucleotide-binding, alpha-beta plait
METNPKKQTITGSQKEWNCRSIIATLENKHLLLNCWVGTLVDPKMHDKIDDLYVMEENRQVFMRYMGGDLVFSLCVEHEENFLSIFKSVQKWEESTHTTNRLTWIRCYNVSLFVWNTNCLSSLISDFGKVQDIDEDSLSLKGVKFMRVLVMTSTQQTISKNFKITINGLITLVKLVEEMKVFKNHCCCKEDRIRNEEDAYNQDSEMGMRLGSLGSKCSFDAWHASKHDVIQRQDCRQAKEDNMVQNSLDNNRWSKSTNDNTHDESTNARPQKEEE

SEQ ID NO: 213590 - protein, 256 aa, Glycine max
  Coding DNA Sequence Number=SeqID_96812
  Gene Ontology: Mol. function=RNA-directed DNA polymerase activity; Biological process=RNA-dependent DNA replication
MGETHKMPHHNLADFEPCLGYATEGQAVGDIPLQNTLEGPQYHPQPHPLHSTAGTNPHAMAEMGKLDYLEERLRAIEGGKDCAFANLEELFLVPNIITPPKFKVSDFDKYKGTTCPKNHLKMYCWKMGTYTKDEELLIHFFQESLTEVAITWYNFDMAPDRMQLQNMCKKGQESFKEYAQRWRDLATPVAPPMVEKEMITIIVDMLRVFYYEKMVGYVPSIFVKSVFASKRIKAGLKRGKFDHPALMNEKTGANEE

SEQ ID NO: 213591 - protein, 162 aa, Glycine max
  Coding DNA Sequence Number=SeqID_96813
  Gene Ontology: Mol. function=oxidoreductase activity, acting on single donors with incorporation of molecular oxygen, incorporation of two atoms of oxygen; Biological process=aromatic compound catabolic process
  Homolog annotation: Hit_ID=Q89SR6; Match level="QueryCoverage=98%, HitCoverage=75%, E-value=3e-59, Identity=68%"; Hit description =Protocatechuate 3,4-dioxygenase alpha chain
  Pfam annotation: Domain name=Dioxygenase_C; Domain location=30-161; Score=-9.6; E_value=8.9e-08; Accession=PF00775.11; Description =Dioxygenase
MKDYLAETASQTAGPYVHIGLAPDAAGFHIFEKNFGPNLVSAETKGQRITIEGRVFDGSGTPVRDVLLELWQANADGRYNHPDDRQQSKALDPNFRGWGRTCSDFASGVWRFQTIKPGAVVGRDGRMMAPHLNLWVVARGINIGLNTRMYFADEQAANEQDP

SEQ ID NO: 213592 - protein, 143 aa, Glycine max
  Coding DNA Sequence Number=SeqID_96814
  Gene Ontology: Mol. function=transition metal ion binding; Biological process=cytoskeleton organization and biogenesis
MYLVERYMKILKGYIKNLHCPEASIVESNEVLPYIVRHKGLVKENNPKTSKNRVLKEHNKNFLNWFKDTIFGDDNASETLRKLEDGPKRNVITWQGYNINKYSFYTKAQDEKSTMQKSGITLRAKSQHFANVNVDNPRVAFIA

SEQ ID NO: 213593 - protein, 57 aa, Glycine max
  Coding DNA Sequence Number=SeqID_96815
  Subcellular localization annotation: CTP_CleavageSite=32; ConfidenceScore=5.02e-01
MELRGSSNGIIGMPQVRKRLKPRRRVRSRGIRTGNKEGPKGRMGSKEVLRGVVGQQQ

SEQ ID NO: 213594 - protein, 77 aa, Glycine max
  Coding DNA Sequence Number=SeqID_96816
NDKVVESWDACKSKGREKKKEDEGGAPEAGCWVRLRFILGAAFLQDPRLIPQSVTLAPALIMDPSATNTEKFLVFFR

SEQ ID NO: 213595 - protein, 116 aa, Glycine max
  Coding DNA Sequence Number=SeqID_96817
  Gene Ontology: Mol. function=nucleic acid binding; Biological process= DNA integration
MVSIMEDTVKVDNIPIHLLSSLKGVVLVLNTQCQGSYTRIVETGNARFIENGETSESEASQNVEIKEVRVQVPLTSASTSRIFVPYTVEPHNNQEEQQINDHEVNNEPIVEQSQEM

SEQ ID NO: 213596 - protein, 71 aa, Glycine max
  Coding DNA Sequence Number=SeqID_96818
MDKGLAEHGWIERESNSHVSLAIPFPCYASFLPTYHLPDPPSVLGNELTNVSEHIRGHEIALPGLLLIYSF

SEQ ID NO: 213597 - protein, 92 aa, Glycine max
  Coding DNA Sequence Number=SeqID_96819
MKRLEVATSPNLFARDGPLSYPNFVRGKSKGSRLAQSVKFRDVAEIEKRGVQIAIWPTWAFQILPPEGCCFWRKQPCSPGRATPAPKGGGDM

SEQ ID NO: 213598 - protein, 44 aa, Glycine max
  Coding DNA Sequence Number=SeqID_96820
ETLGTSGGVLLPKTKHDQSRPNPGISNMALVIDYQLGVIDYTGR

SEQ ID NO: 213599 - protein, 107 aa, Glycine max
  Coding DNA Sequence Number=SeqID_96821
  Homolog annotation: Hit_ID=Q1RYJ4; Match level="QueryCoverage=33%, HitCoverage=4%, E-value=2e-11, Identity=88%"; Hit description =Protein kinase; Curculin-like (Mannose-binding) lectin; Apple- like
MITPQTPRIFPPLESAPVSLALARPRRARCDTDVSSYGMLLLEIIGGRRNLDMSFGAEDFFYPDWAYKWGFYGGWIFELQWGPLIVIFHHGDAAEDKGEEVRGGVIH

SEQ ID NO: 213600 - protein, 313 aa, Glycine max
  Coding DNA Sequence Number=SeqID_96822
  Gene Ontology: Mol. function=oxidoreductase activity; Cellular component=intracellular; Biological process=regulation of transcription, DNA-dependent
  Homolog annotation: Hit_ID=Q5LKN6; Match level="QueryCoverage=99%, HitCoverage=94%, E-value=2e-85, Identity=51%"; Hit description =Oxidoreductase, aldo/keto reductase family
  Pfam annotation: Domain name=Aldo_ket_red; Domain location=2-294; Score=159.0; E_value=1.2e-44; Accession=PF00248.11; Description =Aldoketo reductase family
MGLSEFYGQTDDTASLQLLHTLIDLNITFIDTADMYGRGHNERLIGHFLAGLDNTTREQFNIATKCGIDRPADQAYARTINNQPDYITRCCNESLKRLGVERIDLFYLHRVSQVTPIEESMECLSRLVKAGKINHIGLCEVSASTLRRAHAVHPIAALQTEYSLWTRDIEAEILPVVKELGIGLVPYSPLGRGFLTGKYRHNSDFAEGDFRKNNARFSQSSLDHNAQLLDAVHPLAEKYSCTSGQIALAWLLAQYDKLIPIPGTKQTRYLAENAQAADIVLEQADIALLNAIHQHIEIKGERYSQEGMKSINA

SEQ ID NO: 213601 - protein, 176 aa, Glycine max
  Coding DNA Sequence Number=SeqID_96823
  Gene Ontology: Mol. function=transcription factor activity; Cellular component=chloroplast; Biological process=regulation of transcription, DNA-dependent
  Homolog annotation: Hit_ID=Q3KB31; Match level="QueryCoverage=76%, HitCoverage=46%, E-value=3e-16, Identity=41%"; Hit description =Transcriptional Regulator, LysR family
  Pfam annotation: Domain name=HTH_1; Domain location=15-74; Score =74.9; E_value=2.5e-19; Accession=PF00126.17; Description=Bacterial regulatory helix-turn-helix protein, lysR family
MATAEHLISNHLPSVKQLQCFLAVAHELNFRRAAERLSMTQPPLTRQIKRLEAVLEQPLFSRSTHDVSLTDAGRALVIKAEKILQALNELKPGPLSSEKRLRIGLTRTLNFALIAPIHQQLLKLDAADDVETPDLTSAQLLQCLAKNRLDLVLTGEKATGHEDTVQYQWIGREPCW

SEQ ID NO: 213602 - protein, 279 aa, Glycine max
  Coding DNA Sequence Number=SeqID_96824
LLVFGVVLFPNVDGLVDLAAIDTFLAYHHNKESSVVAVLVDAYDTFDWRCEKSSTRIVCCTPALYVWLGCPLIGSLDGRKEGPGFCAHVKGVPSEDSIASFIARGFSDPNAKMLQRVRKAWNTVQRKDKELRGSNNGVIGRYHKWLKARMQGITWLPKLKSSGGEEADVPEESEEVQALKAELERTQVVKEKFKTIDIRVRKEWQQQRTQALKGRKGRVKGGKYDIRGQVEGLSKVEEELDPPPLSRTEENMWTIIDQYKEKLDLAASHELRLEDEHAK

SEQ ID NO: 213603 - protein, 284 aa, Glycine max
  Coding DNA Sequence Number=SeqID_96825
  Homolog annotation: Hit_ID=P23355; Match level="QueryCoverage=49%, HitCoverage=25%, E-value=8e-22, Identity=51%"; Hit description=PTS system fructose-specific EIIBC component (EIIBC-Fru) (EII-Fru) [Includes: ...
  Homolog annotation: Hit description=Fructose-specific phosphotransfera se enzyme IIB component (EC 2.7.1.69) (PTS system fructose-specific EIIB component); Fructose permease IIC component (PTS system fructose-specific EIIC component)]
  Subcellular localization annotation: CTP_CleavageSite=14; ConfidenceScore=5.55e-01
MAPAPWPPAAGLSAAMNVWAMPVGQEVTATMRLPAFVPALLDSVAASGASAATGSSSTSPRLACATSALAKRAMSASPSPTSSRCVAAAAFDAGSAPVTPWSLRISIISSSPRWRAARRSASAARTASMLRSPAAMTTVEACMGTPGILRVRPCRGRCGWREASRRASGRRGQSNRSISTSPAHARTCAGSSRRASPLCSRLIENAVASRAQPARSREDSSIAAAMPATMASPAPTVLPWASRGGRATSAPLRSMNSAPSVPIEIATSATPRSTNAWPATRRAL

SEQ ID NO: 213604 - protein, 459 aa, Glycine max
  Coding DNA Sequence Number=SeqID_96826
  Gene Ontology: Mol. function=kinase activity; Cellular component =proton-transporting two-sector ATPase complex; Biological process =ATP synthesis coupled proton transport
  Homolog annotation: Hit_ID=Q1SMI5; Match level="QueryCoverage=99%, HitCoverage=31%, E-value=1e-156, Identity=50%"; Hit description =Prefoldin; tRNA-binding arm; t-snare; Protein kinase PKN/PRK1, effector
MVEEFYRAYRALAKRYDHATGVIRHAHKTMAEAFPNQKCDTQQGAFLDLDEPQKDASAHFHAIKRNGGYTGEPDSPLNKTGLKQLNDLYIPREQENLPKFARRGFNFFETREESNEQNSGSNNTLSESERVTKDETEILALKKAIAKLEDEKEAGLLQYQQSLEKMSNLELEVSTAPENSRKLDERASKAEAEVQALKEAQIKLQAESEASLLQYQECLEKISNLEKNISSLQKEAGELNERATKAETESESLKQELARVEAEKKATLVQYNQCLETISKLEERIKEAEENARRIKEHADIAEKEIEALELQVTKLNEEKEDAALHYQQCMEIISSLEYNLSCAEEEVHRLNSKIVDGVEKLEFRTEMSSLGDIKSHSAELGRLWGCIQKERLRFIEAETAFQTLQQLHSQSQEELRSLASELNSKVEILGNVESRKPDLEDEVHRVSEENKILNEDIF

SEQ ID NO: 213605 - protein, 77 aa, Glycine max
  Coding DNA Sequence Number=SeqID_96827
TCKGFLQDIETLKRVAWGLDVGTRRVVFSGLYWSILLHPRAIPLFVVFERGHYIRTDREGSLDFDKGLRVKRDIKML

SEQ ID NO: 213606 - protein, 58 aa, Glycine max
  Coding DNA Sequence Number=SeqID_96828
MWDQHELKGAFKLGVFTPKTYTLKSLLGPLPPDSGTYTFSLTLGINTFLKINTGRVIV

SEQ ID NO: 213607 - protein, 176 aa, Glycine max
  Coding DNA Sequence Number=SeqID_96829
  Gene Ontology: Mol. function=DNA binding; Cellular component=cytosol; Biological process=regulation of transcription, DNA-dependent
  Homolog annotation: Hit_ID=Q8S8I2; Match level="QueryCoverage=57%, HitCoverage=43%, E-value=3e-18, Identity=45%"; Hit description =Protein ULTRAPETALA2
MTTGDPPQQKTSQGNEKKKDENITQGDPPQQERSLRIKIEEELKNITEGDPPKHKRSQGNEKKTEDNNITQEELKMILDFKRGEDSIEVLCGATNKKYGDYVGRLKINNEGQYFITCECCPECPLVNVTLEAFEEHALRGGSGRWKRNIWDHWEDEDRVPLWKTPLIKYYTPDKCD

SEQ ID NO: 213608 - protein, 110 aa, Glycine max
  Coding DNA Sequence Number=SeqID_96830
MDKFDIFVPHPLVITSLLPVECGCKPLVCFLKRPTLLSLDFQDRSIRNYSCYTFGKGAVSKAEKKGCENKTTMDTSEPYTGAMKGTMHKPQANLGADEKFSPNRFPATRS

SEQ ID NO: 213609 - protein, 86 aa, Glycine max
  Coding DNA Sequence Number=SeqID_96831
MSSFRDLEQKWAPKVEALLGNNGGGRKEEEGCVRERERELSEIFRLSEEREYSFLLCHMSPSEWSKKGPLSLLIVTHTQPQKVRKT

SEQ ID NO: 213610 - protein, 131 aa, Glycine max
  Coding DNA Sequence Number=SeqID_96832
MARSPTFFVGDNESFTAQAPQQHELEPENDHSSEATISGAVDFKKRRLETRSNEAAHHGPVPASADAPFLGVDPSSPQHVADSSIPILEIHEGQTIPVLPLDTSLPATLVWHLTNEKDVQIEDNQDQSQEF

SEQ ID NO: 213611 - protein, 217 aa, Glycine max
  Coding DNA Sequence Number=SeqID_96833
MDELERRNFHKRLTNLAGTSIDLALVKEFYANLYSPEGLSPKQVRIQGHLIRIEADSLNVFLETLVVLAEGESLPAYSRYCRVTTGIREIEVALCIPDQRFIFNAEGRPGKILKKDLTTLAQVWSVLSYSNLAPTSHTSDLTMDRARLIFGLVTQLDMNVGDLISGQITSMAQSNSSRLGFPTFITALCRSKGVVSDSLAFERLSPVINLAYIRKNC

SEQ ID NO: 213612 - protein, 68 aa, Glycine max
  Coding DNA Sequence Number=SeqID_96834
MSQNIHNLSLRAIGLDRLRTAKSCEITIICLRLSSGLPPLDEKRRRITIMCLCVPSDLIVSGWRKGAE

SEQ ID NO: 213613 - protein, 275 aa, Glycine max
  Coding DNA Sequence Number=SeqID_96835
  Gene Ontology: Mol. function=chitin binding; Cellular component =extracellular region; Biological process=chitin metabolic process
  Homolog annotation: Hit_ID=UPI000044A8F0; Match level="QueryCoverage =99%, HitCoverage=99%, E-value=5e-42, Identity=28%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
ELHAVTFRGLHVLAFRELHALTFTGLHVLTFSGLHVLAFRGMHALAFRGQHAPAFRGLHALAFRGLHALTFRGLHILTFRGLRVLTFRGLHALTFRGLHVLAIRGLHALTFRGLHVLTFRGLHTLTFRGLHVLAFGGLHALAFRGLHVLPFKGPHVFTFRGLHAFTFKRLQVLALRGLQVLTFRGLHVLAFRGLHALAFRGLHVLAFRGLHALTLRGLHALTFRGLHVLTFRGLHVLAFRGLHAHAFRGLHVLTFRGLHVFSFKGPHALNLRGLH

SEQ ID NO: 213614 - protein, 85 aa, Glycine max
  Coding DNA Sequence Number=SeqID_96836
MRFTEVIWAFPSFRTILLNRYPDIHHVPPFAGLLSQNVNYLAITLTYDGNFQPYPRKREQEDLLSEASLVGQNSTRTALRQTYYN

SEQ ID NO: 213615 - protein, 120 aa, Glycine max
  Coding DNA Sequence Number=SeqID_96837
MVAWPGAQPSLDREGEGPTAWVPQHVRDASSKTTIPEPFTLHPEAGEEQVRPETAVTPERSLEGTSEPRTPVADLSSPQPIADPSTHLLDIPEDQTTPVLALNTSPPATPVLHLIDEEDA

SEQ ID NO: 213616 - protein, 165 aa, Glycine max
  Coding DNA Sequence Number=SeqID_96838
HIPTKKSLLELSSQDALLALNKLLSKKLEALTETLSCTLCGGAHGPGLCIPTEETSHEVNYMGNQPRQNFNVVGFSGFQHGQPYQQHNQWRTHPSNQFNKDQGGPPNRPQQQGPSLYERTKKLEETLAQFMQVGQLAKQLIEKSSSTFGAKTEQNPKEECKAVMT

SEQ ID NO: 213617 - protein, 137 aa, Glycine max
  Coding DNA Sequence Number=SeqID_96839
MKDLVSAEDDVNLRVSTGLLAAIDEGRRRRHSKKVYTDDHSGISARQRDSKVSMTDLVSAEDDVNLRVSTGLSAAIDEGRRRQYSKKVYTDDHSGISARQRDSKVSMTDLMSAEDDINLRVSTGLSAAINEGRRRRR

SEQ ID NO: 213618 - protein, 175 aa, Glycine max
  Coding DNA Sequence Number=SeqID_96840
MEGLVDLAAIDAFLAFHHGKESPVVAILAMYDTFDRGCSSIRYKVTARASKKKRILSSCEGCPNVPLMGTRGCINYKSRPRHKTAWLPHERSAIRRKHHAFHRTGVSVTTMRGYSKEFARHGMRREERTESLGEATVRDNEVKASEESDEVQALKAKLERARVVKEKFKSIAIKV

SEQ ID NO: 213619 - protein, 209 aa, Glycine max
  Coding DNA Sequence Number=SeqID_96841
  Gene Ontology: Mol. function=chloramphenicol O-acetyltransferase activity; Biological process=response to antibiotic
  Homolog annotation: Hit_ID=Q36CQ9; Match level="QueryCoverage=98%, HitCoverage=95%, E-value=4e-65, Identity=56%"; Hit description =Antibiotic acetyltransferase
  Pfam annotation: Domain name=Hexapep; Domain location=109-126; Score =6.9; E_value=21; Accession=PF00132.14; Description=Bacterial transferase hexapeptide (three rep
  Pfam annotation: Domain name=Hexapep; Domain location=127-144; Score =9.9; E_value=9.2; Accession=PF00132.14; Description=Bacterial transferase hexapeptide (three rep
  Pfam annotation: Domain name=Hexapep; Domain location=63-80; Score =0.9; E_value=1.1e+02; Accession=PF00132.14; Description=Bacterial transferase hexapeptide (three rep
  Pfam module annotation: Pfam domain module=Hexapep::Hexapep::Hexapep; Domain location=109-126::127-144::63-80
MSEKHWSNTELLHQTVTNPNIIVKGTHSYYSDCWDNGFERSVVRYLHGDAVSRQWQPLGDIDRLLIGDYVCIAAEAVILMGGNHTHRIDWLSLYPFMATIKQAYRPKGDTRLGDGCWIGMRAMLMPGISIGEGAIVAAGSVVAGDVEPYAIVGGNPARFIRWRFAPEVIARLLALRLYDLSEADFTVIQPLLADGDIDALERGIAALRR

SEQ ID NO: 213620 - protein, 186 aa, Glycine max
  Coding DNA Sequence Number=SeqID_96842
  Gene Ontology: Mol. function=hydrogen ion transporting ATP synthase activity, rotational mechanism; Cellular component=proton -transporting two-sector ATPase complex; Biological process=ATP synthesis coupled proton transport
  Homolog annotation: Hit_ID=UPI00005F9415; Match level="QueryCoverage =79%, HitCoverage=29%, E-value=5e-60, Identity=78%"; Hit description =COG3333: Uncharacterized protein conserved in bacteria
QGRHPRRSGAGSGQQRLCLRFVHSDADAGGAGFRHHGGDDGRADAVQHHPRPGDVHRTAGYRLGADRRAADRQRHFADHEPAAGRPVHPHADHPAVVPGAGDRRGFGGGGLCGAQHHLRPAADGRIGRVRLHPAENALPDVAADSGLRAGSIAQTLLVLAVAVLALPPLLRLMRKRRQSAIEAKAE

SEQ ID NO: 213621 - protein, 382 aa, Glycine max
  Coding DNA Sequence Number=SeqID_96843
  Gene Ontology: Mol. function=structural molecule activity; Cellular component=viral capsid
  Homolog annotation: Hit_ID=Q0AQP3; Match level="QueryCoverage=53%, HitCoverage=55%, E-value=4e-48, Identity=46%"; Hit description =Hypothetical protein precursor
  Pfam annotation: Domain name=DUF979; Domain location=2-142; Score= -59.3; E_value=1.7e-10; Accession=PF06166.2; Description=Protein of unknown function (DUF979)
GVSVGGVFLLDQKQLTLAALCVACVAAILTGWWLTKGTPLHAVRQSRRLVDTIGWAVILPQMLAMLGGVFVVANTGDSVQKVVSLFVNPDSRFMLVVIYCVGMALFTMIMGNAFAAFPVLSAGIALPLLRHVDDADGRELQYRSRRAAGAERQISGDQDPDPDRVNPAGGERVLNADAFARMPLTYLRQEYPNHIMHLLNDDGDVLPPRELHPIFYGCFDWHSAVHGYWLLLRCVRLYPELPCRDAIVALFDEHLTEENVARELAYFTAPFRASFERPYGYGWLLALAQELKQSSLPQATGWYQTQAPLTQDIRNRLVDYLGKLTYPIRVGTHYNTAFALALALDYGRAVGDKALEQAIVAAAERFYLADTRYPAHYEPGGD

SEQ ID NO: 213622 - protein, 37 aa, Glycine max
  Coding DNA Sequence Number=SeqID_96844
MKCFTQFGVLLIPIALKVVGPMLLDLNSSRDGINPSF

SEQ ID NO: 213623 - protein, 300 aa, Glycine max
  Coding DNA Sequence Number=SeqID_96845
VCVSDAEGTSTTDWVAPEDAEAEGPTEAPAVTEETGALDAPITLSTDMVVTIDKVSTMTVKPETPGEYAGSAVVVEVSVVNDSKRTQSIDSAVVNLVTDDGDVGVATTAGPNEPLAGDVAAGAKATGSYVFMLDPVKGRQVKISVNYAAGEPVATFSVARHDADHADLSQSTFAISHSKKKSQAAGESLMGNSTNSRRVLGAIASVVTTALLVAGMTTLGAQAASADVPSPPPLLQRDDDVVTSDPIPTVQIDNGYVWSQTMIGSTVYAVGKFDNARAPLAAPGTSLTAQLQRAGVYINT

SEQ ID NO: 213624 - protein, 142 aa, Glycine max
  Coding DNA Sequence Number=SeqID_96846
  Homolog annotation: Hit_ID=Q20CD0; Match level="QueryCoverage=56%, HitCoverage=25%, E-value=5e-09, Identity=44%"; Hit description =Fgenesh protein 81
MKKATARGSKAEQKAKKKQVEEEVCQLSAKLKGNHAKELVALGYSSGNGNEKSNLDSLVKAIVGVSVTSQPEDTKVYQESIGAVCILDWAKETMVLQFVSIEVDAQQLMKVEVHNLAFTSVKPGFYTVSYRGVPSVKPGFYY

SEQ ID NO: 213625 - protein, 76 aa, Glycine max
  Coding DNA Sequence Number=SeqID_96847
  Gene Ontology: Biological process=ubiquitin cycle
  Homolog annotation: Hit_ID=Q1SB87; Match level="QueryCoverage=62%, HitCoverage=15%, E-value=1e-13, Identity=70%"; Hit description =Cyclin-like F-box; Galactose-binding like
MNRPSKASVSRVCFPVSVSISSDKDTSTKPLGKSSKVKPKGESINIIRKREADLPIHFKPPYLLQICYSVEPEMNK

SEQ ID NO: 213626 - protein, 68 aa, Glycine max
  Coding DNA Sequence Number=SeqID_96848
  Subcellular localization annotation: CTP_CleavageSite=15; ConfidenceScore=5.21e-01
LSLPYPTLHVPNFKTATTKSENEHMKLTSTPTSTMATSWLRLGVRKKSHDVERNTRAATERKKHYRRD

SEQ ID NO: 213627 - protein, 45 aa, Glycine max
  Coding DNA Sequence Number=SeqID_96849
MVSSSTKTSCRSMFVRLVGTWKKDKDRYIANSNTKGEAAGLVMLV

SEQ ID NO: 213628 - protein, 245 aa, Glycine max
  Coding DNA Sequence Number=SeqID_96850
  Gene Ontology: Mol. function=receptor activity; Cellular component =mitochondrion
  Homolog annotation: Hit_ID=Q2QXR0; Match level="QueryCoverage=60%, HitCoverage=27%, E-value=2e-33, Identity=50%"; Hit description =Expressed protein
  Pfam annotation: Domain name=DUF668; Domain location=64-156; Score =144.3; E_value=3.3e-40; Accession=PF05003.3; Description=Protein of unknown function (DUF668)
MSAANNSPVIQSCMQTNGGSMRLTDCHLKSIDKMKTVDKLSPSNRIRIYSKLSIKNRLKASSLTLGDAALALHYAKMIVLIERMASSPHLVDLAARDDLYNMLPTTVRTALRAKLKRHVKSKSSSNGHDANLAAEWSPVLAQILDWLAPLAHNMISWHSERNFEKEQSIFNTNVLLVQTLYFANQPKTEAAIIDLLVALNYVCRVDTKVGTRDTLDCANSTRSFNGVRLRKNGMYNEFLYTDVDT

SEQ ID NO: 213629 - protein, 674 aa, Glycine max
  Coding DNA Sequence Number=SeqID_96851
  Gene Ontology: Mol. function=protein kinase activity; Cellular component=integral to membrane; Biological process=protein amino acid phosphorylation
  Homolog annotation: Hit_ID=Q1S8N8; Match level="QueryCoverage=95%, HitCoverage=96%, E-value=0.0, Identity=66%"; Hit description=Protein kinase
  Pfam annotation: Domain name=APH; Domain location=368-555; Score= -16.6; E_value=0.088; Accession=PF01636.13; Description =Phosphotransferase enzyme family
  Pfam annotation: Domain name=LRRNT_2; Domain location=28-68; Score =24.9; E_value=0.00028; Accession=PF08263.3; Description=Leucine rich repeat N-terminal domain
  Pfam annotation: Domain name=LRR_1; Domain location=118-140; Score =16.8; E_value=0.078; Accession=PF00560.23; Description=Leucine Rich Repeat
  Pfam annotation: Domain name=LRR_1; Domain location=142-164; Score =9.1; E_value=5.8; Accession=PF00560.23; Description=Leucine Rich Repeat
  Pfam annotation: Domain name=LRR_1; Domain location=166-187; Score =9.9; E_value=4; Accession=PF00560.23; Description=Leucine Rich Repeat
  Pfam annotation: Domain name=LRR_1; Domain location=190-213; Score =10.4; E_value=3.2; Accession=PF00560.23; Description=Leucine Rich Repeat
  Pfam annotation: Domain name=LRR_1; Domain location=95-116; Score =10.6; E_value=3; Accession=PF00560.23; Description=Leucine Rich Repeat
  Pfam annotation: Domain name=Pkinase; Domain location=366-639; Score =43.2; E_value=3.9e-11; Accession=PF00069.15; Description=Protein kinase domain
  Pfam annotation: Domain name=Pkinase_Tyr; Domain location=365-639; Score=72.8; E_value=1.1e-18; Accession=PF07714.7; Description =Protein tyrosine kinase
  Pfam module annotation: Pfam domain module=APH::LRRNT_2::LRR_1::LRR _1::LRR_1::LRR_1::LRR_1::Pkinase::Pkinase_Tyr; Domain location=368 -555::28-68::118-140::142-164::166-187::190-213::95-116::366-639::365- 639
MKQVCLCLIILTLALCLCILCVSAEAAGQNDTLALTEFRLQTDTHGNLLTNWTGADACSAVWRGIECSPNGRVVGLTLPSLNLRGPIDSLSTLTYLRFLDLHENRLNGTVSPLLNCTSLELLYLSRNDFSGEIPPEISSLRLLLRLDISDNNIRGPIPTQFAKLTHLLTLRLQNNALSGHVPDLSASLQNLTELNVTNNELRGHVSDSMLTKFGNASFSGNHALCGSTPLPKCSETEPGTETTITVPAKPSSFPQTSSVTVPDTPRKKGLSAGVIVAIVVAVCVAVLVATSFVVAHCCARGSTSGSVVGSESAKRKSGSSSGSEKKVYGNGENLDRDSDGTNTETERSKLVFFDRRNQFELEDLLRASAEMLGKGSLGTVYRAVLDDGCTVAVKRLKDANPCERNEFEQYMDVVGKLKHPNIVRLRAYYYAKEEKLLVYDYLPNGSLHALLHGNRGPGRIPLDWTTRISLVLGAARGLARIHASKIPHGNVKSSNVLLDKNSVALISDFGLSLMLNPVHAIARMGGYRTPEQVEVKRLSQEADVYGFGVLLLEVLTGRAPSTQYPSPARPRVEELAEVDLPKWVKSVVKEEWTSEVFDQELLRYKNIEDELVAMLHVGMACVAAQPEKRPCMLEVVKMIEEIRVVEQSPLGDDYDEARSRTSFSPSLATTQDIQ

SEQ ID NO: 213630 - protein, 285 aa, Glycine max
  Coding DNA Sequence Number=SeqID_96852
  Gene Ontology: Mol. function=receptor activity
  Homolog annotation: Hit_ID=Q2QXR0; Match level="QueryCoverage=71%, HitCoverage=37%, E-value=3e-20, Identity=36%"; Hit description =Expressed protein
MGGETVNGSWFSVLWPVSRKSASDNKAVVGVLALEVAGLMLKVVNLWQSLSDAEVLSLREGIVNSVGVKTLVSDDDDYLMELALNEILDNFQSLARSVARLGKKCVDPVYHRFEHFVHNPAQNYFQWSGWEYRWKKMERKVKKMEKFVAAMTQLCQEVEVLAEVEQTFRRMQANPELHKLKLLEFQKKVMLQCQEVRNLRDMSPWNRSYDYVVRLLARSLFTILERIILVFANNHPSTVQEQNDYQHMNANNLLRSHSFSVIHSSVHPSEHDLCGFNSGPVGGRP

SEQ ID NO: 213631 - protein, 134 aa, Glycine max
  Coding DNA Sequence Number=SeqID_96853
  Homolog annotation: Hit_ID=Q1SJT1; Match level="QueryCoverage=56%, HitCoverage=22%, E-value=4e-16, Identity=57%"; Hit description =Aldo/keto reductase; NLI interacting factor
MAGKNKSIKFSDSEDEYDYETDDSGTDLNLHLEKLNLGPRKKLLIMNLNGLLLLRVHRCSKSEIPKSRAADGHYRGYLVFKRPFSQEFMKFCLERFEVGIWSSAMDFRYENRHNIDAALNYAIGSLRSKLLFVW

SEQ ID NO: 213632 - protein, 198 aa, Glycine max
  Coding DNA Sequence Number=SeqID_96854
  Gene Ontology: Mol. function=hydrolase activity, acting on acid anhydrides, in phosphorus-containing anhydrides
  Homolog annotation: Hit_ID=Q4KBE7; Match level="QueryCoverage=92%, HitCoverage=58%, E-value=3e-50, Identity=54%"; Hit description=ADP -ribose pyrophosphatase
  Pfam annotation: Domain name=NUDIX; Domain location=47-188; Score =44.3; E_value=4.1e-10; Accession=PF00293.18; Description=NUDIX domain
MHEDAPRVRHVRETLLSDNWYTLKKYTFELLRRDGRWQEQSREAYDRGNGAVILLYNRHKQSVVLIRQFRFPVWINGHDGFLIEAAAGLLDNASPEERIIAEAEEETGFRVTRIEPVFTAFMSPGSVTEKLYFFIAEYSADDRRGDGGGLAAEGEDIEVLEWPLARALQAIRDGEIVDAKTIMLLQHLALNADTLLAG

SEQ ID NO: 213633 - protein, 93 aa, Glycine max
  Coding DNA Sequence Number=SeqID_96855
MVIDYQCPITLCNRLHPAVIDYQRSFNILSPFLSPVIDYPRMVIDYQRPFYIYHPRYMAGQPPHKLPCFVEFVLLSVDCQELSCLGTSQVLTD

SEQ ID NO: 213634 - protein, 59 aa, Glycine max
  Coding DNA Sequence Number=SeqID_96856
MSFSTGDIPHHMNKEEKTETLSFLSKNTTLEKILLVRNRVQNKVMVQLWFGNRVKHLPV

SEQ ID NO: 213635 - protein, 524 aa, Glycine max
  Coding DNA Sequence Number=SeqID_96857
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q1RYZ6; Match level="QueryCoverage=92%, HitCoverage=95%, E-value=0.0, Identity=72%"; Hit description =Glycoside hydrolase, family 1
  Pfam annotation: Domain name=Glyco_hydro_1; Domain location=40-518; Score=753.1; E_value=1.7e-223; Accession=PF00232.9; Description =Glycosyl hydrolase family 1
MAFNGYFLLGLIVLVLVRSSKVTCELETDTVSPIIDISLSRKSFPEGFIFGAGSSSYQFEGAAKEGGREPSVWDTFTHNYPEKIMDRSNGDVAIDSYHHYKEDVGMMKDMNLDSYRFSISWSRILPKGKLSGGINREGINYYNNLINELVANGIQPLVTLFHWDLPQALEDEYGGFLSPRIVKDFRDYAELCFKEFGDRVKHWVTLNEPWSYSQNGYANGRMAPGRCSAWMNLNCTGGDSSTEPYLVTHHQLLAHAAVVRVYKTKYQAFQKGVIGITLVANWFLPLRDTKSDQKATERAIDFMYGWFMDPLTSGDYPKSMRSLVRTRLPKFTTEQSKLLIGSFDFIGLNYYSTTYASDSPQLSNARPSYLTDSLVTPAYERDGKPIGIKIASDWLYVYPRGIRDLLLYTKEKYNNPLIYITENGINEYNEPTLSLEESLMDTFRIDYHYRHLFYLQSAIKNGVNVKGYYVWSLFDNFEWSSGYTSRFGMIFVDYKNNLKRYEKLSAQWFKNFLKKETRLYSSTK

SEQ ID NO: 213636 - protein, 439 aa, Glycine max
  Coding DNA Sequence Number=SeqID_96858
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q1RYZ9; Match level="QueryCoverage=97%, HitCoverage=98%, E-value=1e-177, Identity=64%"; Hit description =Glycoside hydrolase, family 1
  Pfam annotation: Domain name=Glyco_hydro_1; Domain location=2-434; Score=577.4; E_value=1.4e-170; Accession=PF00232.9; Description =Glycosyl hydrolase family 1
FEGAANEGGRGLSIWDTFTHKYPEKIQDKSNGDVAIDAYHRYKEDVKIVKDMNLDSYRFSISWSRILPSIQPLVTLFHWDLPQSLEDEYGGFLSPRIVKDFRDYAELCFKEFGDRVKYWVTLNEPWSYSQHGYANGGMAPGRCSAWVNPNCTGGDSGTEPYLVTHYQLLAHAAAVRVYKTKYQVSQKGLIGITLVANWYLPFSNTKADQKATERAIDFMFGWFMDPLTSGDYPKIMRSLVRTRLPKFTTEQSKLLIGSFDFIGLNYYSSTYASDAPHLSNARPNYVTDSLVTPEFERDGKPIGIKIASDWLYVCPRGILDLLLYTKEKYNNPLIYITENGINEFRDETLSLEESLLDTFRIDYHYRHLFYLRSAIRHGVNVKGYYIWSLFDNFEWSSGYTVRFGMILVDYKNNLKRYHKLSAIWIKNFLKKTSLYDSSI

SEQ ID NO: 213637 - protein, 195 aa, Glycine max
  Coding DNA Sequence Number=SeqID_96859
  Gene Ontology: Mol. function=nucleoside-triphosphatase activity; Cellular component=chloroplast
  Homolog annotation: Hit_ID=Q2PMM5; Match level="QueryCoverage=98%, HitCoverage=15%, E-value=2e-80, Identity=88%"; Hit description =Protein ycf2
MSHTNGFGSTTMGSNVRDLVALTNEALSISIIQKKSIIDTNIIRSVLHRQTWDFRSQRFLYEKYESEFEEGGGVLDPQQIEEDFFNHIVWAPRIWSPWGFLFYCIERPNELGFPYWARSFRDKRIIYDEEDELQENDSEFLQGGTMQYQTRDRSSKEQGFFRISQFIWDPADPLFFLFKDQPFVSVFSHRQFFTR

SEQ ID NO: 213638 - protein, 187 aa, Glycine max
  Coding DNA Sequence Number=SeqID_96860
  Subcellular localization annotation: CTP_CleavageSite=25; ConfidenceScore=5.20e-01
MKAKILENIIIMCRLLRSFSRISFRSNSSSSSSSRNSNLLNDQDNQTQEVAPKHNLFDEEVRFEDINQNMDDWNIPEIPQDQLYVPETIKDKHNFDYIIKTVENNIPLGQDIGEEFHLLSKNSIYEHSRKYKYLHIGCVQVVIKPLIDMGIDAAVLMCLRDIRHNQFEDSLIGTVETSLGQGPIYLN

SEQ ID NO: 213639 - protein, 53 aa, Glycine max
  Coding DNA Sequence Number=SeqID_96861
  Subcellular localization annotation: CTP_CleavageSite=44; ConfidenceScore=5.49e-01
KRRPTSSAASSSSPLTSPSVPPFPSSRKLLPAFWSCIYVVGLAQTSSVEGKRH

SEQ ID NO: 213640 - protein, 525 aa, Glycine max
  Coding DNA Sequence Number=SeqID_96862
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q1RTS8; Match level="QueryCoverage=97%, HitCoverage=99%, E-value=0.0, Identity=64%"; Hit description =Glycoside hydrolase, family 1
  Pfam annotation: Domain name=Glyco_hydro_1; Domain location=41-519; Score=767.3; E_value=9.6e-228; Accession=PF00232.9; Description =Glycosyl hydrolase family 1
MTFKGYYFLLGLIALVVVSTSKVTCKIEADTVSPIIDISLNRNSFPEGFIFGAGSSSYQFEGAAKEGGREPSVWDTFTHNYPAKIKDRSNGDVAIDSYHHYKEDVRMMKDMNLDSYRFSISWSRILPKGKLSGGINQEGINYYNNLINELIANGIQPLVTLFHWDLPQALEDEYGGFLSPRIVKDFRNYAELCFNEFGDRVKYWVTLNEPWSYSQHGYANGGMAPGRCSAWLNSNCTGGDSATEPYLVTHHQLLAHAEAVRVYKTKYQASQKGSIGITLVANWFLPLKDTKSDQKAAERAIDFMYGWFMDPLTTGDYPKSMRSLVRTRLPKFTTEQSKLLIGSFDFIGLNYYSTTYASDAPQLSNARPNYITDSLVTPAYERDGKPIGIKIASEWIYVYPRGIRDLLLYTKKKYNNPLIYITENGINEYDEPTQSLEESLIDIFRIDYHYRHLFYLRSAIRNGANVKGYYVWSLFDNFEWSSGFTSRFGMTYVDYKNDLKRYKKFSALWFRNFLKKETKLYGYSK

SEQ ID NO: 213641 - protein, 497 aa, Glycine max
  Coding DNA Sequence Number=SeqID_96863
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q08IT7; Match level="QueryCoverage=97%, HitCoverage=94%, E-value=0.0, Identity=66%"; Hit description =Isoflavone conjugate-specific beta-glucosidase
  Pfam annotation: Domain name=Glyco_hydro_1; Domain location=40-488; Score=677.6; E_value=9.3e-201; Accession=PF00232.9; Description =Glycosyl hydrolase family 1
MAFKGYFVLGLIALVVVGTSKVTCEIEADKVSPIIDFSLNRNSFPEGFIFGAASSSYQFEGAAKEGGRGPSVWDTFTHKYPDKIKDGSNGDVAIDSYHHYKEDVAIMKDMNLDSYRLSISWSRILPEGKLSGGINQEGINYYNNLINELVANGIQPLVTLFHWDLPQALEDEYGGFLSPRIVKDFGDYAELCFKEFGDRVKYWITLNEPWSYSMHGYAKGGMAPGRCSAWMNLNCTGGDSATEPYLVAHHQLLAHAVAIRVYKTKYQASQKGSIGITLIANWYIPLRDTKSDQEAAERAIDFMYGWFMDPLTSGDYPKSMRSLVRKRLPKFTTEQTKLLIGSFDFIGLNYYSSTYVSDAPLLSNARPNYMTDSLTTPAFERDGKPIGIKIASDLIYVTPRGIRDLLLYTKEKYNNPLIYITENGINEYNEPTYSLEESLMDIFRIDYHYRHLFYLRSAIRNGANVKGYHVWSLFDNFEWSSGYTVRGPIGLRGKIEM

SEQ ID NO: 213642 - protein, 516 aa, Glycine max
  Coding DNA Sequence Number=SeqID_96864
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q1RYZ6; Match level="QueryCoverage=95%, HitCoverage=96%, E-value=0.0, Identity=65%"; Hit description =Glycoside hydrolase, family 1
  Pfam annotation: Domain name=Glyco_hydro_1; Domain location=40-515; Score=745.0; E_value=4.7e-221; Accession=PF00232.9; Description =Glycosyl hydrolase family 1
MALNLSMLPLLCVLSLFVTSAITITLSKSVAPIHDVSYLNRSSFPQGFIFGSASSAYQYEGAAREGGKGPSIWDTFTHKYPEKIKDGSNGDVADDSYHRYKEDIGIMKYMNLDAYRFSISWSRVLPKGKLSAGVNHEGVNYYNNLINELMANGLQPYVTLFHWDVPQALEDEYGGFLSPHIVDDFRDYAELCFKEFGNRVKHWITLNEPRSVSKNGYANGRFAPDRCSDWLKLNCTGGDSGTEPYLTSHNQLLAHAAAAKLYKTKYQTSQKGLIGITLNSDWYVPVSKEKSDQDAARRGLDFMFGWYMDPLTKGEYPKTMRSMLGNRLPEFSKEEARQLKGSFDFLGLNYYSSFYAAHAPHQRGARPTLQTDALVNVTNHHDGKPLGPMAASNWLCIYPRGFRQLLLFIKKQYNNPLIYITENGYDEFNDPTLSLEESLLDTYRVDYLYRHLYYLQTAIKDGVNVKGYFVWSLLDNLEWNSGYTVRFGLVFVNFRDGLKRYPKLSAHWFKNFLTKS

SEQ ID NO: 213643 - protein, 298 aa, Glycine max
  Coding DNA Sequence Number=SeqID_96865
  Gene Ontology: Mol. function=DNA-directed RNA polymerase activity; Cellular component=chloroplast; Biological process=transcription, DNA-dependent
  Homolog annotation: Hit_ID=Q8HVY4; Match level="QueryCoverage=99%, HitCoverage=43%, E-value=1e-154, Identity=94%"; Hit description=DNA -directed RNA polymerase beta' chain
  Pfam annotation: Domain name=RNA_pol_Rpb1_1; Domain location=1-208; Score=-63.6; E_value=4.3e-08; Accession=PF04997.3; Description=RNA polymerase Rpb1, domain 1
  Pfam annotation: Domain name=RNA_pol_Rpb1_2; Domain location=210-298; Score=33.6; E_value=1.8e-10; Accession=PF00623.11; Description=RNA polymerase Rpb1, domain 2
  Pfam module annotation: Pfam domain module=RNA_pol_Rpb1_1::RNA_pol _Rpb1_2; Domain location=1-208::210-298
MKSNLGNTAYHFFLLPKGFDIFRNREISSGAGAIREQLADLDLRILMDSSLIEWKELGEEGSPDNENEWEDRKVGRRKNFLVRRIELAKHFLRTNIEPEWMVLCLLPVLPPELRPIIQIDGGKLMSSDINELYRRVIYRNNTLIDLLTTSRSTPGELVMCQEKLVQEAVDTLLDNGIRGQPMRDGHNKVYKSFSDIIEGKEGRFRETLLGKRVDYSGRSVIVVGPSLSLHRCGLPREIAIELFQTFLIRGLIRKHFASNIGIAKSKIREKEPIVWEILQEVMQGHPVLLNRAPTLHRL

SEQ ID NO: 213644 - protein, 59 aa, Glycine max
  Coding DNA Sequence Number=SeqID_96866
MFAHSIKGCRPLGRACGVLIPSPCVNTTPEPFTKKFADRRAYSFRGTRIPRVMRRPPAE

SEQ ID NO: 213645 - protein, 102 aa, Glycine max
  Coding DNA Sequence Number=SeqID_96867
  Gene Ontology: Mol. function=transition metal ion binding
MGDRLENMICDLGQESFQQAHVPMYDTLQTDSKKLLYLGCNNLLILLLVVLSLVNLKARYEWSDKSFTSVLQVVHNMLPEENSLPKSYYQAKKILCSMGMEY

SEQ ID NO: 213646 - protein, 51 aa, Glycine max
  Coding DNA Sequence Number=SeqID_96868
MALLAASLVPACFLGKSGVSLKDSTLFGLLLSEPIKANFSSSALRIKELSL

SEQ ID NO: 213647 - protein, 144 aa, Glycine max
  Coding DNA Sequence Number=SeqID_96869
  Gene Ontology: Mol. function=transition metal ion binding; Biological process=RNA-dependent DNA replication
MKILKRYIKNLHCSEASIIERYIAEEAIEFCSKYMEKAKPVGILESRLDERVRDIIFGDHNASETLRKLVDGPKRNVTTWQRYGINKYLFYTKSQDDKSTMQNSGYKWVDRNIGVQTDDFGFTLVDLKKLAYQNDPFIMAEQAI

SEQ ID NO: 213648 - protein, 126 aa, Glycine max
  Coding DNA Sequence Number=SeqID_96870
MQSSKRDVYLGAYLNGGHWQMVVILPKEHLVFWFCSLYKRPGNYLKEIINSALKCLDDAPQPKSKAPARWIVVKCNRQKGSTECGCYVMHWMSTIILGTFRNNWETRLKELRIQWAHCYLRVRDQI

SEQ ID NO: 213649 - protein, 46 aa, Glycine max
  Coding DNA Sequence Number=SeqID_96871
MSIGVNDEICAISARLSAQLALSSNPLTRAKRKGRAKRNITNSEPI

SEQ ID NO: 213650 - protein, 181 aa, Glycine max
  Coding DNA Sequence Number=SeqID_96872
  Gene Ontology: Mol. function=oxidoreductase activity, acting on NADH or NADPH, quinone or similar compound as acceptor; Cellular component=photosystem II; Biological process=electron transport
  Homolog annotation: Hit_ID=Q9M3I5; Match level="QueryCoverage=99%, HitCoverage=64%, E-value=8e-74, Identity=87%"; Hit description =NAD(P)H-quinone oxidoreductase chain H, chloroplast (EC 1.6.5.-) (NAD(P)H dehydrogenase, chain H)
  Pfam annotation: Domain name=Complex1_49kDa; Domain location=110-181; Score=-131.2; E_value=0.0009; Accession=PF00346.9; Description =Respiratory-chain NADH dehydrogenase,
MGPHHPSMHGVLRLIVTLDGEDVIDCEPILGYLHRGMEKIAENRTIIQYLPYVTRWDYLATMFTEAITVNGPEQLGNIQVPKRASYIRVIMLELSRIASHLLWLGPFMADIGAQTPFFYIFRERELIYDLFEAATGPMLRASGIQWDLRKVDNYECYEEFDWEVQWQKEGDSFSSLFSSNW

SEQ ID NO: 213651 - protein, 446 aa, Glycine max
  Coding DNA Sequence Number=SeqID_96873
  Homolog annotation: Hit_ID=Q0L4P7; Match level="QueryCoverage=33%, HitCoverage=46%, E-value=4e-16, Identity=38%"; Hit description =Alcohol dehydrogenase GroES-like
  Pfam annotation: Domain name=ADH_zinc_N; Domain location=1-121; Score= -16.3; E_value=0.1; Accession=PF00107.16; Description=Zinc-binding dehydrogenase
  Pfam annotation: Domain name=Ifi-6-16; Domain location=374-446; Score= -14.1; E_value=0.085; Accession=PF06140.3; Description=Interferon -induced 6-16 family
  Pfam module annotation: Pfam domain module=ADH_zinc_N::Ifi-6-16; Domain location=1-121::374-446
LAALRGAEVWATCGARNAPLVERLGAVRTFDQRVSPPSDIPAGRLDAVVDIAGGIPLRAMQRLTAHRGTIVLVTGDGGHVLGPVPRMLRAAVLSIGSRRIRPLAETPRPEVLAKLLELVAEGRVVPVIEREYPFAEGSAALAQNEAGHTVGKVVIFDMNPVWPMPVPNPSDVVMMQQVLQHWNSGNQAAAFDAVRPRAEEGQAWAAALLSWLHMQQGYPGIDESVTWAIAAAHGGLPGQLVHAYNSLLAHLPSNPALVNRLPEIFQVGSPWGNGTDHVGQGWNLVANGQAELGLQVMMLPTPYPTPEPQLSALVAQANDRAIELDNVMAALREREAEAGLLVTATTSDATNALFMADARRNTEESRGAWRWGLVVLGGAALVAVLPVVLHYLQLGPDYLAFEQIAVHLVSTAALGTFAGVLLARARSRDHAAQRANDLSTAMGTMI

SEQ ID NO: 213652 - protein, 274 aa, Glycine max
  Coding DNA Sequence Number=SeqID_96874
  Gene Ontology: Mol. function=pyridoxal phosphate binding; Cellular component=mitochondrial matrix; Biological process=arginine metabolic process
  Homolog annotation: Hit_ID=Q82HT8; Match level="QueryCoverage=96%, HitCoverage=64%, E-value=6e-98, Identity=65%"; Hit description =Putative ornithine aminotransferase
  Pfam annotation: Domain name=Aminotran_3; Domain location=1-216; Score=141.3; E_value=2.6e-39; Accession=PF00202.11; Description =Aminotransferase class-III
ARIIVAAGNFHGRTTTIVSFSDDEQARDDFGPYTPGFDVVPYGDAEAIAAAITDDTAAVLVEPIQGEAGVVIPPEGYLRRIREICDEKNVLFIADEIQAGLGRVGETFACDREGVVPDLYLLGKALGGGILPVSAVVGNADVLGVIRPGEHGSTFGGNPLAAAVGLRVVEMLQTGEFQERARALGAHLEQAIAPLIGQGVTALRIAGLWAGVDIDPTHGTGREIAEKLLARGVLVKDTHGQTIRIAPPLVIRATELDWAVEQLALVLRGETAGR

SEQ ID NO: 213653 - protein, 185 aa, Glycine max
  Coding DNA Sequence Number=SeqID_96875
  Gene Ontology: Mol. function=catalytic activity; Cellular component =protein serine/threonine phosphatase complex; Biological process =protein amino acid dephosphorylation
  Homolog annotation: Hit_ID=O49449; Match level="QueryCoverage=99%, HitCoverage=71%, E-value=4e-67, Identity=70%"; Hit description =Protein phosphatase 2C-like protein
  Pfam annotation: Domain name=PP2C; Domain location=1-168; Score=35.2; E_value=5.4e-08; Accession=PF00481.12; Description=Protein phosphatase 2C
HDFWTETESAVKRAYLETDEKILEQALVLGRGGSTAVTAILIDGQKLIVANVGDSRAVICENGKARQLSVDHEPSKEKKWIERRGGFVSKIPGDVPRVDGQLAVARAFGDRSLKMHLSSEPDVLVEEVDPHTEFLILASDGIWKDFIGNHGYVKRRSSGIYSTNKGCSSCSKALDRRGSFQGKQG

SEQ ID NO: 213654 - protein, 67 aa, Glycine max
  Coding DNA Sequence Number=SeqID_96876
MTPSQQYHGPIPTPNAPLGTQWNVPGQIPNTGDLFGVDLRHAFSAEADEEEAGRHWGRRNPYRQARR

SEQ ID NO: 213655 - protein, 171 aa, Glycine max
  Coding DNA Sequence Number=SeqID_96877
  Subcellular localization annotation: CTP_CleavageSite=30; ConfidenceScore=5.73e-01
MASPPASPPPPCPPSPRPSAPPSDALASPSAVKRTRKASRLRSLYTRPPGADRPVVHVDPTTGKAGGPHMKKLKTYLGIVVRDKVDLTYENRKEAEFEIPKASDNRTKKKLLQTVADQDDVDDTVCEKYGINKEKWTQFCQTRRDPSWEDVRKKAQTIQKQNTTAHVLSRG

SEQ ID NO: 213656 - protein, 96 aa, Glycine max
  Coding DNA Sequence Number=SeqID_96878
  Gene Ontology: Cellular component=mitochondrion
MVQRLFIVLAREPKHACYLLYWTFDQAFYPCRIGTNHHCIALEQLSGRRPATSVPYTDIDSFFVPGPTSQPFAGWSEALRRTNRMAAGKKDDLTFS

SEQ ID NO: 213657 - protein, 183 aa, Glycine max
  Coding DNA Sequence Number=SeqID_96879
  Homolog annotation: Hit_ID=Q1SPB9; Match level="QueryCoverage=78%, HitCoverage=28%, E-value=2e-07, Identity=25%"; Hit description =Transposase
MCPPLEKVKSKGAPKNPLIKQQKSTKRDLSYWEYIDVLHFVQNSNSSVKRNASSFEQPIQRQNIRMLDQFHMCIQDSIENIIDVKADGNCGYRGIAAVATYPSIGGRQQTHGCVFQERKMREVATNIYSRKTSEKLEKGKRGRWLPPSSPRRAGLLPPEGTAFCWNTLEGPSGPGCYLHTVVY

SEQ ID NO: 213658 - protein, 279 aa, Glycine max; identical to SEQ ID NO: 133352
  Coding DNA Sequence Number=SeqID_96880
  Homolog annotation: Hit_ID=Q1S0F5; Match level="QueryCoverage=47%, HitCoverage=24%, E-value=3e-13, Identity=34%"; Hit description=IMP dehydrogenase/GMP reductase

SEQ ID NO: 213659 - protein, 179 aa, Glycine max
  Coding DNA Sequence Number=SeqID_96881
  Subcellular localization annotation: CTP_CleavageSite=38; ConfidenceScore=5.61e-01
MAESSKKRKVSSTSTAAHRTSRPGATGASQAPIPPSLSSSTLFSSYEQRIRNSSIFQSHQILDPKYLDLEFFDGETFDCYQVFQNTGLIPFMSLKLPYPELVRVFYSNLKIQDGTLIFEVHGIPMIIDESLFFSLTQLPSQGAPFEGTLVDQWKFDYSSHDARRMVCIDQADMANRLLV

SEQ ID NO: 213660 - protein, 119 aa, Glycine max
  Coding DNA Sequence Number=SeqID_96882
MLAIISKYQEELNLATAQEYRVADEYAQVYAEKEARGRVIDWKNTITKRTPRHPYRTRSKSRTMGDQEETREQMKADMSALKEQMASMMEAMLGMTQLMDKNMATAAAVARMPKQTQLF

SEQ ID NO: 213661 - protein, 97 aa, Glycine max
  Coding DNA Sequence Number=SeqID_96883
MTPSPLDRKTKANDAEPRWRDRLVLTRVSPITKLEFLTSLCLLFYHSGIQNGATGGDAEATRVGLVRDDIKRSRIESKAQKGSEGSVPPMQCGMARS

SEQ ID NO: 213662 - protein, 123 aa, Glycine max
  Coding DNA Sequence Number=SeqID_96884
MIQQGRPKQLVDQLSPHRCREWHSDQTSDCLRLMPSLGGEHPSKKQKSEEVTSKPSDGPKLDSVRAPARGSKDGVLFAPLAFFLPETMPFLDTDLQTKSDEELASLKVALADLPVPLLSRFWQ

SEQ ID NO: 213663 - protein, 100 aa, Glycine max
  Coding DNA Sequence Number=SeqID_96885
MGIAPTKTPSGPEEIQQGPRVSSSGIVPARHLVDPKKANSVLELPALNTGLYQFKGVPVAPSRAGAGRDTTAALGWTVGDRQVIRRPAKDVKEALLGGNL

SEQ ID NO: 213664 - protein, 77 aa, Glycine max
  Coding DNA Sequence Number=SeqID_96886
  Subcellular localization annotation: CTP_CleavageSite=39; ConfidenceScore=5.33e-01
MRSLGRILLSSNVIYVRVVMLVRMIRTRLFAAARVKSCPSMHSSSVIASLSSCARTVGPPPISGGGPGTVKTKLLAP

SEQ ID NO: 213665 - protein, 59 aa, Glycine max
  Coding DNA Sequence Number=SeqID_96887
  Subcellular localization annotation: CTP_CleavageSite=41; ConfidenceScore=5.24e-01
MCIFRASASRLRAKCKISVLSVAGVFSQAQRTTSTKLESLTCAKREGGTKCNFANSEPI

SEQ ID NO: 213666 - protein, 69 aa, Glycine max
  Coding DNA Sequence Number=SeqID_96888
MGFVTWWEKYYSTRSIGDTTIMISRLESGFTQPTVENIRSNLQARESKRKMTVLRLPRLPNARSMRASN

SEQ ID NO: 213667 - protein, 103 aa, Glycine max
  Coding DNA Sequence Number=SeqID_96889
MKPVDMPDLDVDLMYLMTLIILQLFLRPLQMSWDASVFGVYNDNFPLHMTETNMRAENAYVYGFLEPQYIQRSRQSQFESEDYIKKWMYNLQRDVYLEAYLNG

SEQ ID NO: 213668 - protein, 280 aa, Glycine max
  Coding DNA Sequence Number=SeqID_96890
  Gene Ontology: Mol. function=sulfuric ester hydrolase activity; Biological process=metabolic process
  Homolog annotation: Hit_ID=Q88IZ7; Match level="QueryCoverage=92%, HitCoverage=35%, E-value=1e-136, Identity=87%"; Hit description =Sulfatase domain protein, putative
HDAVLGHEAQAGTLQVVGSEAGLAQLRWQAGLVAFVLGQQFHALGRAVGQLVIVTAEHRVKATDGLVGMQHVVRGVHAALGPLAELWHQLFVEAAVQGLAVGPQVGPGDAFHGDDQQVAGVAWPGEQPLAMQVGLGQAGTGQRGEGLCAAHPAFDLALQVAGPGRKQLVGEVVLPPLVGVGRYQLLAAPMGAKQQQRNGPGLAWQRLAALATAAPGDGQPAQQAGAHDPGQPGMGQAATGRVFHELRVEQVCQVSAGGQTADRADQFGRSHPEGRPGQQY

SEQ ID NO: 213669 - protein, 154 aa, Glycine max
  Coding DNA Sequence Number=SeqID_96891
MWYWLWENPYPLTPDTAGCPLISERLRLLCVYPAEGALISGQITSMAQSNSSRLGFPTLITTLCRSRGVASDSLVFERLSPVINLAYIRKNCWNPDDLTVTIKGARRARARLAEAPSTSATPPPARTLAAPSTPSSTDSQHLEAMLRSIHQGHI

SEQ ID NO: 213670 - protein, 231 aa, Glycine max
  Coding DNA Sequence Number=SeqID_96892
  Gene Ontology: Mol. function=chitin binding; Cellular component =extracellular region; Biological process=chitin metabolic process
  Homolog annotation: Hit_ID=UPI000044A8F0; Match level="QueryCoverage =93%, HitCoverage=99%, E-value=4e-34, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GLHVLTLRGLHVLTFRGLHTLAFRGLHVLAFKGLQVLAFRGLHALAFKGLHVLTFSVLHVFTFRGLHALAFRGLHVLAFRRLQVFAFRGLHALAFRGLHVLTFRGLHALAFKGLHVLTFRGLQVFAFRELHALAFSGLHVLAFRGLHALAFRGLHILTFRGLHALTFRGLHILAFRGLHVLAFKGLHVLAFRGLHMLAFRARHVLAFRGQHVLTFKGLHIRSFRELKVLCP

SEQ ID NO: 213671 - protein, 40 aa, Glycine max
  Coding DNA Sequence Number=SeqID_96893
MDYGLELNSMDAIHVDKFACEACVICEENRGHDMDWIWRS

SEQ ID NO: 213672 - protein, 60 aa, Glycine max
  Coding DNA Sequence Number=SeqID_96894
MCCMLVSSFVTGSWKVHITFLTAHMGHCASECAKASFMMMNQVDSRSFDNDKDVDKKPKE

SEQ ID NO: 213673 - protein, 99 aa, Glycine max
  Coding DNA Sequence Number=SeqID_96895
MERGRTHGRTFFRGNSRKNLLPLTLAEEVLPRSSTEDGSSAVLLPLTLAEEMFHGHPRKNLLPSTAEEGSFADARGTFLPPVSSKEIPHKIDGPFSYYV

SEQ ID NO: 213674 - protein, 320 aa, Glycine max
  Coding DNA Sequence Number=SeqID_96896
  Homolog annotation: Hit_ID=Q47522; Match level="QueryCoverage=18%, HitCoverage=77%, E-value=6e-19, Identity=74%"; Hit description=LacZ protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDATVTNTNSNGNCCELELELEHQLKRELVRTPTRTRIGMAASGGHQAYRYRRPRGGARYQLLFPLVRVNFELGVIMLTHINCVALTARFPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGK

SEQ ID NO: 213675 - protein, 143 aa, Glycine max
  Coding DNA Sequence Number=SeqID_96897
  Subcellular localization annotation: CTP_CleavageSite=58; ConfidenceScore=5.35e-01
MIKLVSTAPPSSAPLILAHSSSAPSTSLPPAPAAPVLTEPASGLALDHAELAKCGPPVAAWTGVQPSPSGGGEASATQEPQPVQEDASTNISEPSPLEPFIFEDDSIISSQAEPSTPVPKLPISQDPPSAPALDLNEHAEDHS

SEQ ID NO: 213676 - protein, 207 aa, Glycine max
  Coding DNA Sequence Number=SeqID_96898
  Gene Ontology: Mol. function=transcription factor activity; Biological process=regulation of transcription, DNA-dependent
  Homolog annotation: Hit_ID=Q4ZSA0; Match level="QueryCoverage=87%, HitCoverage=61%, E-value=5e-39, Identity=44%"; Hit description =Regulatory protein, LysR:LysR, substrate-binding
RTDRNLKQGGAHPSAFFRTPALLAGPALLLHRLSERRNKHADARRQVAGGGKQRPHAQHLRLRVLQLQRHQFAGCQLFPHVPLRKLRDAAAGHAQRTHPFDIAAAEASVNAQAGEMAVHHKTPLHHIRQAQTVVLMQLRQMTRRAEALQIARSRTQPARVVGQTVCHQAGIAQRGDANRDIKAQPDNVRDIVAELKLNAQPGVLLHQ

SEQ ID NO: 213677 - protein, 189 aa, Glycine max
  Coding DNA Sequence Number=SeqID_96899
  Homolog annotation: Hit_ID=Q1SKD7; Match level="QueryCoverage=80%, HitCoverage=39%, E-value=2e-07, Identity=27%"; Hit description =Ankyrin
MERYTDVIVPRKLLPERNVVVYYIEFDEFKEELERRHWDEELTDFIDGNIDVAIMKEFYANLYEPEDKSPKQVKVRGHLIKFDEDMLNTLFKSPVIVEEGESLCAYSRFALLRPNPQELAAKLCIPGSGFELNADGQPLKILRKNMTTLAQTWSALSFTNLIPTSHTSDVTLDRAKLIYGIIMKMDMNV

SEQ ID NO: 213678 - protein, 99 aa, Glycine max
  Coding DNA Sequence Number=SeqID_96900
  Homolog annotation: Hit_ID=Q1S7C5; Match level="QueryCoverage=89%, HitCoverage=8%, E-value=6e-11, Identity=52%"; Hit description =Integrase, catalytic region
MARTAECGEGVAMATMIDIADKNLISMSKAARDNCVFFEFHTNRCFVESQDSNEILLRGDVVPNDWGGRVNFVAFPLIWVIEAFFIGFHAPHTSSEWCG

SEQ ID NO: 213679 - protein, 141 aa, Glycine max
  Coding DNA Sequence Number=SeqID_96901
  Homolog annotation: Hit_ID=Q1SPD0; Match level="QueryCoverage=56%, HitCoverage=25%, E-value=4e-11, Identity=39%"; Hit description =Peptidase M, neutral zinc metallopeptidases, zinc-binding site; Nucleic acid-binding, OB-fold
KGRRVVFKLKDLSQQLLSCTLWDDYCLQFLKFLDDHEGHGPITVLSTHGRIKEAQGSYLPSVSNSFKASKLVINQPVMEIQEFNEGLAELGIEARSVFKSHGEGSSQLSGSIQLSSKELFFGKAEAKTIAEINTISEVIIL

SEQ ID NO: 213680 - protein, 140 aa, Glycine max
  Coding DNA Sequence Number=SeqID_96902
  Homolog annotation: Hit_ID=Q47522; Match level="QueryCoverage=44%, HitCoverage=83%, E-value=2e-22, Identity=75%"; Hit description=LacZ protein
GHQDLFILRSDLPSQWLLFLSAVPPVQLLTGWCVTAKAPPDISAGKCSGHAARRVPFAIQAAQLLGRAIGAGLFAITPAGERGMCCKAIKLGNARVFPVTTLNSMVELHADDADVSTFLARADAACYRAKNEGRGAIASD

SEQ ID NO: 213681 - protein, 99 aa, Glycine max
  Coding DNA Sequence Number=SeqID_96903
  Gene Ontology: Mol. function=unspecific monooxygenase activity
  Homolog annotation: Hit_ID=O04892; Match level="QueryCoverage=94%, HitCoverage=32%, E-value=1e-15, Identity=78%"; Hit description =Cytochrome P450 like_TBP
  Subcellular localization annotation: CTP_CleavageSite=36; ConfidenceScore=5.21e-01
IRESANGSVTSGKGLALRAGHGGPSPEPVGCRWTARAASAARAGRRVPVGGRIGNGPFGASSPGVEQSTQNCETTAKGTGLAESAGKEDPVELDSSPTL

SEQ ID NO: 213682 - protein, 140 aa, Glycine max
  Coding DNA Sequence Number=SeqID_96904
  Subcellular localization annotation: CTP_CleavageSite=57; ConfidenceScore=5.79e-01
MVRLLPPRDSRTSSTPSPSSVSIPIRPPDVAPTPSRPSTKARPSSSHVNARGPSPVPASTPSPSSVDVQGPSPIPTSTPSPSLLVGNMTTDEDAINLAMEDPLNDRPMVTLINGVFHPSKVVAKALTLSIRQQFGQPWPT

SEQ ID NO: 213683 - protein, 72 aa, Glycine max
  Coding DNA Sequence Number=SeqID_96905
  Subcellular localization annotation: CTP_CleavageSite=48; ConfidenceScore=5.27e-01
MGELASLSLTVTPTNSVHSLDFPPIVSTGPLPKTTTFIAFEDKVVEASFMMMNQVDSRSFDNDKDDDKKPKE

SEQ ID NO: 213684 - protein, 101 aa, Glycine max
  Coding DNA Sequence Number=SeqID_96906
  Subcellular localization annotation: CTP_CleavageSite=30; ConfidenceScore=5.01e-01
MISYRIKRLHARSRTNRIFSRVVFLERRLGASVFSSLFMWGGTSSVGNDLEWKSQRKNHFKYGFSLCRRIRYSLSLEEILLSKFFGGKDEDSLHAPRFKVA

SEQ ID NO: 213685 - protein, 75 aa, Glycine max
  Coding DNA Sequence Number=SeqID_96907
MNSARQSIHGAPDLMVEDARTAQGNQFMGIRTQWWRMHEQRLAINSWGSRLDGGGCMNSARQSIHGAPDLMVENA

SEQ ID NO: 213686 - protein, 215 aa, Glycine max
  Coding DNA Sequence Number=SeqID_96908
  Gene Ontology: Mol. function=single-stranded DNA binding; Cellular component=nucleus; Biological process=response to DNA damage stimulus
  Homolog annotation: Hit_ID=Q84L33-2; Match level="QueryCoverage=54%, HitCoverage=32%, E-value=7e-50, Identity=84%"; Hit description =Isoform 2 of Q84L33
  Pfam annotation: Domain name=UBA; Domain location=170-209; Score =40.0; E_value=8.4e-09; Accession=PF00627.21; Description=UBATS-N domain
  Pfam annotation: Domain name=XPC-binding; Domain location=97-148; Score=89.1; E_value=1.4e-23; Accession=PF09280.1; Description=XPC -binding domain
  Pfam module annotation: Pfam domain module=UBA::XPC-binding; Domain location=170-209::97-148
MNREEKDGFSLFINAGDWLGNSPGKRWVTDGKSRTRLWMSSLARQDLCQHWAVLGSAVRSCNSDGSSEQSAMRSEEVRAGSSKKKSQPTPPIGMRLLVFQALRSMVQSNPQILQPVLQELGKQNPGLLRLIQEHHGEFLQLINEPVEGSEGDMFEQPEQDMPHAINVTPAEQEAIGRLEAMGFDRASVIEAFLACDRDEQLAANYLLENAGDFED

SEQ ID NO: 213687 - protein, 371 aa, Glycine max
  Coding DNA Sequence Number=SeqID_96909
  Gene Ontology: Mol. function=DNA-directed RNA polymerase activity; Cellular component=chloroplast; Biological process=transcription, DNA-dependent
  Homolog annotation: Hit_ID=Q8HVY5; Match level="QueryCoverage=99%, HitCoverage=42%, E-value=0.0, Identity=80%"; Hit description=DNA -directed RNA polymerase beta chain
  Pfam annotation: Domain name=RNA_pol_Rpb2_6; Domain location=1-280; Score=324.0; E_value=2.7e-94; Accession=PF00562.18; Description=RNA polymerase Rpb2, domain 6
  Pfam annotation: Domain name=RNA_pol_Rpb2_7; Domain location=282-359; Score=144.1; E_value=3.6e-40; Accession=PF04560.10; Description=RNA polymerase Rpb2, domain 7
  Pfam module annotation: Pfam domain module=RNA_pol_Rpb2_6::RNA_pol _Rpb2_7; Domain location=1-280::282-359
MHQKPQVRRGKCIKKGQILADGAATVDGELALGKNVLVAYMPWEGYNSEDAVLINERLVYEDIYTSFHIRKYEIQTHMTSYGSERITNKIPHLEAHLLRNLDKNGIVILGSWVETGDILVGKLTPQMAKESSYSPEDRLLRAILGIQKREIKVGDKVAGRHGNKGQIFECSLGLAGGMLERHYRITPFDERYEQEASRKLVFSELYEASKQTSNPWIFEPEYPGKSKIFDGRTGNSFKQPAIMGKPYILKLIHQVDDKIHGRSSGHYALVTQQPLRGRAKQGGQRVGEMEVWALEGFGVAHILQEMLTYKSDHIKTRQEVLGTTIIGGTIPKPTDAPESFRLLVRELRSLAMELNHFLVSEKNFRIHRKEA

SEQ ID NO: 213688 - protein, 119 aa, Glycine max
  Coding DNA Sequence Number=SeqID_96910
MYYTGTQRSPEKWPSDRFWLPTSGTVLGSEPEKEEELQLSTTVVTVEESVVMESKVASVMTTSSLEKSKRSSTMKLSGLLLFLLVSKVNCGKIGEELGDSMAKKKKDSSRLGGKMAMTT

SEQ ID NO: 213689 - protein, 81 aa, Glycine max
  Coding DNA Sequence Number=SeqID_96911
METKDSPKVLSMKEVVARETAQLLDQQKRLSVHDLASKFEKGLAAAGEGRATVKGKMVLALPHNIADLDSNLPHWMLTFAK

SEQ ID NO: 213690 - protein, 175 aa, Glycine max
  Coding DNA Sequence Number=SeqID_96912
  Homolog annotation: Hit_ID=Q1RWM6; Match level="QueryCoverage=37%, HitCoverage=24%, E-value=1e-09, Identity=46%"; Hit description=Zinc finger, SWIM-type
MVIFNHGVVAKDKGEEEKGDSIHYGISHGRRSFTTKRVPWIRSLKRKLQWGKIMRERRWHGKLKEEREGGNLTNLKEEKPILIFIEKSGPNLGPWAQKSTLREDCITPIGRFLEYRINRLSKIGGHLPPSLATIPCENPIFLWNLAEPINFLVSIYFLPQHVVVMIERRLRPCIC

SEQ ID NO: 213691 - protein, 64 aa, Glycine max
  Coding DNA Sequence Number=SeqID_96913
  Subcellular localization annotation: CTP_CleavageSite=20; ConfidenceScore=5.11e-01
MRVSSSTVSDLSFLGDPTVPSFEGKDGNSHLGSRFMVSSDFGSRLVERLDMMYVRVLVWPAVQG

SEQ ID NO: 213692 - protein, 92 aa, Glycine max
  Coding DNA Sequence Number=SeqID_96914
MAKIHHQAWSTKTYHPMKRTSPITLIPKTLPKLQNSLKVGKGNIGSKGLSKELIQGRLIWLEAYKNKMPKSSPNMHVKQEVSTRVKPRLLCK

SEQ ID NO: 213693 - protein, 289 aa, Glycine max
  Coding DNA Sequence Number=SeqID_96915
ARCDTEATTIQVILHQPFILHPPLRKPSATKEYFPLLFRVTSGFTRKESECIFTQAFLCETHFVYALDPNPPIFILLDKGFQAKKVEKAKAEKARVEKDKGKQKENPQHEWVPSPPPPIAAGVTIRDDLAFRWRSVKEVEVDADTDFNPKAFIQAFMLSQLDRDMVREIGPHHQWIPLLVLLQGLGESLNSGMKSLRGRTLNLRRHRLIVPRLNRLSLKPPVLQEEIELLNKEFPLFKVNVEKVAEKLKIYFGEAEVEILKTHEARFNKAFPQVKYFSKNVDTSLFNVD

SEQ ID NO: 213694 - protein, 148 aa, Glycine max
  Coding DNA Sequence Number=SeqID_96916
MAENLHGITHGNVSDVLRKKMREELATQLAQASEVPSGGTSWKAQIVQQCSLLTSGTSWNFTYCATMGAKYLEVVKQRLHAIKQWSPDEIREPIGKITKKPYFPLTGGSVLDNGGRMNSARQSIHEAPNKMVEDARTMLGNQFVGLRT

SEQ ID NO: 213695 - protein, 46 aa, Glycine max
  Coding DNA Sequence Number=SeqID_96917
MFPRGKMSMKGVSRERAQSMKNLGSQVLWSGQLKVVCHQAIVPGRN

SEQ ID NO: 213696 - protein, 292 aa, Glycine max
  Coding DNA Sequence Number=SeqID_96918
MFNEFYGELQWRQWHRVLTKILEKQIYIALVKEFYSNIYDPEGGAPKYYKVQGHVIRFDTETINDFLDNPVILAGGEEYLSYSQYLHTYPDHEAIVVALCTPEGGFVLNVNGTPWKLLRKDLTSLTQAWTVLYYFNLAPTSHTFDLNVDRATLIYGLVMKMDMDLGSFILGQITQIAQSNTSRTPPCPCQSRCTRCLTSRTASSTTCCPPPVAIHLSLDRHAYSDALVHLPRQADHCSESSQTLSLPGDGSTTDDPKSLHLPSKVRDTIEARLGDDIITYLATNWNPWPNLG

SEQ ID NO: 213697 - protein, 95 aa, Glycine max
  Coding DNA Sequence Number=SeqID_96919
MAPRKLSSKRSRKDAVDERTSAAPSSIAIVSEALSTSSVSKPSRDGPSTERDASSSGTTKEGVRDMRSWVRGQWIPFDADALSQFLGYPLVLEEG

SEQ ID NO: 213698 - protein, 171 aa, Glycine max
  Coding DNA Sequence Number=SeqID_96920
FVWESYPSTVISLLPPVCLVGSLAWRKTKMFVDPQNAKTATLAKVAETLQYMVSPQGRNTWTVDDLVPYVEKITILSEEQERVTEPVSHGPASERQFPTQQFHILQSSVETQGIDRRRETVEREEYSQKMPERGHGMYYTPQTFAEHPTQMYQYPFRGHHIDTSASQQSFG

SEQ ID NO: 213699 - protein, 61 aa, Glycine max
  Coding DNA Sequence Number=SeqID_96921
MAKLMTYPKCPSQEILGLMFHSLHWPNQLKRLIVLMESKCCASQAIGLLDKDYSNLHKWAK

SEQ ID NO: 213700 - protein, 113 aa, Glycine max
  Coding DNA Sequence Number=SeqID_96922
GELSYYEGNLLKEASQGNFSRKLLKEHPLQASYPRHILGGKAPSSMAYSLVDGKSSCVKGDCSVSRVVTSTSVRVAAFDLASKIRRVRRVQHTHITLAYVSLMEWACTEDAIR

SEQ ID NO: 213701 - protein, 154 aa, Glycine max
  Coding DNA Sequence Number=SeqID_96923
MLTSLKRVQMTTLASACQSDLGSPNDKVRITVRCLRMLPDSQVMIAKGGVVDKSGAFAPTYPQFVMRNSDLHSVSTCHWTLKSQDSKKYARITIGCLRVPPDSQGVSNSTVSDSSFLGDPIVPSFEGKDGNSHPGSRFMVIRGLGSKGLQNGRT

SEQ ID NO: 213702 - protein, 50 aa, Glycine max
  Coding DNA Sequence Number=SeqID_96924
MFRNLKYVIKHRVVTVYHPQTKGQVEVFNRDQASVAKGSAAQQEGLEQAS

SEQ ID NO: 213703 - protein, 225 aa, Glycine max
  Coding DNA Sequence Number=SeqID_96925
  Homolog annotation: Hit_ID=Q9SGE3; Match level="QueryCoverage=39%, HitCoverage=37%, E-value=7e-29, Identity=66%"; Hit description =Histone H2B.2
  Pfam annotation: Domain name=Histone; Domain location=130-200; Score =70.2; E_value=6.7e-18; Accession=PF00125.14; Description=Core histone H2AH2BH3H4
MAPKRAEKLVVRSTKKVVESSVLVSVVGKRLTRGKKDTQTTDGEEEVGSQEHLVVIPIQEVTPQAQKDSPNSAITTENKAEQENNTQDGGVENNQEEEEEHEEVKEKKNKAKTPKGKNGKEKKRGRKKGRRSVEGYQRYVYRVLKQVHPEMGISSKCMTVLNNLMNDMFERLAFEASKLKDYTGHMTLSSREIQGAVRLVLPGELGKHAIAEGVKAVNNYTSYDA

SEQ ID NO: 213704 - protein, 124 aa, Glycine max
  Coding DNA Sequence Number=SeqID_96926
MAICRAIGNRQSNWRVPTAEGACHGSEGQSASRQSRPNRQWQWRFALGMDRQPCWRVAPKYASSIIKAQSESAPATLPSWLSPRVHQLASFVPLLPLILPLLCFHCCAIFFISFSVRFCYFDIC

SEQ ID NO: 213705 - protein, 118 aa, Glycine max
  Coding DNA Sequence Number=SeqID_96927
MLATKGSTTEQPIPPQVEEESSVCKQEEEGEDAKIRVVIAQEGIEECKTPTGSGYKIPIVQKCPLAPRKKRRPVPPFSSQMKTSSSSGLSYVVRHEEVETFFQSMFELTRVNKRCRSV

SEQ ID NO: 213706 - protein, 98 aa, Glycine max
  Coding DNA Sequence Number=SeqID_96928
  Gene Ontology: Mol. function=oxidoreductase activity
  Homolog annotation: Hit_ID=Q1SVN8; Match level="QueryCoverage=83%, HitCoverage=18%, E-value=5e-18, Identity=59%"; Hit description =Aldo/keto reductase
MAKLIKFFELNTGAKIPSVGLGTWQAEPGVVAKAVTTAILNTNSTEEYFSTGFSFSYDLSLVLILVGYRHIDCAQAYNNQAELVLFYLSIYWICYYVI

SEQ ID NO: 213707 - protein, 246 aa, Glycine max
  Coding DNA Sequence Number=SeqID_96929
  Gene Ontology: Mol. function=ubiquitin-protein ligase activity; Cellular component=ubiquitin ligase complex; Biological process =protein ubiquitination
  Homolog annotation: Hit_ID=Q8VZ40; Match level="QueryCoverage=97%, HitCoverage=53%, E-value=6e-52, Identity=54%"; Hit description=E3 ubiquitin ligase PUB14
  Pfam annotation: Domain name=Arm; Domain location=113-153; Score =13.9; E_value=0.22; Accession=PF00514.13; Description=Armadillobeta -catenin-like repeat
  Pfam annotation: Domain name=Arm; Domain location=154-194; Score =19.7; E_value=0.01; Accession=PF00514.13; Description=Armadillobeta -catenin-like repeat
  Pfam annotation: Domain name=Arm; Domain location=72-112; Score=11.5; E_value=0.45; Accession=PF00514.13; Description=Armadillobeta-catenin- like repeat
  Pfam module annotation: Pfam domain module=Arm::Arm::Arm; Domain location=113-153::154-194::72-112
TCPKTQQTLVHTALTPNYVLKSLIALWCESNGIELPKRQGNCRTKKCGGSSLSDCDRTAIGALLDKLMSNDIEQQRAAAGKKDAATALIKLLCEGTPASKKDAATAIFNLSIYQGNKARVVKAGIVAPLIQFLKDAGGGMVDEALAIMAILASHHEGRVAIGQAKPIHILVEAIRTGSPRNRENAAVVLWSLCIGDPLQLKLAKEHGAEAALQELSENGTDRAKRKAGSILELLQRMEGVDNLQSS

SEQ ID NO: 213708 - protein, 103 aa, Glycine max
  Coding DNA Sequence Number=SeqID_96930
  Homolog annotation: Hit_ID=Q9FNK3; Match level="QueryCoverage=48%, HitCoverage=7%, E-value=7e-11, Identity=57%"; Hit description =Arabidopsis thaliana genomic DNA, chromosome 5, P1 clone:MCL19
MLHSVPPIAAPMVYDHRAESGASLGMLSSSSLYGGYGSFSACCIFFLLWGDNGYGSMSSYATKLYGGLPPPSTLDMLIPANVVGKVLGKGGANIANIRKFMVD

SEQ ID NO: 213709 - protein, 62 aa, Glycine max
  Coding DNA Sequence Number=SeqID_96931
MDYGNGLLVATEKTEGTGRSTTTLALKQLHNLFLIAQCDMPASYYLMGALYYYRHKGLTAPM

SEQ ID NO: 213710 - protein, 81 aa, Glycine max
  Coding DNA Sequence Number=SeqID_96932
ANYILWEAFVVVVGKMVYLGGVENYAPRGLVILLVYMGWIIVDSKTWIFEIDHEKALSLVLEVFVVANAEWTYRIDGWANP

SEQ ID NO: 213711 - protein, 147 aa, Glycine max
  Coding DNA Sequence Number=SeqID_96933
MAAEWRRKRERRRHFKEKMSLEEAHHHRRPWIRAWRKKEMNEGRGREEHEILCSKGALKSEIIGPNLGPWAQKSTLRFMRTLGPSSAALAQSSWSLLLMVLVIGPFLGRIASEVDDGQRYTECSGWRGLKNLGELASGDDPTFGALI

SEQ ID NO: 213712 - protein, 673 aa, Glycine max
  Coding DNA Sequence Number=SeqID_96934
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=92%, HitCoverage=42%, E-value=0.0, Identity=55%"; Hit description=Chromo
  Pfam annotation: Domain name=Chromo; Domain location=573-627; Score =27.9; E_value=3.5e-05; Accession=PF00385.14; Description='chromo' (CHRromatin Organisation MOdifier
  Pfam annotation: Domain name=RnaseH; Domain location=70-184; Score= -32.2; E_value=0.057; Accession=PF00075.14; Description=RNase H
  Pfam annotation: Domain name=rve; Domain location=313-472; Score =69.8; E_value=8.5e-18; Accession=PF00665.16; Description=Integrase core domain
  Pfam annotation: Domain name=zf-H2C2; Domain location=254-295; Score =10.2; E_value=0.016; Accession=PF09337.1; Description=His(2)-Cys(2) zinc finger
  Pfam module annotation: Pfam domain module=Chromo::RnaseH::rve::zf -H2C2; Domain location=573-627::70-184::313-472::254-295
LRGLLGLTGYYRRFIKGYATIASPLTNLLKKDNFLWNKTATTAFTNLKSAITQAPVLGLPDFSQTFILETNASGLGIGAMLSQNHHPIAFFSKKLTPIMQRQSAYAREFYAITEAIAKFRHYLLGHKFIIRTDQQSLRGLTDQAIQTPEQQKWLHKLLGYDFSIEYKPGKENIVVDYLSRSFFMAWSQPQLSILSNLREAILVDPKLKAIVDLCITNHPPNPNYSVHDHLLFWKGRLVLPADHEIVQKILHEFHSSMLGGHAGFARTLARISAQFFWHGMNRDIKAYVQNCLTCQQAKTEATLPAGLLQPLPIPDQIWEDLVMDFITGLPSSGGYTVILVVIDRLSKYAHFSPLKEDYSSKVVAETFMKFVVKLHGFPKTIVSDRDKIFTSQFWQHLFRLSGTSLNMSTAYHPQFDGQSEALNKCLEMDPPTLVKYVPTGNDPISIHDQLLQRNYVLARLKQNLQKAQQYMKKYVDQKRRLEEWKVGDMVLVKLQPYKQHSIALRKNQKLILRYFGPFQIIERVGPVAYKLLLPSTAKIHPVFHASQLKLCRGDHIHPYVPLPITTNDFSPVIKPTAILKSRVVIKGSQHVQQDLIQWEGMDESQSTWEHHSALQKAYPDFNLEDKVVLNGGGIVSKSVRAGVKWAENGMTEDGHVAVDPLHQERRKSSRPPK

SEQ ID NO: 213713 - protein, 138 aa, Glycine max
  Coding DNA Sequence Number=SeqID_96935
MEEETRLHAHFGYIQCHVLLLDEPHVPLITIKTNASYHYSFEHTSQCDTIYSISYYAYFGLQFFGHDVNRRPTRSTFRKDTTVEVHENVGDFSDDKDFTPLRLPSTGRLLVKRYLRERCFHLMRNAIPWETRVTFPRI

SEQ ID NO: 213714 - protein, 195 aa, Glycine max
  Coding DNA Sequence Number=SeqID_96936
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=90%, HitCoverage=11%, E-value=2e-77, Identity=77%"; Hit description=Chromo
MALLLYTYKEVFSIPSGLPPPRAQNHSIPLIQGSGSVKVKPYRYPHSQKLQIESMIHDMLHEGIIVPSTSPFSSPIVLVKKKDGTWRFCTDYRALNAITVKDSFPIPTVDELIDELHGAQYFSKLDLRSGYHQILVKEEDRHKTAFRTHQGLYEWLVMPFGLSNAPATFQSLMNESFLGFTSASLGGSIKITAPT

SEQ ID NO: 213715 - protein, 109 aa, Glycine max
  Coding DNA Sequence Number=SeqID_96937
MVRWMVMENLVLEDAGTPCYDRMVKSVTISTYLYKAQSELLNTPFLNVLLLVPPNKAQQLNPTPLLLPSGTNRKRASSSETLMQHFTHKKIVGFGGRGFWLASGSPIGI

SEQ ID NO: 213716 - protein, 303 aa, Glycine max
  Coding DNA Sequence Number=SeqID_96938
  Gene Ontology: Mol. function=aminoacyl-tRNA ligase activity; Cellular component=integral to membrane; Biological process=translation
  Homolog annotation: Hit_ID=UPI00005F72A9; Match level="QueryCoverage =99%, HitCoverage=73%, E-value=1e-118, Identity=49%"; Hit description= COG3008: Paraquat-inducible protein B
  Pfam annotation: Domain name=MCE; Domain location=102-184; Score =19.9; E_value=0.0013; Accession=PF02470.10; Description=mce related protein
  Pfam annotation: Domain name=MCE; Domain location=220-301; Score =58.7; E_value=2e-14; Accession=PF02470.10; Description=mce related protein
  Pfam module annotation: Pfam domain module=MCE::MCE; Domain location =102-184::220-301
MLYGVKIGQVISRRLDENGISFVAAINPEHRQLVHADSKFIVNSRLDVKFGLDGMQVLGASAREWVDGGIRLVPGAKGQPSSRYPLYADSERAAEGITGDQPPTTLKLTANSLPDVQAGSVVLYRKFQVGEVVDVVPRADAFEISVHIQPQYRKLLTSESVFWAEGGAKVQLNGSGLTVQASPLNRALKGAISFDNLTGAQAAKGVKRVLYPSETAARAVGSQITLHTFDASKLSAGMPIRYLGINVGQVESLALSQDNNQVVAKAVLYPEYVQDFARIGSRFSVVSPEISPAGVNHLETLLQ

SEQ ID NO: 213717 - protein, 549 aa, Glycine max
  Coding DNA Sequence Number=SeqID_96939
  Gene Ontology: Mol. function=peptidase activity
  Homolog annotation: Hit_ID=Q7CL70; Match level="QueryCoverage=59%, HitCoverage=68%, E-value=1e-139, Identity=76%"; Hit description =PmbA/TldD family protein
  Pfam annotation: Domain name=CN_hydrolase; Domain location=1-149; Score=4.9; E_value=3.7e-05; Accession=PF00795.12; Description=Carbon- nitrogen hydrolase
  Pfam annotation: Domain name=PmbA_TldD; Domain location=244-542; Score=376.4; E_value=4.3e-110; Accession=PF01523.7; Description =Putative modulator of DNA gyrase
  Pfam module annotation: Pfam domain module=CN_hydrolase::PmbA_TldD; Domain location=1-149::244-542
QAAQCRGKIGHDAGERADVRQLHSLSPTGGKTGRCPAAERGARTGAPLWRVVAGGLDALDQPRKPGAYHHQQPGEIRARYDKLHMFDVDINDAHAHYRESDTYQHGQHLTVVDTPVGRLGMTICYDLRFPALFQALRAQGAELISVPAAFTRVTGGAPRADPPHLGPHAGCRRLGQGAGREPGRRGGAEGARGHHKPAAPAATDAGAAAQPIPDVADGALLATNKLSHQDLYQVLGQLAERRIDYADLYFQSSYHEAWVIEDGIIKDGSYNIDQGVGVRAVSGEKTGFAYADQITLNALQQSAQAARSIVREQGDGRAHTLGEIGYRALYPLLDPLQSLPREEKIALLHRVDKVARAADARVQEVNASITGVYEQVLVAATDGTLAADVRPLVRLSVSVLVEQDGKRERGSSGGGGRFGYDYFLETVDGDVRAEAYAKEAVRMALVNLGAVAAPAGNMPVVLGAGWPGVLLHEAVGHGLEGDFNRRGTSVFSGHMGELVASELCTVVDDGTLQGRRGSLAIDDEGVPGQYNVLIENGVLKGYMQDKLNA

SEQ ID NO: 213718 - protein, 364 aa, Glycine max
  Coding DNA Sequence Number=SeqID_96940
  Gene Ontology: Mol. function=transferase activity, transferring glycosyl groups; Cellular component=membrane
  Homolog annotation: Hit_ID=O80941; Match level="QueryCoverage=99%, HitCoverage=70%, E-value=1e-117, Identity=54%"; Hit description =Putative zinc finger protein
  Pfam annotation: Domain name=DUF604; Domain location=128-364; Score =365.4; E_value=9.1e-107; Accession=PF04646.3; Description=Protein of unknown function, DUF604
MGGSAKSWQDHRHYTEVWWQPNVTRGFMWLEQEPLVLAKETWPETLPPYKVSGVTSSFMYTNKVGLQFAIHLARILKETFQLGLENVRWFVMGDNDTVFFTENLVTVLAKYDHNEMYYIEDNSESVEQNVAQTYGMAFGGGGFAISYPLAEVLVKILDGCINRYAVLFGSDQKVHACMSEIGVQLTKEPGFHQTDGLLAANPIAPLVSLHHLHASEPLFRDTGRVESLKRFVSAYKMDPGRILQKSICYDPNRNWTFSVSWGYNVELYRSLETSIELQTTFKTFQTWRGYEDPFTFNTRPVIPDQCKRPVVFFLDQIEDGGLGEWTESSYKIYDNVLLEKSNCSLEVQYVNVTASYFRPELWKK

SEQ ID NO: 213719 - protein, 71 aa, Glycine max
  Coding DNA Sequence Number=SeqID_96941
MELQRKDKSIRGERRRHPLENKPWKEKLHHQESALDKKLREEASMEEENEKEKGGLAHGKLPWEAKGRKLP

SEQ ID NO: 213720 - protein, 47 aa, Glycine max
  Coding DNA Sequence Number=SeqID_96942
MKFPTGENARNWVVNGMLKFHKDPTVNESKIVIFLRQHCDFSITLGF

SEQ ID NO: 213721 - protein, 85 aa, Glycine max
  Coding DNA Sequence Number=SeqID_96943
MRPSTLITTIGTLRYLNQNEQHYTTLCYPLFYFWKLCQNCSGHKYWNIALKVRSGRHGAIHITIDIKHSKVYKVSTTYLNQNETL

SEQ ID NO: 213722 - protein, 201 aa, Glycine max
  Coding DNA Sequence Number=SeqID_96944
MEKKKNKRIKSIGHRPATLRMKKEKELAKDGPSRWLRSEGFALLELIEYHGLKKLLEMKGTYYTDSVKIFYTITHIDGDTGLLDAEVKGQQIVMTPEVWLDIIRLSSEGVMENQLGLKEARFDFNKVEKHKSMMKNPSTYVVVVTKAMGKECFGIEPLMLEHMLLAYAVTWIITPRGRNHAQLTKEDLLLISLMQGKLKIN

SEQ ID NO: 213723 - protein, 339 aa, Glycine max
  Coding DNA Sequence Number=SeqID_96945
  Gene Ontology: Mol. function=nucleic acid binding; Cellular component= intracellular
  Homolog annotation: Hit_ID=Q1SVP5; Match level="QueryCoverage=91%, HitCoverage=91%, E-value=6e-65, Identity=49%"; Hit description=Zinc finger, C2H2-type
  Pfam annotation: Domain name=zf-C2H2; Domain location=80-102; Score =21.5; E_value=0.003; Accession=PF00096.16; Description=Zinc finger, C2H2 type
  Subcellular localization annotation: CTP_CleavageSite=42; ConfidenceScore=5.20e-01
MASSLLLLAKKMQKKGNLKPNTIQHTNKKGQCWTKRKKYSLSSSTGSPTNPSYGDSWEEQAFAEDAANSLGGCIWPPRSYSCSFCRREFRSAQALGGHMNVHRRDRARLKQQPTSPHNEILCHDLETQLHKPVQSPFASLGGYLYPSPLCGLACKKTNPNCDPDFVASPSSSPSPSKALLAPSANIGTFREETMIPLYDSSILHKISPASNSSESWPNSAEDHRLYSCKFHPQADTTKPSKGIMDFRCRGNKGNNDDIDGDINFNSVVYRTHPSLQFESTKEPDHISCKKRKTDASSTLFSPKSSSVDRHQVQPKMFEFSPSSMEELDLELRLGNRSKI

SEQ ID NO: 213724 - protein, 110 aa, Glycine max
  Coding DNA Sequence Number=SeqID_96946
MRGWCMMYPYVAITPNVIHMIFVRPSRLGRIGSSDWACSSQREWVWPYTITQTTHYSYHTQVHVVPADIHDTVCIEYTQWRLRGPRWPFGHVIRGDGGVPGTTEAIGTDA

SEQ ID NO: 213725 - protein, 197 aa, Glycine max
  Coding DNA Sequence Number=SeqID_96947
  Gene Ontology: Mol. function=nucleotide binding
  Homolog annotation: Hit_ID=Q67XL6; Match level="QueryCoverage=94%, HitCoverage=25%, E-value=2e-46, Identity=55%"; Hit description=MRNA, complete cds, clone: RAFL25-35-C17
  Pfam annotation: Domain name=DUF246; Domain location=1-197; Score= -71.4; E_value=1.7e-10; Accession=PF03138.5; Description=Plant protein family
MKVKSENNAKKASKYLALHLIFEIDMIAHSLCEFAGGEEERKELEAYREIHVPTLSLLKWTTKRHQFQFMKKSPLLVKNNWNLLCILPSPSKLRSEGLCPLTLEESILMLGALGFNRKMHIFVVGFNLYGGGSQLVALTNLYPKLVTKENLLSSAELESFANYSSQLAALDFIGCTASDAFAMTNSGSQLSSLVSRY

SEQ ID NO: 213726 - protein, 148 aa, Glycine max
  Coding DNA Sequence Number=SeqID_96948
MGQAVGMEDLPTPMYDFFALTEDDPYVSIAYAASVHDFMIPPIPPLCYPYAPIPYEGYGLIRANLLDDLPRLKLLMASFCDQDRWEVVSYLLSHLLQLSFDSFIDPQVQLAIMTTGSLLLSLQKLTSSMKCPKKIAIGSGALSAAKNS

SEQ ID NO: 213727 - protein, 223 aa, Glycine max
  Coding DNA Sequence Number=SeqID_96949
  Gene Ontology: Mol. function=RNA-directed DNA polymerase activity; Cellular component=extracellular region; Biological process=RNA -dependent DNA replication
MHEFWENDAIPRGGNSSFIALIPKRDNAQELVEFRPISLIGHMHDSVLVANEMVDDSRRGNKASLILEVDFEKAYDCMPGVYIYFGLGDPIAPFLFLIAAKGLSCLMRKALRSGMYSGYKVGRQQVEATLLQFANDMLLFADESIKNIMCVKAIMRCFELVSSLKVNFHKNSLEGVGMNTYVLHRREWFLWELPLVENFMADLRGVTLDQYVEDKVLWKNSST

SEQ ID NO: 213728 - protein, 70 aa, Glycine max
  Coding DNA Sequence Number=SeqID_96950
MSSWKIHSILNSQEVYMIVMLGLNSLMKDWKDVMALHAGVELGTPCAAHLVEGSDVEQPWDDVVCTQGRR

SEQ ID NO: 213729 - protein, 84 aa, Glycine max
  Coding DNA Sequence Number=SeqID_96951
  Gene Ontology: Mol. function=RNA-directed DNA polymerase activity; Cellular component=chromatin; Biological process=RNA-dependent DNA replication
MVWKGGFQRRTKRGITEEDLVGKFKVYCNASKQGLGCVLMHGGKVAAYASRQLIQHEVNYPTPDLELAAIVFALKIWRHYLYGA

SEQ ID NO: 213730 - protein, 224 aa, Glycine max
  Coding DNA Sequence Number=SeqID_96952
  Homolog annotation: Hit_ID=Q10PC8; Match level="QueryCoverage=88%, HitCoverage=30%, E-value=9e-27, Identity=38%"; Hit description =Hydroxyproline-rich glycoprotein family protein, putative, expressed
FVDERDGLIGWLRSEFAAANAIIDSLYHHLRVVGDPGEYDMVVGAIQQRRCNWNQVLMMQQYFSVADVAYALQQVAWRRQQRPLDPMKVGAKEVRKSGSGYRHGQRFESVKEGYNSSVESYSHDANVAVTGGTEKGTPVVEKSEEHKSGGKVEKVGDKGLASVEEKKDAITNHQSEGSLKSARSTEGSLSNLESEAVVNDGCISNSKGFLPPDNDDSEDIIYLV

SEQ ID NO: 213731 - protein, 481 aa, Glycine max
  Coding DNA Sequence Number=SeqID_96953
  Gene Ontology: Mol. function=chitin binding; Cellular component =extracellular region; Biological process=chitin metabolic process
  Homolog annotation: Hit_ID=UPI00006A17C9; Match level="QueryCoverage =94%, HitCoverage=100%, E-value=1e-55, Identity=33%"; Hit description= UPI00006A17C9 related cluster
MPSEDSTSSPSEDCMSTTLEGYTPSPSKHYMPSPSEDYSSSPLEDYRSSPIEGYTPSLSEGYTSSPSEDLHALAFRRLHVLAFRGLHVLTFIGLHHILAFRGLHVLVFRGLHALAFRGLQVLAFRGLHVLSIRGLQVLAFRGLHALALRGLHVHVFIGLHAHAFRGLHALPFRGLHILTFRGLQVLAIRGLHAYAFRGLHAFAFRGLHALAFRGLHAIAFTGLHGLTFRRLHALAFRRLHVLAIGGLYVLAIRGLHGLTIRGLHVLAFRGLHALAFRGLHVLAFIVLHVLAFSGKHALAFIGLHVLIFRELRALAFRGLRVLALRGLHGLALRRLGLHILIFRGLHLLAIRGLHASTFRGLHAFAFRGLHALAFRGLHVVAFSGLDALAFRGLHVLALRGLHVLTFIGLHVLAFRGQHVLIFRGLHALAFRGLHVLAFTGLHRAAHPRLRRTTSPRLQRASRPRLQRTTRPPIQRDARPRL

SEQ ID NO: 213732 - protein, 74 aa, Glycine max
  Coding DNA Sequence Number=SeqID_96954
MTFGRVIASEHPGDYRGSIKLSLVPGLLQHYVLCAFCILGVQNSVWGKLHVLMCYTCTAICKPSIHDADSILDN

SEQ ID NO: 213733 - protein, 225 aa, Glycine max
  Coding DNA Sequence Number=SeqID_96955
  Gene Ontology: Mol. function=chitin binding; Cellular component =extracellular region; Biological process=chitin metabolic process
  Homolog annotation: Hit_ID=UPI000044A8F0; Match level="QueryCoverage =97%, HitCoverage=99%, E-value=3e-37, Identity=33%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MRGLQVLAFRGLHALAFKGLHVLAFRGLHALAFRGRHVLAFRGLHVLAFIGLHHVLAFRGLHVLAFRGLHALPFKGLHVLAFRGLHALAFRGLKVLVFRGLHAIAFRGLHILAYRGLHVLAFTGLHVLAIRGKHVLAFIGLHVLVFRGLRALAFRGLHVLALRGLHALALRGLGLHVLAFRGLHVLAFRGLHVIAFRGLHVLAFRGLHALAFRGLLDFRGLHVLP

SEQ ID NO: 213734 - protein, 101 aa, Glycine max
  Coding DNA Sequence Number=SeqID_96956
  Homolog annotation: Hit_ID=Q9LL80; Match level="QueryCoverage=37%, HitCoverage=11%, E-value=6e-14, Identity=97%"; Hit description =Putative purple acid phosphatase
MAYGMVNPECTPFLTSGMINPEGKIKTLQKGCRKQLGGAGSNSHDNGEAKESMLKNPNPNNGGSKLESLQHAPKADGSLSFLVVGDWGRKGAYNQSLVAFQ

SEQ ID NO: 213735 - protein, 76 aa, Glycine max
  Coding DNA Sequence Number=SeqID_96957
MDDRWGEPDAGFDEHGVTLPNMDTQDTLFPFISPTKPLLGRGHRTKQPSTRSQDYVTNTTKRLSPSNCSPSPKADS

SEQ ID NO: 213736 - protein, 147 aa, Glycine max
  Coding DNA Sequence Number=SeqID_96958
  Homolog annotation: Hit_ID=Q0K3P6; Match level="QueryCoverage=70%, HitCoverage=21%, E-value=3e-07, Identity=37%"; Hit description =Cation/multidrug efflux system outer membrane porin precursor
MHRETGNDSMLRRKRGWACGMLMVYAQAISAGEATSARGQLIPPEPGAVQSSFNQALLGQLTLRQAEQLFASGNRELLAAKRAVEGAEANTLIAGQRPNPVLSLGLSSVNVNRGQGNMNQNGANGVWDKTYNSALQVSQLYERGNKP

SEQ ID NO: 213737 - protein, 162 aa, Glycine max
  Coding DNA Sequence Number=SeqID_96959
  Gene Ontology: Mol. function=protein disulfide oxidoreductase activity; Biological process=intracellular signaling cascade
MTTTYFKPKPISQTQILLSPLILLLSSAFDHYQSCNHIHSSSSTFGKFLRQHSNDLSSTINKGISTLKHSINDQNDFKKNQKDYNCVMEFNLSAPTYGFDEAVEVEEAVVAKEIGRVVRVLRQRLPIQDWLMKMKIARNCFAGSDLVEFLVRYHGCAPSKVH

SEQ ID NO: 213738 - protein, 176 aa, Glycine max
  Coding DNA Sequence Number=SeqID_96960
  Gene Ontology: Mol. function=protein binding; Cellular component =integral to membrane; Biological process=protein amino acid phosphorylation
  Homolog annotation: Hit_ID=Q1SWI7; Match level="QueryCoverage=72%, HitCoverage=23%, E-value=2e-39, Identity=64%"; Hit description =Leucine-rich repeat
  Pfam annotation: Domain name=LRR_1; Domain location=19-41; Score =16.6; E_value=0.091; Accession=PF00560.23; Description=Leucine Rich Repeat
  Pfam annotation: Domain name=LRR_1; Domain location=43-64; Score=8.5; E_value=7.5; Accession=PF00560.23; Description=Leucine Rich Repeat
  Pfam annotation: Domain name=PAR1; Domain location=62-173; Score= -101.9; E_value=0.019; Accession=PF06521.2; Description=PAR1 protein
  Pfam module annotation: Pfam domain module=LRR_1::LRR_1::PAR1; Domain location=19-41::43-64::62-173
MSHNQLIGHIPQGIGNMRSLQSIDFSRNQLSGEIPPTIANLSFLSMLDLSYNHLKGNIPTGTQLQTFDASSFIGNNLCGPPLPINCSSNGKTHSYEGSHGHGVNWFFVNHGGMPIFISLIMCGSNFNLFAQVCFFPNCANARRQMGEIKSSGMVAPAPFDAVELSDEPAVAPFPQY

SEQ ID NO: 213739 - protein, 411 aa, Glycine max
  Coding DNA Sequence Number=SeqID_96961
  Homolog annotation: Hit_ID=Q9SWB3; Match level="QueryCoverage=83%, HitCoverage=98%, E-value=1e-110, Identity=50%"; Hit description=Seed maturation protein PM39
  Pfam annotation: Domain name=CAP160; Domain location=104-130; Score =43.5; E_value=7.2e-10; Accession=PF07918.2; Description=CAP160 repeat
  Pfam annotation: Domain name=CAP160; Domain location=131-153; Score =26.8; E_value=7.8e-05; Accession=PF07918.2; Description=CAP160 repeat
  Pfam annotation: Domain name=CAP160; Domain location=163-189; Score =38.1; E_value=3e-08; Accession=PF07918.2; Description=CAP160 repeat
  Pfam annotation: Domain name=CAP160; Domain location=50-82; Score =4.3; E_value=19; Accession=PF07918.2; Description=CAP160 repeat
  Pfam module annotation: Pfam domain module=CAP160::CAP160::CAP160::CAP 160; Domain location=104-130::131-153::163-189::50-82
MSWGGPRHEHGRTLWSVQRVQDEKMEDLEMDLMEWAMLTPELSFSTEPNIQHTSTKIHDQHLPQQFATSAKSTVTSKLVYDADTETTRSRDHQENTGSAKPSTISSATSAIADKAMSAKNTVSSKLGYGQQLAIADKAVSAKNTVASKLGYGNNTETKTTQTTQSATSAIADKAFSAKNTVASKLGFGDTATTTPQEKRTDHAAAPTEYGKSVAQSLTEKLAPVSGKVAGVGSGVKSKVSGTQTSSVGVEQDKGVSVKDYLVDKLRPGDEDRALSEVISETLHKKELPPVEVTEEGVRKVVSDAVHKREDDPERRMEHQRILGKVTESEEVKRRLGGESVVTEKKYQEMYVNSPGKGVVDKLKGMVGTWFTNPAENQSSQDSSMNYEAGRAEVEQVNQGAAGERRLQESSN

SEQ ID NO: 213740 - protein, 66 aa, Glycine max
  Coding DNA Sequence Number=SeqID_96962
MGQNTPNKIDDDGSISHQGYLAPFVAQYVKSRDVPKIKRKQAYAIRENSGCDENRKGVFFAIREFS

SEQ ID NO: 213741 - protein, 100 aa, Glycine max
  Coding DNA Sequence Number=SeqID_96963
MTIVSHRGIVRIYMKYKQRHMLFDLCESDLPRDIPRRSSSLFYVVLFLNSNKSGHLLNIACWTLGKDLPQRDMLSPQQIYKAKDLGVKKNSPQRVINSPQ

SEQ ID NO: 213742 - protein, 739 aa, Glycine max
  Coding DNA Sequence Number=SeqID_96964
MADDKLSFECLDRLEALIANLIAAQLHSIVILDSIVSKLNAILLKRHISILSSSSINSHHVDEEVPNDTVEELVSMGSSELSSEVPPLPITHGAAQAVWLPSRPVSTSEFSAKLPPLCFALTTHTTATATTTATRSPYGSVIWHSGVANAFGPCATTRYSLASLPRPLYPPSSPPPPLKPPPPPRAWSARVCALWTVMFGRQGLGRANRFSQLSLPLGAAARAAGVSTSHNQAEERRRDGIDALRHRSPPSPLTFRMLVTLEDYYWRGNVMNQPSDKPNHEEASANRIGAGLLSWHCGIGPLDDPVGNMLFLNSGPRTPETPAPITISIVRVRTLKAGFEGNDLQKEEKEGKHKEYSSNRIRFANLPMREQNATSRIWCRSSYFSLPKLPSNVVFKRVRNNSSLSAMLPYHSLPHQKHLVRKALGFQTKAFKNNIGVPRLMPMKCTRKSSNRQARNTLIVPIEVAKLVLGKKTQSDGVLALQFHEASVMKEHHAAGVGFGFGSGVGFGSGPSDTGVASFGLGYAVLRPNGLWHSSCSWREANSSGVRRLTVGACDGGGEEGSKWGKGVIRGETKGADGGATSGGVCGHGGGRQRSDNCYFWSFARPAAWSTGVGKPIILLTKSSNSFRNKGGVVRNWCGFRCGGERHRSMAVKKLVHVEGHRVHVIVKTSNGLVEAGFEGNDLQKEEKEGKHKIFLFFSSETALKRSLQGMWALVPSSCSWSLLPSTPLMLVLPVFMAF

SEQ ID NO: 213743 - protein, 180 aa, Glycine max
  Coding DNA Sequence Number=SeqID_96965
  Gene Ontology: Mol. function=oxidoreductase activity; Biological process=flavonoid biosynthetic process
  Homolog annotation: Hit_ID=Q1SVN8; Match level="QueryCoverage=85%, HitCoverage=86%, E-value=4e-30, Identity=63%"; Hit description =Aldo/keto reductase
  Pfam annotation: Domain name=Aldo_ket_red; Domain location=17-177; Score=11.0; E_value=6.8e-10; Accession=PF00248.11; Description =Aldoketo reductase family
MWRERGARKGHDSPILFSKSQFKIPSTGLGTFSVDPAIVTTAIKVGYRLIDCAESYFNQAEIGSTQENFEDGVVKREDLWITSKLRFYCLLTLLKIGFSPLGSQGFLNSDVLKNPVINFVAEKLGKTPAQVSLRWGIQTGHSVLPKTSNEARIKENFDVFNWSIPEELIAKFTEIKQASS

SEQ ID NO: 213744 - protein, 378 aa, Glycine max
  Coding DNA Sequence Number=SeqID_96966
  Gene Ontology: Mol. function=RNA-directed DNA polymerase activity; Biological process=RNA-dependent DNA replication
MAATKKEEENFQLYEGSHLEGINHWSSKHFSKLGTEILIKSVTQAIPSYYMSAFLLSSSLGKQGWKFFTDQNAIPHLFFRVVVKKGLRWPLGDGEKINVWNDPCLRSSDNPYVQSAPIDGSEELRVCDLIDATTNTWKQGIIKDIFNEKLRLLEACQYTSSRVMVWTCSNTWHHVSPIIADAESLNDCIFSLLRTLDGDQIANVASVLWCLWQRRNDNVWNNVEKPPQLSLNMATGYIRQSQVACKHFHSSTTTRALPNNTIPRWMKPELGFIKCNVDASISSEARQFMLGGCICNSNGEFMLARTSFSHGNIPAAEAEASSFLAAAHWVSQMGLTHPSDKPNHEEASTNRIGARLLSWHCGIGPMGDPVGNMLFLLG

SEQ ID NO: 213745 - protein, 491 aa, Glycine max
  Coding DNA Sequence Number=SeqID_96967
  Gene Ontology: Mol. function=RNA-directed DNA polymerase activity; Biological process=RNA-dependent DNA replication
MTMVIETITMIVVAITMTTTMLVVAVMMVDDHGGGCDDGHGNCDRNNITVIIFLHPEGLVGKMMGKWKAVEFTVEEENDGELESFQINHCISMERKKSFDHLLNECETHKRGEEDEDNLVLPYRVWMKASLQKNTGSKNHEDIVGEMTTTLMECKITTKGGGHIREKGSTEHHEHLIRGNNLVIQWPIEGVTLGAKMDGEAKTIGGKNTRTWKRTARTFVPHKRRWMKTWGKEKKGGKLKKWKLNPMIKDDVGNLFTNEEDIGEVLIGFFSDLFTSPNPSNMDDVASIVDNRVDAHGKNHLTRDFTEKEVKETPFQMHPTKAPREDDGDPPTMNKNLFFLIPKCKKPMHESEYRPISLCNVIFKIITKAIANRLEPILPDIVKENQSVFVPNRHIMDNALIAFDIFHCMKKEKTASVISNLFFANDSIIFARATLEEITHLLAILKTYEAASGKKAREGSMTYLGILTIIDRSKTQVFNFVLERVWKKLKG

SEQ ID NO: 213746 - protein, 211 aa, Glycine max
  Coding DNA Sequence Number=SeqID_96968
  Gene Ontology: Mol. function=oxidoreductase activity; Cellular component=apical plasma membrane; Biological process=flavonoid biosynthetic process
  Homolog annotation: Hit_ID=Q1SVN8; Match level="QueryCoverage=92%, HitCoverage=64%, E-value=1e-76, Identity=71%"; Hit description =Aldo/keto reductase
  Pfam annotation: Domain name=Aldo_ket_red; Domain location=1-208; Score=171.0; E_value=2.9e-48; Accession=PF00248.11; Description =Aldoketo reductase family
MRSSAFLTTSRCTDHAPEALDRALKELQLDYLDLYLIHFPVRMKKGSVGLKPEKVIQHDIPSTWRAMEALFYSGKVRAIGVSNFSSKKLQDLLDMARVPPAVIQVECHPQWQQPKMHAFCESKGIHLTGYSPLGSGDASGDILKYPVLKEVAEKLGKTPAQVALRWGLHVGHSVLPMSSNEVRIKENLDVFDRPIPEDLMAKFSEIKQAST

SEQ ID NO: 213747 - protein, 39 aa, Glycine max
  Coding DNA Sequence Number=SeqID_96969
MAAATAKVAELATIVLVSTTVIMVVIMMVVGSNGDDEIL

SEQ ID NO: 213748 - protein, 64 aa, Glycine max
  Coding DNA Sequence Number=SeqID_96970
MGDLESILACAFWVIRKEPSPTLAPPNSHPNSWSSPLESQGVKINYDAAIKHGINGNRIEKEER

SEQ ID NO: 213749 - protein, 306 aa, Glycine max
  Coding DNA Sequence Number=SeqID_96971
MAKKSNQGWESKDPSVCPHQLSDLRRDDVAKGKDILGLGQVGHGLPPNPPWSTMRHLEAFAQHTQFGHYQRVVLGDFRPLVIQCELVVGALWVIGVGVEFHHQCLINIVLGKSGECLIPLSALYLILDNIDLPIFKEGSPLWTQVSLDGHILKGFLRNLSGEYGGILLNFELCPLSNDNTPLGGFRSLPFGSGRINEHSLFVKSISKKWDEISSQVLKLWPLKECSHFFASPTKKNENKLRGITSSGTPTILIVLQISILQVSPRFSPLPPLVAPQKKEEAKRLVIVEEVTMVVVEKMKKLLELVA

SEQ ID NO: 213750 - protein, 194 aa, Glycine max
  Coding DNA Sequence Number=SeqID_96972
  Gene Ontology: Mol. function=RNA-directed DNA polymerase activity
MSPFMIMLHGKIDGNLVLGINIVPNLIIAMMPNVPKKHNKLYLDTLRELMEEFEHRTFDGFGNLDFIGYWWYDERTRYCPLVLCFGAMLPNYSIIKISVEKRNCLNGLSIVWIEYLINDFKPPRRICMINEDTYWDVFESRWRWCGDERVVGVLESALRPNIYLVIVSQFPLKTFLDQYLRGMDVTPYTARIET

SEQ ID NO: 213751 - protein, 177 aa, Glycine max
  Coding DNA Sequence Number=SeqID_96973
MSESHFLSLSPPQPYPSHTRHLLCQPKKLKVAPKKLVPRVFRGDGLVGNLVQLEHEVVHERVDARAQVAVGAAMPHREDDENCFLGGWCREGVPGGTKHMDTNRGQAVVDMHVPLLLMHISNNGVCVGVGEGSTICYGVVGEAAATAEMAVATMTVGVGEAAVGIDLPGITSFPRKG

SEQ ID NO: 213752 - protein, 82 aa, Glycine max
  Coding DNA Sequence Number=SeqID_96974
MPLPCFLRRAYDNRCQNRIIKGVAAGVAEEDGGALHRDGAALLLIQVVHEALLFLNVSLSDQRPIVSYASPFHTSLFMFIHS

SEQ ID NO: 213753 - protein, 489 aa, Glycine max
  Coding DNA Sequence Number=SeqID_96975
  Gene Ontology: Mol. function=nucleic acid binding; Cellular component= chromatin; Biological process=DNA integration
  Pfam annotation: Domain name=zf-CCHC; Domain location=19-33; Score =11.6; E_value=0.012; Accession=PF00098.13; Description=Zinc knuckle
  Pfam module annotation: Pfam domain module=RVT_2::zf-CCHC; Domain location=199-328::19-33
PKKNFKKGEPSSSNGYNSFKCEKIGHIMVDCPIYQKKLQEDKKNKGSFKKKKNTYIAWDNDESTTSSDNSEEDEENLCLMPNNEDRSEVIISDLEDDDKYGVPSGKYNWDPKGNNKVFLVADKQLWYLDSGCSRHMIGNKSNFMSLKSKEGRFVTYGDIANGVSTRHSLNLFSEIYEFVSMVEPSTIEEALLDEHWVMAMHDELNLLKKNEVCELVPRPSYNKQRGTDFGETYALVARLEVEIYVSQTPDFEDNKNLTHVYKLKKANKHQDNGEFEISMMGEMNYFLGLQVRQMNHGTFLHQTKYCKEILKKFYMDKRKEAATLMATNCYLSMDEKGKLIDQTKYRGIIGSLLYLTASRPNIMFSIFMCAHYQSCPKESHFSTIKRVMKYLRGTLDVGLWYPKGVEISLRGYFDFDFGECKLDKKSTSDICNLLGRHGLVSWNSMKQACVALSMSEAKYIVAWSYCAQILWPKQQLSDFRLNLEHISLR

SEQ ID NO: 213754 - protein, 338 aa, Glycine max
  Coding DNA Sequence Number=SeqID_96976
  Subcellular localization annotation: CTP_CleavageSite=53; ConfidenceScore=5.05e-01
MAEKKNKRIKSIGHRPTTPKMKKEKVPTKGGPSSRGKWIACSPSPPTTLKATPCYAKTEMIQLKYVSLAWLKSEGFVFPELIEYHGLKKLVDMKGTYYTDLVKKIYTTTHTDDDIGFSCVEVQGKQIVMTLEVWCYDEPTSSQGIGFVFNNIGKYKSTMKNPSTNVAVVTKAKGKECFGTGPLMLEHRLLAYVVAWIITPRGSNHAQLTEEDLLLISLMQGKLKINWVNIIVDIMLKTKRIRSLKCPYVVLISRILDYFGVDTQEEVIGIAWIEKSREDQTKQEEAEENHISPFEQMMLAKMNEFMKVHKEDYAKLKECFKSISERMDVMGAPHVDDI

SEQ ID NO: 213755 - protein, 574 aa, Glycine max
  Coding DNA Sequence Number=SeqID_96977
  Gene Ontology: Mol. function=binding; Cellular component =intracellular; Biological process=metabolic process
  Homolog annotation: Hit_ID=Q337S8; Match level="QueryCoverage=96%, HitCoverage=90%, E-value=9e-89, Identity=31%"; Hit description =Pentatricopeptide, putative
  Pfam annotation: Domain name=PPR; Domain location=165-199; Score =25.1; E_value=0.00025; Accession=PF01535.11; Description=PPR repeat
  Pfam annotation: Domain name=PPR; Domain location=267-301; Score =41.5; E_value=2.8e-09; Accession=PF01535.11; Description=PPR repeat
  Pfam annotation: Domain name=PPR; Domain location=338-372; Score=3.5; E_value=2.9; Accession=PF01535.11; Description=PPR repeat
  Pfam annotation: Domain name=PPR; Domain location=35-69; Score=3.8; E_ value=2.7; Accession=PF01535.11; Description=PPR repeat
  Pfam annotation: Domain name=PPR; Domain location=404-438; Score =13.3; E_value=0.2; Accession=PF01535.11; Description=PPR repeat
  Pfam module annotation: Pfam domain module=PPR::PPR::PPR::PPR::PPR; Domain location=165-199::267-301::338-372::35-69::404-438
MVECDENVNEAAMSMSMDPRARHAQAITSHIKDRAVWNNLITHYSKSDLSSYAVSLFQRLPFPPNVVSWTALISAHSNTLLSLRHFLAMLRHNTLPNHRTVASLFTTCAALTAVSFALSLHSLALKLSLSQHPFPASSLLSLYAKLRMPLNARKVFDEIPQPDNVCFSALIVALAQNSRSVDASSVFSEMRGRGFASTVHSVSGVLRAAAQLAALEQCRMMHAHAVVLGLDSNVVVGSALVDGYGKAGVVNDARRVFEDNLDDMNVVGWNAMMAGYAQQGDYQSAFELFESLEGCGLVPDEYTFLAILTALCNAGMFLEIAPWFTRMRVDYGLEPSLEHYTCLVGAMARAGELERAERVVLTMPIEPDAAVWRALLSVCAYRGEADKAWSMAKRVLELEPNDDYAYVSVANVLSSAGRWDDVAELRKMMKDRRVKKKGGRSWIEVQGEVHVFVAGDWKHERSKEIYQKLAELMGDIEKLGYVPVWDEVLHNVGEEKRKEALWYHSEKLAVAFGVLCGPAPPGKPLRIVKNLRICKDCHEAFKYMTRVIEREIIVRDVNRYHRFVNGNCTCSDIW

SEQ ID NO: 213756 - protein, 72 aa, Glycine max
  Coding DNA Sequence Number=SeqID_96978
MKWRSHVFGISEEVLRGGKLRLALSKHALITLLTAEEVKISTPFAALGENYYYKISNRIITMTSVEVSGKYT

SEQ ID NO: 213757 - protein, 308 aa, Glycine max
  Coding DNA Sequence Number=SeqID_96979
  Homolog annotation: Hit_ID=Q8LKV1; Match level="QueryCoverage=89%, HitCoverage=98%, E-value=3e-90, Identity=60%"; Hit description=GAGA -binding protein
  Pfam annotation: Domain name=DUF1004; Domain location=194-308; Score =331.1; E_value=1.9e-96; Accession=PF06217.3; Description=Protein of unknown function (DUF1004)
MGIGDMHVFWIVVAFRSWGFRFAAIRSIVMDDDVLNMPNWGYYEPFRGGHLGLQLMPGMTERDTKPFLPGRDPAMLMGANGTFHPRDCVVSEAPMPLNYVRDSWINQRDRFFHMQQPTNPNYAVLPETSGAPNLKIIQPPDTSRDEKVDRVEEVVVKKELGKSKKRHTKGALSTPKAKKPRKPKDNSNVPVQRAKPPKKTMELVINGIDMDISDLPIPVCSCTGAPQQCYRWGCGGWQSACCTTNVSIYPLPMSMKRRGARIAGRKMSQGAFKKVLEKLAAEGYNFANPIDLKTHWARHGTNKFVTIR

SEQ ID NO: 213758 - protein, 404 aa, Glycine max
  Coding DNA Sequence Number=SeqID_96980
  Gene Ontology: Mol. function=phospholipid binding; Cellular component= coated pit; Biological process=endocytosis
  Homolog annotation: Hit_ID=Q9FRH3; Match level="QueryCoverage=99%, HitCoverage=100%, E-value=2e-81, Identity=40%"; Hit description =Putative clathrin assembly protein At1g25240
  Pfam annotation: Domain name=ANTH; Domain location=30-298; Score =197.8; E_value=2.7e-56; Accession=PF07651.6; Description=ANTH domain
MRVFERASGAIKDKNSIWAAKFSRKGPLHNPDLETVVIKATSHDDHHIDSKNVQRVFQWLRTSPLYLKPLVWALSMRMQKTRSWVVALKGLMLIHGIYCCDIPVVNRMGRLPFDLSNFSDGHLSPAKAWSFNGFVRAYFAYLDQRSSFVSSEVKQKKNVSNNKKTEEVEETLMEELEKLQKLQGMIDMLLQIRPKDENLNIGLILEAMDCIIVEVFGVYSKFCNKIAKVLVRIYEVGGKMEANIGLQVLQKASIQVEEISLFFDLCKDIGVLNASQCPKIDRISPEDIQDLERIINGASSKKGCGFVGNDEDNNKAIVVRDCSSTAMVSQQEESENGLMTVITQQWEVFDDDHVIVGAKGMDNVSNNGAKDIIGTTTNPFEESYSIVPYVPVHHHQALPDLISW

SEQ ID NO: 213759 - protein, 1136 aa, Glycine max
  Coding DNA Sequence Number=SeqID_96981
  Gene Ontology: Mol. function=protein serine/threonine kinase activity; Cellular component=integral to membrane; Biological process=protein amino acid phosphorylation
  Homolog annotation: Hit_ID=Q9ZPS9; Match level="QueryCoverage=96%, HitCoverage=96%, E-value=0.0, Identity=68%"; Hit description =Serine/threonine-protein kinase BRI1-like 2 precursor
  Pfam annotation: Domain name=LRRNT_2; Domain location=36-76; Score =60.6; E_value=5e-15; Accession=PF08263.3; Description=Leucine rich repeat N-terminal domain
  Pfam annotation: Domain name=LRR_1; Domain location=105-126; Score =2.1; E_value=1.1e+02; Accession=PF00560.23; Description=Leucine Rich Repeat
  Pfam annotation: Domain name=LRR_1; Domain location=129-152; Score =8.9; E_value=6; Accession=PF00560.23; Description=Leucine Rich Repeat
  Pfam annotation: Domain name=LRR_1; Domain location=154-177; Score =17.6; E_value=0.046; Accession=PF00560.23; Description=Leucine Rich Repeat
  Pfam annotation: Domain name=LRR_1; Domain location=179-202; Score =11.0; E_value=2.5; Accession=PF00560.23; Description=Leucine Rich Repeat
  Pfam annotation: Domain name=LRR_1; Domain location=203-225; Score =16.9; E_value=0.074; Accession=PF00560.23; Description=Leucine Rich Repeat
  Pfam annotation: Domain name=LRR_1; Domain location=227-249; Score =18.1; E_value=0.031; Accession=PF00560.23; Description=Leucine Rich Repeat
  Pfam annotation: Domain name=LRR_1; Domain location=251-273; Score =14.9; E_value=0.29; Accession=PF00560.23; Description=Leucine Rich Repeat
  Pfam annotation: Domain name=LRR_1; Domain location=276-298; Score =16.7; E_value=0.084; Accession=PF00560.23; Description=Leucine Rich Repeat
  Pfam annotation: Domain name=LRR_1; Domain location=300-323; Score =11.5; E_value=2; Accession=PF00560.23; Description=Leucine Rich Repeat
  Pfam annotation: Domain name=LRR_1; Domain location=325-347; Score =15.4; E_value=0.21; Accession=PF00560.23; Description=Leucine Rich Repeat
  Pfam annotation: Domain name=LRR_1; Domain location=349-372; Score =7.3; E_value=12; Accession=PF00560.23; Description=Leucine Rich Repeat
  Pfam annotation: Domain name=LRR_1; Domain location=374-396; Score =13.4; E_value=0.83; Accession=PF00560.23; Description=Leucine Rich Repeat
  Pfam annotation: Domain name=LRR_1; Domain location=398-420; Score =13.0; E_value=1.1; Accession=PF00560.23; Description=Leucine Rich Repeat
  Pfam annotation: Domain name=LRR_1; Domain location=422-444; Score =8.3; E_value=8; Accession=PF00560.23; Description=Leucine Rich Repeat
  Pfam annotation: Domain name=LRR_1; Domain location=446-468; Score =14.9; E_value=0.29; Accession=PF00560.23; Description=Leucine Rich Repeat
  Pfam annotation: Domain name=LRR_1; Domain location=470-492; Score =15.6; E_value=0.19; Accession=PF00560.23; Description=Leucine Rich Repeat
  Pfam annotation: Domain name=LRR_1; Domain location=494-516; Score =15.3; E_value=0.22; Accession=PF00560.23; Description=Leucine Rich Repeat
  Pfam annotation: Domain name=LRR_1; Domain location=518-537; Score =14.4; E_value=0.41; Accession=PF00560.23; Description=Leucine Rich Repeat
  Pfam annotation: Domain name=LRR_1; Domain location=610-632; Score =16.7; E_value=0.083; Accession=PF00560.23; Description=Leucine Rich Repeat
  Pfam annotation: Domain name=LRR_1; Domain location=634-656; Score =19.0; E_value=0.017; Accession=PF00560.23; Description=Leucine Rich Repeat
  Pfam annotation: Domain name=LRR_1; Domain location=658-680; Score =13.1; E_value=1; Accession=PF00560.23; Description=Leucine Rich Repeat
  Pfam annotation: Domain name=LRR_1; Domain location=682-704; Score =8.3; E_value=8.1; Accession=PF00560.23; Description=Leucine Rich Repeat
  Pfam annotation: Domain name=LRR_1; Domain location=79-103; Score =7.0; E_value=14; Accession=PF00560.23; Description=Leucine Rich Repeat
  Pfam annotation: Domain name=Pkinase; Domain location=837-1121; Score= 134.8; E_value=2.4e-37; Accession=PF00069.15; Description=Protein kinase domain
  Pfam annotation: Domain name=Pkinase_Tyr; Domain location=837-1121; Score=120.7; E_value=4e-33; Accession=PF07714.7; Description=Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR_1::LRR_ 1::...
  Pfam module annotation: Pfam domain module=Pkinase::Pkinase_Tyr; Domain location=36-76::105-126::129-152::154-177::179-202::203 -225::227-249::251-273::276-298::300-323::325-347::349-372::374 -396::398-420::422-444::...
  Pfam module annotation: Domain location=446-468::470-492::494 -516::518-537::610-632::634-656::658-680::682-704::79-103::837 -1121::837-1121
MENNHVQLLVHLTVTLLLVITVLFPLTEGAAAVSSIKTDAQALLMFKRMIQKDPSGVLSGWKLNKNPCSWYGVTCTLGRVTQLDISGSNDLAGTISLDPLSSLDMLSVLKLSLNSFSVNSTSLVNLPYSLTQLDLSFGGVTGPVPENLFSKCPNLVVVNLSYNNLTGPIPENFFQNSDKLQVLDLSSNNLSGPIFGLKMECISLLQLDLSGNRLSDSIPLSLSNCTSLKNLNLANNMISGDIPKAFGQLNKLQTLDLSHNQLIGWIPSEFGNACASLLELKLSFNNISGSIPSGFSSCTWLQLLDISNNNMSGQLPDSIFQNLGSLQELRLGNNAITGQFPSSLSSCKKLKIVDFSSNKFYGSLPRDLCPGAASLEELRMPDNLITGKIPAELSKCSQLKTLDFSLNYLNGTIPDELGELENLEQLIAWFNGLEGRIPPKLGQCKNLKDLILNNNHLTGGIPIELFNCSNLEWISLTSNELSGEIPREFGLLTRLAVLQLGNNSLSGEIPSELANCSSLVWLDLNSNKLTGEIPPRLGRQQGAKSLFGILSGNTLVFVRNVGNSCKGVGGLLEFSGIRPERLLQVPTLRTCDFTRLYSGPVLSLFTKYQTLEYLDLSYNELRGKIPDEFGDMVALQVLELSHNQLSGEIPSSLGQLKNLGVFDASHNRLQGHIPDSFSNLSFLVQIDLSNNELTGQIPSRGQLSTLPASQYANNPGLCGVPLPDCKNDNSQPTTNPSDDISKGGHKSATATWANSIVMGILISVASVCILIVWAIAMRARRKEAEEVKILNSLQACHAATTWKIDKEKEPLSINVATFQRQLRKLKFSQLIEATNGFSAASLIGCGGFGEVFRATLKDGSSVAIKKLIRLSCQGDREFMAEMETLGKIKHRNLVPLLGYCKVGEERLLVYEYMEYGSLEEMLHGRIKTRDRRILTWEERKKIARGAAKGLCFLHHNCIPHIIHRDMKSSNVLLDHEMESRVSDFGMARLISALDTHLSVSTLAGTPGYVPPEYYQSFRCTAKGDVYSFGVVMLELLSGKRPTDKEDFGDTNLVGWAKIKICEGKQMEVIDNDLLLATQGTDEAEAEAKEVKEMIRYLEITMQCVDDLPSRRPNMLQVVAMLRELMPGSTDGSSNSA

SEQ ID NO: 213760 - protein, 485 aa, Glycine max
  Coding DNA Sequence Number=SeqID_96982
  Gene Ontology: Mol. function=phosphopantetheinyltransferase activity; Cellular component=integral to membrane; Biological process =macromolecule biosynthetic process
  Homolog annotation: Hit_ID=Q8H012; Match level="QueryCoverage=87%, HitCoverage=71%, E-value=1e-179, Identity=72%"; Hit description =Putative endosomal protein
  Pfam annotation: Domain name=EMP70; Domain location=1-399; Score =642.0; E_value=5e-190; Accession=PF02990.7; Description=Endomembrane protein 70
  Pfam annotation: Domain name=Oxidored_q3; Domain location=182-381; Score=-32.0; E_value=0.055; Accession=PF00499.10; Description=NADH -ubiquinoneplastoquinone oxidore
  Pfam module annotation: Pfam domain module=EMP70::Oxidored_q3; Domain location=1-399::182-381
MYYDDLPIWGFIGTVDKEGKTDPSEYKYFLYKHIQFDIHYNKDRVIEISARMDPHSVVDLTEDKDVDVEFVYTAKWKETETPFEKRMDKYSQSSSLPHHLEIHWFSIINSCVTVLLLTGFLATILMRVLKNDFMKYAQDEEAADDQEETGWKYIHGDVFRFPKFKSFFSAALGSGTQLFTLTIFIFMLALVGVFYPYNRGALFTALVVIYALTSGIAGYTATSFYIQLEGTNWVRNLLLTGCLFCGPLFLMFCFLNTVAIAYSATAALPFGTIVVIVLIWTLVTSPLLVLGGIAGKNSKTEFQAPVRTTKYPREIPPLPWYRSTIPQMAMAGFLPFSAIYIELYYIFASVWGHRIYTIYSILFIVFIILLIVTAFITVALTYFQLAAEDHEWWWRTGTDRIVVVRKWAACAQESLARLDFGGWLDEMRPYLGKKREAQQMILAHLFSCIALSGFETFGACSSTDDKSGCGYKKVHWQWQTAAADE

SEQ ID NO: 213761 - protein, 619 aa, Glycine max
  Coding DNA Sequence Number=SeqID_96983
  Gene Ontology: Mol. function=potassium ion transporter activity; Cellular component=membrane; Biological process=potassium ion transport
  Homolog annotation: Hit_ID=Q5J884; Match level="QueryCoverage=97%, HitCoverage=85%, E-value=0.0, Identity=82%"; Hit description=KUP -related potassium transporter
  Pfam annotation: Domain name=K_trans; Domain location=2-619; Score =660.0; E_value=1.9e-195; Accession=PF02705.7; Description=K+ potassium transporter
MSSMFGKSLKMEESSWECGTFALYSLLCRHVNIGILPSKHVGLNTTKDVQKSTSLARFFQTSVVARRLLLFVAMLGTCMLIGDGILTPAISVLSAMDGLRAPFPSVSKTLVETLSAIVLIVLFLLQKFGTSRVSFLFSPIMGAWTLSTPLVGIYSIIHHYPSIFKALSPHYIFRFFWRNGKSGWLLLGGTVLCITGSEAMFADLGHFNQKSIQIAFLFTIYPSLVLTYAGQTAYLIKHPNDHDDGFYKFIPTSVYWPIFVIATSAAVVASQSLISATFSVIKQSVVLDYFPRVKVVHTSNNKEGEVYSPEVNYILMILCVAVILIFGDGKDIGNAFGVVVSIVMLITTILLTLVMIMIWRTPAILVALYFVVFFVMEGVYVSAVFTKFAEGGWIPFAISLILAFIMFGWFYGRQRKIDYELTHKITFERLEELLADRSVQRVPGLCFFYTNIQEGLTPILGHYIKNMKSLHKVTIFTTLRYLLVPKVAPHERIVIKKSNLEGVYCCVIQYGYADALNLEGDHFVNQVITSLTQHIQNSPDKLSSDSREIEETSYLEEARCAGVVHVRGKTKFYIGLNCGWFDKFVLRFYEVMHNNCRSALPALGVPPQQRIEVGMLYEA

SEQ ID NO: 213762 - protein, 633 aa, Glycine max
  Coding DNA Sequence Number=SeqID_96984
  Gene Ontology: Mol. function=solute:hydrogen antiporter activity; Cellular component=integral to membrane; Biological process =regulation of pH
  Homolog annotation: Hit_ID=Q4W3B5; Match level="QueryCoverage=96%, HitCoverage=58%, E-value=1e-165, Identity=49%"; Hit description =Putative plasmalemma Na+/H+ antiporter
  Pfam annotation: Domain name=cNMP_binding; Domain location=235-325; Score=27.9; E_value=3.6e-05; Accession=PF00027.19; Description =Cyclic nucleotide-binding domain
MLNKALEAFGELGDDEELGPADWPTVKRYISCLNDIEGECVHPHGAPENDSNLDPMNLKDIRVRLLNAGGTSSGVQAAYWEMLDEGRISQTTANILMLSVEEAVDLASSEPLCDWKGDSDIASAVINESVVEGEEARKFLEDVNVTYPQVLRVVKTRQATYAVLNHLIEYVENLEKAGILEEKEMLQLHDAVQTDLKKLLRNPPLVKLPKISSIHPMLGALPSSVRESLASCTKEMMKLRGLTLYKEGAKSNGIWLISNGVVKWESKMIRTKHSFNPTFTHGSTLGIYEVLTGRSYICDVVTDSVVFCIFLEADKIRSCLKADPLTEKFLWEESAIFLSKLLLPQIFEKLGMQDLRTLIADSERSRMTIFIRGETIEIPHHSVALLLEGYVKTQGRQELVTAPAALLPSHGNLSFQNLASSGSKEASFIHQQGSSYLVETTARVILFDIPAPEADAALVRRSSSLLSHAGDHPHRSFRRKHSGLMSWPEHFYKQDHKQRSEGAGRQTNSLSARAMQLSIYGSMVDIPPRSRSLLTNDGRPPHSLSYPTIVSHQGRPLVSVKSEGAATAKKVHEVTRHVTNPPSQSTERRQHHHGDNSSDDSGAEEEDIIGEESFVIICLLCNKWCLCITNIVH

SEQ ID NO: 213763 - protein, 113 aa, Glycine max
  Coding DNA Sequence Number=SeqID_96985
MKTPDEAMDLIESMAASDIAILRDRAHIPTKKNLLELTSQDALLAQNKLLSKQLETLTKTLRCTIYGGAHESGCCIPNKEQIAHKVNYMGNQPRGNFNTSGFPGFQNNQQYQQ

SEQ ID NO: 213764 - protein, 86 aa, Glycine max
  Coding DNA Sequence Number=SeqID_96986
  Subcellular localization annotation: CTP_CleavageSite=45; ConfidenceScore=5.30e-01
MYVGKVLSFELNRSCGSADTGMFSFARQGKRCFFDRCCRKNLQCTSARFFGSSSTEVVFLPTPACFHLLGMENINQPRQKNMIPRY

SEQ ID NO: 213765 - protein, 130 aa, Glycine max
  Coding DNA Sequence Number=SeqID_96987
MATARWALKHPVYGIVILRLGTYTNRPNVSKLCSFISSMNPSILISDDVPKGKFYKIPQQTLSTNNEKQDNIQMINDGTYEFGDPTVMWLRMPPDSWVTVTKCGAVDKSRAFAPTYPQFVMRNSELRSSC

SEQ ID NO: 213766 - protein, 228 aa, Glycine max
  Coding DNA Sequence Number=SeqID_96988
  Gene Ontology: Mol. function=protein-glutamate methylesterase activity; Cellular component=cytoplasm; Biological process=two -component signal transduction system (phosphorelay)
  Homolog annotation: Hit_ID=Q6D6I7; Match level="QueryCoverage=86%, HitCoverage=56%, E-value=4e-90, Identity=83%"; Hit description =Chemotaxis response regulator protein-glutamate methylesterase
  Pfam annotation: Domain name=CheB_methylest; Domain location=37-219; Score=414.2; E_value=1.8e-121; Accession=PF01339.8; Description=CheB methylesterase
MIADKIRAAARAKLHARAATPQPVMLKAGPLLSSEKLIAIGSSTGGTEAIRHVLQPLPATSPALLITQHMPPGFTRSFAERLNKLCQITVKEAEDGERILPGHAYIAPGAMHMELARSGANYVVKLNDGPPVNRHKPSVDVLFRSVAVNAGRNAVGVILTGMGNDGAAGMLEMHRAGAWTIAQDEASCVVFGMPREAIAMGGTSEVVDLGHISQHMLAKISAGQALRI

SEQ ID NO: 213767 - protein, 333 aa, Glycine max
  Coding DNA Sequence Number=SeqID_96989
  Gene Ontology: Mol. function=transporter activity; Cellular component= integral to membrane; Biological process=transport
  Homolog annotation: Hit_ID=Q7NVV5; Match level="QueryCoverage=97%, HitCoverage=92%, E-value=9e-50, Identity=53%"; Hit description =Probable POT family transport protein
AEKQCAFPRDFLRPHAVGVFPRHVGGGGADSDPGDDRLHVAGGRGGGAGRGGHSERLRPGAFAVGALPAGGLGRLLRGAGHDGADGGDPAAGRARKLGGGGGLEHGDGAHRRDPGAGAGRDHHRVRRRGAGVRRGRRRDAGHPCPTGGGVGGAAGDADEHRRRRPGAVPGAGAGCLPRRRVLNWPDVFRGAARRDAGRADQRLGGAFLSARRADPGRRHRRVYRYRFAGAVQPPGAGAAGAGVLRLRQRHRFAPAVHADPEQYAGSSAGAGEQPRHRAGRNRRFDRRAGARRTGQGVYPVDERAVVWRIRRCARRADGLQRAHAAPVPAGGRA

SEQ ID NO: 213768 - protein, 162 aa, Glycine max
  Coding DNA Sequence Number=SeqID_96990
MRISPYGRITPTRHPVDSEKSNRALRFPALVTGLCQSYRVPVPPARSRHHEIGITPARHPLNPEMSNKVLGFPALITSLCQFYRVLIAPNKVIRPPTNRAFINKYCAPRQAQGETPQQPGDGQQRAIDAPPPPSEPLISPTKAGALPMTRGRPTGNQVQSQR

SEQ ID NO: 213769 - protein, 160 aa, Glycine max
  Coding DNA Sequence Number=SeqID_96991
  Homolog annotation: Hit_ID=Q1S9T9; Match level="QueryCoverage=39%, HitCoverage=5%, E-value=1e-08, Identity=53%"; Hit description =Peptidase S8 and S53, subtilisin, kexin, sedolisin; Integrase, catalytic region; Zinc finger, CCHC-type
MQALTLKIETLMGAQAQVPVTTPPFPTCDRCGIVPGLGECIVDYELNVLFYVTGCSTRIQEIGWPIQKKKSTGPDNPHCRPPYLYRPLFNNLKSPPWFNNIYELQIQIMRELACWSRHCEHINWMLPSINFWDFEPLLRTDEVVYDVNMFSPLMIDLILG

SEQ ID NO: 213770 - protein, 98 aa, Glycine max
  Coding DNA Sequence Number=SeqID_96992
MGLAISTHVQKELGSTQWRRCPSPPDGILHGGGIVLRRRDGVLCGGSVVLCLCDGVFRGGGAVLRCRDGALLSGFCVSVAEVQNSKSQDPIEVNENDK

SEQ ID NO: 213771 - protein, 175 aa, Glycine max
  Coding DNA Sequence Number=SeqID_96993
  Gene Ontology: Mol. function=RNA-directed DNA polymerase activity; Cellular component=chromatin; Biological process=RNA-dependent DNA replication
GKKLILVEAEYWWENTGQCLEAKGQVVTWEVFKRVFLEKYFAEDVRNKKKMEFLQLKQGNMNVAEYATKFKKLVRYYPHYQGIDGKSSKCVKFLNDLLPEVKQAMNYQDRAAYYRSTCPMKNNMNGPQHQGKPYLTSPKQYGNPPNNRRTIAMGFASGSGRKPTTFSTHITCYKC

SEQ ID NO: 213772 - protein, 166 aa, Glycine max
  Coding DNA Sequence Number=SeqID_96994
HLPVETFSSLTSYPELRRSEFLIGGYVGARASLLSATFTSSVMLTQESRDMRRYPSEAASPMTCGDNLWSFRTPSAIQTQSCPMARRDKLWSFCTLLSSRGGGPDDMRRQIMVIPHTFCHSDTVVFDGTQRQIMSCPIARRDKLWSFCTLLSSRGGEPDDMRRQLM

SEQ ID NO: 213773 - protein, 83 aa, Glycine max
  Coding DNA Sequence Number=SeqID_96995
  Gene Ontology: Mol. function=RNA-directed DNA polymerase activity; Biological process=RNA-dependent DNA replication
MQIHIAPEDQQKTIFTCPFSIFAYTRMPFSLCNIPGTFQRCMSDENPETGQIQAKGLSGEGRRPKWRRTNPRVEKDEGPSGEG

SEQ ID NO: 213774 - protein, 83 aa, Glycine max
  Coding DNA Sequence Number=SeqID_96996
MTLSDIITAIQSSIRDNDVTLLITALWYHCPVYQFNGHVEYMAIQFIDEEAHGPKIYPKAYENPRAFFSSSGPIFLESSIQCP

SEQ ID NO: 213775 - protein, 255 aa, Glycine max
  Coding DNA Sequence Number=SeqID_96997
  Gene Ontology: Mol. function=DNA binding
  Homolog annotation: Hit_ID=Q1S0F5; Match level="QueryCoverage=74%, HitCoverage=37%, E-value=1e-14, Identity=31%"; Hit description=IMP dehydrogenase/GMP reductase
MVEEFEEIIGCPLGGRRPYLFSGFYPSLARISKIVQISAQELDHRKQLENGVVGIPRKCLEAKARILAGRGEWAPFIDILALLIFGGVLFPNVDGLVNLAAIDAFLAYHDHKESPVVAMLADLYDTFDRRCDKSGTRIVCCTPALYVWLVSHLFGQEVRHASPLESHRSCTEKGGANWDRLLANKERASVNWFPRWKEGRTGVLILCRRIFKCSLDGDKGLHQLQSRSCYKTTWLPYERSTTRGKARALSFHEVS

SEQ ID NO: 213776 - protein, 84 aa, Glycine max
  Coding DNA Sequence Number=SeqID_96998
  Gene Ontology: Mol. function=DNA binding; Biological process=DNA integration
  Homolog annotation: Hit_ID=Q1SIT1; Match level="QueryCoverage=76%, HitCoverage=18%, E-value=4e-15, Identity=60%"; Hit description =Integrase, catalytic region
MDQAGEERKLQLSELDEIRLEAYENSKFYKEKTKKFHDSMIIKKDFMVGKKVLLYNSRLGLMSVEIKSNSTNKSFWLLGGISKP

SEQ ID NO: 213777 - protein, 168 aa, Glycine max
  Coding DNA Sequence Number=SeqID_96999
  Gene Ontology: Mol. function=transition metal ion binding
  Homolog annotation: Hit_ID=Q8LAU8; Match level="QueryCoverage=92%, HitCoverage=51%, E-value=3e-53, Identity=66%"; Hit description =Dessication-related protein, putative
MQLGILYFDPYANSIIFLLASYVIPYVGLTGYVGANSLLQNAASRKLVAGLLGVESGQDAVIRALLYEHRASLVHPYGLSVEVFTDRISMLRNKLGNKDLKDEGLIVPKVEGAEGNILAGDINSLAYPRTPEEILRIIYGGGDEHFPGDFYSRGASGRIATSYLNFTT

SEQ ID NO: 213778 - protein, 104 aa, Glycine max
  Coding DNA Sequence Number=SeqID_97000
  Homolog annotation: Hit_ID=Q8LAU8; Match level="QueryCoverage=76%, HitCoverage=25%, E-value=1e-19, Identity=68%"; Hit description =Dessication-related protein, putative
MAPHISRASVVVLVAFLVLPLLFSDMARATIPESDVDLLEFPLNLEYLEAEFFLFGSLGHGLDVVAPNLTEGGPPPIGGKLAKLDNFVKGCHLPVCFTGSWTLR

SEQ ID NO: 213779 - protein, 46 aa, Glycine max
  Coding DNA Sequence Number=SeqID_97001
MDNPSTSRDLFNSSNMSMPPKSLVIGFFCAPLVLTFSGGGYIEFRS

SEQ ID NO: 213780 - protein, 113 aa, Glycine max
  Coding DNA Sequence Number=SeqID_97002
MEQFLEQVARPGALPSMVRPNEAASPEPTPARVEPVPADPQSPAANSPSPKLEVVPPSPPIIIISDSPSGESVAPPDSPAGEAADLSGSLSGEVVALSDSPIFHLIDEEEAQT

SEQ ID NO: 213781 - protein, 135 aa, Glycine max
  Coding DNA Sequence Number=SeqID_97003
MTEGCGEGFCLAKPSRFSMCPGGRFWPVARSWQARWLKFCPPGQLRGFYPVVGLARVGGAGLWPRAKFRIGWPPPPPREGRIKATRAESQWIVAARPLCHLQYPVAYLSRLQRILPAARWELRFKASRRANPPHE

SEQ ID NO: 213782 - protein, 268 aa, Glycine max
  Coding DNA Sequence Number=SeqID_97004
  Gene Ontology: Mol. function=protein binding; Cellular component =integral to membrane; Biological process=defense response to fungus
  Homolog annotation: Hit_ID=Q949G8; Match level="QueryCoverage=99%, HitCoverage=77%, E-value=5e-44, Identity=30%"; Hit description =HcrVf2 protein
  Pfam annotation: Domain name=LRR_1; Domain location=113-138; Score =3.4; E_value=65; Accession=PF00560.23; Description=Leucine Rich Repeat
  Pfam annotation: Domain name=LRR_1; Domain location=12-34; Score =14.5; E_value=0.37; Accession=PF00560.23; Description=Leucine Rich Repeat
  Pfam annotation: Domain name=LRR_1; Domain location=140-163; Score =12.5; E_value=1.3; Accession=PF00560.23; Description=Leucine Rich Repeat
  Pfam annotation: Domain name=LRR_1; Domain location=165-187; Score =10.0; E_value=3.8; Accession=PF00560.23; Description=Leucine Rich Repeat
  Pfam annotation: Domain name=LRR_1; Domain location=189-211; Score =11.8; E_value=1.8; Accession=PF00560.23; Description=Leucine Rich Repeat
  Pfam annotation: Domain name=LRR_1; Domain location=213-235; Score =12.8; E_value=1.2; Accession=PF00560.23; Description=Leucine Rich Repeat
  Pfam annotation: Domain name=LRR_1; Domain location=237-259; Score =19.0; E_value=0.017; Accession=PF00560.23; Description=Leucine Rich Repeat
  Pfam annotation: Domain name=LRR_1; Domain location=63-84; Score =12.0; E_value=1.6; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1; Domain location=113-138::12-34::140 -163::165-187::189-211::213-235::237-259::63-84
MAIPSFLCAMTSLTHLDLSNTGFMRKIPSQIGNLSNLVYLDLGSYASEPLLAENVEWVSSMWKLEYLDLSNANLSKAFDWLHTLQSLPSLTHLYLLECTLPHYNEPSLLNFSSLQTLHLSFTSYSPAISFVPKWIFKLKKLVSLQLSDNYEIQGPIPCGIRNLTLLQNLDLSFNSFSSSIPDCLYGLHRLKFLNLMDNNLHGTISDALGNLTSLVELHLLYNQLEGTIPTSLGNLTSLVELHLSSNQLEGTIPNSLGNLTSLVELDLS

SEQ ID NO: 213783 - protein, 61 aa, Glycine max
  Coding DNA Sequence Number=SeqID_97005
MTRTQHVHIMGEPWGIPLSTDFQVRAIGQFAQATCAPEFGLPRPFSKRLLVLHVGGVAVKQ

SEQ ID NO: 213784 - protein, 87 aa, Glycine max
  Coding DNA Sequence Number=SeqID_97006
MPEIKRKCCYAIRPLGPSRLFLQKALASGGSNLAHLGELGGKLLPYSPINRGRIEEGKGSALLALRNHLKLVRKIVSVKKIQAEALP

SEQ ID NO: 213785 - protein, 95 aa, Glycine max
  Coding DNA Sequence Number=SeqID_97007
  Homolog annotation: Hit_ID=Q1SPB9; Match level="QueryCoverage=95%, HitCoverage=17%, E-value=5e-09, Identity=35%"; Hit description =Transposase
MLDQFEPFIQGFIDNIMDMKVDGNYGYRSIIALLGMGKDSWSLVRNQLIKELGKWSDDYINLFSGTERFEELKVSVDKWMDITDMRYEIASRYIM

SEQ ID NO: 213786 - protein, 105 aa, Glycine max
  Coding DNA Sequence Number=SeqID_97008
  Gene Ontology: Mol. function=nucleic acid binding; Biological process= DNA integration
  Homolog annotation: Hit_ID=Q1S1X7; Match level="QueryCoverage=97%, HitCoverage=7%, E-value=5e-13, Identity=44%"; Hit description =Integrase, catalytic region; Zinc finger, CCHC-type; Peptidase aspartic, catalytic
IEKFNGKNSFNLWRIKMRALLKEQCVWAPVTSASVKKEVTSESKEKASVSKTEELAEQEEKAHSLILLSLPDEVLYEVANEETASGLWLKLEKLYMTKSICNKLF

SEQ ID NO: 213787 - protein, 119 aa, Glycine max
  Coding DNA Sequence Number=SeqID_97009
MFMTPRLCISAILGKKTRFREEKSSGSASIMLLRRFCEQICENFPPFFTVLHPLFVRSSTGLISSSQLRMRRSKSPTFVDHPKRSLMVQCLNVSLLSKTKRSLMVQRLNVSLLSKPRDR

SEQ ID NO: 213788 - protein, 441 aa, Glycine max
  Coding DNA Sequence Number=SeqID_97010
  Gene Ontology: Mol. function=transporter activity; Cellular component= integral to membrane; Biological process=transport
  Homolog annotation: Hit_ID=Q398S2; Match level="QueryCoverage=94%, HitCoverage=94%, E-value=1e-139, Identity=60%"; Hit description =Major facilitator superfamily (MFS_1) transporter
  Pfam annotation: Domain name=MFS_1; Domain location=32-407; Score =79.5; E_value=1e-20; Accession=PF07690.6; Description=Major Facilitator Superfamily
  Pfam annotation: Domain name=Sugar_tr; Domain location=28-441; Score =39.7; E_value=1e-08; Accession=PF00083.14; Description=Sugar (and other) transporter
  Pfam module annotation: Pfam domain module=MFS_1::Sugar_tr; Domain location=32-407::28-441
MNAYTTETAQAAVPAAESAAAPPNTGKLAAASSIGTALEWYDFTVYNIMAALIFNHVFFPSFDPLVGTILAFSTYAVGYVSRPIGGIVFGHLGDVLGRRFVLVTTLVIMGVTTALMGLLPGYASWGIWSPLLLVTLRFIQGIALGGEWAGAVLLSMEHGKPHQRGRNASFAQVGPSCGSLIGTGLITLVTLAMSADDFQQWGWRIPFLLSLVLVIFGLWLRRGVGETPAFLQLEASKDVTQSPIREVFTQHMRPLLIAGGSRIGSDVLYALVVVFTLTYVTTVLNLPRPLALGATMLGAIGNAVAVPLFGALSDRFGRRPVYIGGALAAIAWAFAFFVLLDSSQPVLICMAVVIGLLIHAAMYGPQAAFITEQFPTRVRYAGSSLAYTLAGIIGGGFAPLIITSLFKSYDSTLAISAYVALALLITLWAVWAARETAHKPL

SEQ ID NO: 213789 - protein, 390 aa, Glycine max
  Coding DNA Sequence Number=SeqID_97011
  Gene Ontology: Mol. function=transporter activity; Cellular component= integral to membrane; Biological process=transport
  Homolog annotation: Hit_ID=Q398S2; Match level="QueryCoverage=77%, HitCoverage=76%, E-value=2e-83, Identity=56%"; Hit description=Major facilitator superfamily (MFS_1) transporter
MDQQPDHHCHADQHRLTAVEQDEERKRPRYRRQCTADIHRTTAEAIRQCAKQRYRDGVTYRPQHGGAQRQRARQIQHGGDVGQCEHDHQRIEHVRADTRSAGDQQWAHVLREDFADRRLRNIFRRLQLQKCRRLTHPPTQPQTEDDQHQAQQERDPPAPLLEIVRRHRQRHQRNQAGADQRTAGRPYLSKGRVAPALMRLTVFHRQQHRPRPFSAQRNALNKAQRHQQQRAPNPPAGIAGQQSHQRRGHAHDHQRGDQYKAPPQHIAKVAEHDATDRPGNITHRTVKSYHSNAVPIELAAANLPVLGGAAALSAAGTAACAVSVVYAFMMSAPVRSVASQGHSARHRRRACSALQRPARLNAGRLRRRCFRSIASAAFGGFLAILSAAGN

SEQ ID NO: 213790 - protein, 69 aa, Glycine max
  Coding DNA Sequence Number=SeqID_97012
MTFYRQHVSFLLQDDDYDIDLPRRVLRADAKRIAPRSVNDGGNEMNNYESVELQAVMMRERLRQTGEKR

SEQ ID NO: 213791 - protein, 213 aa, Glycine max
  Coding DNA Sequence Number=SeqID_97013
  Gene Ontology: Mol. function=transcription factor activity; Cellular component=intracellular; Biological process=regulation of transcription, DNA-dependent
  Homolog annotation: Hit_ID=Q26PW0; Match level="QueryCoverage=80%, HitCoverage=75%, E-value=2e-34, Identity=43%"; Hit description =Regulatory protein GntR, HTH
  Pfam annotation: Domain name=FCD; Domain location=80-204; Score=89.6; E_value=9.8e-24; Accession=PF07729.2; Description=FCD domain
  Pfam annotation: Domain name=GntR; Domain location=8-70; Score=44.0; E_value=5.2e-10; Accession=PF00392.11; Description=Bacterial regulatory proteins, gntR f
  Pfam module annotation: Pfam domain module=FCD::GntR; Domain location= 80-204::8-70
MEEAGVSLNELAYRRFKQALVTLSYKPGEYLNTAQVMNDLDMGRTPINQAIHRLANEGLLQVIPRKGVMVSPLSMDDALELIEVRLANEMLCMQLASQRITERQIATLTELNRQIEAASQERDRVRMMTLDHEFHQELAQIAGNNMLADILSVLHARAQRFWASTLSREGHMREVIDEHRAIIAALAAQDSAAAAEAAQAHILSFRSALLHDG

SEQ ID NO: 213792 - protein, 105 aa, Glycine max
  Coding DNA Sequence Number=SeqID_97014
  Gene Ontology: Mol. function=nucleotide binding; Biological process =translation
  Homolog annotation: Hit_ID=UPI00005EF165; Match level="QueryCoverage =78%, HitCoverage=84%, E-value=9e-22, Identity=53%"; Hit description =COG3514: Uncharacterized protein conserved in bacteria
MKRKNSAKNLAHSVLPPLTEEQKAQIASLSALPDEDIDYTDVPALGEEKWQAAVQGRFYKPMKVSKTIRIDADVLAWLQRPGKGYQKRLNAVLREAMLKEHEHEE

SEQ ID NO: 213793 - protein, 542 aa, Glycine max
  Coding DNA Sequence Number=SeqID_97015
  Gene Ontology: Mol. function=amidase activity; Cellular component =cytoplasm; Biological process=translation
  Homolog annotation: Hit_ID=Q7VXB6; Match level="QueryCoverage=64%, HitCoverage=78%, E-value=3e-90, Identity=50%"; Hit description =Putative amidase
  Pfam annotation: Domain name=Amidase; Domain location=167-540; Score =213.9; E_value=3.7e-61; Accession=PF01425.11; Description=Amidase
MRLTFTLPESRGAATLNVEIDHLVIAGWTGRDREAILHHIRELAELGVPQPSAIPLFYRVAANQLSQQETIEVIGNATSGEAEPLIFAHRGELFVSLASDHTDRQLEAHSVALSKQICVKPVARAAWPLQEVLEHWDSLILRSWIKEEGEWRLYQQGSLAALRTPGDLLERYFTAQLTAAALAQIADERGEGARAFTRTYAEWAQRQAQASDRRRAAGSPLSALDGVPVSIKDLFDVAGEVTTAGSRVLADAPPAEKHAAVVERLLQAGAVVVGKTTMTEFAYSGLGINPHYGTPANPWERQAARIPGGSSSGAAVAVADGMCLAAVGTDTGGSVRIPAALCGLTGFKPSASRINQAGTLPLSAALDSIGVIAHDVRSCWLLDSVIADRPLQLTERDITRAHFAIPQTRVLDGLDLAVSQAWHHALAQLRAQGATLTELPLSELAELETMNARGGITAWEAWQWHQSLLQSHAAGYDPQVRMRIERGALLNEADAQLLYQQRADWRQRVEQAVAPFDGLLLPTVPLIAPTIAELDDPERYRQ

SEQ ID NO: 213794 - protein, 747 aa, Glycine max
  Coding DNA Sequence Number=SeqID_97016
  Gene Ontology: Mol. function=DNA binding; Cellular component=nucleus
  Homolog annotation: Hit_ID=Q84YJ6; Match level="QueryCoverage=91%, HitCoverage=92%, E-value=1e-53, Identity=30%"; Hit description=DNA -binding protein family-like
  Pfam annotation: Domain name=Bromodomain; Domain location=351-440; Score=53.0; E_value=9.9e-13; Accession=PF00439.15; Description =Bromodomain
  Pfam annotation: Domain name=Myb_DNA-binding; Domain location=30-82; Score=20.7; E_value=0.0054; Accession=PF00249.21; Description=Myb -like DNA-binding domain
  Pfam module annotation: Pfam domain module=Bromodomain::Myb_DNA -binding; Domain location=351-440::30-82
MENHQNHKVEPEPDIEKNHNHRHQQQQHRNEAWGTWEELLLACAVNRHGFTDWDAVAMEVQSRTTRLLATARHCEQKFHDLSRRFAVQCNDDVPPPRQNGAAAAISDHVPWLDELRKLRVAELRRDVQRSDVSILSLQLEVKRLEEEKAQEKDLKDDEKPDLAVSGELRPENDKTGGEVEEAGPANSEPEERTANNTDKTLPTTGDESDRENQSVNESNSTGSRFEKTGDGDAKTGTGPDPVHTGSQEPDPVERKGKPVGEESNNGSYDALAKVPTCESVPPSEGRKVEEDDDSSELHDSVAHSGEGGTRESSEVQSSASLMRKRKTRRRKEVSGATDASCPAENDEAATVKSEPLVGVLELIKGHEHSSLFERRLDSQDTDRYKDLVKQPMDLETIQLRLQKGHYSSCTSAFFRDLLLLFTNATVFFSHDSLESQAGRQLHRLATAEMKNHGQAQSDPIPRKNDSLPPNAPLAKPDSLLSKNKASGPILVCRKRSSMSSKPSSATFGQKGDQPVFNDKKERPSSDAKPPMKPSSSDTDEEELPKAKEKPVTGARSLRRSNKNLNSNSSNNNNKKPSSISTPKAGSSGNKPSETVKPEKSKAEGGADKKRSAAADFLKRIKRNTSAEASKGGSGGGSGGGGGGGGGSSSSSKGGGGGNGAKEQKKMVNNGKGDKGKERASRHNNVGGGSGSADKRNNKNIENSSQSKRSVGRPPKKAAETNAGSAKRGRENSASAGKDKRPKKRSKK

SEQ ID NO: 213795 - protein, 132 aa, Glycine max
  Coding DNA Sequence Number=SeqID_97017
MQRSFSARCELQERREPCPPPQVAAVDEAPTVQTVDASLLPRLLRNYKSISKQWIWENTDTQPSTLVHSEWSNECPHAYKSRSWKTATTANYFWVESSHWNVTMVPSFLQKHSSLKAHLNRERKKQLDSYMA

SEQ ID NO: 213796 - protein, 49 aa, Glycine max
  Coding DNA Sequence Number=SeqID_97018
VERVFNANHPDALEIEQVKKILKDHEQALIDAIARLADLSDDESGISQF

SEQ ID NO: 213797 - protein, 338 aa, Glycine max
  Coding DNA Sequence Number=SeqID_97019
  Homolog annotation: Hit_ID=Q680Q1; Match level="QueryCoverage=86%, HitCoverage=68%, E-value=7e-71, Identity=51%"; Hit description=MRNA, complete cds, clone: RAFL22-41-F10
  Pfam annotation: Domain name=ENT; Domain location=67-148; Score =130.9; E_value=3.5e-36; Accession=PF03735.5; Description=ENT domain
MAEPLGFLSELAMGHLSRASPLRAVGTDDDLPPTHPNRIPRGERLAGNGRLPAGSIPYPRMHGEIDMETQIHQLEKEAYSSILRAFKAQADAISWEKESLITELRKELRLSNEEHRELLGHVNADDVIQNISTLLNIDFREWRQAGGNQPVVLSVGQAIHDSIPSPTISASRKKLKITPSAPSQSFGGPSAFCPQPVAAPLQPSSVAKRGSISGSKGKKHKPGQVLPGVSSIKQYPSSGLGGRNQVPNRVTSGTVMGEVAKGASLDSLVGRRVRTRWPDDNNFYEAIISDYNRTKGLHALLYDLGTANESWEWVNLSEEFKGVQKESDHRLRLKPVQG

SEQ ID NO: 213798 - protein, 74 aa, Glycine max
  Coding DNA Sequence Number=SeqID_97020
VRAVMQVGSATFIIRVIKHSGICSGDSKILQVASRFQDVKTSHVTSAFCSPCLHAPTAVKQFTLVAYNNHHQQQ

SEQ ID NO: 213799 - protein, 98 aa, Glycine max
  Coding DNA Sequence Number=SeqID_97021
MGCTHGPEIYPKAHKNPRAFSCISGPIYLEFFYPMPLRGRIASGFPLEKLLKVKETVPVEFSLVSSTRKKARERERTIEMLEVTMTLTDLVQQLKCYA

SEQ ID NO: 213800 - protein, 154 aa, Glycine max
  Coding DNA Sequence Number=SeqID_97022
  Gene Ontology: Mol. function=nucleoside-triphosphatase activity; Cellular component=protein complex; Biological process=proteolysis
  Homolog annotation: Hit_ID=Q9FJC9; Match level="QueryCoverage=64%, HitCoverage=24%, E-value=1e-33, Identity=70%"; Hit description=26S proteasome regulatory particle chain RPT6-like protein
  Pfam annotation: Domain name=AAA; Domain location=2-94; Score=-26.5; E_value=0.021; Accession=PF00004.19; Description=ATPase family associated with various cellular activities (AAA)
MTLIPIICENAQVMVLAATNRPSELDEPILRRLPQAFEIGVSDQREKTEILKVVLKGERVEDNIDFGHIASLCEGYTSSDLFDLCKKAAYFPIRALLDEEKKGKRSSVSIFKSFSYIFFCLNFFIFPITMLPTAKLTRIPYQFQFLLTRKEQIN

SEQ ID NO: 213801 - protein, 98 aa, Glycine max
  Coding DNA Sequence Number=SeqID_97023
  Gene Ontology: Mol. function=sequence-specific DNA binding; Cellular component=nucleus; Biological process=regulation of transcription
  Homolog annotation: Hit_ID=Q7XJB6; Match level="QueryCoverage=81%, HitCoverage=17%, E-value=5e-28, Identity=77%"; Hit description =Putative WRKY-type DNA binding protein
  Pfam annotation: Domain name=WRKY; Domain location=60-92; Score=-3.3; E_value=0.0018; Accession=PF03106.6; Description=WRKY DNA -binding domain
MAGRDDGARFVSNRTNEEVDDGDPFSKRRKMKLDVDITLVVKPIWEPRVVVLTLSEVDILDDGYCWRKYGQKVMRSNPNPREMVTLFGLVPVQARLWL

SEQ ID NO: 213802 - protein, 78 aa, Glycine max
  Coding DNA Sequence Number=SeqID_97024
MMIFVKTIIDRSSLKTGLDNRHCIQSLCAASWWWFHRRHGPFITMVLLENIVPPSKSISEPYPSTIVLSSLEGMNLPQ

SEQ ID NO: 213803 - protein, 153 aa, Glycine max
  Coding DNA Sequence Number=SeqID_97025
  Gene Ontology: Mol. function=RNA-directed DNA polymerase activity; Biological process=RNA-dependent DNA replication
MDAFIRQYQYNSDMASDRMQLQNMCKKDNESFKEYAQWWRDLAAQIAPPMMEKEMIIMIVDTLPVFYYEKMVGYMSSSFANLVFAGKRIEVCLRRGKFDYAATTSSSNRRPRMSGRNKKEGETHVVTVVPTWPNFPLALLNPLYQYPPQQYQY

SEQ ID NO: 213804 - protein, 66 aa, Glycine max
  Coding DNA Sequence Number=SeqID_97026
MKLTATIVGFVVHSQFAPKLKHPDSGEKENARTKIATKWTANEERRVEAEEESKELPPIRPYSKAE

SEQ ID NO: 213805 - protein, 117 aa, Glycine max
  Coding DNA Sequence Number=SeqID_97027
MPPTRYTLDPNKSNRALGFPALITGLCQSFGAPDAPSPPHQADPTGSFDTERYLRHLVRQQAANHRAHVQTYDCLYQLSLSLQSQGFTHFPCPTPDQFRAEVAWPGDWPEVQAGEAS

SEQ ID NO: 213806 - protein, 257 aa, Glycine max
  Coding DNA Sequence Number=SeqID_97028
  Gene Ontology: Mol. function=oxidoreductase activity; Cellular component=cytoplasm; Biological process=flavonoid biosynthetic process
  Homolog annotation: Hit_ID=Q39224; Match level="QueryCoverage=98%, HitCoverage=72%, E-value=2e-62, Identity=44%"; Hit description=SRG1 protein
  Pfam annotation: Domain name=2OG-FeII_Oxy; Domain location=109-209; Score=138.8; E_value=1.5e-38; Accession=PF03171.10; Description=2OG -Fe(II) oxygenase superfamily
MGNQVKRFFELPLQEKKRWAQRPGTLEGYGQAFVTSEDQKLDWNDMIFLKCLPIQNRKLDLWPQNPPEFRETLERYSEEIREVTMSVVKFLTMSLGIQDKEISESFREGLYDIRMNCYPPCPEPERVLGIAPHADNSGITLLLDCADFPGLQFLKDKKWVNVEPIEGAIVVNIGQIIEVMSNGIYKAPEHRAVVNKLKERFSIVTFCYPSPHMDIGPADKLTGEGKVAVFKKLTHAEYFRKFFNRDLDESFIDSLRV

SEQ ID NO: 213807 - protein, 686 aa, Glycine max
  Coding DNA Sequence Number=SeqID_97029
  Gene Ontology: Mol. function=protein serine/threonine kinase activity; Biological process=protein amino acid phosphorylation
  Homolog annotation: Hit_ID=Q8H0Z0; Match level="QueryCoverage=99%, HitCoverage=100%, E-value=1e-161, Identity=47%"; Hit description =Putative serine/threonine protein kinase
  Pfam annotation: Domain name=Pkinase; Domain location=27-320; Score =129.1; E_value=1.3e-35; Accession=PF00069.15; Description=Protein kinase domain
  Pfam annotation: Domain name=Pkinase_Tyr; Domain location=27-320; Score=-34.1; E_value=2.2e-10; Accession=PF07714.7; Description =Protein tyrosine kinase
  Pfam module annotation: Pfam domain module=Pkinase::Pkinase_Tyr; Domain location=27-320::27-320
MWRFKPFSHKEQTGLEGRTIDVGNLKIHVIKAIAEGGFSCVYLARDAVHMSKQYALKHMICNDEESLGLVKKEISVMKVLAGHPNVVTLHAHAIFDMGRTKEAFLVMEFCERSLVNVLESRGAGYFDEKQVLLIFRDVCNAVLAMHCQSPPIAHRDLKAENLLLGSDGLWKLCDFGSTSTNHKRFEKPEEMGIEEDNIRKYTTPAYRAPEVVVKAPQPLPSYGSAWVQFLDWACGVQMWDLFLREVINEKVDIWALGCLLFRICYFKSAFDGESKLQVLNGNYRIPELPKYNSPVTDLIRDMLQARPDNRPDITQASALLDWPFISISLGVSMPSNRSPPMPRRNPPPPPSSGEPKTSPQPSPASRGGGSGGALGAFWSTQHAKESLVAEDKSKPIFDEEPSSHHFSLKHDRIRPENDQLPKNDGPNKVVNTQTHTVKSSTHGKLPKPDTAPSKDFELNLFEDKDRVGESTTNFQNQAFNTFVAEFDATKLNPGLNNKPEREQALEAEVEILKEKLKEANLEKAEITSKYEKLSAICRSQRQELQDLKQALAARTPSPSREGLKISPAVTSSASASASSVVFLTQGCVSLQLQDKSWQAFPEEPQQQRSLSAENTSKSVRVKNGQQNKQPVPLATDFDSWGFGTDSFSAVPAGSPQMQRPSSAGTKSQAFGEANKSTSQPAGWAGF

SEQ ID NO: 213808 - protein, 335 aa, Glycine max
  Coding DNA Sequence Number=SeqID_97030
  Gene Ontology: Mol. function=peptidase activity; Cellular component =membrane; Biological process=proteolysis
  Homolog annotation: Hit_ID=Q6XBF8; Match level="QueryCoverage=99%, HitCoverage=76%, E-value=1e-101, Identity=56%"; Hit description=CDR1
  Pfam annotation: Domain name=Asp; Domain location=2-330; Score= -141.9; E_value=3.2e-05; Accession=PF00026.14; Description=Eukaryotic aspartyl protease
MGIADTGSDLIWSQCKPCQQCYNQTTPLFDPSKSATYEPVSCYSSMCNSLGQSYCYSDTEPNCEYTVSYGDGSHSQGNLALDTITLGSTTGSSVSFPKIPIGCGLNNAGTFDSKCSGIVGLGGGAVSLISQIGPSIDSKFSYCLVPLFEFNSTSKINFGENAVVEGPGTVSTPIIPGSFDTFYYLKLEGMSVGSKRIEFVDDSTSNEVKGNIIIDSGTTLTILLEKFYTKLEAEVEAHINLERVNSTDQILSLCYKSPPNNAIEVPIITAHFAGADIVLNSLNTFVSVSDDAMCFAFAPVASGSIFGNLAQMNHLVGYDLLRKTVSFKPTDCTKI

SEQ ID NO: 213809 - protein, 115 aa, Glycine max
  Coding DNA Sequence Number=SeqID_97031
  Gene Ontology: Mol. function=hydrolase activity, hydrolyzing O -glycosyl compounds; Biological process=carbohydrate metabolic process
  Homolog annotation: Hit_ID=P26204; Match level="QueryCoverage=42%, HitCoverage=9%, E-value=3e-15, Identity=73%"; Hit description=Non -cyanogenic beta-glucosidase precursor
MMLYDPNNQWLNHELTLFTETHASHQANVIQSVWVDYRRGFGENYDTASLKRSSFPKDFIFGTSSSAYQYEGATNKGGRGPSIWDTFTQKYPSKGIYPFPFGNLCGMACSFELGG

SEQ ID NO: 213810 - protein, 123 aa, Glycine max
  Coding DNA Sequence Number=SeqID_97032
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q1RTS8; Match level="QueryCoverage=92%, HitCoverage=22%, E-value=5e-45, Identity=68%"; Hit description =Glycoside hydrolase, family 1
  Pfam annotation: Domain name=Glyco_hydro_1; Domain location=1-123; Score=-325.5; E_value=0.023; Accession=PF00232.9; Description =Glycosyl hydrolase family 1
MTFYIGLKPFVTLLHYDHPQSIEDAYGGFLSPKVVKDFTDYAEVCFKAFGDRVKYWITINGPSIFSQQGYTNGIYAPGRCSNWLQLNCTGGDSATEPYLVSHHQLLAHAAAVKVYRQKYQVTN

SEQ ID NO: 213811 - protein, 131 aa, Glycine max
  Coding DNA Sequence Number=SeqID_97033
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=O64879; Match level="QueryCoverage=81%, HitCoverage=21%, E-value=6e-29, Identity=54%"; Hit description =Putative beta-glucosidase
MEPLNSGSYPLEMVHYLGERLPKFSKEQSDMVKNSFDFIGINYYSTTYAADAECPRKNKSYLTDLCAELTYERDGIPIGPRAASEWIYIYPQGIEEVLLYFKPLLKNNFFTTHILRRFLRTVLECALMAFL

SEQ ID NO: 213812 - protein, 119 aa, Glycine max
  Coding DNA Sequence Number=SeqID_97034
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q1SWW1; Match level="QueryCoverage=71%, HitCoverage=16%, E-value=2e-24, Identity=60%"; Hit description =Glycoside hydrolase, family 1
MGTFCLTKVDFHNYADFCFKTFGDRVKHRVTLNEPGSFALAGYNAATLHQVDSKYAGNCTVGDSATEPYIISHNLILAHGTAATLYKKKYQSSSRAFAMHGAQSIKATYINKKANAKRN

SEQ ID NO: 213813 - protein, 112 aa, Glycine max
  Coding DNA Sequence Number=SeqID_97035
  Gene Ontology: Biological process=amino acid metabolic process
  Homolog annotation: Hit_ID=Q1SJX1; Match level="QueryCoverage=68%, HitCoverage=50%, E-value=3e-30, Identity=85%"; Hit description =Ankyrin
  Pfam annotation: Domain name=Ank; Domain location=40-72; Score=38.6; E_value=2.2e-08; Accession=PF00023.20; Description=Ankyrin repeat
  Pfam annotation: Domain name=Ank; Domain location=73-112; Score=1.8; E_value=17; Accession=PF00023.20; Description=Ankyrin repeat
  Pfam module annotation: Pfam domain module=Ank::Ank; Domain location =40-72::73-112
MSCPKPECILKIVGQISNEQKMMEICLRWFGQDLNSPNEEKNTPLHWACLNGHVEAVKKLIMAGANVSVLNSHERTPMDEAVSGGKPEVMDAINEAVALVELRGAMVFAQET

SEQ ID NO: 213814 - protein, 102 aa, Glycine max
  Coding DNA Sequence Number=SeqID_97036
MASARQPFHSFAPERVPLYSPRGAYGYRQNPSLPSSEFLLGGHVPQRLLLCFSVSYLPTNEAQTAMKHYMDCHHHNVTFQVGDLAYVRLCPYRQLSIRPHYF

SEQ ID NO: 213815 - protein, 126 aa, Glycine max
  Coding DNA Sequence Number=SeqID_97037
  Homolog annotation: Hit_ID=Q10QF4; Match level="QueryCoverage=47%, HitCoverage=24%, E-value=1e-16, Identity=66%"; Hit description =UPF0326 protein hag1, putative, expressed
MGTTSLDPFQIGEFMLRQCANYSCDTYGLIVKNFNHFSEDICNKLTGNSIPKWVNRLARIEDIHEFGFSIKPQQGRAQPLMGERSNKNGGEGMKVKNGGMGKFQAFLLVPKPRSEKNALFSCKSPF

SEQ ID NO: 213816 - protein, 79 aa, Glycine max
  Coding DNA Sequence Number=SeqID_97038
MKYRSKYKNEYELVTLVNIDAQLGKTPKNVIIWRHLRPVSTDYLYLTFCIIQGPYLTISSLTALYEPWLILITYFTTTH

SEQ ID NO: 213817 - protein, 87 aa, Glycine max
  Coding DNA Sequence Number=SeqID_97039
MGSEIYHEVHQNPRAFFNNSSPILLEPLAHGSGDWFLPREDCITLSLSLKCMILPEQGSMFEGFRLSYSKCGKHLLFKIGTMPRNKL

SEQ ID NO: 213818 - protein, 59 aa, Glycine max
  Coding DNA Sequence Number=SeqID_97040
  Gene Ontology: Mol. function=acetyl-CoA C-acyltransferase activity; Biological process=metabolic process
  Homolog annotation: Hit_ID=Q6GW08; Match level="QueryCoverage=94%, HitCoverage=22%, E-value=5e-10, Identity=58%"; Hit description =Triosephosphate isomerase
MDNGTTEEVKKIVTTLNEAKIPGDDVVVKISNWDNVNLSYEPVWTIGTGKVATPAQAQE

SEQ ID NO: 213819 - protein, 157 aa, Glycine max
  Coding DNA Sequence Number=SeqID_97041
  Subcellular localization annotation: CTP_CleavageSite=14; ConfidenceScore=5.22e-01
MAKPSKKRKGTSSRSQRHSGSQEAPIPPSIPSGLLFSSEEQRIRYTNLFSSRSIVDPKFIDMEFFSNENFECFQAFENSNLIPFMSLKLPIYSELVKAFYSNLEIHEDVLMSEIYGIKMVIDQSLFYDLTKLPSEGMPFEGALIDEWKFDFSVHDAC

SEQ ID NO: 213820 - protein, 82 aa, Glycine max
  Coding DNA Sequence Number=SeqID_97042
  Gene Ontology: Mol. function=transferase activity, transferring glycosyl groups; Biological process=metabolic process
  Homolog annotation: Hit_ID=Q9ZWS2; Match level="QueryCoverage=98%, HitCoverage=18%, E-value=3e-35, Identity=85%"; Hit description =Flavonoid 3-O-galactosyl transferase
MAYVSFGTVVTPPPHEIVAVAEALEASGFPFLWSLKEHLKDLLPRGFLERTSESGKAMAWAPQTEVLGHGSVGVFVTDYGCN

SEQ ID NO: 213821 - protein, 73 aa, Glycine max
  Coding DNA Sequence Number=SeqID_97043
  Gene Ontology: Mol. function=structural constituent of ribosome; Cellular component=intracellular; Biological process=translation
  Homolog annotation: Hit_ID=Q1VSK0; Match level="QueryCoverage=76%, HitCoverage=67%, E-value=4e-13, Identity=58%"; Hit description=30S ribosomal protein S20
  Pfam annotation: Domain name=Ribosomal_S20p; Domain location=2-73; Score=51.7; E_value=2.5e-12; Accession=PF01649.8; Description =Ribosomal protein S20
MANHKSALKRIRQNEVRKVRNRYYHKTARTAMKVLRNEEDKAAAAEQLPKVISLLDKLAKKNIIHKNKAANLK

SEQ ID NO: 213822 - protein, 217 aa, Glycine max
  Coding DNA Sequence Number=SeqID_97044
  Gene Ontology: Mol. function=N-acetylmuramoyl-L-alanine amidase activity; Biological process=peptidoglycan catabolic process
  Homolog annotation: Hit_ID=UPI000066CD54; Match level="QueryCoverage =66%, HitCoverage=40%, E-value=2e-17, Identity=37%"; Hit description =putative exported N-acetylmuramoyl-L-alanine amidase
MPSVLIETGFINHAEKSHYLASDRGQEEIAESIYQAIIDYKKAIDRKSGGPSMIATKKPEPEKPVEVALKNDFRILLMSSPTKYNDGDPALKGLNYILPIKENGLYKYYYGVTNMASVKDINLRTAKDAGFKNAFAVGFMPNQKLSTGYYTIEVYVGDKLNGNSFILQTLKDVERNKESGVFYYTYGKVYTLEDAVKIQKELETKGIKNTIIQKVYR

SEQ ID NO: 213823 - protein, 71 aa, Glycine max
  Coding DNA Sequence Number=SeqID_97045
YSNVSSDEEELTVPDDLAEYTLEGKWEKVIDLYNQLIPSVSHVALDLDEEGVHGSRACEGNYHAQAAKCEE

SEQ ID NO: 213824 - protein, 117 aa, Glycine max
  Coding DNA Sequence Number=SeqID_97046
MPAQLIRDRVEMEMHRGSLGDPRRQHEVPISGHYSIYGDFFMEPVQVIEVTSSEEDPEEDLEELPPEPAVDALDILEGDEDPLLEVDSPEEVMSASEADSTEDGGPGEMAISGGSSS

SEQ ID NO: 213825 - protein, 202 aa, Glycine max
  Coding DNA Sequence Number=SeqID_97047
MKRKLLSLFSLLIGVFGFSQTEVYFKYDEAGNQRYRGTDVSGKKAPEDLKNLAKTEEKPKAEEVKTIAEIKQQPVLDEKAFWKQIRLYPVPVNDFLTIDWTDEVDGLIESVSLYQHSTVHWKFQQQNTPGLNKQLKINMSNYEWGTILYQQESTSRTVQDPQTVVLAQGFKASSGTSNPFVAKIGPSTENPGGGPTDSGAGA

SEQ ID NO: 213826 - protein, 135 aa, Glycine max
  Coding DNA Sequence Number=SeqID_97048
MILEDKLKACQRSKRSLTEQLSRTEENMWAIIGQYKEKLNLAAIHEQRLEDEHAKVSVLQAEREARERVIDSLHRKAMMWMDRFTFTLNGSQELPRLLAKAKAMADVYSSPEEVHGLFNYCHYMIELMSHIIRNR

SEQ ID NO: 213827 - protein, 152 aa, Glycine max
  Coding DNA Sequence Number=SeqID_97049
  Homolog annotation: Hit_ID=Q70VU9; Match level="QueryCoverage=97%, HitCoverage=39%, E-value=1e-24, Identity=48%"; Hit description =Farnesylated-proteins converting enzyme-2
MERDGVVSQPVAVIACIAMAVFYVAILYAPTVLLRLPPPPSFKTYMIRRFLCAVVSSVLSLFISALILPGHSGGILDSINEVQTKELRHILVVFGIRRDHIIGKQGYSLLNFLYETVAGCGSSSLLDLSNVCWVYIPQVSSVAGFLEATLKF

SEQ ID NO: 213828 - protein, 174 aa, Glycine max
  Coding DNA Sequence Number=SeqID_97050
  Gene Ontology: Mol. function=protein binding; Cellular component =nucleus; Biological process=multicellular organismal development
  Homolog annotation: Hit_ID=Q6TDS5; Match level="QueryCoverage=97%, HitCoverage=97%, E-value=3e-80, Identity=80%"; Hit description =CEN/TFL1-like GTP-associated binding protein
  Pfam annotation: Domain name=PBP; Domain location=20-166; Score =218.5; E_value=1.5e-62; Accession=PF01161.10; Description =Phosphatidylethanolamine-binding protein
MARMSTDPLIIGRVIGDVLGSFTPTIKMTVTYNKKQVYNGYEFFPSTITTRPRVEIGGGDMRSFYTLIMTDPDVPGPSDPYLREHLHWMVTDIPGTTNASFGNVLVSYEMPKPNIGIHRYVFVLFKQKRRQCVTRPPSSRDHFSTRKFSAENDLGLPVASVYFNAQRETAARRR

SEQ ID NO: 213829 - protein, 196 aa, Glycine max
  Coding DNA Sequence Number=SeqID_97051
  Gene Ontology: Mol. function=hydrolase activity; Cellular component =extracellular space; Biological process=biological_process
  Homolog annotation: Hit_ID=Q8S340; Match level="QueryCoverage=92%, HitCoverage=42%, E-value=2e-77, Identity=68%"; Hit description =Purple acid phosphatase
MRLKVFLLSNHMPYKESGSTSNLYYSFEVASTHVIMLGSYIDFDAHTQQYTWLQSDLGKIDRKRTPWVIALLHAPWYNTNEAHQGEGEDIRQAMEELLYQARVDLVFAGHVHAYERFTRIFDNKTDSCGPLYVTIGDGGNREGLTLKFKKPPSPLSLYQEPSFGHGRLRIVNETHAHWSWHRSNDTDTFVADGVLD

SEQ ID NO: 213830 - protein, 49 aa, Glycine max
  Coding DNA Sequence Number=SeqID_97052
MDDTVERECEQETENSKVMVEPWRNIDVEKQISLELLPLKLGMIMDKVL

SEQ ID NO: 213831 - protein, 356 aa, Glycine max
  Coding DNA Sequence Number=SeqID_97053
  Gene Ontology: Mol. function=hydrolase activity, acting on ester bonds; Cellular component=cellular_component; Biological process =lipid metabolic process
  Homolog annotation: Hit_ID=Q7X9E8; Match level="QueryCoverage=26%, HitCoverage=100%, E-value=2e-36, Identity=74%"; Hit description =Lipase
  Pfam annotation: Domain name=Lipase_GDSL; Domain location=45-344; Score=85.3; E_value=1.9e-22; Accession=PF00657.12; Description=GDSL -like LipaseAcylhydrolase
MDSHKQLFFLSFLPLLLLLLSGHMGLQLTEAHLQRHEMNYPPKMLLVFGDSYVDTGNTRIDQAGSWKNPYGVTFPGKPAGRFSDGRVLTDFIAKYLGIKSPVPYKFRKLMLKQLKSGMNFAYGGTGVFDTSSKNPNMTIQIDFLKQLIKEHVYTTSDLNNSVAYVSVAGNDYNFYLATNGSIEGFPSFIASVVNQTVTNLLHIQRLGVRKIVVGGLQPLGCLPSSTALSSFQQCNSTFNDLIGLHNKLLNQAVTKLNQKSKDNSTFIVLDLFDTFMSVLNHPSTNNIKDPLKPCCVGLSSQDFCGSVDERNVKQYKVCDSPKSAFFWDLLHPTQAGWHAVYNKLQTTTSALRRLRY

SEQ ID NO: 213832 - protein, 120 aa, Glycine max
  Coding DNA Sequence Number=SeqID_97054
MDGNYWKPNDSGKFKSDVCHRESVVIKVQLSLEKLGQTVTTKHGCKVVRNTQWKTKRRSYKAAKPSPDRKSKSEGLPTPCTATATSQSSAEMVLPPGTICCHRCRVEMVVAGAKESQIKY

SEQ ID NO: 213833 - protein, 171 aa, Glycine max
  Coding DNA Sequence Number=SeqID_97055
  Gene Ontology: Mol. function=metal ion binding
  Homolog annotation: Hit_ID=Q9SJM6; Match level="QueryCoverage=74%, HitCoverage=72%, E-value=3e-23, Identity=44%"; Hit description=Zinc finger A20 and AN1 domains-containing protein At2g36320
  Pfam annotation: Domain name=zf-A20; Domain location=13-37; Score =26.1; E_value=0.00012; Accession=PF01754.7; Description=A20-like zinc finger
  Pfam annotation: Domain name=zf-AN1; Domain location=113-141; Score =7.3; E_value=0.0091; Accession=PF01428.7; Description=AN1-like Zinc finger
  Pfam module annotation: Pfam domain module=zf-A20::zf-AN1; Domain location=13-37::113-141
MAEEHRCETPEGHLLCANNCGFSGSTATMNLCSKCYGAIRLKEQEEASTKSTIETALSSSSLKPSFSTSPPTLVDVLIESPPPSLAEVAVTVAVEASSSISTSSGSVAQPNRCATCRKRVGLTGFKCRGDCTCQPRDQSGEAAEDLMIRSRPFDGTGFGDLISTVHVYCER

SEQ ID NO: 213834 - protein, 79 aa, Glycine max
  Coding DNA Sequence Number=SeqID_97056
MYYRGTSVVVVAVVGLVVSGNMSKMDEDQWMYDNIMFEEVDMNEQNEDETSVNEERVDCSDVFNTSQVFVTQDDILQWA

SEQ ID NO: 213835 - protein, 397 aa, Glycine max
  Coding DNA Sequence Number=SeqID_97057
  Gene Ontology: Cellular component=transcription factor TFIID complex; Biological process=transcription initiation
  Pfam annotation: Domain name=Extensin_2; Domain location=5-318; Score= -130.8; E_value=0.034; Accession=PF04554.4; Description=Extensin-like region
  Subcellular localization annotation: CTP_CleavageSite=13; ConfidenceScore=5.31e-01
MDPQAPATGTTVRSAAEPSQPQPPKPSPPLPLPPPSTSSTPPHPPPIPNPNPSPGPGPGPGPIQAPSPKPPTPTPTPPQPRPPQPFNRALPPPSQPQFPHFSSPSPPSSAPSAAPPPRGGMAIGVPAHHQSPSPPFSSSFGQHFGGLGRTAVNVAESTSNSSTSQARTPVQGMGMLGSQMRPSGIGSHQQRSVQSSLRPPTSAPNNQPAGSQSFQGHGLMRPSSVGSTATPSPSSSQSMQSLNQPWLSSGSQGKPPLPSAAYRQQLNPQSMQQRSHIPPMQQSTPTSSQQQQQQPLLSNQSQEHFGQQVPPSRAPLHMPHQPQVTRLQGPGNQKPSSLVAAQSSAAQPGTQSRLTNSDTDESSNSILSKRSIHELVNQVLYQMSKELVGGLQTLIAT

SEQ ID NO: 213836 - protein, 65 aa, Glycine max
  Coding DNA Sequence Number=SeqID_97058
MKNKKVVVAGVSLSKASRLASEENLEENLPCMHALSAPSARLASSLSLLMLSAPNSLSGKSLTRA

SEQ ID NO: 213837 - protein, 108 aa, Glycine max
  Coding DNA Sequence Number=SeqID_97059
  Gene Ontology: Mol. function=dihydrodipicolinate reductase activity; Biological process=cell wall catabolic process
  Homolog annotation: Hit_ID=Q9FIS3; Match level="QueryCoverage=90%, HitCoverage=91%, E-value=1e-21, Identity=52%"; Hit description =Arabidopsis thaliana genomic DNA, chromosome 5, P1 clone:MTG10
  Pfam annotation: Domain name=LysM; Domain location=60-102; Score =30.5; E_value=5.8e-06; Accession=PF01476.10; Description=LysM domain
MACGCSSTAMAEKISWNCAVFVALMLVLSSCESNTSDFTTQMMFHESVSNSNNKACDEIYVVREGETLQTISEKCGDPYIVEENPHIHDPDDVFPGLVIKINPFTNRA

SEQ ID NO: 213838 - protein, 78 aa, Glycine max
  Coding DNA Sequence Number=SeqID_97060
  Homolog annotation: Hit_ID=Q6Q2Z9; Match level="QueryCoverage=51%, HitCoverage=3%, E-value=2e-08, Identity=65%"; Hit description =Phosphoenolpyruvate carboxylase
MEVKRQNFTTVPSSAPGFEDDCKLLGNLLNDILQREAGSTFVDKLEKIRVLSQSLVLFGCGENGRRLKHDMRNAFRLS

SEQ ID NO: 213839 - protein, 86 aa, Glycine max
  Coding DNA Sequence Number=SeqID_97061
MIIVVTINMTIIVTLAFIVTNGSANNDDNIDDDNNNYDDNQNSSDSDNNNDHVGNDGGDNHDNSGCSNSNDYGDNIDIKIIVLILT

SEQ ID NO: 213840 - protein, 121 aa, Glycine max
  Coding DNA Sequence Number=SeqID_97062
VYNIPLLHGQVKVGVEEVKDAKAPVLVSTDEAAAKPPERLDPKVDDLLYLMTLTIPQLFLKSLQVMWDATVFGSSKHDVYLGAYQNGPDNYLKGIIKSAFKGLDDTPQPKSKAGAWWIVVK

SEQ ID NO: 213841 - protein, 224 aa, Glycine max
  Coding DNA Sequence Number=SeqID_97063
DGVPFEGTLNDDWKFDFFAHDARQLVCTNHADMTGRLLAGSLAFESRILHYLIVQILLPRSSNLAQVSEEDLVIMWAFHTGCQLDWAHLVRYRMHKALRLNAPLPYPHLVTLFFRNFQIPLDSEPYVPIKRSFLIGAAVIASFGYRKEHDGSWVKKGAQPADDEGNLPVEDNSSLLRKLLDKFDGLQTFVGDKLNVLMMPKDYMFLKVLFKTKKSKIFKMDDQD

SEQ ID NO: 213842 - protein, 232 aa, Glycine max
  Coding DNA Sequence Number=SeqID_97064
  Homolog annotation: Hit_ID=Q9AVH2; Match level="QueryCoverage=18%, HitCoverage=14%, E-value=2e-16, Identity=95%"; Hit description =Putative senescence-associated protein
MTEGCGEGFCLANLPGDAFSLWGNFFEAKKQMMADAKFAGLLGLGKPLVEILPPGQLRGFCPLLAWLGSAVLGYGPVLSFGLVGPLLPPVISFVARILPTLACAPLAKSVPRQNEREPTNGSLFWPNIVEEERDTGLIGYHGGDRVCRILPTARWELRFKASRKANPPHEGHQRHVPLGGLGPLLLVGKRTAGARVASSPDSDLQAFSHNPTHGSFAPLAFQPSAMTNCANQ

SEQ ID NO: 213843 - protein, 66 aa, Glycine max
  Coding DNA Sequence Number=SeqID_97065
MAGTFHGPPSGAFGVDSSSLWVNEGVPLEGGEDPNMPAILYPGCKSYGYEYIGGICDGYRVNACGV

SEQ ID NO: 213844 - protein, 203 aa, Glycine max
  Coding DNA Sequence Number=SeqID_97066
  Gene Ontology: Mol. function=transcription factor activity; Cellular component=intracellular; Biological process=regulation of transcription, DNA-dependent
  Homolog annotation: Hit_ID=P0ACR9; Match level="QueryCoverage=83%, HitCoverage=97%, E-value=2e-75, Identity=80%"; Hit description =Transcriptional repressor mprA
  Pfam annotation: Domain name=MarR; Domain location=80-151; Score =94.9; E_value=2.5e-25; Accession=PF01047.13; Description=MarR family
  Pfam annotation: Domain name=TrmB; Domain location=75-143; Score= -10.2; E_value=0.042; Accession=PF01978.9; Description=Sugar-specific transcriptional regulat
  Pfam module annotation: Pfam domain module=MarR::TrmB; Domain location=80-151::75-143
MAALSAKRLVRAQSPGLWTDLERQRFLMESSFTPIEQMLNIRANRHKDFPLQEIILTRLCMHMQGKLLDNRNKMLKAQGINETLFMALITLDAQENQSIQPSELSSALGSSRTNATRIADELEKRGWIERRESDNDRRCLHLHLTEKGNEFLRQLLPPQHQSLQYLWSSLTDTEQEQLEAITRKLLNRLDKMDEDQVIASLSR

SEQ ID NO: 213845 - protein, 80 aa, Glycine max
  Coding DNA Sequence Number=SeqID_97067
MGLRIRLENGELANIARQSIRGAPDSMAINSRGSRLDGGGRMNSARNQFMGLRIRLENGELANSARQSIRGAQDSMVEDA

SEQ ID NO: 213846 - protein, 112 aa, Glycine max
  Coding DNA Sequence Number=SeqID_97068
MEEISPLRQPPHFLLCKKTLVSIVTPLGLEFIPQVNELLDEGLVRKSLNSCALLVPKIGLPMDPERIKVIIEWPTPPSVEEKSPEFQEPRDLRSNPFQGGGNDAILPRKGIG

SEQ ID NO: 213847 - protein, 367 aa, Glycine max
  Coding DNA Sequence Number=SeqID_97069
MAKFDPEIVMEFYANAWPTEEGVAIAQLLCIPGQDFTQTAAGRRVRIMRTSMTTLTQIWMMLLVSNILPNDHNSDLPLPKCQLVYAILTDGAYETPYGPEEGVTVAPSKVIWPSITRAFIEKYCTRRQPMHHRHPQSPSRLTYGGWSVAYDMWLTSRQPTTKGQDPSPYTWPTPEQFEAAVACPGDWPDFQIGAGPARTSGGGDEARDDEDMANLIDFLLSFCYPETIKSDGMQRQTWSSSSLVKRLNVCGPKLLKPPTIPRQIFARSVELLKDNCHAIRKPWAHQESSRGSNSSPGRACCFKLKPLARLGELGGKLLLHFSYKMALEEKIKSRHFHDVFVINIVNILRRSSFALRSFFVVHRSSTD

SEQ ID NO: 213848 - protein, 284 aa, Glycine max
  Coding DNA Sequence Number=SeqID_97070
  Homolog annotation: Hit_ID=Q8TGM6; Match level="QueryCoverage=42%, HitCoverage=97%, E-value=1e-09, Identity=43%"; Hit description =Protein TAR1
  Subcellular localization annotation: CTP_CleavageSite=60; ConfidenceScore=5.46e-01
ERFARQYRCGLHQSSSGFAPLRHSSPSFGSRQVCSHSNPSQKIRVGRRCNPQGDPTNQLPCALRVYSPVDSHTCQTPWSVFQDGPNGEPTGRRQERAGAEARQGRALPSTIAMMTSPRAYQQPGLGPPSQSASVNVPSRSADRLSPFHIRPGHIAGPHPLPSRQFQALFDSLFKVLFIFPSRYLFAIGLSPVFSLGRNLPPDWGCIPKQPDSPTAPRGATGSGHDGALTLSGAPFQGTWARSATEDASPDYNSDAEGDRFSWWAFPGSLAVTKGILVSFFSSAY

SEQ ID NO: 213849 - protein, 86 aa, Glycine max
  Coding DNA Sequence Number=SeqID_97071
  Subcellular localization annotation: CTP_CleavageSite=15; ConfidenceScore=5.44e-01
MSFLWFQSLAFLSTRRSPFSKDVTAARRHLQMTTRPYLQRTAHPHLQRTRRPGLQRVAHPRLQRTTCPHLQRIAYHHHQRVARLHL

SEQ ID NO: 213850 - protein, 228 aa, Glycine max
  Coding DNA Sequence Number=SeqID_97072
MSRKGNNTAGILAGLLAGAAAGVVLGMLYAPEEGKETRKKIKTKANDLKDQAKTKYGEVSERVKDQYDNISSTFKETANSVAHTVKDGYDKYKDQIVSKTTDVVKDMIETLKEYASKRIDLLKIEATEKSSLSAALDNYSYGFLIVAAFYLLIMILVVLFKKRIVNTVADQAELDDLENLLTFKNTKESLSAFTNGLTDQYLQEKVDEDGDEKIVLRKDVIAKQLTSE

SEQ ID NO: 213851 - protein, 162 aa, Glycine max
  Coding DNA Sequence Number=SeqID_97073
  Gene Ontology: Mol. function=cysteine-type endopeptidase activity; Cellular component=endoplasmic reticulum; Biological process =proteolysis
  Homolog annotation: Hit_ID=Q84Y03; Match level="QueryCoverage=91%, HitCoverage=44%, E-value=8e-31, Identity=46%"; Hit description =Cysteine protease
  Pfam annotation: Domain name=Inhibitor_I29; Domain location=1-43; Score=21.1; E_value=0.00011; Accession=PF08246.2; Description =Cathepsin propeptide inhibitor domain (
  Pfam annotation: Domain name=Peptidase_C1; Domain location=70-161; Score=-57.8; E_value=1.6e-07; Accession=PF00112.13; Description =Papain family cysteine protease
  Pfam module annotation: Pfam domain module=Inhibitor_I29::Peptidase _C1; Domain location=1-43::70-161
MAKRFEIFLSNLNYIIEFNAKRSSPSGYLLGLNNFADWSPSEFQEIYLHSLDMPTDSAPKLNGPLLSCIAPASLDWRNKVAVTAIKNQGSCAAGAIEGIHAITTGELISLSEQELVNCDRVSKGCNGGWGLLLEAVYPYTGKDGGNCNSDKVLLLSTPCSFP

SEQ ID NO: 213852 - protein, 55 aa, Glycine max
  Coding DNA Sequence Number=SeqID_97074
MELVVGPWTWGSLVSKVFLARPPLDSRRLKIKPLEREIAMWKRLTLEEDIVGEQG

SEQ ID NO: 213853 - protein, 116 aa, Glycine max
  Coding DNA Sequence Number=SeqID_97075
  Subcellular localization annotation: CTP_CleavageSite=38; ConfidenceScore=5.78e-01
MILKILPPISWSYATAVSFFLRFAFCVVSPPSSTSIVVVEVVSTTVMLFPSSRTKGLGRAALDRVIGRALEREDNRDSDEALQRRRPITFARRQTETTPIAEDVHHVDDAIDEVFQ

SEQ ID NO: 213854 - protein, 90 aa, Glycine max
  Coding DNA Sequence Number=SeqID_97076
MGNHYLPQTANETPFHHTYGIDAMIPIEVGEPLTRNIFFHTQQNKENMKVELDIREEVQEMARVNEEATKLEPQEDTTPKSGLMPFSLAT

SEQ ID NO: 213855 - protein, 373 aa, Glycine max
  Coding DNA Sequence Number=SeqID_97077
  Gene Ontology: Cellular component=cellulose and pectin-containing cell wall
  Homolog annotation: Hit_ID=Q41695; Match level="QueryCoverage=99%, HitCoverage=100%, E-value=0.0, Identity=78%"; Hit description =Pectinacetylesterase precursor
  Pfam annotation: Domain name=PAE; Domain location=11-350; Score =811.2; E_value=5.7e-241; Accession=PF03283.4; Description =Pectinacetylesterase
MEITRIGQWLSLLICVLLLLQTEGVPVGITFVENAVAKGAVCLDGSPPAYHFHKGSGAGINNWIVHFEGGGWCNNVTTCLSRRDTRLGSSKKMDTSLSFSGFFSNSKKFNPDFYDWNRIKVRYCDGSSFTGDVEAVDPKTNLHFRGARVFAVVVEDLLAKGMKNAQNAIISGCSAGGLASILNCDRFKSLLPATTKVKCLADAGFFINVKDVSGAQRIEEFYSQVVQTHGSAKNLPTSCTSRLRPGLIKNILAPGAADPRGQWRECKLDIKNCSPNQLSVMQGFRTDFLRAFSVVGNAASKGHFIDGCYAHCQTGIQETWLRNDSPVVAKTSIAKAVGDWFYDRRPFREIDCAYPCNPTCHNRIFDQNERPDV

SEQ ID NO: 213856 - protein, 105 aa, Glycine max
  Coding DNA Sequence Number=SeqID_97078
  Gene Ontology: Mol. function=DNA binding; Biological process=DNA integration
MYHIPREDNTRADLLSKLASTNKTGHLKTIIQETLQAPTIDINEVMAGVEKEPNWMKKGNYYIILDGELFKRGGHSLATEVVRAGYYWLTLKANTLNFMKKCRKC

SEQ ID NO: 213857 - protein, 676 aa, Glycine max
  Coding DNA Sequence Number=SeqID_97079
MAIEATGRDNGGEVKDVLKYCSGITSFVSVGALWRQLQLAKSGDTYKMTLVACGEDGHLFMRPALDGPLTSMSTGKMFEFNSKTFHRFKDTFFKVRATSAISDGLPLMYEENGEPPLLDAWAILCLPLASDPLLVLDVKLVGPAEGDVSLPPNNANELSGGGGDLTDARVDLPRASDVVEVTPDVPPSMATKRKRNKEALKHATGPPSTPSTIEAAAAMANAFDPPAPLSPPTQMVYAPSSSTPATSSFPLPCLLLHFPLHRHYDRWKLPSGGPLPGQCGEWSALRFNHQLPLLKCPKCGEWATVAFAEAIGFNHQLLSRVDNVFAKSVSTKLDNDEVFRRYKDVLKEKNDLAAKVECSAEEKEALNTMVAESAKLIVDLQAQLRDSELTASNLQAKPKEFELKVVNEKKGNKELEDELLTFKKEAMKQHKKKDRKLLDEDEIATMEVSDGEEGKWVDTWPHRGTLGVVLCVKYCTAMLDGHLGFDFNLVEGLAMVDSHDIALISGTIIMSAHWCIGYNTLHWPSVRLIWTLTRNIMVLSEEVYQKMDLGFVEPLEIRQGHICPGFGDTHQRRTLGLTSLWRFDQEHICPGFGETHQGQTFGLKSLWRFDQEHVCLGFGETHQGQILSLTSLWRFDQGHVCPGFGETHQGRTLGLVSLQRFDLEHVCPGFSETYQG

SEQ ID NO: 213858 - protein, 84 aa, Glycine max
  Coding DNA Sequence Number=SeqID_97080
MDYQLQAQVDPKTTKNLKDKYQAVYFSLLRTFFPGGEIHVEDSSVQGTTAVTFSRMESEGKLIMGFTKATNSAAVQVFELISTL

SEQ ID NO: 213859 - protein, 64 aa, Glycine max
  Coding DNA Sequence Number=SeqID_97081
MADEVVPTCPSSRLKPQMKTLQCTRSFFAPSSLIVDNVQAMLDLALTKKKEEAQTMYKPFLIWL

SEQ ID NO: 213860 - protein, 99 aa, Glycine max
  Coding DNA Sequence Number=SeqID_97082
MNWVLLIEDIMLKSHRLVDYEFPYVVHASRFIDYFNVDVFNEIVDFTKASSEMTERNFKKIGMRFVDHGWIKAGEPAARNIEQMEEDAKAEAPQEPAHQ

SEQ ID NO: 213861 - protein, 138 aa, Glycine max
  Coding DNA Sequence Number=SeqID_97083
  Gene Ontology: Mol. function=structural constituent of ribosome; Cellular component=ribonucleoprotein complex; Biological process =translation
  Homolog annotation: Hit_ID=Q2QD65; Match level="QueryCoverage=67%, HitCoverage=73%, E-value=8e-37, Identity=85%"; Hit description =Ribosomal protein S12
  Pfam annotation: Domain name=Ribosomal_S12; Domain location=15-138; Score=144.8; E_value=2.3e-40; Accession=PF00164.15; Description =Ribosomal protein S12
MGQILQDQTLWELRNDGRKEIKKKWDKRIDREKDFLFLLEDRDWIHICLSGSKGDLSVNFSTITPKKPNSALRKVARVRLTSGFEITAYIPGIGHNLQEHSVVLVRGGRVKDLPGVRYHIVRGTLDAVGVKDRQQGAF

SEQ ID NO: 213862 - protein, 85 aa, Glycine max
  Coding DNA Sequence Number=SeqID_97084
  Subcellular localization annotation: CTP_CleavageSite=54; ConfidenceScore=5.37e-01
MFLLVWWFDDKQRQLVVVTGGHGSWRRSSLSGSPLLALSVTFHAQCNSSRVGICAERNSSCAKRNNSRSVQFPLELELCLACFLR

SEQ ID NO: 213863 - protein, 74 aa, Glycine max
  Coding DNA Sequence Number=SeqID_97085
MAIVQDLVIANRKKRLIICRIKPDLKRAFKETIKATKEAQVLLTILMQVSQIRAHNNNNNKLNWICWIEWPQNN

SEQ ID NO: 213864 - protein, 80 aa, Glycine max
  Coding DNA Sequence Number=SeqID_97086
VNPKEQCNSITTRWETVVGLKDNGEKKNKEGVEKEKEKNDEVVTSEKVKEKVGQTYLSGGGRAEKDEDMRNPVDYVIGGD

SEQ ID NO: 213865 - protein, 76 aa, Glycine max
  Coding DNA Sequence Number=SeqID_97087
MGINSGTIAQAKLPLGEVGLTENIMGLEGDSYEVVEAIHVGLRGMRWSGYHASAFRSNKKGEVIEGSSGKMQRRWW

SEQ ID NO: 213866 - protein, 81 aa, Glycine max
  Coding DNA Sequence Number=SeqID_97088
  Gene Ontology: Mol. function=helicase activity
  Homolog annotation: Hit_ID=Q1SRJ5; Match level="QueryCoverage=99%, HitCoverage=10%, E-value=4e-12, Identity=45%"; Hit description =Probable helicase [imported]-Arabidopsis thaliana-related
GYDRVTTVLIHEDNDQTQNGGIHNDEIKEYLDCRRIFGFPIHGRKSAVERLHFHLPGQHIVLYEDHDDIDDVLSKPSISDS

SEQ ID NO: 213867 - protein, 85 aa, Glycine max
  Coding DNA Sequence Number=SeqID_97089
MAFSASMAVVEYYHLKHFPVPYETCYLLVTWWSIIIHVATCPFTGVQGEAHGCAFQRRKDAQSRHQRLFVENVGKTKGNRSKRKF

SEQ ID NO: 213868 - protein, 102 aa, Glycine max
  Coding DNA Sequence Number=SeqID_97090
MASPNHTPPNVAHTPNEDVDNSTPIPIKSQQPQADHAHVSQPMGETHEIPHHNLTNFKPRLKYATKGKAVSGVPLPNTLEGPCILRQEESLLLWRRKGSWII

SEQ ID NO: 213869 - protein, 107 aa, Glycine max
  Coding DNA Sequence Number=SeqID_97091
  Gene Ontology: Mol. function=DNA binding; Biological process=DNA integration
MVMDSKLVAYFSEKLPGDWVWVHMRKERFFAQRKFKLQPRGDLPFQFLVKINNNAYKLDLPREYGNESDSRTNDVDPCRACRPWIFFINGVLYFLKINDSRMEKEER

SEQ ID NO: 213870 - protein, 492 aa, Glycine max
  Coding DNA Sequence Number=SeqID_97092
  Gene Ontology: Mol. function=RNA-directed DNA polymerase activity; Cellular component=chromatin; Biological process=chromatin assembly or disassembly
  Pfam annotation: Domain name=rve; Domain location=201-334; Score =52.2; E_value=1.7e-12; Accession=PF00665.16; Description=Integrase core domain
  Pfam annotation: Domain name=zf-H2C2; Domain location=142-183; Score =19.8; E_value=0.00085; Accession=PF09337.1; Description=His(2) -Cys(2) zinc finger
  Pfam module annotation: Pfam domain module=rve::zf-H2C2; Domain location=201-334::142-183
MTTLPFGHHFTIVTDHHSLKELLNQVIQTPEQHMYLAHLMGYDYDIQYRSDSHNQAADALSRLPEHDSPMLMVLSVPCLTFMKELCHQLDNHSAYQHYLQEVLTCPTKHPGPEVSQGLILSKGRIWLPRSLPIASTLLTEHHATPTGRHIGVTKTLARIMKNFVWPGLREDVAQFVANCVKCQVTKYEAKKMVGLLCPLPVPHRPWEDLSLDFIVGLPSYQGNIVLLVVVDRFSKGIHLGMLPSNYSALMMASLFLDIVVKLHGLPRSLVSDRDPLFVSRFWQELFWASGTQLRMISPYHPQSDGQTKLLSWVELSHNASWIRGTGSTPYEITFGCKPFNFPEYVAGTSKVDVVEEILTEREEIFQSIRPGTSRTGSLSITFTGTARIHLVFHCSLLKPFHGSPENTDVAELPTQFANHQPLISPLAILDYCRASPSAPWEARGMTQNRLNIHKDKKGGANIGQAQKEAHKTSIPQWLHMKKQTKAQDPCLP

SEQ ID NO: 213871 - protein, 406 aa, Glycine max
  Coding DNA Sequence Number=SeqID_97093
  Gene Ontology: Mol. function=RNA-directed DNA polymerase activity; Cellular component=chromatin; Biological process=one-carbon compound metabolic process
  Pfam annotation: Domain name=RVP_2; Domain location=183-305; Score= -30.1; E_value=0.00022; Accession=PF08284.2; Description=Retroviral aspartyl protease
MPGHRKISEADLIEIENYITIGIRPPQIYVAFANTSGGYENVRFVRKDLCNQVHRICRGYKLDVEGAFKFFKELYQFSDAMKGRAACSEITYGDLAMRNATDENNWVAELYKKRNMWSPAHNHGNFFAAISKVFNLFRFHEVEVDYDSKVGSLGLEIDFHAIKRSGAEVITKELFMAFQSNLKTMMLRVDECQEMGMSCVYTVEAVLLLVDGGSTHNFIQQHLVTQLGLPFRTTTPLSVMVGNGQQLECCWLCEAVTIDLQTASFTVDLYVLPIVGANVILGVQWLQSLGDKDAKMGMMTPPQLRRLCRKLGNATCFHVTVVPKDTSPTPTTDFSPELRALLTKFSSLFQNPQSLPLARDIDHNIHLLPADTTQHQPVLFTGAVGEETRRLMEVLCRLPSPECPHR

SEQ ID NO: 213872 - protein, 69 aa, Glycine max
  Coding DNA Sequence Number=SeqID_97094
  Gene Ontology: Mol. function=RNA-directed DNA polymerase activity; Cellular component=chromatin; Biological process=chromatin assembly or disassembly
MVKMILRRAVIDENVIEKDDDELSKLFWECPPHACESGGSLVTDLALRSNAHHRVHPRARQLWESRIDS

SEQ ID NO: 213873 - protein, 155 aa, Glycine max
  Coding DNA Sequence Number=SeqID_97095
  Gene Ontology: Cellular component=cellulose and pectin-containing cell wall
  Homolog annotation: Hit_ID=Q41695; Match level="QueryCoverage=81%, HitCoverage=31%, E-value=9e-44, Identity=59%"; Hit description =Pectinacetylesterase precursor
  Pfam annotation: Domain name=PAE; Domain location=1-132; Score=-73.6; E_value=2.7e-11; Accession=PF03283.4; Description=Pectinacetylesterase
MDEIRSSKTNCGDILLVFYSNPQDIALIQIQNIFVPGSADPSDSWHSCKLDISNCSPDQLSKMQDFKSEFEKAVSVVGDSSSKGMFIDSCYAHCQTESQETWYKSDSPQLANTTIAKAVGDWFYGRSSFRHVDCNYPCNPSCQNRVFDLKDHPGI

SEQ ID NO: 213874 - protein, 105 aa, Glycine max
  Coding DNA Sequence Number=SeqID_97096
MNGHVEYRACRIIDKESVWCMFNTFTNMPSGICMELRVEVHTSPPPSQANELIWTEMEQKRLCMYSQANAGVPQSVPKTCSGIHLVGNWWNVVYVRRTRWNIIRD

SEQ ID NO: 213875 - protein, 138 aa, Glycine max
  Coding DNA Sequence Number=SeqID_97097
  Gene Ontology: Mol. function=rRNA binding; Cellular component =ribonucleoprotein complex; Biological process=ribosome biogenesis and assembly
  Homolog annotation: Hit_ID=O80362; Match level="QueryCoverage=96%, HitCoverage=67%, E-value=1e-36, Identity=52%"; Hit description=50S ribosomal protein L10, chloroplast precursor
MAQHPLFLRVLNIRLENGNKLSSKGLKSVDKGGTKALQSPQESVINLSTGREGFEVLNLVGAIKLALKNDVGEVVVLELLLLLEVPKGLDGKRNIPGHALHHLVDKHVPCHDQLHCFWERLSELLELLHSEAIVVDAS

SEQ ID NO: 213876 - protein, 272 aa, Glycine max
  Coding DNA Sequence Number=SeqID_97098
  Gene Ontology: Mol. function=RNA-directed DNA polymerase activity; Biological process=RNA-dependent DNA replication
MMMHDAIQISNVLRCNKQYNNQYKFHSRELGILWIVHHVAPLSLTQGIAKRKVYSKKRWCKKDLGLHETTGPKNRQKTPCVTDGLKVTRLTRAELELNKLEKEVNDRQLSEQEIKMRKHWQEELWVATHSNESIIRQKARTRWIKDGDCNSWFFHLIVNRKQRFNMIRGVFADGCWIKEPCRVKEEIRQFFKRRVKVLEKERPRLDRDFLLDMVRWMRFYTKWITWIAGCLKSASISILVNRSPSAKFTPQRGLRQGDPLAPFLFNIVAEGL

SEQ ID NO: 213877 - protein, 64 aa, Glycine max
  Coding DNA Sequence Number=SeqID_97099
MKEKDLWLEFKKWGDVREVFIAKNKNRNGLKLHANLPKHGREWKMKEKTSNNYQHKKWPLKENL

SEQ ID NO: 213878 - protein, 410 aa, Glycine max
  Coding DNA Sequence Number=SeqID_97100
  Gene Ontology: Mol. function=metal ion binding
  Homolog annotation: Hit_ID=Q9FH81; Match level="QueryCoverage=89%, HitCoverage=59%, E-value=4e-22, Identity=28%"; Hit description =Arabidopsis thaliana genomic DNA, chromosome 5, TAC clone:K9E15
  Subcellular localization annotation: CTP_CleavageSite=58; ConfidenceScore=5.76e-01
MGSNGSKATSSSFGSSSSSSSSSGSLRKGRSKGLKVFQSCCLGTTSGSHDSDNEDQVCDQNKVNGSDVTYADGNGTDSDEVKTESFRKVIAGEMTCVPSNIDLDGWGETSIPNTSSRTGSISVHSSSTHSLNPTSHCLSRFSLIPGNVSFRLSRTTSLGSSRPRPVSSANLSIFDNEDEHNLNPGSPGRLINRSETQQCSNLLPASFSNQIHAQCHEDASNNSRSNVPTSGVVGNLQSYPTDGVCARERPDVNLFSLRIQTDTENVDNDTRHIDQRIGAREPVERNVRFSRTLSVGRLRDRVLRQSTLSDLTFFPLQQERELRDASLPSQDIIDRQAVEGDSRVSPSDHSTINSSTSRYPPSSMSNSIFSIQDYEVETSRLREGRYQDLLEHRSNFLERRRRIRPQVCGF

SEQ ID NO: 213879 - protein, 97 aa, Glycine max
  Coding DNA Sequence Number=SeqID_97101
  Gene Ontology: Mol. function=transferase activity, transferring nitrogenous groups; Biological process=amino acid and derivative metabolic process
  Homolog annotation: Hit_ID=Q4ZJF7; Match level="QueryCoverage=85%, HitCoverage=19%, E-value=3e-30, Identity=77%"; Hit description =Tyrosine aminotransferase
MAFLDWQAVVSQIIAHTEEVFFKKTIHNLRHVAYICGKELKDIPYFICPYKPQEFMAMMVRLNLSLLEDIRDDIDFCFKLAKEESVIILPKSIPLVK

SEQ ID NO: 213880 - protein, 175 aa, Glycine max
  Coding DNA Sequence Number=SeqID_97102
  Gene Ontology: Mol. function=metal ion binding
  Homolog annotation: Hit_ID=Q9FH81; Match level="QueryCoverage=87%, HitCoverage=28%, E-value=2e-38, Identity=55%"; Hit description =Arabidopsis thaliana genomic DNA, chromosome 5, TAC clone:K9E15
  Pfam annotation: Domain name=zf-C3HC4; Domain location=117-158; Score= 44.8; E_value=3e-10; Accession=PF00097.15; Description=Zinc finger, C3HC4 type (RING finger)
VHALQRLGSRFENLSGHDRTCVLSGQHRNGRCTCRINNRNTNSNDDTGARANISRIVMLAEALFEVLDEIHLQSVVLSSRPSVSSIGPVPAPNDVVDSLPVKLYEKLHKHQEDAAQCYICLVEYEDGDNMRVLPCHHEFHRTCIDKWLKEIHRVCPLCRGDICISDSTPTENSSD

SEQ ID NO: 213881 - protein, 71 aa, Glycine max
  Coding DNA Sequence Number=SeqID_97103
MALVDAEIHDRVINLIRINLTNQLDPYDLQTTLTHTQHKCEESAWVVLIFLRNVGCTSNNAGCTSNNAECT

SEQ ID NO: 213882 - protein, 326 aa, Glycine max
  Coding DNA Sequence Number=SeqID_97104
  Gene Ontology: Mol. function=protein serine/threonine kinase activity; Cellular component=integral to membrane; Biological process=protein amino acid phosphorylation
  Homolog annotation: Hit_ID=Q2R440; Match level="QueryCoverage=86%, HitCoverage=58%, E-value=5e-61, Identity=35%"; Hit description =Leucine Rich Repeat family protein
  Pfam annotation: Domain name=LRRNT_2; Domain location=1-40; Score =38.8; E_value=1.8e-08; Accession=PF08263.3; Description=Leucine rich repeat N-terminal domain
  Pfam annotation: Domain name=LRR_1; Domain location=118-140; Score =12.6; E_value=1.2; Accession=PF00560.23; Description=Leucine Rich Repeat
  Pfam annotation: Domain name=LRR_1; Domain location=142-165; Score =5.9; E_value=23; Accession=PF00560.23; Description=Leucine Rich Repeat
  Pfam annotation: Domain name=LRR_1; Domain location=167-189; Score =10.7; E_value=2.8; Accession=PF00560.23; Description=Leucine Rich Repeat
  Pfam annotation: Domain name=LRR_1; Domain location=191-213; Score =11.7; E_value=1.9; Accession=PF00560.23; Description=Leucine Rich Repeat
  Pfam annotation: Domain name=LRR_1; Domain location=215-238; Score =5.7; E_value=25; Accession=PF00560.23; Description=Leucine Rich Repeat
  Pfam annotation: Domain name=LRR_1; Domain location=240-262; Score =2.6; E_value=92; Accession=PF00560.23; Description=Leucine Rich Repeat
  Pfam annotation: Domain name=LRR_1; Domain location=69-91; Score =11.3; E_value=2.2; Accession=PF00560.23; Description=Leucine Rich Repeat
  Pfam annotation: Domain name=LRR_1; Domain location=93-116; Score =7.6; E_value=11; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1; Domain location=1-40::118 -140::142-165::167-189::191-213::215-238::240-262::69-91::93-116
MTDQLSSLRFKEAVENNPFNVLASWNSSTHFCKWHGVTCSLKHQRVTALNLQGYALRGLITPEIGNLTFLRYVNLQNNSFYGEIPHEIGRLFRLQELCLTNNTLKGRQIPTNLSSCSELKGLSLSGNKLVGKIPMELGFLAKLELLYIAMNNLLTSEIPASIGNLSSLSFLSLGVNNLEGNVPEELGHLINLTHISIADNKLSGMLPSTLFNIPSLTFFSAGANQFNGSLPSNMFLTLPNLQQFGIGMNKISGPIPASISNATRLLLFNIPRNNFVGQVPIGTHIVLHSIARDTIHSLTHSLVYHSLFSSKELHTYTLGITLATEK

SEQ ID NO: 213883 - protein, 285 aa, Glycine max
  Coding DNA Sequence Number=SeqID_97105
  Gene Ontology: Mol. function=hydrolase activity, acting on acid anhydrides, catalyzing transmembrane movement of substances; Cellular component=proton-transporting ATP synthase complex, catalytic core F(1); Biological ...
  Gene Ontology: Cellular component=process=plasma membrane ATP synthesis coupled proton transport
  Homolog annotation: Hit_ID=P56757; Match level="QueryCoverage=94%, HitCoverage=66%, E-value=1e-118, Identity=95%"; Hit description=ATP synthase subunit alpha
  Pfam annotation: Domain name=ATP-synt_ab; Domain location=1-209; Score=374.5; E_value=1.6e-109; Accession=PF00006.15; Description=ATP synthase alphabeta family, nucleotide-binding domain
MIPIGRGQRELIIGDRQTGKTAVATDTILNQQGQNVICVYVAIGQKASSVAQVVNTLQERGAMEYTIVVAETADSPATLQYLAPYTGAALAEYFMYRERHTLIIYDDLSKQAQAYRQMSLLLRRPPGREAYPGDVFYLHSRLLERAAKLSSQLGEGSMTALPIVETQSGDVSAYIPTNVISITDGQIFLSADLFNAGIRPAINVGISVSRVGSAAQIKAMKQVAEIGQVRKFLVELRAYLNTNKPQFKEIISSTKTFTGEAEVLLKEAIQEQMELFLLQEQVEKN

SEQ ID NO: 213884 - protein, 95 aa, Glycine max
  Coding DNA Sequence Number=SeqID_97106
FNDPNARVLQGVRKAWDAAQKKDKELRGSSNGVISGYHKWLRVRTQGLDWPPKLKAAREEEAEAPEESEEVQALKVELEKARAVKEKFKSTTIKV

SEQ ID NO: 213885 - protein, 86 aa, Glycine max
  Coding DNA Sequence Number=SeqID_97107
MAEFTHSKTIIEQLEDAITKLTNHQISLSDTLHVVALKLEQLLHQMPSPDYHSMSEHERLTIASFYMEDRALAWLQWMRSNGQFSS

SEQ ID NO: 213886 - protein, 111 aa, Glycine max
  Coding DNA Sequence Number=SeqID_97108
MEEFTSTISLNQTMKLREAQAVDQVLLDKIMGVTPVTKYHHLLVCDMAQKVGDIWKTLIVIRDQEKYLGGTFVEDGLSGVGNNGGGVGEMEEGPNEMVGEGKGKVLSQNER

SEQ ID NO: 213887 - protein, 119 aa, Glycine max
  Coding DNA Sequence Number=SeqID_97109
  Subcellular localization annotation: CTP_CleavageSite=51; ConfidenceScore=5.34e-01
MHNAKYTGSSHWQMGIKSMFGWRNLIGIRQLLPKTSALVQLPAVTVRFVVRGTPVMPVNEHGLWFGSQFKSRVGFGREFLKLRSCRVGTEEEDAEHTKRKKRSKRELLYRAFIFSRYRR

SEQ ID NO: 213888 - protein, 152 aa, Glycine max
  Coding DNA Sequence Number=SeqID_97110
  Homolog annotation: Hit_ID=Q2HRX8; Match level="QueryCoverage=73%, HitCoverage=20%, E-value=2e-11, Identity=31%"; Hit description=IMP dehydrogenase/GMP reductase
  Pfam annotation: Domain name=DUF1723; Domain location=76-125; Score =37.1; E_value=5.9e-08; Accession=PF08330.1; Description=Protein of unknown function (DUF1723)
MQMKPPNDEGPQHPHPEEAAADDVGTDVEGFSGGPHDTSVLHDYVYHVAMKVWNEEIKGLVAATGLSPLIACSLDTGDQGLMSAFVERWHKETSSFHLLIEEVTITLDDLASLLHFPITCTFHSFEPLHVDDVIFLLVELLEVSAEEARAKI

SEQ ID NO: 213889 - protein, 282 aa, Glycine max
  Coding DNA Sequence Number=SeqID_97111
  Gene Ontology: Mol. function=guanyl-nucleotide exchange factor activity
  Homolog annotation: Hit_ID=Q93ZY2; Match level="QueryCoverage=60%, HitCoverage=32%, E-value=2e-19, Identity=35%"; Hit description=Rop guanine nucleotide exchange factor 1
  Pfam annotation: Domain name=DUF315; Domain location=1-152; Score= -153.0; E_value=3e-07; Accession=PF03759.4; Description=Domain of unknown function (DUF315)
ASLGEELHKVLIAESSSREEMLKALNLNSEHAALETINRLEAATFSWKERIIQENSGKSPVRTSWSFMKDPMAGIDKMELLLERAETLLNLLKARYPNLPQTFLDAAKVQYGKDIGHSILEAYSRVLGSLAFSILSRIADILQEDALSNPNTPISASCSPGINLSEAWVVGSRIRHSLIDKMNEADGQYCASSCGSTSDIELSSTQANATSSVPTTPSRGRLWCIAPSSSSFFIPPSPRAAAVRATYPAVSDRQDHRIERDWAIRIRHTIQIVNPYALRISV

SEQ ID NO: 213890 - protein, 245 aa, Glycine max
  Coding DNA Sequence Number=SeqID_97112
  Gene Ontology: Mol. function=chitin binding; Cellular component =extracellular region; Biological process=chitin metabolic process
  Homolog annotation: Hit_ID=UPI000044A8F0; Match level="QueryCoverage =92%, HitCoverage=99%, E-value=2e-34, Identity=29%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
TSSPLKGLHVLAFRGLLVLAFRGLPVLTFRGLCALAFRGLHILAFRGLYALAFRGLYALAFRGLHVLTFRGLHVHAVRGLHALAFRGLHVLSFRGLHALAFRGLHVLSFRGLHALTFRGLHVLAFRGLHFLAIRALHALTFRGLHVLSFRGLHAFTLRGLHALTYSGLHVLAIRGLHALTFRGVHVLAIRGIHAFTFRGLHALAFRGLHALTFRGLHALAFRGLDVFAFGGLHICTLREFKVLCP

SEQ ID NO: 213891 - protein, 127 aa, Glycine max
  Coding DNA Sequence Number=SeqID_97113
MEVAQFSWAYMSHLKQAAEDMRPRIDDKHPRWLHLRIRPSSLPVLDPAKFNHPRKLKTKAFVDGRWTLAFRDEESCKSALSMILEEINFLSDEVHRRLKPLLNLETALDLSGPEEDSSTLSTSPNSV

SEQ ID NO: 213892 - protein, 586 aa, Glycine max
  Coding DNA Sequence Number=SeqID_97114
  Homolog annotation: Hit_ID=Q2QYU1; Match level="QueryCoverage=86%, HitCoverage=92%, E-value=1e-104, Identity=42%"; Hit description =Nodulin-like family protein, expressed
  Pfam annotation: Domain name=MFS_1; Domain location=72-501; Score= -5.5; E_value=0.00056; Accession=PF07690.6; Description=Major Facilitator Superfamily
  Pfam annotation: Domain name=Nodulin-like; Domain location=47-250; Score=253.1; E_value=5.8e-73; Accession=PF06813.4; Description =Nodulin-like
  Pfam module annotation: Pfam domain module=MFS_1::Nodulin-like; Domain location=72-501::47-250
  Subcellular localization annotation: CTP_CleavageSite=39; ConfidenceScore=5.11e-01
MRPRRETEKRRFDFDSANTNNSASSSPKSPRRRPKLLAVLMAGQSRKWMILVATIWIQAFTGTNFDFSQYSSSLKFALNVSQVQLNYLATANDMGKVFGWSSGIALMHLPVSVVMFVAAFMGFFGNFPVNRALALSLTVSFNGISAALYTLVANSIDPSSDALYLLLNALVPLLICIAVLVPILNQPALDPLPPDAVNRDSVIFLILNFIALLTGLYLLLFGSSASGVTSARFYFGGAIFLLIFPLCIPGIVYARAWFQHTIHSSFQMESSSFILVHDDDLEMHKELHSRQNSIVSNGDTYSLLSNNGYMFGSQREKDSDPCCETMIGQDQLAVLGEEHSVAVVVRRLDFWLYYATYFCGGTLGLVYSNNLGQIAQSVGQSSNTSTLVMLYASFSFFGRLLSAGPDYIRNKIYFARTGWLSIALIPTPVAFFLLAASDSLLALQTGTALIGLSSGFIFAAAVSVTSELFGPNSVGVNHNILITNIPIGSLLYGFLAALVYDANAPSMPGNLITSDSVVCMGRQCYFWTFVWWGCISVLGLASSMLLFLRTKHAYDHFEKNPVEAGAMLRPCVGSKDAATLYFFSSF

SEQ ID NO: 213893 - protein, 495 aa, Glycine max
  Coding DNA Sequence Number=SeqID_97115
  Gene Ontology: Mol. function=transferase activity; Biological process= biosynthetic process
  Homolog annotation: Hit_ID=Q5VPB6; Match level="QueryCoverage=94%, HitCoverage=93%, E-value=1e-158, Identity=58%"; Hit description =Glycosyl transferase family 1 protein-like
  Pfam annotation: Domain name=Glycos_transf_1; Domain location=300 -465; Score=66.2; E_value=1e-16; Accession=PF00534.10; Description =Glycosyl transferases group 1
  Subcellular localization annotation: CTP_CleavageSite=49; ConfidenceScore=5.59e-01
MALNTTKSKKSTSPSNFYFCTTLFFIVLFTIPVLFLLHAPTTTSICTTLASSQAKTWSGDLQLVEFAWNRLSFFEHNPSPFALKVAVFSRKWPIGTTPGGMERHAHTLHTALARRGHQVHVFTSPPEDESISVSSSEVNENKHQEGAPSSPYIHFHEGEPGRWRYNKAWEQFVEENQREPFHVVHSESVALPHWLARNMSNLAVSWHGIALESLQSSIFQDLTRRQDEPMSPLFNKSIQGVVPKVLNEIRFFKNYAHHVAISDSCGEMLRDVYQIPNRRVHVILNGVDEDDFGEDVELGREFRTKIGIPGNASLVLGVAGRLVKDKGHPLLHEAYSRLITKHPNVYLIVAGSGPWENRYRDLGSQVLVLGSMSPSMLRAFYNAIDIFVNPTLRPQGLDLTLMEAMMSGKPLLASRFPSIKGTIVVDDEYGYMFSPNVESLQEALEAVVKEGPQRLARRGKACREYAAKMFTARKMALAYERLFLCIKDRSFCTYP

SEQ ID NO: 213894 - protein, 317 aa, Glycine max
  Coding DNA Sequence Number=SeqID_97116
  Gene Ontology: Mol. function=guanyl-nucleotide exchange factor activity
  Homolog annotation: Hit_ID=Q93ZY2; Match level="QueryCoverage=66%, HitCoverage=39%, E-value=2e-52, Identity=48%"; Hit description=Rop guanine nucleotide exchange factor 1
  Pfam annotation: Domain name=DUF315; Domain location=1-317; Score =285.2; E_value=1.2e-82; Accession=PF03759.4; Description=Domain of unknown function (DUF315)
MTYNGLENCIPDNQSYGDESRTSRGDGCITDSFNDDDSSSSSSKDAFGSFSSKCLTMKRDDHGLEEWELTESPQHFYLKDKSAFDVVNCSDVEAMKEKFAKLFLGGDVTGGAKGLNTALALSTAITNLAVTVFGELWKLEPLSEERKSKWRREMGWLLSPTNYMVQLVPAKQNGANGGIFEIMTPKARADIQMNLPALQKLDSMLIEALDSMVQTEFWYAEEGSRSEGRNTSGRHSKRWWLPSPRVPRTGLSDIERKRLLNQGRVVQQIFKAAKAINDNMLLEMPVPTLIKDALLKPQANCSPLVLIRKQNDSNKIG

SEQ ID NO: 213895 - protein, 79 aa, Glycine max
  Coding DNA Sequence Number=SeqID_97117
MERRRSITKHVNRTTNDGTEEKRNGASGNVEKSVFAESGPFDQPFHVADDALVHTNGHDDGVQGFMVGPKIVGPRGPMI

SEQ ID NO: 213896 - protein, 227 aa, Glycine max
  Coding DNA Sequence Number=SeqID_97118
  Homolog annotation: Hit_ID=Q8S342; Match level="QueryCoverage=28%, HitCoverage=14%, E-value=6e-08, Identity=42%"; Hit description =Putative anthocyanidine rhamnosyl-transferase
MVTREKVQIHYMIDCKTVGRKEDGYLIPWDELDGSLTSDVVADSIRLVMVENEGRIYREKIKEVKDLFVNVDSQERFLVQQQHHFRLINGNMAATKICMCNQVAIVSIIATNQGIGFGFNSTHIVIPQFILGSWLRETFKTILLRWFTLSEPTWEDNETFVKTYPAFNLVEKVVLEGEGNDTLLRETSSPNEVMEDNARYGPANESESTIAMPQRLKTIPFWRKVYV

SEQ ID NO: 213897 - protein, 237 aa, Glycine max
  Coding DNA Sequence Number=SeqID_97119
  Gene Ontology: Mol. function=transferase activity, transferring hexosyl groups; Biological process=metabolic process
  Homolog annotation: Hit_ID=Q8S342; Match level="QueryCoverage=47%, HitCoverage=29%, E-value=2e-17, Identity=33%"; Hit description =Putative anthocyanidine rhamnosyl-transferase
MGDFTVPPLWIPFPTTVAYWHFKIMRIFNIVSDNDSGISDIYRFGTAIQNYDIVVIRGCIKFKPEWFEVLENIYQKSILLEWLDNQEHESQVYVVFGCKVKPRRDEVIEIALVYEAPTQDTTWTRTRGHLSVGNNLSLTSAKSNPTLEYISEGQPSPLELAFESLLCGDKRPPFVVHVPSPGSAWHEGATTCSKGGVWFACGKQQGEDEEDGKQQLIFTKHARALIKHDLINQMPPN

SEQ ID NO: 213898 - protein, 49 aa, Glycine max
  Coding DNA Sequence Number=SeqID_97120
MVLPNDKSKKAEAAEMLVAQGKSEAKDMRVIVEEFLFEARYKELHMFNP

SEQ ID NO: 213899 - protein, 139 aa, Glycine max
  Coding DNA Sequence Number=SeqID_97121
  Gene Ontology: Mol. function=glycine hydroxymethyltransferase activity; Cellular component=mitochondrion; Biological process=L -serine metabolic process
  Homolog annotation: Hit_ID=Q5IWY0; Match level="QueryCoverage=85%, HitCoverage=55%, E-value=5e-41, Identity=70%"; Hit description =Plastid glycine hydroxymethyltransferase
  Pfam annotation: Domain name=SHMT; Domain location=29-139; Score= -135.3; E_value=1e-08; Accession=PF00464.10; Description=Serine hydroxymethyltransferase
MTKNDLFCPWNHMQLQILGDGSSFLDYGLSEADPEVRAIIDKEKDRQFKSLELIASENFTSRAVMEAVGSCLTNKYSEGLPGKRYYGGNEYIDELETLCQQRALATFHVDGNKWGVNVQALSSSPANFAVFTAVLKPHD

SEQ ID NO: 213900 - protein, 127 aa, Glycine max
  Coding DNA Sequence Number=SeqID_97122
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=P26205; Match level="QueryCoverage=96%, HitCoverage=29%, E-value=2e-52, Identity=76%"; Hit description =Cyanogenic beta-glucosidase precursor
MKEDDFRNYAELCFKEFGNGVKHWITLNEPRSVSKNGYANGKFAPGQCSDWLKLNCTGGDSGTEPHLTWRYQLLAHATTAKLYKTKYQASQKGLIGITLNSDWYMPVSKEKSDRDAARRGLDFMFGW

SEQ ID NO: 213901 - protein, 207 aa, Glycine max
  Coding DNA Sequence Number=SeqID_97123
  Homolog annotation: Hit_ID=Q9FH78; Match level="QueryCoverage=73%, HitCoverage=76%, E-value=5e-44, Identity=57%"; Hit description =Arabidopsis thaliana genomic DNA, chromosome 5, TAC clone:K9E15
  Pfam annotation: Domain name=Hin1; Domain location=49-186; Score =87.8; E_value=3.3e-23; Accession=PF07320.4; Description=Harpin -induced protein 1 (Hin1)
MATTMPKFKRKLVMGANGRTNPLVWLVAIICTIIAVAVVVVGIVVFIGYIVIHPRVPVISVTNAHLDLLRNDYAGLLQTQLTIVVTAKNGNAKAHASFSAITFNISYQGQDIAVLVADPFEVPKNSSKDLSYVVQSSSIPLTPDQMEEVNDAWKRNEIEFDFKGAARTQWRVGPLGSVKFLCHLDCDLKFRPVNGTYIPSRCTSKSH

SEQ ID NO: 213902 - protein, 54 aa, Glycine max
  Coding DNA Sequence Number=SeqID_97124
METGGSNRALPGFFVDHVMARARNEKHSTEETLKTSMPRPEFWYHDSPFTPPRQ

SEQ ID NO: 213903 - protein, 73 aa, Glycine max
  Coding DNA Sequence Number=SeqID_97125
ISLEGTSEPPTPVVDLSSPQLVADPSTPLLDILEDETTPVLALNTSPPATPVLHLTDKEDAQTQDTQDLSQEF

SEQ ID NO: 213904 - protein, 286 aa, Glycine max
  Coding DNA Sequence Number=SeqID_97126
MLESNPFNGVAHEDPMQHLRKFIKLTNSMRQNCVPIEYIRLYAFPFSLRGRHEIGCAHYLRTTSLHGTSAQMPSYKVSSQNKTSLDVACGGNLMLKTPAYAIMIIEDMCSNPYNNSWDRRIMKRGINQVEKDDSKIKLGKRIQALKLKIETLMRAQAQVPFIAPSFPTYDRCGIVHGLEECTIDDKLGATMLGNLPSQPKPNPKREDVNTVMTRSKRIQQDSEENKSSFPKAIDDVLTEKDQALRKVEVPTDGNPVANKEGGNEVSIPPQVQNIEDEDSNYFNNVL

SEQ ID NO: 213905 - protein, 100 aa, Glycine max
  Coding DNA Sequence Number=SeqID_97127
MVESSKKRKGSLPPPPLQHFNIPLDDEPFVKVKRSFAIGAAVVASFGYRKDLDGQWIRKQDLPSNAPEECTPSPPPRDPSSSLLNDVLNKLQDLHAFVGD

SEQ ID NO: 213906 - protein, 103 aa, Glycine max
  Coding DNA Sequence Number=SeqID_97128
MELTSGLDNTTSDEEGEEEANLCQMTDHTKLKEIHQSKDIGSLIETTQNNEAYDTLKRELCLLLKNEVLKGQPQDVVKHNEEIDTLKKSLTKFVGGTENLDKL

SEQ ID NO: 213907 - protein, 117 aa, Glycine max
  Coding DNA Sequence Number=SeqID_97129
MDQEDHINTINLEDLDYLDRLYDDLTLGSVLKSNWIFTLQPSTFSLVEGNNFLNNFLVSTETPFPIQVEDYCLTKLPPYVQTWPHTIPNCTSWYDKESPLLEAVEEFARMDPLKQAF

SEQ ID NO: 213908 - protein, 94 aa, Glycine max
  Coding DNA Sequence Number=SeqID_97130
MTNVDDEINLLLHKKEALEINLRLGEKGLTKDLKSWNAMRDQLSQLENELAADLANAGTTSSTIVLDTSSIVPNTSSVVLDSMATNDTASASNY

SEQ ID NO: 213909 - protein, 209 aa, Glycine max
  Coding DNA Sequence Number=SeqID_97131
  Gene Ontology: Mol. function=RNA-directed DNA polymerase activity; Biological process=RNA-dependent DNA replication
ALADFLAECVEIEDVMVEMNKDINLQPWVSMFDGSKTREFVGVGIKVADLEGKGDDYHGSTMCIYLGRFTIGNELAQSALRYKLLDENTQLKEYPLANCHALDVDKALKYMMGDDVLFRRSVNGVLLKCINKEDALKVIGEVHEGTCGAHQSRYNMKWTINRYDNYWPTIIKDYFLYARGCEEYQKHGNIQRVPVDELNLVVKPWPFKG

SEQ ID NO: 213910 - protein, 73 aa, Glycine max
  Coding DNA Sequence Number=SeqID_97132
MHALLGSFNSGNWSDSDDLDRTGLSCRTIMRRDFHTIYLFTEIAYQVTQVPREFGTRFLPFYTTCVIRCTCRK

SEQ ID NO: 213911 - protein, 62 aa, Glycine max
  Coding DNA Sequence Number=SeqID_97133
MVTTISAIMNRCDFIVEDYVDNEGETPNNTSPLISKYLGDIVKPTVLNEIQKAREKERHQHD

SEQ ID NO: 213912 - protein, 113 aa, Glycine max
  Coding DNA Sequence Number=SeqID_97134
RIQGTNRLRILCPNTLEGTSFVVQVEGTSTWVVILRTREDTSLVDQFKWRVHPLGCSKRTREGTSLVDLWLVKDFTRLNEISRTVGCLGTGCRHGLLPNQYKYCVCLLLPYTL

SEQ ID NO: 213913 - protein, 78 aa, Glycine max
  Coding DNA Sequence Number=SeqID_97135
MMLHSLNQRLLLGGLSSRQKGTTECGYYVMHWMSTIILGSFRNNWEAYFNDPRPLEPERLKALRIQWAQFYLRVRDQA

SEQ ID NO: 213914 - protein, 108 aa, Glycine max
  Coding DNA Sequence Number=SeqID_97136
MHIRPQTHRHHLGRPIQLGHWVWSVIYSIWFTSRWPTTMDSLSQQGQGSAPFVCPTPKQFGAEVAWPGDWPDALAGEEPAGSPGEADESRMDEDMTDLLGFLGGSGAT

SEQ ID NO: 213915 - protein, 127 aa, Glycine max
  Coding DNA Sequence Number=SeqID_97137
  Gene Ontology: Mol. function=polygalacturonase activity; Cellular component=cellulose and pectin-containing cell wall; Biological process=carbohydrate metabolic process
  Homolog annotation: Hit_ID=Q1S5D1; Match level="QueryCoverage=90%, HitCoverage=29%, E-value=3e-24, Identity=44%"; Hit description =Polygalacturonase
MVGTKNTFYNVMDFGAHGNGKSDDSHAFSSAWQHTCGTQGTSTLVIPPKGVFLVTNITLKGPCKARSIHILLQGKIVAPAKDAWAKGLDPLILISNLNGLTIDGSGGQIDGFGSTWWKCRSCLRPRV

SEQ ID NO: 213916 - protein, 52 aa, Glycine max
  Coding DNA Sequence Number=SeqID_97138
MAKIQGPKEGKTYSNIYKVERTQPWSMGSEIYPGDCIRNYKAKDVESYETSQ

SEQ ID NO: 213917 - protein, 216 aa, Glycine max
  Coding DNA Sequence Number=SeqID_97139
  Subcellular localization annotation: CTP_CleavageSite=28; ConfidenceScore=5.60e-01
YLALDGIYRPIGAAFPNNPTRRQRLVVRQGPGTTGLSPSLAPPSRGLGPGPPLRTLLQTTIRTPRATDFHGGLFPRVAPPDLRSRWERACTQRVVDGSRTDRLARDWSRAWLIHHFITAKSAMNPDFNQPRGGCSREVSIHPAQQHCYMFALGKRCVTPRQACPRPNGFGRNLRSKTRWFTGFCNSHQVSHFATFFIDAKSRDIRCRESLYVNVVS

SEQ ID NO: 213918 - protein, 53 aa, Glycine max
  Coding DNA Sequence Number=SeqID_97140
MDRYLVELFDSGGATSHRLPTETRMGFRGKVIPNNWVAMVKPGNSRNNKVYST

SEQ ID NO: 213919 - protein, 117 aa, Glycine max
  Coding DNA Sequence Number=SeqID_97141
MVFQNCKQLSTNPMSEGYPQKAILTLVINSLIWKSFLLLELLSWDLKLVLVQIEDYKDLGEYINDKVQRFVEWFKFEFDLSIFKFPLNQKPTQNGLQFSRWLMGCGYKNKPSRDEDE

SEQ ID NO: 213920 - protein, 54 aa, Glycine max
  Coding DNA Sequence Number=SeqID_97142
MRQVARVRDGLERCEREAKWRKGVCVAKGRVRRQMERKSQEGRQGPRRMDNEDI

SEQ ID NO: 213921 - protein, 53 aa, Glycine max
  Coding DNA Sequence Number=SeqID_97143
  Gene Ontology: Mol. function=transferase activity, transferring glycosyl groups
  Homolog annotation: Hit_ID=Q1RTA0; Match level="QueryCoverage=98%, HitCoverage=4%, E-value=5e-18, Identity=77%"; Hit description =Glycosyl transferase, group 1
LEWEEVQRVTSRRWEREQGCREAAEDMSEDLSEGEKGDSVVEMVQSDTPKKKF

SEQ ID NO: 213922 - protein, 101 aa, Glycine max
  Coding DNA Sequence Number=SeqID_97144
  Gene Ontology: Mol. function=protein-N(PI)-phosphohistidine-sugar phosphotransferase activity; Cellular component=membrane; Biological process=phosphoenolpyruvate-dependent sugar phosphotransferase system
  Homolog annotation: Hit_ID=Q2G219; Match level="QueryCoverage=94%, HitCoverage=18%, E-value=3e-16, Identity=52%"; Hit description=PTS system, glucose-specific IIBC component, putative
  Pfam annotation: Domain name=PTS_EIIB; Domain location=25-59; Score =31.1; E_value=3.9e-06; Accession=PF00367.11; Description =phosphotransferase system, EIIB
MQVETPGRESEEEAKPQQVAADERTRVIISGLGGEANIEDVDCCFTRLRVRVKEMKEVVDQTLLSTGANGVNRVSEHDVQVIYGPQVEKIANEVKSALGVA

SEQ ID NO: 213923 - protein, 213 aa, Glycine max
  Coding DNA Sequence Number=SeqID_97145
  Homolog annotation: Hit_ID=UPI00005F853E; Match level="QueryCoverage =93%, HitCoverage=52%, E-value=3e-12, Identity=29%"; Hit description =COG2128: Uncharacterized conserved protein
MQPELITASSISALDAVGLTEPDIVTLNQLVGYVSYQARVVAALQAMMGLPVRWIPGVTPPADADAALFSQAAAWQHAIKPVELRYASADQLAAVTFCQGMAGLDDAVWLLVHDAQALYGWATLRQRLEAYGGEEEQLAQAVSARVLGCRRQFAQLANGWRARLLHEVDQASDDSLTQQVIALSAQLTRLPERFSAAHLQPLRWHLPAGRIDC

SEQ ID NO: 213924 - protein, 43 aa, Glycine max
  Coding DNA Sequence Number=SeqID_97146
WDIKVSRIRQLQIALDYLKFYEIERGNINVIKPGPVINLVDDV

SEQ ID NO: 213925 - protein, 303 aa, Glycine max
  Coding DNA Sequence Number=SeqID_97147
  Homolog annotation: Hit_ID=Q53JH6; Match level="QueryCoverage=96%, HitCoverage=31%, E-value=2e-52, Identity=41%"; Hit description =Coiled-coil protein
  Pfam annotation: Domain name=DUF869; Domain location=98-302; Score= -118.9; E_value=4.6e-10; Accession=PF05911.2; Description=Plant protein of unknown function (DUF869)
MSILGNLLLESNQSPDVTSKATAYAEEVNHSSFINEQLPEEVTSKSVPAAGIASDGSSENDENEENVNIIDVKEGDLNDGLRNMSEKLSAALVNVNAKEDLVKQHAKVAEEAIAGWEKAENEVAVLKKQLDTVILRNSVLEDRVTHLDGALKECVRQLRQTREEQEENIYDAVAKKTQELESAKIKLENKLTELQNKLDASEAKSSSIDFDMCQKVENLERENMALRHEILVQSEDLEVRTIERDLSTQAAETASKQHLESIKKVAKLEAECRRLRSMASRASLANDHKSIAQSSFSVESPTD

SEQ ID NO: 213926 - protein, 87 aa, Glycine max
  Coding DNA Sequence Number=SeqID_97148
MTMKFCGELDISNIKLGKKVSFQNILSMSEEFRIRLSNQVVVKVHLRFFGRKSLYRKNRSYMPRNKIVGTGFTPKFISGKNQSFLTP

SEQ ID NO: 213927 - protein, 88 aa, Glycine max
  Coding DNA Sequence Number=SeqID_97149
LRQERGLRTIGRIELAYGRIEVKATRFLDLAQFLTKLHKISSTSSNMDNRSKEQLCACKADFGVANHLYKSLYTQSIQRREKRVRKGN

SEQ ID NO: 213928 - protein, 88 aa, Glycine max
  Coding DNA Sequence Number=SeqID_97150
MTRFFGAMFLNQSMGAEGDWEIQMLYPPKQTMLFLEGPMGIGKLCCVAAWDLAKHRAWAWINAKGKGRKFSYCEWEMNPRACLNCLTL

SEQ ID NO: 213929 - protein, 223 aa, Glycine max
  Coding DNA Sequence Number=SeqID_97151
  Gene Ontology: Mol. function=alkanesulfonate monooxygenase activity
  Homolog annotation: Hit_ID=Q4ISB0; Match level="QueryCoverage=93%, HitCoverage=57%, E-value=8e-55, Identity=53%"; Hit description =Alkanesulfonate monooxygenase
SLESPQPYDHQGRFYQAEQAFSAIKPLQHKLPIYFGGSSPEAIDVAARHADVFALWGEPLKGAAETVRNVRAAAAAQGRQIAFNISFRPILGNTEKEAWERAEHIRATAEKQLAESGYTFGLPKPQSVGAQRLLAAAHESDRHDKVLWTGVAKLVQGGYNSTALVGTPDQVSEALLDYYRLGIHSVLIRGFDPLNDAVEYGRELLPLTREKVAALSATEKRSA

SEQ ID NO: 213930 - protein, 220 aa, Glycine max
  Coding DNA Sequence Number=SeqID_97152
  Gene Ontology: Mol. function=N-methylhydantoinase (ATP-hydrolyzing) activity; Cellular component=signal recognition particle, endoplasmic reticulum targeting; Biological process=SRP-dependent cotranslational protein targeting to membrane
  Homolog annotation: Hit_ID=Q97XP8; Match level="QueryCoverage=100%, HitCoverage=32%, E-value=4e-98, Identity=82%"; Hit description=N -methylhydantoinase A
  Pfam annotation: Domain name=Hydant_A_N; Domain location=3-178; Score= 290.8; E_value=2.5e-84; Accession=PF05378.3; Description =Hydantoinaseoxoprolinase N-terminal region
MTKVGIDIGGAFTDVVVYNEENGEISWVKVETTPDDPSNGVLEAIDETKINLGYVNTIIHGQTLAINTIVERKGAKVGLITTKGFRDILEIQRANRRDMYNFRYKKPIPLVPRYLRLEVGERIKSNGDILLPINENEVVEAVKKLKEENVEAIAVGFINSYVNPIHELKAGEIIKRIDSSIMVTLSHEVTREWREYERTSTAVLNAYVMPKMNRYLSKLK

SEQ ID NO: 213931 - protein, 111 aa, Glycine max
  Coding DNA Sequence Number=SeqID_97153
MKGGSRAPLSTELMSWFLKILLRLKGFTPCCGPMENGCNSWWSPVAVGGGGAEWRRKRERRHHFKEKMSLEEARHHRRPWIRAWRKKEMNEGRGREEHKILCSKRALKSEV

SEQ ID NO: 213932 - protein, 66 aa, Glycine max
  Coding DNA Sequence Number=SeqID_97154
MAEILQGKTMTGHDWSHIIWLLLAGSSGQTLTHKEEGDMVNVPLQKKKWQVQHRRFKIGAQMQFQA

SEQ ID NO: 213933 - protein, 51 aa, Glycine max
  Coding DNA Sequence Number=SeqID_97155
MNFFFVHASSTQRVWSYASSLTSEDPLVQSSILQGFSSSKKEGVEMRVVID

SEQ ID NO: 213934 - protein, 185 aa, Glycine max
  Coding DNA Sequence Number=SeqID_97156
MWCKLSCSIVTFFLFFFLLLRKMQGMSNYVSGSCMSEHNMRTMKIKSDFEPWLGYATEGKAVGGIPLENTSEGPQYHPQLHLLHCTTSKNPRAMAEMEKLDHLEEGLRAIEGGEDYAFANLKELFLEPNIITPPKFKVLDFDKYKGTTCPKNHLKMYYRKMGAYAKDEELLIHSFQENLTGVAVT

SEQ ID NO: 213935 - protein, 103 aa, Glycine max
  Coding DNA Sequence Number=SeqID_97157
  Gene Ontology: Mol. function=RNA-directed DNA polymerase activity; Cellular component=signal recognition particle, endoplasmic reticulum targeting; Biological process=SRP-dependent cotranslational protein targeting to membrane
MKADGEITSESEISEEVEEELVEEALQGSCTNVASSRSVSKLNLDTKPHPRPYRLQWLRENEEEFKDVFPKEIPHGLPPSRSIEHKVDLLPGASLPNKASLQK

SEQ ID NO: 213936 - protein, 173 aa, Glycine max
  Coding DNA Sequence Number=SeqID_97158
MARRDQVWSFCTHDTRRYLTVICTPLLGRHSCVRWHAETKQTQLCPMARRDQVWSFCTHDTRRYLTVICTPLLGRHSCVRWHAETKFGHSAPMIRGDTLRLSAPLCHADTVVSDGTQRPSLVILHPRYAEIPYGYPHPFVSQRRWARWQAETKFGHSAPKIRGDTLRLSAPFC

SEQ ID NO: 213937 - protein, 164 aa, Glycine max
  Coding DNA Sequence Number=SeqID_97159
LTIDLAYIIRNYWNANDQTVNFPEARKTKLRAADVPSFFATITGIPASSTSSPLPALADLSAQSFETSDAKFQSLPIMSVEQFIEKVAWPGARPSFVGHNESFTAQAPQKHEPEPENDHSSEATIPGAVDFAKRRLETRSNEAAHPGLVPASADAPFYLFVKNG

SEQ ID NO: 213938 - protein, 46 aa, Glycine max
  Coding DNA Sequence Number=SeqID_97160
MDVMDWCEDLIWARLDEGKCGFRNLHFVQIFAVKLCSRILHSAEKY

SEQ ID NO: 213939 - protein, 141 aa, Glycine max
  Coding DNA Sequence Number=SeqID_97161
  Gene Ontology: Mol. function=serine-type endopeptidase activity
  Homolog annotation: Hit_ID=Q4J7A0; Match level="QueryCoverage=99%, HitCoverage=49%, E-value=5e-36, Identity=50%"; Hit description =Conserved protein
  Pfam annotation: Domain name=DUF917; Domain location=1-141; Score= -6.1; E_value=5.8e-17; Accession=PF06032.3; Description=Protein of unknown function (DUF917)
MKISVSDLYNLAIGSSILGSGGGGNPFLGYKIVKAKMLQMNIDYVEYTDEIDEDRDFIIGVGGMGSPLIGGINSVVPFMASLMSKKPLVDGDYEGRAFPELYMTTMHFAGYKATPLSICDERENCFIIDAVDNFKAEIIAR

SEQ ID NO: 213940 - protein, 71 aa, Glycine max
  Coding DNA Sequence Number=SeqID_97162
MEAQCKFKRPYLVTRMSVSCQQYIETLEIEQRRLSRNSNGLKFSLGCSIHGHIISTCPKFNMEAQGKCKRS

SEQ ID NO: 213941 - protein, 57 aa, Glycine max
  Coding DNA Sequence Number=SeqID_97163
MNILMADDQGWEQELSPYNQYEEEKTPNLESVFEEFLAYHDSSKANQNSMKNHEIHF

SEQ ID NO: 213942 - protein, 224 aa, Glycine max
  Coding DNA Sequence Number=SeqID_97164
  Gene Ontology: Mol. function=transition metal ion binding; Cellular component=nucleus; Biological process=DNA integration
MDRSWMKSSCISDEYQNEVDELLQFTKRNTPYLRGKFFCPCVNYGNGRHQSINDIRSHLICEGIIPTYTKWIWYGELPDMPQVPHIKSVDEDVGHRIEDMIRDLGQDGFQQAHSALYDKIENDSKKPLYSGCTTFTRLSAVLALVNLKARFGWSDKSFTKLLVLFKNMIHEDNTLPKNHYEAKKILCPVGMEYQKIRACPNDCILYRNQFAEMPYCPTWGNHDT

SEQ ID NO: 213943 - protein, 454 aa, Glycine max
  Coding DNA Sequence Number=SeqID_97165
  Gene Ontology: Mol. function=transporter activity; Cellular component= integral to membrane; Biological process=transport
  Homolog annotation: Hit_ID=Q89YK3; Match level="QueryCoverage=75%, HitCoverage=77%, E-value=4e-72, Identity=40%"; Hit description =Putative hexose phosphate transport protein
  Pfam annotation: Domain name=DUF1228; Domain location=163-229; Score=- 26.5; E_value=0.074; Accession=PF06779.4; Description=Protein of unknown function (DUF1228)
  Pfam annotation: Domain name=MFS_1; Domain location=142-446; Score =81.1; E_value=3.4e-21; Accession=PF07690.6; Description=Major Facilitator Superfamily
  Pfam module annotation: Pfam domain module=DUF1228::MFS_1; Domain location=163-229::142-446
MGVGTSHRVTPAQFLPFLDALLSDGGMFIRNGSGALMSAWAAAGRLIGYYEPHMNPWDALPGLVLMREAGGVANDFLAQEGIRHVTITTLTDEAHQSVKPPTVGETIMSGIIHFFRASPPQAGAAFDEKRFRRVRWQTFIAMTLAYVTFYVCRLSFTVAKSALVELGITPTELGMIGSTLFFSYAIGKLVNGFIADHANVVRYMSLGLLLSAGMNLLMGMTTNAMLLAIFWGINGWAQSMGVGPCAVSLARWYGFKERGTFYAIWSTAHNIGEAMTYMVIAAVIAGFGWQMGYLSTAALGAAGVVLLLLFMRDSPQSSGFPSINVIRDEPQEETEARGSVFKNQLLALRNPALWTLALASAFMYIDRYAVNSWGIFFLEQDKAYSTLEASGIIGVNAIAGIAGTIIAGMLSDRFFPRNRSVMAGFISLLNTAGFALMLWSPHNYYTDILAMIVF

SEQ ID NO: 213944 - protein, 67 aa, Glycine max
  Coding DNA Sequence Number=SeqID_97166
MGRKQRSNLFVDELRSRGDGSASVARCRPSLGCCGVSPCACLGMQYFLMKARLVGGLKTLLGATGTP

SEQ ID NO: 213945 - protein, 560 aa, Glycine max
  Coding DNA Sequence Number=SeqID_97167
  Gene Ontology: Mol. function=transcriptional elongation regulator activity; Cellular component=cytoplasm; Biological process =regulation of transcription, DNA-dependent
  Homolog annotation: Hit_ID=Q45GG2; Match level="QueryCoverage=91%, HitCoverage=88%, E-value=1e-105, Identity=44%"; Hit description =Expressed protein
  Pfam annotation: Domain name=DUF547; Domain location=341-482; Score =271.6; E_value=1.5e-78; Accession=PF04784.5; Description=Protein of unknown function, DUF547
MSIHDDISFRLEASMILIIESEKLAVSYSASMDQLASELNSQTFQVDRLKKQLRHEENIHRALERAFNRPLGALPRLPPYLPPYILALLAEVAVLEEEIVRLEEQVVHFRQDLYQEAVYMSSSMRKLENSVSAPPNKSNPTLDSPKLDKLKSLTQTAGNSTATSETKPTTTLTEDRQGKENQSCTNSSKSRQQSSNQMNKTPIKNIDSQSLQKRLDHPKRKQEPRVNNQQIADVRNHSPHKNSPEAQSPNIISENILKCLSNILLRMSAVKNPGSTCDMAPLWDLKPQNCDEEADFWDPYGICLEFGKRDIGPYRQLCAIDAKSFNPKRTANTLFLLHRLKLLFRKVASVNLENLNHQEKLAFWINIYNSCMMNAFIENGIPENPQMAVALMRKATINVGGHVLSATTIEHFILRLPYHWKFTFSKGTKNHQMTARSIYGLELSEPLVTFALSSGTWSSPAVRVYTASQVENELEVAKREYLQAAIGFSTSKFAIPKLLDWYLLNFAKDLESLLDWICLQLPSELGKEAIKFLEERKTEPLSQFVQIMPYEFSFRYLICT

SEQ ID NO: 213946 - protein, 820 aa, Glycine max
  Coding DNA Sequence Number=SeqID_97168
  Gene Ontology: Mol. function=protein binding; Cellular component =intracellular; Biological process=defense response
  Homolog annotation: Hit_ID=Q1S2K5; Match level="QueryCoverage=84%, HitCoverage=100%, E-value=0.0, Identity=68%"; Hit description =Disease resistance protein; AAA ATPase
  Pfam annotation: Domain name=LRR_1; Domain location=659-681; Score =8.5; E_value=7.2; Accession=PF00560.23; Description=Leucine Rich Repeat
  Pfam annotation: Domain name=LRR_1; Domain location=683-705; Score =16.2; E_value=0.12; Accession=PF00560.23; Description=Leucine Rich Repeat
  Pfam annotation: Domain name=LRR_1; Domain location=707-729; Score =11.4; E_value=2.1; Accession=PF00560.23; Description=Leucine Rich Repeat
  Pfam annotation: Domain name=LRR_1; Domain location=731-753; Score =9.6; E_value=4.6; Accession=PF00560.23; Description=Leucine Rich Repeat
  Pfam annotation: Domain name=LRR_1; Domain location=755-778; Score =6.9; E_value=14; Accession=PF00560.23; Description=Leucine Rich Repeat
  Pfam annotation: Domain name=NACHT; Domain location=199-343; Score= -16.8; E_value=0.0012; Accession=PF05729.3; Description=NACHT domain
  Pfam annotation: Domain name=NB-ARC; Domain location=161-453; Score =99.3; E_value=1.2e-26; Accession=PF00931.13; Description=NB-ARC domain
  Pfam module annotation: Pfam domain module=LRR_1::LRR_1::LRR_1::LRR _1::LRR_1::NACHT::NB-ARC; Domain location=659-681::683-705::707 -729::731-753::755-778::199-343::161-453
MALNDFFAGEIATELLKMLINISRKSLLCRGSADQLISYIQDLLPTIEEIKYSGVELPAQRQSQLDRLSEILRSGVELSHKVLASSRWNVYRNLHLAKKMDKLEKNVSKFLVGPMQAHIMADIHHTRFQMEERFDRVDNSVRRLEKYFGNMKIGVGGGGWVEEAVRSVDEDVVDSSSAVGLGFGKNKVREMVIGREDLWVVGISGIGGSGKTTLARELCKDNQVRCYFKDRILFLTVSQSPNVEKLRTKIWGYIMGNERLDANYVVPQWQWMPQFECRSEARTLIVLDDVWTLSVVDQLVCRIPGCKFLVVSRSKFQTVLSYEVELLSEEDALSLFCHHAFGQRSIPLAANENLVKQVVTECGRLPLALKVIGASLRDQTEMFWMSVKNRLSQGQSIGESHEINLIERMAISINYLPEKIKECFLDLCCFPEDKKIPLDVLINMWVEIHDIPETEAYVIVVELSNKNLLTLMKEARAGGLYSSCFEISVTQHDVLRDLAINLSNRESIHERQRLVMPKRENGMPKEWLRYKHKPFEAQIVSIHTGEMKEVDWCNLEFPKAEVLILNFTSTEYFLPPFINRMPNLRALIIINYSATYACLLNVSVFKNLSNLRSLWLEKVSTPELSSIVLENLGKLFIVLCKVNNSLVEKEVDLAQVFPNLLELTLDHCDDLIQLPSSICGMKSLQNLSLTNCHNLTQLPVELGKLRSLEILRLYACPDLKTLPNSISHMIRLKYMDISQCVNLTCFPEEIGSLVSLEKIDMRECSMIRNVPKSALSLQSLRLVICDEEVSGIWKEVEKAKPNNFHIQVSEQYFDLDWLKE

SEQ ID NO: 213947 - protein, 409 aa, Glycine max
  Coding DNA Sequence Number=SeqID_97169
  Gene Ontology: Mol. function=protein serine/threonine kinase activity; Cellular component=cell cortex; Biological process=protein amino acid phosphorylation
  Homolog annotation: Hit_ID=Q10EQ9; Match level="QueryCoverage=75%, HitCoverage=38%, E-value=1e-102, Identity=60%"; Hit description =Protein kinase domain containing protein, expressed
  Pfam annotation: Domain name=Pkinase; Domain location=90-351; Score =276.1; E_value=6.7e-80; Accession=PF00069.15; Description=Protein kinase domain
  Pfam annotation: Domain name=Pkinase_Tyr; Domain location=90-351; Score=125.9; E_value=1.1e-34; Accession=PF07714.7; Description =Protein tyrosine kinase
  Pfam module annotation: Pfam domain module=Pkinase::Pkinase_Tyr; Domain location=90-351::90-351
MTYLPPKIIRNTVYQDAVTVNSFSFNPKIEEGSQNHKFLSRVCPENNLLDSHPLPLPPRASSPKQLSVVLHQSRIKHHATENLPSVKGRWQKGKLIGRGTFGSVFHATNIETGASCAMKEISLIADDPTYAECIKQLEQEIKILGQLHHPNIVQYYGSETVGNHLYIYMEYVYPGSISKFLREHCGAMTESVVRNFTRHILSGLAYLHSNKTIHRDIKGANLLVNKSGIVKLADFGLAKILMGNSYDLSFKGSSYWMAPEVVKGSIKNESNPDVVMAIDIWTLGCTIIEMLTGKPPWSEVEGPSATFKVLLESPPIPETLSSVGKDFLQQCLQRDPADRPSAATLLKHAFVQNLHGQGVIVRSQSYTRGDLGQGGNSASPRDTTKNRRGIMQASNSTLILNKIQKSIGY

SEQ ID NO: 213948 - protein, 421 aa, Glycine max
  Coding DNA Sequence Number=SeqID_97170
  Gene Ontology: Mol. function=DNA binding; Biological process =regulation of transcription, DNA-dependent
  Homolog annotation: Hit_ID=Q1S2L8; Match level="QueryCoverage=92%, HitCoverage=95%, E-value=1e-154, Identity=51%"; Hit description =Transcriptional factor B3; Cupredoxin; TonB box, N-terminal
  Pfam annotation: Domain name=B3; Domain location=16-111; Score=61.4; E_value=2.9e-15; Accession=PF02362.12; Description=B3 DNA binding domain
  Pfam annotation: Domain name=B3; Domain location=227-326; Score=41.7; E_value=2.5e-09; Accession=PF02362.12; Description=B3 DNA binding domain
  Pfam module annotation: Pfam domain module=B3::B3; Domain location=16- 111::227-326
MSIGSRKQARLHRFGQTSSTLLHENPSSHRLKLPDGFVCHMEGRTYGSVSLTGPSGKTWTVQLIKQENDLFLHHGWSTFVVDHQLECGELLVFRYEGHLHFTVQVFDKDACEKEAAFHSECSQSSKIMSTNENQELELGVGKELLRYEIVRPISMFRENEETSKACSANDVPVPFHMDNSKEDEETAILYRSGKDDHRYILSGVSLSNVSAHDEKKVSQSFISSFPYFVRIMKSFNVSGSYTLNIPYQFSMAHLPNCKIKIILHNLKGEHWTVNSVPTTRVHTSHTLCGGWMAFVRGNNIKVGDICIFELVHECELRVRIAEVAKDGSDCQVGNLAITRPSAGHAVTSRCMPMNPKVNSKCIRKVDLSDKKWSKIGQETILSIDLKKSSRASNTSKKMGLCPQSKAAHKKLGKVFLYLLNR

SEQ ID NO: 213949 - protein, 439 aa, Glycine max
  Coding DNA Sequence Number=SeqID_97171
  Gene Ontology: Mol. function=DNA binding; Biological process =regulation of transcription, DNA-dependent
  Homolog annotation: Hit_ID=Q1S2M4; Match level="QueryCoverage=57%, HitCoverage=49%, E-value=2e-69, Identity=55%"; Hit description =Transcriptional factor B3; Cupredoxin
  Pfam annotation: Domain name=B3; Domain location=25-118; Score=76.7; E_value=7.2e-20; Accession=PF02362.12; Description=B3 DNA binding domain
  Pfam annotation: Domain name=B3; Domain location=309-406; Score=28.4; E_value=2.5e-05; Accession=PF02362.12; Description=B3 DNA binding domain
  Pfam module annotation: Pfam domain module=B3::B3; Domain location=25- 118::309-406
MVGQNCGGCRSWEEDIYWSHFQFLHFVQFLRADYDQHLALPKAFSDNLKKKLPENVTLKGPGGVVWNIGMTTRDDTLYFVHGWEQFVKDHCLKENDFLVFKYNGESQFDVLIFNGGSLCEKAGSYFVRKCGHTGIEHAGGSLNKKRDTDNNSLEEGNIPPSNAGVECALHEKSVHANGTKEPIDVPPETPPTEKTFNAGVESSGVEQFTPDGGVTLVAVPSETANGKRIRNIVSAVKHVQTKRRGRPAKVHVRERTLDWVAALEASEPISTSRSGTYEVYKSNRRPVTDDETKMIESLAKAACTEDSIYVVMKPSHVYKRFFVSMRGTWIGKHISPSSQDVILRMGKGEWIARYSYNNIRNNGGLTGGWKHFSLDNNLEEGDACVFKPAGQMNNTFVIDMSIFRVVPETVPLTPMSRGTGRRGRKQATMKSIQTQLSPP

SEQ ID NO: 213950 - protein, 140 aa, Glycine max
  Coding DNA Sequence Number=SeqID_97172
MLSVLCLFPTLTIKPCRHRTSVKPAPQGGSAVAHHCDGPPLPLMGILDEEQEREGEQSTVMRSRLVALVGVIDWFYDALRDCGDEDEVPVMIEVARWFVVIWRFPLAKDLTGAHVCLLVAMVVCDGEEERERKEKETWLP

SEQ ID NO: 213951 - protein, 86 aa, Glycine max
  Coding DNA Sequence Number=SeqID_97173
MRIYKTKRREQSKSLSPRQGHAHKSREGSHVDAEEYDKRQTNASVEILNVNVGSRVGDALLYTIPTCTSAKHFFPAPFTNSLPATL

SEQ ID NO: 213952 - protein, 115 aa, Glycine max
  Coding DNA Sequence Number=SeqID_97174
MAPRKLPAKRSGKDKAAEGTSAAPEYDNHRFWSAEHQQRRDSSPAMDIAGYPHGQVRPRHSPGILCQCLAYTGGRAGYAILGEGRNRADGFDEETIAQLLCIPGQDFAWTTAGRR

SEQ ID NO: 213953 - protein, 76 aa, Glycine max
  Coding DNA Sequence Number=SeqID_97175
MIVKVQRATAISPPPMVNKEDSDTSATYDSKELSSPNNTNDEYKGRARRVSVSPSFNEGGQYGYMHYGIRMEYNGI

SEQ ID NO: 213954 - protein, 112 aa, Glycine max
  Coding DNA Sequence Number=SeqID_97176
  Gene Ontology: Mol. function=protein serine/threonine kinase activity; Cellular component=integral to membrane; Biological process=protein amino acid phosphorylation
  Homolog annotation: Hit_ID=Q9C890; Match level="QueryCoverage=74%, HitCoverage=13%, E-value=3e-18, Identity=50%"; Hit description =Protein kinase, putative; 86372-89112
MLRDESVGSRSARHSATATATVSNKVLVAVKAEKVISNTALAWALTHVAHSTDSITLLAVYSSHKTGRRFWNFSRLAGDCTNGPAGKLPEQISDISESCAQMVLQLHNQIED

SEQ ID NO: 213955 - protein, 667 aa, Glycine max
  Coding DNA Sequence Number=SeqID_97177
  Gene Ontology: Mol. function=protein-tyrosine kinase activity; Cellular component=integral to membrane; Biological process=protein amino acid phosphorylation
  Homolog annotation: Hit_ID=Q9FVN2; Match level="QueryCoverage=87%, HitCoverage=92%, E-value=1e-153, Identity=52%"; Hit description=Dual- specific kinase DSK1
  Pfam annotation: Domain name=Pkinase; Domain location=313-591; Score =111.1; E_value=3.1e-30; Accession=PF00069.15; Description=Protein kinase domain
  Pfam annotation: Domain name=Pkinase_Tyr; Domain location=313-591; Score=100.5; E_value=5.2e-27; Accession=PF07714.7; Description =Protein tyrosine kinase
  Pfam module annotation: Pfam domain module=Pkinase::Pkinase_Tyr; Domain location=313-591::313-591
MLCDVVLDGQYRGSLKKNNKETRSSSLDILEIENFILPNCMRKLKQEVKHCTDELNCSIVVMNGSQAKILRLNLRSSNELQTPFFSANSSPGIEIAKLKGRRLKHSTPVGSPEEAGTSVTRNIGVNSVSSSDSTTSLFLVYEQNPLYEGQGPEKRTDESINEPTKDFHVQPPLYFDLERDSPPPSWTRPASSVASDNKTIFWIPQNHNIVDKFQKTKNNSVIQRTKSPTSKTLLENFIRCDQEIWTNELGFDQAQSRSYVPNLGIRDNNSVPLGRTTSIPPPLCSQCKNKAPVFGKPPKRFSYKELEEATDMFSDENFLAEGRFGVVHQGILKDGQVVAVKQLKFGGSQADLDFCREVRVLSCAQHRNVVLLIGFCIESNLRILVYEYICNGSLDLYLYGDESMPLDWNSRLKIAIGTARGLRYLHEDCRVGCIAHRDLRPKNILVTHDFEPMVADFGLARWHSEWNIDTEDRVIGTSGYLAPEYLDAGNLTYKVDVYAFGIVLLELITGRRISELEQFNGHSYLSEWFHPIRMLEPGHILQNVRSLKPCFDSKESVEFNLQLQAMARAVSLCLRVDPDARPPMSKILRVLEGGNPVRPMGLDINSVGNTSGHLSGLKSHTPPKARGSIVGNIVLFVSCIVSVIHLKRGTLSYAYTNFQTSTAPGGN

SEQ ID NO: 213956 - protein, 140 aa, Glycine max
  Coding DNA Sequence Number=SeqID_97178
  Gene Ontology: Mol. function=RNA-directed DNA polymerase activity; Biological process=RNA-dependent DNA replication
  Homolog annotation: Hit_ID=Q1SFJ7; Match level="QueryCoverage=96%, HitCoverage=17%, E-value=4e-12, Identity=35%"; Hit description=RNA -directed DNA polymerase
MCLSKHQGGLGIKNIVHFNQALLGKWRWRLISGGEDLWCKVLKSNYGKESCGKFCRRSYRDSMWWRDSGLTCGENVGLITSVGGKLGVEVKLEMGTVRVGDFFTNQFFAWYSSDAITIDCEGCWNVERGSNKALYCEISI

SEQ ID NO: 213957 - protein, 291 aa, Glycine max
  Coding DNA Sequence Number=SeqID_97179
  Gene Ontology: Mol. function=5-methyltetrahydropteroyltriglutamate -homocysteine S-methyltransferase activity; Cellular component =microtubule; Biological process=methionine biosynthetic process
  Homolog annotation: Hit_ID=Q5FNV5; Match level="QueryCoverage=98%, HitCoverage=84%, E-value=1e-149, Identity=89%"; Hit description=5 -Methyltetrahydropteroyltriglutamate--homocysteine S- methyltransferas e
  Pfam annotation: Domain name=Meth_synt_2; Domain location=2-284; Score=-15.2; E_value=2.3e-10; Accession=PF01717.8; Description =Cobalamin-independent synthase, Catal
QQAGIDIVSDGEQTRQHFVTTFIEHLNGVDFENRKTVRIRNRYDASVPGVVGEVSRQKPVFVDDAKYLRQLTQRPIKWALPGPMTMIDTLYDDHYKSREKLAWEFAKILNQEARELEAAGVDIIQFDEPAFNVFFDEVNDWGIAALERAIEGLKCETAVHICYGYGIKANTDWKKTLGTEWRQYEEIFPKLQSSGIDIVSLECQNSRVPMDLIELIRGKKVMVGAIDVATNTIETPEEVAATLRKALQFVDADKLYPSTNCGMTPLSRHVAYGKLQALSAGAEIVRKELQG

SEQ ID NO: 213958 - protein, 120 aa, Glycine max
  Coding DNA Sequence Number=SeqID_97180
NDPETGDSNRCGLYIEANLARLVALGRVYEGSTVVHNTPLLPGQVKVGNSHLLCLADTSGKAFIRMVVSPAKPPQKSDPEVDDPLYLMTLTIRELFLRPYQVTWDATMFEIFNPDFPLYI

SEQ ID NO: 213959 - protein, 227 aa, Glycine max
  Coding DNA Sequence Number=SeqID_97181
MIMRSQDIYSSQDEATTSPSSSESDEAKGEESSEEFYPQEEGQPLMVKEECKEVSASSKRLVKKESHFEIKKNIKETSPLRQPLHLLLCKKTLVSTATPLGLEVIPQVKELLDEGLVRKSLNPCALLVPKIGIIRHQIPTISDMMNLLSVATLFCKISHAPNVFMIHVHRDSLGRNNQHKNTEKGVPTNPKRIKVIPDWPTPPSIREIWGCHDLTNFYKRKHHSLSW

SEQ ID NO: 213960 - protein, 86 aa, Glycine max
  Coding DNA Sequence Number=SeqID_97182
  Subcellular localization annotation: CTP_CleavageSite=41; ConfidenceScore=5.74e-01
MARKPRQNFSVFKPPHFFRQLSLSLTLPFSSPSFSIEAPSKASTFGHHFCSKSRKEGIFGVVNFENSGLGGLLSLLNFVGMRFWEI

SEQ ID NO: 213961 - protein, 136 aa, Glycine max
  Coding DNA Sequence Number=SeqID_97183
  Pfam annotation: Domain name=Transposase_23; Domain location=51-121; Score=-0.7; E_value=0.0013; Accession=PF03017.5; Description =TNP1ENSPM transposase
MESFSQMQSQLQSQMQSQGLALPPEHEVGPSVARVSIKGSCVDPSPTDPETGDSNKCGLYIEQNPSHLVALGRVYEGSTVVYNIPLLHGQVKVGVEEVKDAEAIVPVPTDEVILVGQALNTFLAWPIHLVKRVSEQ

SEQ ID NO: 213962 - protein, 93 aa, Glycine max
  Coding DNA Sequence Number=SeqID_97184
MTIIHILTIGILKTTNLDVSLSSKGALSAIPTREGIALSENWPADVKNTIFTLSSSPKCHLNPNTSFSTTHDHRWLPRAAVACRQTPTPRGTL

SEQ ID NO: 213963 - protein, 201 aa, Glycine max
  Coding DNA Sequence Number=SeqID_97185
MTMDEFLQRVAWPGAQPFLDREGEGPTTQVPQQAQDASFEATIPEPFTFHNEAGEAPVRQKEADTPARSLEATSEPPTPRLPEDLTTPVLALNTTPPATPVLHLTDKDDAQTQDTQDMSQVSQHALLRASKGEAHGCAFQRRKDARSRHQRLFVGNVGKNRTKPVKMKILSSGVVFTLDEGRKKWGFCSYVPSFGEEIRPT

SEQ ID NO: 213964 - protein, 98 aa, Glycine max
  Coding DNA Sequence Number=SeqID_97186
MTTLAQVWSVLSYSKLAPTSHTSDLTVDRARLIFGLVSHMDMNVRALISGKNCWNVDDLKLLSEGPGEQGRGQLTFHLPLQSNIYLSTYYSFSTSIYL

SEQ ID NO: 213965 - protein, 77 aa, Glycine max
  Coding DNA Sequence Number=SeqID_97187
  Subcellular localization annotation: CTP_CleavageSite=28; ConfidenceScore=5.40e-01
LGPSLASLAQSSWSLLSNALGGRIASQRATRDVPSLVLFEQPSRCTLYLKRTTKDVSSLVFTITMKKLPASYTEFLD

SEQ ID NO: 213966 - protein, 341 aa, Glycine max
  Coding DNA Sequence Number=SeqID_97188
  Gene Ontology: Mol. function=tagaturonate reductase activity; Cellular component=cytoplasm; Biological process=metabolic process
  Homolog annotation: Hit_ID=P0A6L7; Match level="QueryCoverage=100%, HitCoverage=70%, E-value=1e-118, Identity=62%"; Hit description =Altronate oxidoreductase
  Pfam annotation: Domain name=Mannitol_dh; Domain location=16-173; Score=90.3; E_value=5.8e-24; Accession=PF01232.13; Description =Mannitol dehydrogenase
  Pfam annotation: Domain name=Mannitol_dh_C; Domain location=203-341; Score=-35.5; E_value=1.5e-05; Accession=PF08125.3; Description =Mannitol dehydrogenase C-terminal domai
  Pfam module annotation: Pfam domain module=Mannitol_dh::Mannitol_dh _C; Domain location=16-173::203-341
MLRLNRRDFPGARYSERVIQFGEGNFLRAFIDWQLDWFNEHQGTDAGVVVVRPRNRMQTETLNQQDGLYTTLLRGLNDAGEPLSETRLIRSLNREIQPYQQFDEFLALARAPQMRFVFSNTTEAGIAYAEQDRLEDQPASSFPGKLTQLLWARYQHFAGAADKGWLIVPCELIDHNGDTLRALVLRYCQQWQLPAAFAQWVTQHCAFYNTLVDRIVSGYPPDGAQIAAQLGYDDRYLVAGERDYQLVLQGPDTLMHELQLTALAPAVRRVDDITPYKAQKVAILNGAHTALVPVAFQAGLASVGEAMNDAQLAAFVDALLREEVIPTLDLPRAELHAFADA

SEQ ID NO: 213967 - protein, 336 aa, Glycine max
  Coding DNA Sequence Number=SeqID_97189
  Gene Ontology: Cellular component=integral to membrane
  Homolog annotation: Hit_ID=Q665N4; Match level="QueryCoverage=56%, HitCoverage=81%, E-value=9e-92, Identity=84%"; Hit description =Putative DedA-family membrane protein precursor
MPIASSASTPAHSQGSKRLGKLRNPVITVTSRSDPPDTDDQQHQRQQHQAEHQLIFIAAENGGFPQRKAEHGKNQHPQEAAHPVKELEAGIAQAREAGNGRQQGTDKGDKAANQQRRQAVAMEQTVGALMILRGQMGEPFLHRRRIAKPAALNVTDPAAEAGAGGQHQQGQRKAHGAFRDQHADQNQQTVTRQKRGGQQAIFEKQNHEQHAINRPHQRGVGEHFVILLPQGMQQCLQNIHQSFLNIIVKRAREGLRRRRVKLYILGMPPEQDFRIHPELIVKSATFYSPVAKGKKRAITVTKIAGFRQCKVAVAQEFYLLTQMVKRSFTRADTIAD

SEQ ID NO: 213968 - protein, 175 aa, Glycine max
  Coding DNA Sequence Number=SeqID_97190
  Homolog annotation: Hit_ID=Q7CPR4; Match level="QueryCoverage=43%, HitCoverage=62%, E-value=5e-14, Identity=48%"; Hit description =Putative periplasmic protein
  Pfam annotation: Domain name=DUF1090; Domain location=90-175; Score =38.1; E_value=3e-08; Accession=PF06476.2; Description=Protein of unknown function (DUF1090)
MQHETVVKIRVAHSGTNLPDGFYLYQQLSAQGVRIKSITSAGDALVIHFENEEQSLAAQKVLRRLLPQGFVVAAGPQASQQREQTTSWDAPPVRFATGRQQWKDIQHEIEMAKQHDNQRRVTGLERALTEVRANCTDEKLKSAHAERIEAQQHKVAEREHELQQDRQEGKDQEKI

SEQ ID NO: 213969 - protein, 79 aa, Glycine max
  Coding DNA Sequence Number=SeqID_97191
AGAVTSFGYCKDRDGQWLKKDALPPQDERTPPQRDDSSVLTNEVLSELRGLCTYVGERLIPWMVALKEWIPVSCSLKRM

SEQ ID NO: 213970 - protein, 68 aa, Glycine max
  Coding DNA Sequence Number=SeqID_97192
  Subcellular localization annotation: CTP_CleavageSite=44; ConfidenceScore=5.26e-01
MPGLGQDWPSLVLGNSTPPDVPKVSRPPRHISKWRSGDGANQLSHFHKSNMNTPSPVAHLQLSSRTPT

SEQ ID NO: 213971 - protein, 283 aa, Glycine max
  Coding DNA Sequence Number=SeqID_97193
  Gene Ontology: Mol. function=RNA-directed DNA polymerase activity; Biological process=RNA-dependent DNA replication
MKYADLLPALLAKNLVQVRTPPRTPDVLPPWFRHDLTCAFHQGAPGHDVENCYVLKNEVQKLVRANLLSFKDQNPNVQANPLPNHGPAVNMIQDCDEDGVILNVQHVRTPLVPIHIKMCEAALFDHDHAACEICPVNVKGCPKVQEDVQGLIDSRELIITRKDKEVCVITPEFQRLEISYNSGESTTTPLVISLPGPMPYASLKAVPYKYSATMLEGGQEVPLPSLTPAVSVDNVANDGKVLRNGRVIPTLFAKKVNDPAVKQVTVNGPGTRKEVGQSNGTKE

SEQ ID NO: 213972 - protein, 51 aa, Glycine max
  Coding DNA Sequence Number=SeqID_97194
MVKARQKGGKRGRWLPPSSPGLLPPEGTAFCWNTMVGTAFCWNTMEGPSES

SEQ ID NO: 213973 - protein, 74 aa, Glycine max
  Coding DNA Sequence Number=SeqID_97195
ALIGLDDALQPKSKAPARWIVIKCNRQKGSTECSYYVMHWMSTIILGIFRNNWEAYFNNPRPLKLERLKALQIQ

SEQ ID NO: 213974 - protein, 125 aa, Glycine max
  Coding DNA Sequence Number=SeqID_97196
MTNANYPQESLHSISNENLRGMIEVDGICDNQEGLGWCVCHEGVCDASSIGACRPRIFFINGFLCFLEDEWQRNGERKRERRRHFKEKMSLEEAHHHRRPSIRAWRKKKMNEGRGREEHEILCSK

SEQ ID NO: 213975 - protein, 84 aa, Glycine max
  Coding DNA Sequence Number=SeqID_97197
MAVRLFPAADHPNAAVVFRPAPVWGAVLLDESSISRGPDALAGGLIEARNQSWKPQGPVGLLQVHWVSLWGEIGIAVAGQNVAK

SEQ ID NO: 213976 - protein, 68 aa, Glycine max
  Coding DNA Sequence Number=SeqID_97198
MTGDIFVFEMCADYRIGRLRMLPDFSQITTWGISACHLTSRVRINRSVFVRITTWGISNLPPDFTGQD

SEQ ID NO: 213977 - protein, 210 aa, Glycine max
  Coding DNA Sequence Number=SeqID_97199
YPELRRSEFLIGGYVGAKASLLSTTLLSVTMTQELVARGDTIRLSAPRHSVTQSVIDEQRPMWSSAPFFGDEQEPCFCRPPHNLCHTDPEAAGPMTRRDKIWSFCTLVSSRGGGPDDTRRYLTVIRTLVSSRSGGPDDKQRPKTKFGHSAPLYHPEAAGPMIRGDTLRLFAPFCHPEAAGPMTSRDQVWSFCTLVSSRGGGPDDTRKYPS

SEQ ID NO: 213978 - protein, 111 aa, Glycine max
  Coding DNA Sequence Number=SeqID_97200
  Subcellular localization annotation: CTP_CleavageSite=33; ConfidenceScore=5.47e-01
MGNSSCLLFLIFQHLSLAHQWAKRTSTAKRNFSATEESGRASISRSCTKREISALSVAVVFSQAHRTTNAKLKSTYSKADDLHRIPEHTTVPISGKELWRQQEEQLLQRYL

SEQ ID NO: 213979 - protein, 82 aa, Glycine max
  Coding DNA Sequence Number=SeqID_97201
MIHVDLVTRKVDGPHRKKLRTYLGIVTRDKVDVIYDNWEQVFVAQKDLIWEDIQTEFDIPESFDLRTKKKNTSDRRRAVEVV

SEQ ID NO: 213980 - protein, 124 aa, Glycine max
  Coding DNA Sequence Number=SeqID_97202
MGEVEEVQEKMKADMEAMKEQMATMMEAKMIMKKIMEASAVAVVATNTVAKYGRPHDVQIQNEHAFPPHGLPPNYTPPNVAYTPNEDVNKCSLRADNLIIYMSLNPWGRHMKFPTTIKPTSGLD

SEQ ID NO: 213981 - protein, 81 aa, Glycine max
  Coding DNA Sequence Number=SeqID_97203
MGFPLPTVTYLAENLSGRKEPDLDIWGKTNLGVKVSVSGRTSILFRATMMIWKQRAKLVTATAGWALKHFVYGIVILRLGI

SEQ ID NO: 213982 - protein, 230 aa, Glycine max
  Coding DNA Sequence Number=SeqID_97204
  Gene Ontology: Mol. function=transcription factor activity; Biological process=regulation of transcription, DNA-dependent
  Homolog annotation: Hit_ID=Q8KLX9; Match level="QueryCoverage=77%, HitCoverage=58%, E-value=3e-77, Identity=83%"; Hit description=LysR protein
MAGRAGPLQVGGRGIDAQLQVADAPRHQGLVGQLAAAHHAVDVLADHVDDAVAHAHIELDVRVARMEGGQGGHQDHARQRTGHVDPQPAARHGRGDGEAGLGVVHVGQQAQHAFVVDRAVGGDVDLARGAVEQAHAQAGLELLHQLGDAGLAHVQGVGRLGEAAGLHHAGEGLHCVETIHRHSRDQGIVCILQTVMDRLARLSAAAPSVQCLHHQYGLQGPGQENEYGNA

SEQ ID NO: 213983 - protein, 42 aa, Glycine max
  Coding DNA Sequence Number=SeqID_97205
MVGVIVMKANGVVVSNNDMMVMFNCEMDYLDSKCSINPNYKY

SEQ ID NO: 213984 - protein, 136 aa, Glycine max
  Coding DNA Sequence Number=SeqID_97206
MFFSIYHHYGPYGQIDVVRIIVCPFEKDECPTHVISAKGFVSEVRISALSLLRGSTSLSGGGGIIEKRKALYVLVLGAPVKGLTSDVWKYVVEVNSSEMQPEGNLSFDPVCIWLWFRYRLKTFFRALISVEVEYCS

SEQ ID NO: 213985 - protein, 199 aa, Glycine max
  Coding DNA Sequence Number=SeqID_97207
  Pfam annotation: Domain name=Transposase_23; Domain location=46-116; Score=3.9; E_value=0.00043; Accession=PF03017.5; Description =TNP1ENSPM transposase
MTSFSQLQSQMQYQGPPEPLVGPGPFGPRVSTKGSCVDPSGNDPETGDSDRYGLYIEADPARLVTVGRVYEGSTLVHNTPLLPGQVKVSVDKVKDADAAVPVPTVEVSLVGQALHTFLAWPTHQIKSLSNQVRWDATVFGVVNPDFPLYIKNEDLSEIAHDGQCLSISVLQLWILHLTETCMRAGNSDIYEFLEPQSIQ

SEQ ID NO: 213986 - protein, 207 aa, Glycine max
  Coding DNA Sequence Number=SeqID_97208
  Homolog annotation: Hit_ID=Q1SP02; Match level="QueryCoverage=56%, HitCoverage=25%, E-value=1e-12, Identity=34%"; Hit description=IMP dehydrogenase/GMP reductase
GITGAPYRARCDGLTVTDVSWLPYTEHRGVRAFQEISSFQGQLRWGPMIVAVRPERVVRQFGYIQSIPPPPVSARLSQDQIDDRWMEFADHLLPAGQPCLVPGQVSADYIEWFFRISHPFMTPTQAADQQRDAPAADPEDYIQPPSPQVPVAFDPPPYVDDYEGYEAIAQRLERVLNLRIVTAGTELYDIMQDCLTIARGGLSADGT

SEQ ID NO: 213987 - protein, 337 aa, Glycine max
  Coding DNA Sequence Number=SeqID_97209
  Homolog annotation: Hit_ID=Q1SP02; Match level="QueryCoverage=72%, HitCoverage=57%, E-value=6e-20, Identity=32%"; Hit description=IMP dehydrogenase/GMP reductase
  Pfam annotation: Domain name=DUF1723; Domain location=130-179; Score =52.6; E_value=1.3e-12; Accession=PF08330.1; Description=Protein of unknown function (DUF1723)
  Pfam annotation: Domain name=Oxidored_molyb; Domain location=139-246; Score=-77.3; E_value=0.045; Accession=PF00174.9; Description =Oxidoreductase molybdopterin binding d
  Pfam module annotation: Pfam domain module=DUF1723::Oxidored_molyb; Domain location=130-179::139-246
MVKEDYRETLVSTATPLGLEVIPKVKKLSDEGLVRKSLNPCALLIMVRTRGLGWALGRVIGRALGREHVDHADDEVHEQPKEAAVDDERPELKLSSHGSKVEKFGRPAPEIKGLVAATGLSPLIACSLDTSDRGLMFAFVERWHKETSSFRLRVGEVTITLDDVASLLHLSITCVFHCFEPLHVDDFVFLLVELREVSAKEERAKTVQCHRAYVRLSWLRDNATHMHVVFLDAFRDLTQSGSYAWGATVLVHMYDNLNDASKSTARQLLQCWIYEHFPTVGSAIATEDYDERTPLVCRWNSGKALPVSTYYKNLDRLTSDDVFWILYGGHRAFREFE

SEQ ID NO: 213988 - protein, 256 aa, Glycine max
  Coding DNA Sequence Number=SeqID_97210
  Gene Ontology: Mol. function=DNA binding
  Homolog annotation: Hit_ID=Q1RTB4; Match level="QueryCoverage=52%, HitCoverage=27%, E-value=1e-11, Identity=38%"; Hit description=IMP dehydrogenase/GMP reductase
MGSSQAPPLKKRFYQVKVKSLGITSLKELGQLMGQLQRQAFRKAYGKIWDLAMAEVSIEAIASLAQYYDQPLRKQVENGVVGVSRKCLEAKAKARILVGRGEWAPFIDILALLIFGGVLFLNVDGLVDLEAINAFLAYHDRKESLVVAILAYLYDTFNRRCEKSSTRIFCYTLALYVCKEGASVNWFPRWKEGRTGVLISCRGFPNVPLMGTRGCISYNPILAISHLASPMRGPPLEEELAPTIARGFNNTNVGAL

SEQ ID NO: 213989 - protein, 133 aa, Glycine max
  Coding DNA Sequence Number=SeqID_97211
MTTFGQGKLSRSFTIRYLLVDATTSYFALIGRKTLKELGAISSMPHLTTKFPTLTWEIVIVKADQKSLFMPHPIVAECTQVMTVDEGSHVRALTVYQASLGGEFDIDPRYDTFNRGLKPIEDLAQLQLRPKLG

SEQ ID NO: 213990 - protein, 59 aa, Glycine max
  Coding DNA Sequence Number=SeqID_97212
  Homolog annotation: Hit_ID=Q0KIN0; Match level="QueryCoverage=96%, HitCoverage=4%, E-value=2e-07, Identity=40%"; Hit description =Integrase core domain containing protein
MSESGKGLLYENKGSAEDDGNLVSWKSTKQSIVARTKAKAKYHTMAASTSEQKWLKQLL

SEQ ID NO: 213991 - protein, 411 aa, Glycine max
  Coding DNA Sequence Number=SeqID_97213
  Gene Ontology: Mol. function=zinc ion binding; Cellular component =nucleus
  Homolog annotation: Hit_ID=Q7XCX5; Match level="QueryCoverage=96%, HitCoverage=24%, E-value=1e-105, Identity=50%"; Hit description=Plus- 3 domain containing protein, expressed
  Pfam annotation: Domain name=Plus-3; Domain location=252-359; Score =172.3; E_value=1.2e-48; Accession=PF03126.8; Description=Plus-3 domain
  Pfam annotation: Domain name=SWIB; Domain location=113-188; Score =79.9; E_value=8e-21; Accession=PF02201.9; Description=SWIBMDM2 domain
  Pfam module annotation: Pfam domain module=Plus-3::SWIB; Domain location=252-359::113-188
MNHNIPRRPGFGQIDFDDRNSWEYLFKDYYIDIKKKLSLTFDELTQAKNPWKGSDMLLSKEESLDETFDATNDRGSDSDSSYENADLSRSKRKKAKKRGKSRSKEGDDSSEWASKELLEFVMHMRNGDKSVLSQFDVHTLLLEYIKRNKLRDPRRKSQIICDARLQNLFGKPKVGHFETLKLLESHFLLKDDSQAEDLQGSVVDTEMSHWEGDGNPNSYTKAGKDKRRKNRKKGDERGLQTNVDDYAAIDNHNINLIYLRRNLVEDLLEDTEKFHDKVVGSFVRIRISGSGQKQDLYRLVQVVGTCKAAEPYKVGKRMTDILLEILNLNKTEIVSIDIISNQEFTEDECKRLRQSIKCGLINRLTVGDIQDKALVLQEARVKDWLETETVRLSHLRDRASEKGRRKEYPFL

SEQ ID NO: 213992 - protein, 705 aa, Glycine max
  Coding DNA Sequence Number=SeqID_97214
  Homolog annotation: Hit_ID=Q7XCX5; Match level="QueryCoverage=8%, HitCoverage=3%, E-value=6e-13, Identity=59%"; Hit description=Plus-3 domain containing protein, expressed
  Pfam annotation: Domain name=GYF; Domain location=159-214; Score =47.1; E_value=5.8e-11; Accession=PF02213.6; Description=GYF domain
  Pfam annotation: Domain name=zf-CCCH; Domain location=681-705; Score =9.1; E_value=0.083; Accession=PF00642.15; Description=Zinc finger C -x8-C-x5-C-x3-H type (and similar)
  Pfam module annotation: Pfam domain module=GYF::zf-CCCH; Domain location=159-214::681-705
MDPSYESEEDENEVDDKRQENYMRPRGSTAFGRRGRDIVSPRSGSISNDSWSGTRNYSNVNQELSRNLSNKGFSIKGDNASNANEALNDAQLHRGRDRESQLSNSWERQKQSSTLESGAKNTQPLVASESFSAAVSEASAAPSSAGITPPAVKINETEKMWHYQDPSGKVQGPFSIVQLRKWSNTGYFPADLRIWRTTEKQDDSILLTDALTGNFSKEPSMVDKAQSVHDLHYPSSYSRKSPQQGIEGQVGERLSLDQNGGSWNSHSTLGSPGQTTGGSWRSKDNMNSLANRTSPLAVEVPKNPANGWGSDAGVRNDATNLPSPTPQTTPGGTMGLAFENKWSPTPVQLPGSLLGNSFPGSHGGLQASVAVHPEHAVQNAEKGSSSQPGISSASTDNTKLHPQATAVVPVVASGVDIKMAGANMQNQVVSSQNSHAEAQGWGSAGVPKPEPLAWGGASSQRIEPNNPATMPSQPASHGPWGDASSVPTTVSFNTGNPTASLPTPGFLGMTAPEPWRPPASSSQSNIAAPAPPNMPWGMGMSGNQNMNWGGVVPANMNVNWMPTQVPAPGNSNPGWAAPSQGLPPVNAGGWVGPGQGRSHVNANAGWVGPGQGLAPGNANPGWTAPVGNPGMWGSEQSHNGDRFPNHGDRGAQGRDSGYGGKSWNRQSSFGRGGSSRPPFGGQRVVCKYYESGRCRKGTSCDFLHT

SEQ ID NO: 213993 - protein, 99 aa, Glycine max
  Coding DNA Sequence Number=SeqID_97215
MARIVFAPCPYLRDIYGRELKRETNKGGCHDKTLRKIKWPNSQKIVPSGVANCRNLAFGGRAMRDSWVRVPRKEYARSRHQRLFEENVRKTGKDVIYEL

SEQ ID NO: 213994 - protein, 317 aa, Glycine max
  Coding DNA Sequence Number=SeqID_97216
  Gene Ontology: Mol. function=ubiquitin-specific protease activity; Cellular component=proteasome complex (sensu Eukaryota); Biological process=ubiquitin-dependent protein catabolic process
  Homolog annotation: Hit_ID=Q307X2; Match level="QueryCoverage=99%, HitCoverage=100%, E-value=4e-95, Identity=58%"; Hit description =Ubiquitin fusion-degradation protein-like
  Pfam annotation: Domain name=UFD1; Domain location=7-202; Score =382.2; E_value=8.2e-112; Accession=PF03152.5; Description=Ubiquitin fusion degradation protein UFD1
MFFNGYGYQGTSSFEQTFRCYSASFIEKPEIENGDKIIMPPSVLDRLAFLRMDYPMMFELRNGASERVSHCGVLEFIADEGTIYMPYWVGPEELKHYEYLVTSRMMMQNLLLQEGDIVRVKFVSLPKGTYVKLQPHTKDFFDISNPKAILETTLRKFSCLTTGDTIMMTYNNKKYYLDVIETKPANAISIIETDCEVDFAPSLDYKVTTASKTLDKAIFLEGKFNPFFGTGRRLDGISIPPVYSSRPSDVPNVNSLSSTTSSSPNFARPSQGKLVFASNFYRTKEIGKEKNESKQEPPHQKQPKFQPFIGNKYSLRG

SEQ ID NO: 213995 - protein, 119 aa, Glycine max
  Coding DNA Sequence Number=SeqID_97217
  Gene Ontology: Mol. function=NADH dehydrogenase (ubiquinone) activity; Cellular component=mitochondrial membrane; Biological process=photorespiration
  Homolog annotation: Hit_ID=Q5Z7T4; Match level="QueryCoverage=74%, HitCoverage=78%, E-value=1e-38, Identity=80%"; Hit description =Complex 1 family protein-like
  Pfam annotation: Domain name=Complex1_LYR; Domain location=13-78; Score=87.9; E_value=3.2e-23; Accession=PF05347.5; Description =Complex 1 protein (LYR family)
MASTAAYLARRAAQKERVRILYRRALKDTLNWAVHRHLFYDDASNLRERFEENRHVEDPDTIDRLIADAEASYNKWRHPDPYIVPWAPGGSKFTRNPTPPQGGALCLYLSSQASDDPII

SEQ ID NO: 213996 - protein, 899 aa, Glycine max
  Coding DNA Sequence Number=SeqID_97218
  Gene Ontology: Mol. function=microtubule motor activity; Cellular component=microtubule associated complex; Biological process =microtubule-based movement
  Homolog annotation: Hit_ID=Q0WLK7; Match level="QueryCoverage=97%, HitCoverage=98%, E-value=0.0, Identity=54%"; Hit description=Kinesin like protein
  Pfam annotation: Domain name=Kinesin; Domain location=30-347; Score =445.7; E_value=6e-131; Accession=PF00225.13; Description=Kinesin motor domain
MGAVAGEELVKWEKMGGVGGHEEKILVLVRLRPLSEKEIDVNETGDWECINDTTILYRNTLREGSTFPSAYTFDRVFRGDCSTKQVYEEGAKDIALSVVGGINSSIFAYGQTSSGKTYTMIGITEYAVADIFDYINKHEERAFVLKFSAIEIYNEIIRDLLSTENTSLRLRDDPERGPIVEKLTEETLRNWVHLKELLSFCEAQRQVGETYLNDKSSRSHQIIRLTIESSAREFMGKSSSTTLAASVNFVDLAGSERASQALSAGARLKEGCHINRSLLTLGTVIRKLSKGRQGHINYRDSKLTRILQPSLGGNSRTAIICTLSPARSHVEQTRNTLLFACCAKQVTTKAQVNVVMSDKVLVKQLQKEVARLETELRTPCPPSTNCDCAAMLRKKNLQIQKMEREIRELIEQRDLAQSQVEDLLRMVGNDQKSRKERMNTWEDDDSTSESSSIYPSDLRIREFNNPHYNNENSESSPDKHPDECCKEILSVELEESSRDDLEYANPSVSDNGVLALTLYGEENVISQEIPTPVNEDREDRQNQLTYGVLEQRIDDSQLSNDSPLTMSETVSNCRNLKLIRSWSCREYYMTGSPEKTGEMQRTPASSFKKCFPGRPDGLQRKFLPLTYGSSTKLSMNGSPSSIGSPSMDELRTNSMRSYANEDVTSLQTFVAGMKEMVKLEYEKQLVDDDQDQQAETTTFRFEKNMKDVGVGSMLEAPESPVEWPLQFKQQQTEIVELWQACNVSLFHRTYFFLLFRGDPTDSIYMEVELRRLSFLKETFASGNQSTNDAHTVTLASSAKGVRWEREVLVKLMRRRLSEEERKNLFSKWGIALDSKRRRKQLANRIWSSTVMNHIVESAAVVAKLLRFTGQGKALKEMFGLSFSPHRMSYSWRNTRASLF

SEQ ID NO: 213997 - protein, 142 aa, Glycine max
  Coding DNA Sequence Number=SeqID_97219
  Homolog annotation: Hit_ID=Q39827; Match level="QueryCoverage=48%, HitCoverage=9%, E-value=9e-36, Identity=98%"; Hit description =Arginine decarboxylase
MWANGDVPGGVDGEVGAAPAVDVVKGGGERRRPMVVAVVGVVCRGRRYASKGDRRRKRDVTGKCIAGRAVKVGALKAAEAEAPASPSKEDSERSIENGENPLLLPEKTLVSPRLPLRRKIDTKLMNPTLSPCTRSGAGQRSK

SEQ ID NO: 213998 - protein, 253 aa, Glycine max
  Coding DNA Sequence Number=SeqID_97220
MFPKSIDGSKFVKIGEKLSELLYSLLEEIGEHDVVQNLPQKIHLRTLLWLMVKVSCLHPHLHHQGTKASSIPMRKLASLKCLHLQERALDLWLGTKGSSNSSLWRKNNAASKSKKRGHDHEGENVKMRYKIRPKVSTKVGAIDKSVLAARKLNFSKGRGNVIELQPRSNIIFIIMSLKRLQLFKVFIVYFEVNKIATLSDSLKYIRKGELSGNHITSETSKRVGLRPQKETTPENLAFHGFKQKTQMKHEAET

SEQ ID NO: 213999 - protein, 113 aa, Glycine max
  Coding DNA Sequence Number=SeqID_97221
  Subcellular localization annotation: CTP_CleavageSite=49; ConfidenceScore=5.34e-01
MSLTRFTTSCPAKGFGAPSISWLSLNVFFNHRYGFPSYTYTLSTHNFLKSSIKGDVVPCGACRPWIFFINGVLCFLKFDGSGMEKEKDYWRCHFKEKMSLEEAHHHRKPWIRA

SEQ ID NO: 214000 - protein, 140 aa, Glycine max
  Coding DNA Sequence Number=SeqID_97222
  Gene Ontology: Mol. function=protein phosphatase type 2C activity; Cellular component=nucleus
  Homolog annotation: Hit_ID=Q9FG61; Match level="QueryCoverage=94%, HitCoverage=29%, E-value=6e-31, Identity=48%"; Hit description =Protein phosphatase-2C PP2C-like
MSFPSWEGTFMRWFSEIDEKLAKNIDTDGFRGGSTSVSVIKQGDQVIIGNVGDSRAVLCRRAPDNHLIPVQLTVDLTPDIPTFLPQCHSGEAMRIFAVEEDPTVNRVWMPKRDCPGLAMARAFRNFCLKDYGVASVPDVS

SEQ ID NO: 214001 - protein, 102 aa, Glycine max
  Coding DNA Sequence Number=SeqID_97223
  Gene Ontology: Mol. function=ribonuclease H activity; Biological process=DNA integration
MKSAFNKRVCLREFSKGDLVLKKVSHVKKDHQGKWAPNYEGPFMVKKAFLGGAVLLMNMDDEELPSLALEHMPTYVESMIGFVRNQRKGIMEDEVVKPQPQP

SEQ ID NO: 214002 - protein, 102 aa, Glycine max
  Coding DNA Sequence Number=SeqID_97224
MMAHQGRWKKIKKKSMKERHLLSGKRIGVATNVYSRKMLEKPKEFLEPLNLSHAWLFIGKGHLVQGKLAWASWSSPKQVACLGLKKFHGLGESDASLGEFRS

SEQ ID NO: 214003 - protein, 150 aa, Glycine max
  Coding DNA Sequence Number=SeqID_97225
MDKRSRVWGQWIPYDTDAINQFLGHPLILEEEQDHRSATLLPRTQFCTKRSREAGIAPPTNSVHSEKSHRAPGFPTLIIGLCQFYGVPDPNPYPWPTPRHFRAIVAWPRDRPNFQDEVGPVDAQGATQGDEGGAEDDGEMVDLLDYFIGG

SEQ ID NO: 214004 - protein, 44 aa, Glycine max
  Coding DNA Sequence Number=SeqID_97226
MAEGMTELMKGTIELRDELGRYVLQRGHGSKGNTIFYSQAKAKY

SEQ ID NO: 214005 - protein, 93 aa, Glycine max
  Coding DNA Sequence Number=SeqID_97227
MQLRTQCKLSRFIVTLATKKRMRGISNYMAGEPNGKDPKVHYLVTTPKGSFITPQPFLCMAIYRKRPFGARKASSNDGCLKLKVLARPGKWHA

SEQ ID NO: 214006 - protein, 79 aa, Glycine max
  Coding DNA Sequence Number=SeqID_97228
  Subcellular localization annotation: CTP_CleavageSite=36; ConfidenceScore=5.11e-01
MQYLGSDPRLSPRENNDTSNSPTLSLLHSWAKSKSRARNKSRDIKERQTNTKTFTYFSMNLKEWKEWATSSTYRVKESR

SEQ ID NO: 214007 - protein, 105 aa, Glycine max
  Coding DNA Sequence Number=SeqID_97229
MAPITQPNTAGASQPRLMQPLHFSIGGPPPTVEGKEKLDLIEERLRAIKGFGDYAFADMTNLCWVPNMVIPPKFKVPDFDRQLGRSSIILGNGLVFGFFSFTGNL

SEQ ID NO: 214008 - protein, 121 aa, Glycine max
  Coding DNA Sequence Number=SeqID_97230
  Gene Ontology: Mol. function=nucleic acid binding; Cellular component= mitochondrion; Biological process=DNA integration
MCDADWAFDVDNRRSTSGSGVFLVRFSTEAEYRGIAQTLAELTWVQALLQELQVPFSTPILLCDNQSAVAIAHNHIFHRKTKHMEIDVFFVREKVLSNQLLIYHIPTLNQWIDILTKPLSL

SEQ ID NO: 214009 - protein, 263 aa, Glycine max
  Coding DNA Sequence Number=SeqID_97231
  Homolog annotation: Hit_ID=Q1S159; Match level="QueryCoverage=100%, HitCoverage=45%, E-value=2e-66, Identity=58%"; Hit description=SH3
MEAIRKQASKLREQVARQQQMCMPIYTCNKSDPRCLKAKVACIFCYLLETAMVFDWKRACFACFLSIQAVLKQFGAGGYGGSDNMVTDEVELQQHQKLEKLYISTRAGKHYQRDIVRGVEGYIVTGSKQVEIALISVQEKKKEGGTKLSEDNRKYGADNTCTSGSTLSRAALNYAHARAQMEKERGSLLKALGTQVLKFERESLVAVVRLLPCDLGHWFKPEETSSPIVVAEPLRAMVMGAPLEDARHLAQRYDRMRQEAEAQ

SEQ ID NO: 214010 - protein, 59 aa, Glycine max
  Coding DNA Sequence Number=SeqID_97232
MVGAFSQNIVTLTGLPMILLSESDLTNPLCARNVITHSLCVVVFGSCDDLELVFGGPDE

SEQ ID NO: 214011 - protein, 78 aa, Glycine max
  Coding DNA Sequence Number=SeqID_97233
MTTSIDHRVRRESCPPPCYLLVLVFLLLVKKGEKGMMAMVVGKRENEQRKATTKDVVGGEGGKVVGVAIVVGVIDATK

SEQ ID NO: 214012 - protein, 124 aa, Glycine max
  Coding DNA Sequence Number=SeqID_97234
  Gene Ontology: Cellular component=mitochondrion
  Homolog annotation: Hit_ID=Q9SIV6; Match level="QueryCoverage=92%, HitCoverage=53%, E-value=1e-23, Identity=55%"; Hit description =Expressed protein
  Pfam annotation: Domain name=DUF1640; Domain location=14-123; Score= -40.3; E_value=0.0099; Accession=PF07798.2; Description=Protein of unknown function (DUF1640)
MTFCKRAFHLCSNHRQSLVKHCDLVSLLPFTRHLSQAGNVKRVFLVDTLGLVRGLEAKGVPSKQAKAITSAITEVLNDSLENVTQSLVPKSEKQKLDLLQESNLSNFKSKVQSSENFEKEMPWP

SEQ ID NO: 214013 - protein, 78 aa, Glycine max
  Coding DNA Sequence Number=SeqID_97235
MAYSGTAVPLVTVHLLSLNGREIHGGSSVSCGGEKTKNIAVGDNGSKKMVTITVEWYLLLTHVEGRDVLFDICEYVTK

SEQ ID NO: 214014 - protein, 167 aa, Glycine max
  Coding DNA Sequence Number=SeqID_97236
  Gene Ontology: Mol. function=oxidoreductase activity, acting on single donors with incorporation of molecular oxygen, incorporation of two atoms of oxygen; Cellular component=cytoplasm; Biological process=flavonoid biosynthetic process
  Homolog annotation: Hit_ID=O48631; Match level="QueryCoverage=99%, HitCoverage=47%, E-value=3e-63, Identity=66%"; Hit description =Ethylene-forming-enzyme-like dioxygenase
  Pfam annotation: Domain name=2OG-FeII_Oxy; Domain location=20-120; Score=142.0; E_value=1.6e-39; Accession=PF03171.10; Description=2OG -Fe(II) oxygenase superfamily
MAKSLNLEEDCFLNECGERADMFLRFNYYPPCPMPDHVLGLKPHADGSTITFLLQDKEVEGLQVLKDDQWFKVPIIPDALVINVGDQIEIMSNGIFRSPIHRAVINSEKERLTVAMFCLTDSEKEIKPVEKLVNESRPTLYRPVKNYSEIYFQYYQQGKRPIEASKI

SEQ ID NO: 214015 - protein, 58 aa, Glycine max
  Coding DNA Sequence Number=SeqID_97237
  Gene Ontology: Mol. function=protein binding; Cellular component =protein complex; Biological process=red or far red light signaling pathway
  Homolog annotation: Hit_ID=Q1SNG8; Match level="QueryCoverage=81%, HitCoverage=11%, E-value=1e-17, Identity=89%"; Hit description =Proteasome component region PCI
MICIGQKRFQKALDLLHNVVTAPMSTINAIAVEAYKKYILVSLIRHGQLRLEKTGGSL

SEQ ID NO: 214016 - protein, 123 aa, Glycine max
  Coding DNA Sequence Number=SeqID_97238
MTPHPRELLGAPSIFAGAPRRFRSVFDLQWCTCLCEEYAVNFGRFSSSEKERNRVHLLGYCYTENKRWYISCGSVQVEGTSTWFFKENKRGHIPCGSLACKEFYKVEKKSQEPQVAWGLDVGT

SEQ ID NO: 214017 - protein, 235 aa, Glycine max
  Coding DNA Sequence Number=SeqID_97239
  Gene Ontology: Mol. function=nucleic acid binding; Cellular component= chromatin; Biological process=DNA integration
MVTTSDEVGNIASWYLGTGCSTRTTSRRNWFISLDESTKNKFRYVDDTTLKAEGIGKVLIKRKDATVASKPKWLWHHRFRHLNFSNLSLLKRHNMVHGLPHVEVLSEVCEGFLECKQSRSPFNKHVPTKANDKLEVVYSDVCGEIQYESLGGNKCMLKSKRLANYLWGKATTTIVYVLNISPTKRLEGKTPEEASTRVKPNVAHFRVFGSICFKHVPDQLRRKLDDKCEHVVLIG

SEQ ID NO: 214018 - protein, 80 aa, Glycine max
  Coding DNA Sequence Number=SeqID_97240
  Homolog annotation: Hit_ID=Q9LYR6; Match level="QueryCoverage=75%, HitCoverage=9%, E-value=6e-14, Identity=68%"; Hit description =Peptide transporter-like protein
  Subcellular localization annotation: CTP_CleavageSite=40; ConfidenceScore=5.19e-01
MNTFLPIWGISLLTTIDIPLCMHRLLGSSFLTRVAQVLVVAFRKKNASFGSSGFIGLYEVPGRQPPIKGSRKITHVDEVA

SEQ ID NO: 214019 - protein, 104 aa, Glycine max
  Coding DNA Sequence Number=SeqID_97241
  Gene Ontology: Mol. function=catalytic activity; Biological process =metabolic process
MKENEYKEKRRYTWCASKEKNTNAAWAVAGKSGHDSVYHYTLTTAFSQRLLRVPLRPHLINIPRAQTVFLEEEGHRHERRVASSRTRFRELSSEREDEDYKGNT

SEQ ID NO: 214020 - protein, 154 aa, Glycine max
  Coding DNA Sequence Number=SeqID_97242
LFRELVVNPRTFFGFYYKDWGTRGDLRFVPITHIQFNKRLGVNENQTYCPPGDFMTAHTHGYISKHGLEYHHRICHYDFCPPHVVVHVNFSTRSPLGFARQYLWMEKNKSHDDSTSGGFNPFSVSLTFGNSIEAVRGKKLEESQGTARDAVVTG

SEQ ID NO: 214021 - protein, 214 aa, Glycine max
  Coding DNA Sequence Number=SeqID_97243
MELLNIGFSKTDVNYFIFHKSHALENLALPLLFVILLPEIALLFLLPPEISQKPLPRHPHCPHSNPQNPLHCRKNYIVLARTHRTPYTVGKPTLSSLEPTEPPTLFLEVWLEENPTYTVATRVLKHSWVLKAQSFLREVLLLIEVRGKLKVSCHFVRSHCHCHCLGSRLLGAPVEITSDKDPVIVHNKLLTLLEIILEFGALVWSKLILGKIET

SEQ ID NO: 214022 - protein, 68 aa, Glycine max
  Coding DNA Sequence Number=SeqID_97244
MEENFTMHFNYWSSNLPAAKAEAAVAIPTTTFMPKIPIGAILAIVDPVVIAVSKFKVVFQSLLERHLC

SEQ ID NO: 214023 - protein, 201 aa, Glycine max
  Coding DNA Sequence Number=SeqID_97245
  Gene Ontology: Mol. function=acyl-[acyl-carrier-protein]-phospholipid O-acyltransferase activity; Cellular component=integral to membrane; Biological process=metabolic process
  Homolog annotation: Hit_ID=Q74RZ6; Match level="QueryCoverage=95%, HitCoverage=26%, E-value=1e-77, Identity=72%"; Hit description=AAS bifunctional protein [Includes: 2-acylglycerophosphoethanolamine acyltransferase (EC ...
  Homolog annotation: Hit description=2.3.1.40) (Acyl-[acyl-carrier -protein]-- phospholipid O-acyltransferase) (2-acyl-GPE acyltransferase); Acyl- [acyl-carrier-protein] synthetase (EC 6.2.1.20) (Long-chain-fatty- ...
  Homolog annotation: Hit description=acid--[acyl-carrier-protein] ligase) (Acyl-ACP synthetase)]
  Pfam annotation: Domain name=Acyltransferase; Domain location=2-102; Score=37.4; E_value=5e-08; Accession=PF01553.11; Description =Acyltransferase
MSFLDGVLLALFLPIKPVFAVYSSISEQWYMRLLRPVIDFVPLDPTKPMSIKHLVRMINEGRPVVIFPEGRITVTGSLMKIYSGAGFVAAKSAATVVPMRIEGAEYTPFGRLAGVFKRRLFPRITLTVLPATVIPMPEAKRARDRRVLAGEHLHHVMMEARMAVRPRETLFDAFLNARTRYGLSKPCIEDINLSRTATPGC

SEQ ID NO: 214024 - protein, 72 aa, Glycine max
  Coding DNA Sequence Number=SeqID_97246
  Gene Ontology: Mol. function=chromatin binding; Cellular component =chromatin; Biological process=chromatin assembly or disassembly
  Homolog annotation: Hit_ID=Q1SAV4; Match level="QueryCoverage=84%, HitCoverage=19%, E-value=4e-11, Identity=50%"; Hit description =Integrase, catalytic region
MVTSGARPDQTIGPAPVLWEVKQKCPISNLAGKVVGKAWGPDGASTVIHGRRDESGKKLAKEGDKRQGHSNA

SEQ ID NO: 214025 - protein, 79 aa, Glycine max
  Coding DNA Sequence Number=SeqID_97247
MAVINQGVIVVAENELSLVRVDVAKVGSKISHVGLRVAFVKRTRGGTCKIKDFDTESGVEAAGPYWLGLLRCCNNPCRS

SEQ ID NO: 214026 - protein, 970 aa, Glycine max
  Coding DNA Sequence Number=SeqID_97248
  Gene Ontology: Mol. function=DNA binding; Cellular component=oxygen evolving complex; Biological process=DNA integration
  Pfam annotation: Domain name=rve; Domain location=193-353; Score =137.3; E_value=4.3e-38; Accession=PF00665.16; Description=Integrase core domain
  Pfam module annotation: Pfam domain module=RVT_2::rve; Domain location=496-718::193-353
MSRPIMSSWILDSGATDHVTCSLNNLHSYEPINPVTVKLPNGHHVHATHSGIVHLSKTITLFDVLYIPTFTFNLISISKLVSSTDCALIFSSTSCMLQDTNNRMKIGIVEERHGLYHLIPDQNDKAICSTIVHPKCNIIPVDLWHFQMGHLSTERLQCIRSYYPILRNNKDFVCNTCHYTKHKKLPFSSSISHASHIFDLLHMDIWGPCSKTSMHGHKYFLTIADDHSRFTWIHLMHTKAETRDIIISFIASIETQYNRKVKTIRSDNGSEFLMPSFYASKGIMHQATCVETPEQNGIAERKHQHLLNVTCALLFQANLPSSSWCYALLHAAYLVNCIPTPFLHNISPYEKLHGHIPDISHLRIFGCLCYASTLKANRKKLDPRAHPCIFIRFKPNTKGYLIYDLHSHSIITSRNVVFYENHFPQIINSQHSDMKLSTPLPEPFFITQHDSIIEITPTLPPVNEPVNITHAVEPTSSQPRRSTRTKQAPTYLQDYHRELSSHDTNPSTKVKHKADGSIERYKARLVTKGYTQMEGLDYLDTFSPVAKLTTVRLLLVVAALNHWHLRQLDVNNAFLHGELEEEVYMQVPPGLTVPNTNLASRQWFMKLSGLLTVHGFQQSHSDHSLFLRFNGSVTTMLLVYVDDIILTGNRNSEIQDVITLLDQAFKIKDLGNLKYFLGLEIARSSEGIHLSQRKYTLDILSDLGMLGCRPNTTPMDYSTKLQATTGTPLSAEASSSYRRLIGRLIYLTNTRPDIAYAVQQLSQYMSSPTNAHLQAAYWVLRYLKGTLGSGIFLSATGTPQLRAFSDSDWAGCQDSRRSTTGFVVYFGSSLISWQSKKQSTVSQSSSEAEYRALASTTCELQWLTYLLQDFRMTFVEPATIYCDNHSAIRIATNPVFHERTKHIEIDCHVVRQKVTSDHLKLLPVSSSLQLADIFTKALPPAVFQTLCNKLGMLNIHSQLEGGILTASNEK

SEQ ID NO: 214027 - protein, 63 aa, Glycine max
  Coding DNA Sequence Number=SeqID_97249
MGAKYLEAVKQRLHAIKQWFPNEIREGVRGNIKWNAQARIRKSLGGSAIKLRSARFHAERMIC

SEQ ID NO: 214028 - protein, 136 aa, Glycine max
  Coding DNA Sequence Number=SeqID_97250
MSTPFNYSGLLIGANARKLSTWQPVIDKMRSKLTSWRRRHYDLVGGFAWWFQSGLGRGVGGGNNVSFWEAKWLGDKKKSKSIGEAGDWCRGVWSRHFSWRRLWFQWEIPIACATIGGSFGDLGYKGGRERWMGVQT

SEQ ID NO: 214029 - protein, 150 aa, Glycine max
  Coding DNA Sequence Number=SeqID_97251
  Gene Ontology: Mol. function=DNA binding; Biological process=DNA integration
  Homolog annotation: Hit_ID=Q1SS72; Match level="QueryCoverage=98%, HitCoverage=11%, E-value=3e-19, Identity=32%"; Hit description =Integrase, catalytic region
  Pfam annotation: Domain name=zf-CCHC; Domain location=44-61; Score =10.8; E_value=0.017; Accession=PF00098.13; Description=Zinc knuckle
  Pfam annotation: Domain name=zf-CCHC; Domain location=80-97; Score =8.2; E_value=0.043; Accession=PF00098.13; Description=Zinc knuckle
  Pfam module annotation: Pfam domain module=zf-CCHC::zf-CCHC; Domain location=44-61::80-97
MDPIPAISKIFSYVAQQERQLLGNSSSPNFNFESKEISINAAKSICDYCGRMGHTENVCYKKHGMPLNHETRNKSNGGRKTCTHCGKIGHTIDVCYWKHGYPPGYKPFNGRSTVNNMVTMDNKTLDDQTQQHESQDLVQFSPEQYKALLA

SEQ ID NO: 214030 - protein, 159 aa, Glycine max
  Coding DNA Sequence Number=SeqID_97252
  Gene Ontology: Mol. function=nucleic acid binding; Biological process= DNA integration
  Homolog annotation: Hit_ID=Q1SS72; Match level="QueryCoverage=62%, HitCoverage=6%, E-value=2e-27, Identity=53%"; Hit description =Integrase, catalytic region
MAKAEQEHLMLQVQAGSGLKFSISSQITRNLVKYSVTERAPCFNVDASCCKSEILRRSPSEYLDFRSLQMSSALSIQSTLCLIEAATECTIQDTTILLHRRQAPFVHDEQQTLGRKKDRKIGYRDMQKKIQDLVLEDQKCVSVLLHAVKNYLMVVVMVV

SEQ ID NO: 214031 - protein, 199 aa, Glycine max
  Coding DNA Sequence Number=SeqID_97253
GTIVDDWKFDYSSHDARRMVCNDQADMTGRLLAGSLTFDCRIMHYIIVRILLPRSSNLAQASEEDLILMWAFLTGRQALLANAPLPYPQLVTPFLCHFQIPLDDEPFVQVKRSFAIGVGAVTSFGYRKDRDGQWLKKDVLPPQDEYTPSHPSQRDDSSTLMNEVLSELRDLHTYVGERFDSLDGRFEGMDTRITQLEED

SEQ ID NO: 214032 - protein, 268 aa, Glycine max
  Coding DNA Sequence Number=SeqID_97254
GTFDAAGDVEEAVAALGDEGVGVEGEPAEAEGGGERDVDGEQPGERREKEAEEGGELGERGGDGEAFGLWSETRAEPLEGLGEVYLIEPYEGDLLAYINKCWAQILEDDVTFFTKCCRPFGRAQDDQGNQYNPLLQNPSFQQQNSTLNGPTPLPSGFATSSVLNSAILGLSGTSFSGGSSSQVFNNQPPQFASLLRDSKNHHVAVAPGNTLNQVRHLFLLINTERGNPGKTPLSGGNNTSDGVVIREDLNPRNPSSDATAFYHFTFHF

SEQ ID NO: 214033 - protein, 70 aa, Glycine max
  Coding DNA Sequence Number=SeqID_97255
MVEEADIQKEEHERLMLEGVVSSFQGQDLNQTGYLNQFPNMENEDILALQGIRHYDKQKLSNPLIDTEYS

SEQ ID NO: 214034 - protein, 80 aa, Glycine max
  Coding DNA Sequence Number=SeqID_97256
VRAVMQVGSATFIIRVIKHSGICSGDSKILQVASRFQDVKTSHVTSAFCSPCLHASTAVKQFTAAFCKLQVVSRMSRHLT

SEQ ID NO: 214035 - protein, 69 aa, Glycine max
  Coding DNA Sequence Number=SeqID_97257
MKRSSKLEGGVHMNCARQLHSWGSEKSGEWRIALEGGVGYRQSRTTLNGNLKGRDTKNGFSFAGSPLPC

SEQ ID NO: 214036 - protein, 87 aa, Glycine max
  Coding DNA Sequence Number=SeqID_97258
MAINSWGSGLDGGGHTNSARQSIRGAPDSMDAWTALRNQFVGLRTRWWGCMNDNQFMGLRIRFDGGGRTNSARQSIRGAPDSMVEDA

SEQ ID NO: 214037 - protein, 136 aa, Glycine max
  Coding DNA Sequence Number=SeqID_97259
MAVISPGKIYQPPFPKWYNPDATCTYHGKTPGHSTEQCLAFKHKVQHLIEAGWLTFPEDQPNVKTNPLANHGGGAVNAVESGRSCRSKPLKDVTTPRRFIYEALQKGGVIPRGGHEEDSCLMHPGALHNMELCLAV

SEQ ID NO: 214038 - protein, 146 aa, Glycine max
  Coding DNA Sequence Number=SeqID_97260
  Homolog annotation: Hit_ID=Q7MZC8; Match level="QueryCoverage=21%, HitCoverage=9%, E-value=1e-09, Identity=87%"; Hit description =Similar to unknown protein YjbN of Escherichia coli
RAGRAPVASPPERERPQAGRRCAGGGAGAGAGIRRVDGCLSHLFNWLALPPFWHASCNPFSRYVELQRSNHVGNLLSHWLCGDADGDRHLAAGDLRCAVGGGGVHAGGRVVRGGHQAAAVADFGGGRGMDLPRDAETAGQALLIFC

SEQ ID NO: 214039 - protein, 121 aa, Glycine max
  Coding DNA Sequence Number=SeqID_97261
  Subcellular localization annotation: CTP_CleavageSite=8; ConfidenceScore=5.25e-01
MACRRVINAGYGRSRVAVPVQRRMAQQRPDTGATRSVLLKTVRYYFFFFTTFHFPPSAVSVKETLNLLLFQWVKPNNRRALRLLFALIMISLLWLAKVDAAPCSRQAPDAFIQGVSYLPRI

SEQ ID NO: 214040 - protein, 149 aa, Glycine max
  Coding DNA Sequence Number=SeqID_97262
  Gene Ontology: Mol. function=structural molecule activity; Cellular component=flagellin-based flagellum; Biological process=ciliary or flagellar motility
  Homolog annotation: Hit_ID=UPI00005F9D4B; Match level="QueryCoverage =99%, HitCoverage=47%, E-value=1e-43, Identity=58%"; Hit description =COG1344: Flagellin and related hook-associated proteins
MTIGHTGNAVFMSLTSNPKPEPDGSTPVSNVFESIDIALNALKTPLQGADEATRQQVNDALAKANRGLDNSYNNVLSVRAELGSQLQEMDQLDSIGKERDMTNQVQMSALTDADLAESISSYFMQQAALQASYKTFSDMQGMSLFQMNR

SEQ ID NO: 214041 - protein, 137 aa, Glycine max
  Coding DNA Sequence Number=SeqID_97263
MVSNACTSKEAWEILRTSLESVDKVKKVGLQSLHGEFESLCVKGFESILNFDNRVVVVVNQMNYCEENMELNSQWTLSQRLWGSLQVYEEGSKEEMMSLWSKFLKPKLLRKKMEEKKVKEDMVMEESVDMAKEERRS

SEQ ID NO: 214042 - protein, 90 aa, Glycine max
  Coding DNA Sequence Number=SeqID_97264
MGMTKPHVLMLLIIMVVSIAEKPSVIEGRALSLISGQGYSKIFATLGVVCKCCDGVGGACTSKWTESCNNLQCFPWKSHCTKQHQIFYAN

SEQ ID NO: 214043 - protein, 170 aa, Glycine max
  Coding DNA Sequence Number=SeqID_97265
  Gene Ontology: Mol. function=catalytic activity; Biological process =metabolic process
  Homolog annotation: Hit_ID=Q42793; Match level="QueryCoverage=70%, HitCoverage=5%, E-value=2e-58, Identity=93%"; Hit description=Acetyl CoA carboxylase
  Pfam annotation: Domain name=CPSase_L_chain; Domain location=38-146; Score=61.0; E_value=3.9e-15; Accession=PF00289.12; Description =Carbamoyl-phosphate synthase L chain, N-terminal domain
MADIGHRNGYVNSVLPNRPPAAISEVDDFCNALCGNRPIHSILIANNGMAAVKFIRSVRSWAYETFGSEKAILLVAMATPEDMRINAEHIRIADQFVEVPGGTNNNNYANVQLILEVCSVDFMRFCTSSNCHSSFWSGKLKATKYGWQLYLKMFIYIFLLVIKVIDLNAI

SEQ ID NO: 214044 - protein, 547 aa, Glycine max
  Coding DNA Sequence Number=SeqID_97266
  Gene Ontology: Mol. function=GTPase activity; Cellular component =intracellular; Biological process=small GTPase mediated signal transduction
  Homolog annotation: Hit_ID=Q6Z9X4; Match level="QueryCoverage=92%, HitCoverage=94%, E-value=0.0, Identity=67%"; Hit description =Putative tRNA modification GTPase trmE
  Pfam annotation: Domain name=AIG1; Domain location=300-517; Score= -103.5; E_value=0.074; Accession=PF04548.7; Description=AIG1 family
  Pfam annotation: Domain name=ArgK; Domain location=283-504; Score= -195.2; E_value=0.1; Accession=PF03308.6; Description=ArgK protein
  Pfam annotation: Domain name=Dynamin_N; Domain location=302-423; Score=-32.5; E_value=0.0072; Accession=PF00350.13; Description =Dynamin family
  Pfam annotation: Domain name=MMR_HSR1; Domain location=300-424; Score= 151.8; E_value=1.8e-42; Accession=PF01926.13; Description=GTPase of unknown function
  Pfam annotation: Domain name=Miro; Domain location=301-424; Score =13.6; E_value=0.00026; Accession=PF08477.3; Description=Miro-like protein
  Pfam annotation: Domain name=Ras; Domain location=301-468; Score= -96.8; E_value=0.051; Accession=PF00071.12; Description=Ras family
  Pfam module annotation: Pfam domain module=AIG1::ArgK::Dynamin_N::MMR_ HSR1::Miro::Ras; Domain location=300-517::283-504::302-423::300 -424::301-424::301-468
  Subcellular localization annotation: CTP_CleavageSite=26; ConfidenceScore=5.31e-01
MAAFRGVLRHIHISTFSCFTPPPRIPTMALFSSQGAMWHCLIPSKASRTVKSRAGSENYNNLVLKKDERLGAGECVGEVGSGTTIAAIVTSVGGPPAAVGIVRLSGPGAVSIAGRVFRPARKTWRPTSHVVEYGVVLDSDGNVIDEVLAVPMLAPRSYTREDVVELQCHGSEVCLRRVLRTCLEAGATLAQPGEFTLRAFLNGRLDLSQAENVARLIAAKSVAAADAALEGIQGGFSSLVRSLRSQCIELLTEIEARLDFDDEMPPLDLNLIMDKIHNMSREVENALETANYDKLLQSGLQIAIVGRPNVGKSSLLNAWSKSERAIVTEIAGTTRDVIEASISVSGIPITLLDTAGIRDTDDIVEKIGVERSEAVARGADLIIMTMSAVEGWTSEDTKLLERIQSTKGSTGSSTPVILVVNKIDCKPCAETEWDKGCQNHIFSKHVFTCAVTGQGLHDLEGAVLQIVGLEGIPAGGRRWTVNQRQCEQLVRTKEALVRLQSSIKDELPLDFWTIDLRDAALSLGQISGEDISEEVLSNIFGKFCIGK

SEQ ID NO: 214045 - protein, 2120 aa, Glycine max
  Coding DNA Sequence Number=SeqID_97267
  Gene Ontology: Mol. function=acetyl-CoA carboxylase activity; Cellular component=vacuolar membrane; Biological process=metabolic process
  Homolog annotation: Hit_ID=Q42793; Match level="QueryCoverage=99%, HitCoverage=92%, E-value=0.0, Identity=94%"; Hit description=Acetyl CoA carboxylase
  Pfam annotation: Domain name=ACC_central; Domain location=591-1335; Score=1342.4; E_value=0; Accession=PF08326.2; Description=Acetyl-CoA carboxylase, central regio
  Pfam annotation: Domain name=ATP-grasp; Domain location=6-203; Score=- 81.6; E_value=0.045; Accession=PF02222.12; Description=ATP-grasp domain
  Pfam annotation: Domain name=ATP-grasp_3; Domain location=51-205; Score=-44.4; E_value=0.014; Accession=PF02655.5; Description=ATP -grasp domain
  Pfam annotation: Domain name=Biotin_carb_C; Domain location=277-384; Score=173.4; E_value=5.7e-49; Accession=PF02785.9; Description =Biotin carboxylase C-terminal domain
  Pfam annotation: Domain name=Biotin_lipoyl; Domain location=524-590; Score=32.6; E_value=1.9e-07; Accession=PF00364.12; Description =Biotin-requiring enzyme
  Pfam annotation: Domain name=CPSase_L_D2; Domain location=6-238; Score=145.5; E_value=1.4e-40; Accession=PF02786.7; Description =Carbamoyl-phosphate synthase L chain, ATP binding domain
  Pfam annotation: Domain name=Carboxyl_trans; Domain location=1432 -1989; Score=913.2; E_value=1.1e-271; Accession=PF01039.12; Description=Carboxyl transferase domain
  Pfam annotation: Domain name=Dala_Dala_lig_C; Domain location=6-213; Score=-110.8; E_value=0.02; Accession=PF07478.3; Description=D-ala D- ala ligase C-terminus
  Pfam module annotation: Pfam domain module=ACC_central::ATP -grasp::ATP-grasp_3::Biotin_carb_C::Biotin_lipoyl::CPSase_L _D2::Carboxyl_trans::Dala_Dala_lig_C; Domain location=591-1335::6 -203::51-205::277-384::524-590::6-238::1432-1989::6-213
MAALGDKIGSSLIAQAAEVPTLPWSGSHVKIPPESSLITIPDEIYREACVYTTEEAVASCQVVGYPAMIKASWGGGGKGIRKVHNDDEVRALFKQVQGEVPGSPIFIMKVASQSRHLEVQLLCDQYGNVAALHSRDCSIQRRHQKIIEEGPITVAPIETVKQLEQAARRLAKSVNYVGAATVEYLFSMETGEYYFLELNPRLQVEHPVTEWIAEINLPAAQVAIGMGIPLWQIPEIRRFYGVEHGGGYDAWRKTSVLATPFDFDKAQSTRPKGHCVAVRVTSEDPDDGFKPTSGKVQELSFKSKPNVWAYFSVKSGGGIHEFSDSQFGHVFAFGESRALAIANMVLGLKEIQIRGEIRTNVDYTIDLLNASDYRENKIHTGWLDSRIAMRVRAERPPWYLSVVGGALYKASTSSAALVSDYVGYLEKGQIPPKHISLVHSQVSLNIEGSKYTIDMIRGGSGSYRLRMNQSEIEAEIHTLRDGVLPITVLFIIVNIMAFHEEEAAGTRLLIDGRTCLLQNDHDPSKLVAETPCKLLRYLVADDSHVDADTPYAEVEVMKMCMPLLSPASGIIHFKMSEGQAMQAGELIARLDLDDPSAVRKAEPFTGSFPVLGPPTAISGKVHQKCAASLNAARMILAGYEHNIDEVVQSLLNCLDSPELPFLQWQECLAVLATRLPKDLKNELESKYKEFEGISSSQIVDFPAKLLKGILEAHLSSCPDKEKGAQERLVEPLLSLVKSYEGGRESHAHIIVQSLFEEYLSVEELFSDNIQADVIERLRLQYQKDLLKIVDIVLSHQGIKSKNKLILLLMDKLVYPNPAAYRDQLIRFSLLNHTNYSELALKASQLLEQTKLSELRSNIARSLSELEMFTEDGENIDTPKRKSAINDRMEDLVSAPLAVEDALVGLFDHSDHTLQRRVVETYIRRLYQPYLVKGSVRMQWHRSGLIATWEFYDEYIERKNGVEDQTLNKMVEEKHGEKKWGVMVIIKSLQFLPAIISAALREATNNLHEALTSGSVEPVNYGNMMHIGLVGINNQMSLLQDSGDEDQAQERINKLAKILKEHEVGSTIRAAGVRVISCIIQRDEGRAPMRHSFHWSEEKLYYAEEPLLRHLEPPLSIYLELDKLKAYENIRYTPSRDRQWHLYTVVDHKPQPIQRMFLRTLLRQPTTNEGFSSYQRLDAETSRTQLAMSFTTRSIFRSLMAAMEELELNAHNANIKSEHAHMYLYIIREQQIDDLVPYPKRINIDAGKEETTVEAILEELAREIHSSVGVRMHRLGVVVWEVKLWMAACGQANGAWRVIVNNVTGHTCTVHIYREKEDTVTHKVVYRSVSIKGPLHGVPVNENYQPLGVIDRKRLSARKNSTTYCYDFPLAFETALEQSWAIQQPGFQRAKDKNLLKVTELKFADKEGSWGAPLVPVERYPGLNDVGMVAWFMEMCTPEFPSGRTILVVANDVTFKAGSFGPREDAFFRAVTDLACTKKLPLIYLAANSGARLGVAEEVKSCFRVGWSEESNPEHGFQYVYLTPEDYARIGSSVIAHELKLESGETRWVIDTIVGKEDGLGVENLSGSGAIAGAYSRAYKETFTLTYVTGRTVGIGAYLARLGMRCIQRLDQPIILTGFSALNKLLGREVYSSHMQLGGPKIMATNGVVHLTVSDDLEGISSILKWLSYIPSHVGGALPIVKPLDPPERPVEYFPENSCDPRAAISGTLDGNGRWLGGIFDKDSFVETLEGWARTVVTGRAKLGGIPVGIVAVETQTVMQIIPADPGQLDSHERVVPQAGQVWFPDSATKTAQAILDFNREELPLFILANWRGFSGGQRDLFEGILQAGSTIVENLRTYKQPIFVYIPMMGELRGGAWVVVDSRINSDHIEMYADRTAKGNVLEPEGMIEIKFRTRELLESMGRLDQQLITLKVKLQEAKSNRDIAAFESLQQQIKSRERQLLPVYTQIATKFAELHDTSLRMAAKGVVREVLDWCNSRAVFYQRLHRRIGEQSLINSVRDAAGDQLSHASALNLLKEWYLHSDIAKGRADAWLDDKAFFRWKDNPANYENKLKELRAQKVLLQLTNIGDSALDLQALPQGLAALLSKLEPSGRVKLTDELRKLEDHNRHHHVPSIYLLVD

SEQ ID NO: 214046 - protein, 78 aa, Glycine max
  Coding DNA Sequence Number=SeqID_97268
MESNLSDPDGDSNAALVLQQDAVPTPATMAQTLDSPRAIFSNRTVPLITSGQFYQTHVRFCFRIEDSLIKIMEDKYNR

SEQ ID NO: 214047 - protein, 43 aa, Glycine max
  Coding DNA Sequence Number=SeqID_97269
MKAKTITRRPLPMKPPTRSSISQTRNNGSMRGRGSMDEQHYNN

SEQ ID NO: 214048 - protein, 384 aa, Glycine max
  Coding DNA Sequence Number=SeqID_97270
  Gene Ontology: Mol. function=chitin binding; Cellular component =extracellular region; Biological process=chitin metabolic process
  Homolog annotation: Hit_ID=UPI00006A17C9; Match level="QueryCoverage =99%, HitCoverage=100%, E-value=2e-32, Identity=31%"; Hit description= UPI00006A17C9 related cluster
TLTFVGLHALTFKGLHALAFRGLHVLTFKGLHALVFRGLNILTFRGLHALAFRGLHILAFRALHVLAIRGLHALAFRGIHALAFRGQDVLAFRGLDRATGPRLLRTARPCLSRTARPCLSRTTRLCLQRNTRCRLQRAARSHFQRTTHPLHHRTTRPHLQRATRPRLEDYTSSPSEDYTSSPSEGYTVSPSEGSTPSPLEDYMSSPSEGFTPSPLEDYTSSPSEEYIIRGLHALTYRGLDALTFRGLHVLAIRGLHALVFRGLHVLTFRGLHALVFGGLHVLTFRGLHALAFRELHVIAFRGLHVLAIRGIHALAFRGQDVLVFGGLDVLAFRGLHTLTFRGLHLLAFRGLHALAFRGLHALAFRGLHVLAFRGLHALAFRELH

SEQ ID NO: 214049 - protein, 77 aa, Glycine max
  Coding DNA Sequence Number=SeqID_97271
  Homolog annotation: Hit_ID=Q9FFL9; Match level="QueryCoverage=83%, HitCoverage=23%, E-value=5e-07, Identity=43%"; Hit description =Arabidopsis thaliana genomic DNA, chromosome 5, P1 clone:MIK22
MSVVVSKEWGTLLHVVAGTDQVHFVDLLVKLLNPNDLELQNFNRNMAFCYSAASGNLYIASLMIKKNAGLPKIQGRE

SEQ ID NO: 214050 - protein, 150 aa, Glycine max
  Coding DNA Sequence Number=SeqID_97272
  Homolog annotation: Hit_ID=Q93W00; Match level="QueryCoverage=37%, HitCoverage=10%, E-value=3e-16, Identity=71%"; Hit description =Putative CRK1 protein
MQHFSEYKLTRYNLLMRGFRITLIRQRMVPRMVMVLKQQKLSIKLEEVHDCQLVDDILVEKLLIHDVPVDIICTPTQPFQRCNLCTSVQPCKKSKLPHATIFKARQSYKRCIADTFKNFPASSLPLIETFLTIDLAERQTAAAALHTEVR

SEQ ID NO: 214051 - protein, 172 aa, Glycine max
  Coding DNA Sequence Number=SeqID_97273
  Homolog annotation: Hit_ID=Q9Z621; Match level="QueryCoverage=56%, HitCoverage=61%, E-value=3e-36, Identity=76%"; Hit description=CigR
  Pfam annotation: Domain name=DUF1236; Domain location=105-168; Score=- 2.7; E_value=0.024; Accession=PF06823.3; Description=Protein of unknown function (DUF1236)
  Pfam annotation: Domain name=GRP; Domain location=1-69; Score=-25.4; E_value=0.03; Accession=PF07172.2; Description=Glycine rich protein family
  Pfam module annotation: Pfam domain module=DUF1236::GRP; Domain location=105-168::1-69
  Subcellular localization annotation: CTP_CleavageSite=25; ConfidenceScore=5.13e-01
MATRRLTTTALAVVLSLTFATAPVMANPGNGNGGGGHGNSGGQGNGGNHGNSGNHGNGNSGTHGSKHNTDNPGKSNKSVSDDVDARVSFDHARHLAVNYGLTGYESLPPGIAKNLARGKPLPPGIAKKTVPASMLDQLPSYPGYEWRVVGDDLVLIALSTAVVTTIINGVFK

SEQ ID NO: 214052 - protein, 67 aa, Glycine max
  Coding DNA Sequence Number=SeqID_97274
MEEVSLYQLYERVKHCSFYKGLQFLDLVELNLQLQFYPHLLEYLFLMSHDDKPILPIYLPNVFAKTQ

SEQ ID NO: 214053 - protein, 138 aa, Glycine max
  Coding DNA Sequence Number=SeqID_97275
MTLLLRNVLPSDHNSNLSLPKCQLVYTILTRMIVHVSQGPGVSGVDHGPLLVIQGSRHPYKVIRPLITRAFIEKYCTPRQAQGDAHQAADALSPPQQADPAGSLGIERYLQHLVRQQAANHHGQVQIHECLYRFSLSQ

SEQ ID NO: 214054 - protein, 293 aa, Glycine max
  Coding DNA Sequence Number=SeqID_97276
  Gene Ontology: Mol. function=chitin binding; Cellular component =extracellular region; Biological process=chitin metabolic process
  Homolog annotation: Hit_ID=UPI000044A8F0; Match level="QueryCoverage =97%, HitCoverage=99%, E-value=8e-43, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
SFTSTLHAIAFGGLHILAFVALRVLAFRGLHTLTFRGHHGLAFRVIHTLTFRGLHVLASRGLHALTFRGLHVLTFKGLHVLTFRGLHTLAFIGQHTLTFRVLHILTFRGLYVLALRGLHALAFRGLHVLAFIGLDALAFRGIHALAFEGRHVLAFRGLHVITLRGLHALALRGLHALAFRRLHILVFKGLHALAFKGLHVLALRGLHALAFRGLHVLAFRGLHVIAFKGLHALRGLHILAFRGLHILPFRGLHILTFRGLHVLPFRGLYVLVFRGMDLLAFRGLHILAFRGLH

SEQ ID NO: 214055 - protein, 297 aa, Glycine max
  Coding DNA Sequence Number=SeqID_97277
  Gene Ontology: Mol. function=RNA-directed DNA polymerase activity; Cellular component=intracellular; Biological process=RNA-dependent DNA replication
MAKSTLDQLSYRGPPMRRSGVVVKAFDGSRKSVIGEVDLPVTIGPFVFQITFQVMDIQAAYSCLLGRPWIHEAGAVTSTLHQKLKFVRNGKLITVSGEEALLVSHLSAFSFIGADETEGTSFQGLTLEGKKPEKNEVSFATWKSAQKVVQEGTGVGWGKVVQLLESKNREGLGFASSAGSATNSVGSSSITSTFCSAGFINNSPEANAVLEDAPEEIVLAFVTPGKLVRNWDAVDIPSVVHASKLGIYEPVEHNNPALSPNYESPVYEAEEEEDDEIPKELARLLEYEKKTIRPHEE

SEQ ID NO: 214056 - protein, 141 aa, Glycine max
  Coding DNA Sequence Number=SeqID_97278
MAANDHTILHDRIYIPTKKSLLELSSQDALLAQNKLLSKQLEALTETLSCTLYGGAHGSGFCIPTEETSHEVNYMGNQPRQNFNAGGFSGFQHGQPYQQQNKWRTHPGNQFNKDQGGPPNRPQQQGPSLYERTTKLEETLA

SEQ ID NO: 214057 - protein, 70 aa, Glycine max
  Coding DNA Sequence Number=SeqID_97279
  Homolog annotation: Hit_ID=Q8S3J3; Match level="QueryCoverage=74%, HitCoverage=9%, E-value=3e-13, Identity=71%"; Hit description =Hydroxyisourate hydrolase
MEPPQTRLMINVFIVSFLALLVNLVVGVLGADNYSRDDFPLDFVFGLGTSAYQESEREILCDFVHPCLCV

SEQ ID NO: 214058 - protein, 267 aa, Glycine max
  Coding DNA Sequence Number=SeqID_97280
  Gene Ontology: Mol. function=oxidoreductase activity; Biological process=electron transport
  Homolog annotation: Hit_ID=Q4H439; Match level="QueryCoverage=86%, HitCoverage=42%, E-value=1e-71, Identity=59%"; Hit description =Polyamine oxidase
MYISNCKQEHEHSSISAAKLLAENGVKDLVILEASNCIGGRIRKENFGGVSVELGAGWIVGVGGKESNPIWELVAEYGLRTCFSDYTNVPYNIYDRRRDSISFSIFLLLLLCRLLCSIIPVIVHSSGKIFSSGIAADSYKKAVDSAIRNLTNQEEADREGNSSKTTEPPSSPLELAIDFILHDFEMAEAVPISTFTAFGEREFLVADERGFDYLVYKMAEDFLLTSEGKILDTRLKLNHGNNGLVRYIALNCYIIFIRLLRGFFSAL

SEQ ID NO: 214059 - protein, 43 aa, Glycine max
  Coding DNA Sequence Number=SeqID_97281
MNSSYMLTIKEATTHFGRLWGITFGILFGVICTSFVMGTTYQP

SEQ ID NO: 214060 - protein, 764 aa, Glycine max
  Coding DNA Sequence Number=SeqID_97282
  Gene Ontology: Mol. function=formate C-acetyltransferase activity; Cellular component=membrane fraction; Biological process =carbohydrate metabolic process
  Homolog annotation: Hit_ID=P09373; Match level="QueryCoverage=96%, HitCoverage=99%, E-value=0.0, Identity=85%"; Hit description=Formate acetyltransferase 1
  Pfam annotation: Domain name=Gly_radical; Domain location=605-716; Score=219.1; E_value=1e-62; Accession=PF01228.11; Description =Glycine radical
  Pfam annotation: Domain name=PFL; Domain location=4-589; Score =1192.1; E_value=0; Accession=PF02901.5; Description=Pyruvate formate lyase
  Pfam module annotation: Pfam domain module=Gly_radical::PFL; Domain location=605-716::4-589
MASAWEGFSAGEWQNSVNVRDFIQKNYTPYEGDEAFLAGATPATTKLWDSVLEGIKIENRTHAPVDFDTDLASTITSHDAGYINKSLETIVGLQTEAPLKRAIIPFGGIKMVEGSCKVYGRELDPALKKVFTDYRKTHNQGVFDVYTPDILRCRKSGVLTGLPDAYGRGRIIGDYRRVALYGIDFLMKDKVAQFNSLQSDMENGVDLEATIRLREEISEQHRALGQIKEMAAKYGFDISLPATTAQEAVQWTYFGYLAAVKSQNGAAMSFGRVSTFLDVYIERDIKAGKLSEEQAQELIDHLVMKLRMVRFLRTPEYDELFSGDPIWATESLAGMGVDGRTLVTKSTFRFLNTLYTMGPSPEPNMTILWSEKLPYENDDLMRPDFDNDDYAIACCVSPMIVGKQMQFFGARANLAKTLLYAINGGVDEKLKMQVGPKEAPITDDVLDYDTVMARLDHFMDWLAKQYVTSLNIIHYMHDKYSYEAALMALHDRDVYRTMACGIAGLSVAADSLSAIKYAKVKPVRDADGLAVDFEIEGEYPQFGNNDPRVDDLACDLVERFMKKIQKLQTYRNAVPTQSVLTITSNVVYGKKTGNTPDGRRSGAPFGPGANPMHGRDQKGAVASLTSVAKLPFAYAKDGISYTFSIVPNALGKDDNVRKTNLAGLMDGYFHHEASIEGGQHLNVNVMNREMLLDAMEHPEKYPQLTIRVSGYAVRFNSLTKEQQQDVITRTFTQSLQSGKTDLHPQSTTQIVPPARQAEPENTSQ

SEQ ID NO: 214061 - protein, 1736 aa, Glycine max
  Coding DNA Sequence Number=SeqID_97283
  Homolog annotation: Hit_ID=UPI00005F9F6B; Match level="QueryCoverage =38%, HitCoverage=54%, E-value=0.0, Identity=68%"; Hit description =COG1674: DNA segregation ATPase FtsK/SpoIIIE and related proteins
  Pfam annotation: Domain name=AAA; Domain location=916-1089; Score =85.5; E_value=1.6e-22; Accession=PF00004.19; Description=ATPase family associated with various cellular activities (AAA)
  Pfam annotation: Domain name=AAA_2; Domain location=912-1024; Score= -46.3; E_value=0.03; Accession=PF07724.4; Description=ATPase family associated with various
  Pfam annotation: Domain name=AAA_3; Domain location=916-1023; Score= -0.9; E_value=0.00041; Accession=PF07726.2; Description=ATPase family associated with various
  Pfam annotation: Domain name=AAA_5; Domain location=916-1029; Score= -3.8; E_value=0.0035; Accession=PF07728.4; Description=ATPase family associated with various
  Pfam annotation: Domain name=ABC_tran; Domain location=912-1092; Score=-60.7; E_value=0.04; Accession=PF00005.17; Description=ABC transporter
  Pfam annotation: Domain name=FtsK_SpoIIIE; Domain location=290-504; Score=351.5; E_value=1.4e-102; Accession=PF01580.9; Description =FtsKSpoIIIE family
  Pfam annotation: Domain name=LolA; Domain location=717-876; Score =260.8; E_value=2.8e-75; Accession=PF03548.6; Description=Outer membrane lipoprotein carrier protein LolA
  Pfam annotation: Domain name=Mg_chelatase; Domain location=889-1034; Score=-131.0; E_value=0.00069; Accession=PF01078.11; Description =Magnesium chelatase, subunit ChlI
  Pfam annotation: Domain name=Seryl_tRNA_N; Domain location=1317-1423; Score=170.6; E_value=4e-48; Accession=PF02403.12; Description=Seryl -tRNA synthetase N-terminal domain
  Pfam annotation: Domain name=Sigma54_activat; Domain location=892 -1068; Score=-186.3; E_value=0.05; Accession=PF00158.16; Description =Sigma-54 interaction domain
  Pfam annotation: Domain name=tRNA-synt_2b; Domain location=1488-1666; Score=233.5; E_value=4.5e-67; Accession=PF00587.15; Description=tRNA synthetase class II core domain (G, H, P, S and T)
  Pfam module annotation: Pfam domain module=AAA::AAA_2::AAA_3::AAA _5::ABC_tran::FtsK_SpoIIIE::LolA::Mg_chelatase::Seryl_tRNA_N::Sigma54_ activat::tRNA-synt_2b; Domain location=916-1089::912-1024::916 -1023::916-1029::...
  Pfam module annotation: Domain location=912-1092::290-504::717 -876::889-1034::1317-1423::892-1068::1488-1666
ASWQVPQPHDDDNAALQEAQLRDAFHSQQQQRYGDSWQQQPAEEEDEEALQQAQLAQQFAQQQQQRYSQPEQESAPVFNLDTSAAFDFSPMKDLVDDTPSEPLFTIAATPEPDAPAQWQQPAAPEPAVPASLSEETSPWSTPDDEVYAAPAETPKPVAPAQDSLFHPFLVRHEQPLEKPSTPLPTLDLLTSPPAEEEPVDMFALEQTARLVEARLADYRVKAEVVGISPGPVITRFELDLAPGVKAARISNLSRDLARSLSAVAVRVVEVIPGKPYVGLELPNKHRQTVYLREVLDCDKFRDNPSPLSVVLGKDISGQPVVADLAKMPHLLVAGTTGSGKSVGVNTMIISMLYKATPEEVRFIMIDPKMLELSVYEGIPHLLTEVVTDMKDAANALRWSVVEMERRYKLMSALGVRNLAGYNEKIEQAAAMGRPIPDPFWKPGDSMDTTPPVLEKLPYIVVLVDEFADLMMAVGKKVEELIARLAQKARAAGIHLVLATQRPSVDVITGLIKANIPTRIAFTVSSKIDSRTILDQGGAESLLGMGDMLYMPPNSSMPVRVHGAFVRDQEVHAVVQDWKARGRPQYIDSITAGEESESGAGGLDGDEELDPLFDQAVAFVVEKRRASISGVQRQFRIGYNRAARIIEQMEAQGIVSEPGHNGNREVLSPPPHEIKCQETMNKESYQMKFRVIACGLLAGFVASSALADASSDLQQRLNKVNSFHASFSQKVTDGSGANVQDGEGELWVKRPSLFNWHMTAPDESVIISDGKNLWFYNPFVEQASVSLLQNATSNTPFMLIARNQPSDWQQYNIKQQGDNFELTPKSSDGNLKQFTINVTSAGTINQFSAIEQDGQRSSYQLKSQKNGAISPDKFTFTPPKGVTVDDQPTLQQYIGQQHLLAAGKPLPRAIEAGQLHSMILWGPPGTGKTTLAEIIAHYGKADVERISAVTSGVKEIREAIERARQNRQVGRRTILFVDEVHRFNKSQQDAFLPHIEDGTITFIGATTENPSFELNSALLSRARVYLLKSLTSADIEQVLDQAMQDKTRGYGDSDILLPDNTRRMIAELVNGDARRALNTLEMMADMAELNAQGQRELTPQLLNEVSGERAARFDNKGDRFYDLISALHKSVRGSAPDAALYWYARIITAGGDPLYVARRLLAIASEDVGNADPRAMQVAIAAWDCFTRVGPAEGERAIAQAIVYLACAPKSNAVYTAFKAAMRDAREFPDYDVPEHLRNAPTKLMKEMGLGKEYRYAHDEPNAYAAGEVFFPPEMAQTRYYQPTNRGLESKIARISMHSGGMHPSIRSINLLLHRISMLDPNLLRNEPDAVAEKLARRGFKLDVDTLRSLEERRKVLQVETENLQAERNSRSKSIGQAKARGEDIEPLRQEVNALGERLDAAKAELDTLQNEIRDFALALPNLPADEVPLGKDDSENQEVSRWGQPRQFDFPVKDHVELGEAVKGLDFASAVKLTGSRFIVMQGQIARLHRALSQFMIDLHSQQHGYLETYVPYLVNHETLYGTGQLPKFGEDLFHTKPLGEEAGSSNYALIPTAEVPLTNLVRDEIVEEESLPIKLTAHTPCFRSEAGSYGRDTRGLIRMHQFDKVEMVQIVAPETSMDALDELVGHAEKVLQLLNLPYRKVLLCTGDMGFGSAKTYDLEVWLPAQDTYREISSCSNMWDFQARRMQARCRSKTDKKPRLVHTLNGSGLAVGRTLVAVLENYQQADGRITVPDVLR

SEQ ID NO: 214062 - protein, 146 aa, Glycine max
  Coding DNA Sequence Number=SeqID_97284
MPPQRGGVVGQRRRLGLHQRIADHHVPAADRQVPGEGAVQGHSGQLGVVQLGGAQVGQVEMGHGGSECSGGPTVPDAKGRGKVVLGKWPSRARIRRCPGDRDPIGEMAERFKAPVLKTGEGSNLPWVRIPLSPPVVSKSPWKQGLF

SEQ ID NO: 214063 - protein, 50 aa, Glycine max
  Coding DNA Sequence Number=SeqID_97285
MEMVVVENQLLQLGPQQKEQKEERESDAKMLRAKSNNYFGFLSQGKQGEF

SEQ ID NO: 214064 - protein, 243 aa, Glycine max
  Coding DNA Sequence Number=SeqID_97286
  Homolog annotation: Hit_ID=UPI00006DB690; Match level="QueryCoverage =98%, HitCoverage=83%, E-value=1e-55, Identity=49%"; Hit description =COG3662: Uncharacterized protein conserved in bacteria
MLCGGISALMLQMLHPAALAGVWDHSSFRQDMLGRLRRTSQFIAVTTFGNTADAHTLIERVKRIHLRVTGIDNTGKPYAASDPHLLTWVHVAETSRFLAAHLRYKNPQLSLADRDRYYAEAARVAEALGAQQVPKSVEAVEAYLQAMRAELVYDARTHEVMQLLLNAPAPSWQAKPAMRVMLRAGCGLLPDWAQQLMHQPIGPVTQWRIDKQIALIAALLRWSIQRGAWARAMQRMGRDPRYR

SEQ ID NO: 214065 - protein, 126 aa, Glycine max
  Coding DNA Sequence Number=SeqID_97287
  Subcellular localization annotation: CTP_CleavageSite=40; ConfidenceScore=5.20e-01
MAGAAAAKLQIFLRFFYRFACYCQRTLLLRSCRHGAANPRSQSARNRDSRPAAVAVCPLYVGDGSPDADRRCHRAAGAAAAGYLLHAGAAGATGRWPGHAAASLSAAPAPAETRGAHAAQLHQQAG

SEQ ID NO: 214066 - protein, 109 aa, Glycine max
  Coding DNA Sequence Number=SeqID_97288
MGETHEIPYRNLANFETRLGYATKGKAADGKIPPAMAEMGMLDHLEERLRAIEEGKDYVFADIEELFLVPNMVIPPKFKVSEFDKYMGTACPKNHQKMYCRKMGGVRER

SEQ ID NO: 214067 - protein, 57 aa, Glycine max
  Coding DNA Sequence Number=SeqID_97289
MATARWALKNPVYGIVILRLGIYTNRPNVSKLCSFISSMNSSILISVYSEDTFALYE

SEQ ID NO: 214068 - protein, 80 aa, Glycine max
  Coding DNA Sequence Number=SeqID_97290
MVLVLLLIPIVAVVGHVVTFVVVDALALVALIDAAETCYMPQLVCSFFKPPAVLTNLSPKSLFFSRIWGRISELAPHGAA

SEQ ID NO: 214069 - protein, 366 aa, Glycine max
  Coding DNA Sequence Number=SeqID_97291
  Homolog annotation: Hit_ID=Q01GB3; Match level="QueryCoverage=58%, HitCoverage=52%, E-value=8e-26, Identity=37%"; Hit description=[R] KOG2950 Uncharacterized protein involved in protein-protein interaction
MAAESSRSSAKRPFMEEDDDEFSKKPPAKRVRFPKGKKVKPGDEVVVDKANVEEGEEVDLVNAKTATNAAKEREKLRRFLKGKKVKPGDEVVVDKANVEEGEVDLMNPKIAAAKERAKLRNQITAELLRESAGGITNDLSAAEVTYEDRQAVIGDILWQDNENFVDDGIQIEPFNLEKEREEGYFDAAGNFVEYIRENEIKDAWLDNVEVDPKYAALSSVATDDEDEGPPDLSSKDIGIMKRRIANVLEPGETVLQALRRLKGNSDRKAKMSAETKIVFDQLTEDAMKLMENDVYHEKQEVFDREAEGYEKLAQANYDMFADDDEHDTSKPSTDENNAVSQSSSDAINSGPEGGASQSDYVYDESS

SEQ ID NO: 214070 - protein, 95 aa, Glycine max
  Coding DNA Sequence Number=SeqID_97292
EEILLSAIFLFLIVVWWRQLCRFMVELGIDDVIYDGDASGEAGGAEPLRGDGGLQQQTRMQDHVLEVLLANVEECEDVVLHRELALVDNGGRSRE

SEQ ID NO: 214071 - protein, 53 aa, Glycine max
  Coding DNA Sequence Number=SeqID_97293
  Homolog annotation: Hit_ID=Q6NPP4; Match level="QueryCoverage=74%, HitCoverage=3%, E-value=9e-12, Identity=80%"; Hit description =Calmodulin-binding transcription activator 2
MWVFFSYIQQLQFEAQHRWLRPAEICEILRNYRMFHITSEPHNRPPSMVTACY

SEQ ID NO: 214072 - protein, 645 aa, Glycine max
  Coding DNA Sequence Number=SeqID_97294
  Gene Ontology: Mol. function=calcium ion binding; Cellular component =nucleus; Biological process=regulation of transcription, DNA -dependent
  Homolog annotation: Hit_ID=Q6NPP4; Match level="QueryCoverage=99%, HitCoverage=57%, E-value=1e-121, Identity=40%"; Hit description =Calmodulin-binding transcription activator 2
MEKKMKIFKGEATGCLNREDMMHIVFVHYLEVKGNKNIVVNTEGDEIPSDSQKVTSSSSSLPTHHSSVPSLSTDSVSPTTSLMSLREDADSEDIHQASSGLRPLYESQHSGNGPLTEKIGAGSNSSYLIHPFSGDYEQSSISGTDYIPVVHGDKFRGNDTAYIDGQKTHDVATWSTVLQSTAKLHNDPSLASSPSIPSSSMGDVLEQEHTIFSDLLMSKSGLTEVAESSQSLQSNWQIPFEDNSGGMPMLTQTQTFGLQFRSDYGTGLLGNETRNACSESAAILYSFNGEPKEQPMQQNYLQELEDGQSQHALKSNSANKVPDEETINYGLTVKRTLLDKDESLKKVDSFSRWITKELGEVADLNMQSSPGISWSTDECQHVIDDTSLSPSLSQDQLFSINDFSPKWAYAESEIEVLIIGSFLKSQPEVTTCNWSCMFGEVEIPAKVLADGILCCQAPRHKVGRVPFYVTCSNRLACSEVREFDFREGFARNVDFADFYNSSEILLHLRLEDFLSLKPVDPSNHSFEGDMEKRNLIFQLISLREVEEYSIKDEVTTELDISQHMVKEHLFHKQFKEKLYSWLLHKVTESGKGPNVLDEDGQGVLHLAAFLGYDWAINPIISAGVNINFRDVNGWTALHWAASCGR

SEQ ID NO: 214073 - protein, 186 aa, Glycine max
  Coding DNA Sequence Number=SeqID_97295
  Gene Ontology: Mol. function=calcium ion binding; Cellular component =nucleus; Biological process=regulation of transcription, DNA -dependent
  Homolog annotation: Hit_ID=Q6NPP4; Match level="QueryCoverage=67%, HitCoverage=12%, E-value=1e-41, Identity=65%"; Hit description =Calmodulin-binding transcription activator 2
MTTSEIFLLFFLVFFPIFHFFFVSLCTWHMLPLTVEICGVKAHVRGHQVRKQYKPIIWSVGILEKIILRWRRKGSGLRGFRPNVINEVPDQQNNSLKEDDYDYLKEGRKQKEEKIQKALSRVKSMAQYPEARAQYRRLLNVVEDFRQTKASNEGLINSEETVDGMEDLIDIDMLLDDDNFIPIAFD

SEQ ID NO: 214074 - protein, 241 aa, Glycine max
  Coding DNA Sequence Number=SeqID_97296
  Gene Ontology: Mol. function=hydrolase activity; Biological process =aromatic compound metabolic process
  Homolog annotation: Hit_ID=Q4PSG2; Match level="QueryCoverage=92%, HitCoverage=73%, E-value=5e-82, Identity=62%"; Hit description =Hydrolase
MLPKLSKCISFTASRDWLYRHLFAAAGLRSVATDLGEGTIVHCWVPKMHKPCKPSLVLIHGFGANAMWQYGEHIRLFMGHFNVYVPDLVFFGESFTLRAERSEYFQAECMVKMMEAHGVHKMSLVGISYGGFVGYRVAAHFPDVVEKIVLCCAGVCLEEVDMENGLFRVSNLDEASSILLPQTPDKLRELMKLSFVRPARGVPTWFLQDFIQMFALCSMENRLSLIRTFEMKAFDLIYPPF

SEQ ID NO: 214075 - protein, 410 aa, Glycine max
  Coding DNA Sequence Number=SeqID_97297
  Gene Ontology: Mol. function=amidase activity; Cellular component =chloroplast; Biological process=translation
  Homolog annotation: Hit_ID=Q9FY73; Match level="QueryCoverage=96%, HitCoverage=67%, E-value=1e-127, Identity=57%"; Hit description =Putative subunit of TOC complex
  Pfam annotation: Domain name=Amidase; Domain location=4-370; Score =17.4; E_value=5.7e-13; Accession=PF01425.11; Description=Amidase
MSCNILFVCGRFDVKGYVTGFGNPQWKKTHGEAGKTAIVITALLSDGATCVGKTVMDEFSFGISGENKFYGTPTNPQMPSSIPGGSSSGSAVAVAARLVDFAIGTDTTGCVRIPAAFCGILGFRPSHGVISTIGVLPNAQSLDTVGWFARDPSVLHRVGLVLLPLTSVELKRTRRIIFADDLFQLSKAPSQKTAYIIGKAIENLSGYQSLQHMNLCQYIASNVPSLKGFHEKLTQQQNGLSILKALTSVMFSLQGYEFKTNHEEWVKSVKPRLGRGVSERVNAAMNATHDNIKTLYKDDGILVIPTVADYPLKLNTEKGFSSEFHDRAFALSSIASISGCCQVAIPLGCHNDCCASISLISAHGVDKFLLNTVLDMYSTLQEQVSVAYALPLLDTNGSMETSELLKEKFL

SEQ ID NO: 214076 - protein, 158 aa, Glycine max
  Coding DNA Sequence Number=SeqID_97298
  Gene Ontology: Mol. function=RNA-directed DNA polymerase activity; Cellular component=intracellular; Biological process=RNA-dependent DNA replication
MCIDYTDLNQVFPKDAYPFSNIDCLVHGAAGHRTLSFLDAYSGYNQIKMDLVDEDKTVFITESANHYYKVIPFGFKNAETTYQRLMDKVFNAQLGRNLEVYVNGMVVKSDDILVHIKDLEKLKVTLSTPLVLSKPVTKKGLIVYLLVFIEAISMVLVQ

SEQ ID NO: 214077 - protein, 66 aa, Glycine max
  Coding DNA Sequence Number=SeqID_97299
MVIALDGAHVRYVGCCVCSWGAKCTDLVGWPIRGGEACVCLCGGSALTLSDDPFVGTSVVKESKHF

SEQ ID NO: 214078 - protein, 33 aa, Glycine max
  Coding DNA Sequence Number=SeqID_97300
MSSRQLGGSSPGSYSLHPDIVILLPQTMFAIIT

SEQ ID NO: 214079 - protein, 190 aa, Glycine max
  Coding DNA Sequence Number=SeqID_97301
  Gene Ontology: Mol. function=3'-5' exonuclease activity; Cellular component=intracellular
  Homolog annotation: Hit_ID=Q1SJ16; Match level="QueryCoverage=55%, HitCoverage=22%, E-value=6e-24, Identity=55%"; Hit description=3-5 exonuclease
MTILVWRPCLTLESLKKSGSLIMLNSLCVFLSVRRVDSNINVRTDDFKFTLVDLKKLAYQNKPFIMAEQAKYVFYVQEPCDESETQSPPSHPHRLARVRAPELGAESDLGGRPGRGVEARPKVVPEGGGAPNRVRRLGGVRTGLAVASPLFPVGPPARVAAVPRHPQTRIRIQAGFGLFVLHFRLPRRFR

SEQ ID NO: 214080 - protein, 68 aa, Glycine max
  Coding DNA Sequence Number=SeqID_97302
  Subcellular localization annotation: CTP_CleavageSite=44; ConfidenceScore=5.37e-01
MATASMGKAKISSLIYPFFSFYFYRLSFSPSVLLPKDFSHDGSVANMVGCPSSKLEPDCVNAFDTSYS

SEQ ID NO: 214081 - protein, 101 aa, Glycine max
  Coding DNA Sequence Number=SeqID_97303
MGVANNFPKYALRHIKKKESKKEPRSMTSQPSPKPASPPLSKNEVFALEKSKKSWAETKKKAKVDKSLKKKEVFKLEEVILAFVATLSTEKSVKGSTKSKY

SEQ ID NO: 214082 - protein, 144 aa, Glycine max
  Coding DNA Sequence Number=SeqID_97304
MADDKPSSDRLNVVIAELAVAQLHSTVTLASMVSKLDVIFLKLLIPITSQYFPSFSSEESPPPPSFSMLTPPPCSPPMQPSPAPLPAPLPMSTVLPYPTPVQPIPAPLSAPLPIPSPHLPISIMFASPLPFSTTFSTLFFVLAM

SEQ ID NO: 214083 - protein, 55 aa, Glycine max
  Coding DNA Sequence Number=SeqID_97305
MGEASTMTTNKVQQLNMKEYKTQLRMLNSSTEISILFYEKIGNTWEEWENQKFQS

SEQ ID NO: 214084 - protein, 167 aa, Glycine max
  Coding DNA Sequence Number=SeqID_97306
MSRNLTDYAIVPSLASGMLQNFTDCALTLPFNSRHVAELHGLPNDGCQVPRSGQARVASQQTYGPRMKLGYDSCPSLLVFYWRSKGTPNDQHHPDTAEFVPLGRRKARMTIICLRMSLGSLPLDDKRRRMTIICLCVPSNKIISGWRNGAQNDHNLSSHVIGLTASG

SEQ ID NO: 214085 - protein, 52 aa, Glycine max
  Coding DNA Sequence Number=SeqID_97307
MTKARQKGVRKNCTNCATMLPFDFRHVTEPHGLCNNASFRLPGIVTELPRIA

SEQ ID NO: 214086 - protein, 55 aa, Glycine max
  Coding DNA Sequence Number=SeqID_97308
  Gene Ontology: Mol. function=hydrolase activity; Biological process =aromatic compound metabolic process
  Homolog annotation: Hit_ID=Q4PSG2; Match level="QueryCoverage=98%, HitCoverage=17%, E-value=7e-20, Identity=81%"; Hit description =Hydrolase
MGRARSDIPSGVRTQIKKAYRGKCSNGSHQECRACSEPRKGQRVWQALESIPYRF

SEQ ID NO: 214087 - protein, 98 aa, Glycine max
  Coding DNA Sequence Number=SeqID_97309
MNSSKRAGEARLTCSGCQFKFLVPTITNPYRCYKFICGVTYGKRKFKLEGTINDVNNMKNLLLDNFKFPIGCICVLTVEQHLIYVSLQKGKVQLELEG

SEQ ID NO: 214088 - protein, 526 aa, Glycine max
  Coding DNA Sequence Number=SeqID_97310
  Pfam annotation: Domain name=zf-C2H2; Domain location=102-124; Score =12.7; E_value=0.44; Accession=PF00096.16; Description=Zinc finger, C2H2 type
  Pfam annotation: Domain name=zf-C2H2; Domain location=55-78; Score =18.6; E_value=0.023; Accession=PF00096.16; Description=Zinc finger, C2H2 type
  Pfam module annotation: Pfam domain module=zf-C2H2::zf-C2H2; Domain location=102-124::55-78
MCVLVLQSAGVAQEHQDERQIVAVNSDVSAANEREKEVALLGIENLADVQIHDLFECRKCNMSFDAKDLYLQHLLSFHQRTTRRYRLGSSVGDGVIIKDGKFECQFCHKVFLERRRYNGHVGIHVRNYVRKVEDLPGQANVQGTDDKSPVRGQDVPLRISKMDALIEIAQNSIMEDSVTEPHSSAKLNRIPASDIAVGYIDQDRNSESPISEQKMEDSMTGNNVDHDLDEELVEEIDDDNHVINVKMVTFLDNVGLLSVNKQDVNVPETSKVKDDVPLTIEELDQSGMDLDEDSHNCLLPLSEHHIIPESEKSENSGCANTKGLFILDEDISNKTELEFGLNGLKDVPVTVSTNVQEMVRPASQENVAHSRVFNSSISTEQSLDCLPAFSSDKGEEQFCSVDHEHDNVKGFQELRFDEIDTAECDFARVQVSPLPDVPTELTNNTVVEGTCASPVQFESQVVMLNIGGRNQLTTVCVWCGIEFNHDAVNSEIQPDSVGFMCPACKAKISGQVNVLLDCGSPNAGCL

SEQ ID NO: 214089 - protein, 43 aa, Glycine max
  Coding DNA Sequence Number=SeqID_97311
EAYLVSLLFIFTLNCRKEKPKMSLLNEERKPHAVVTPYPVQGH

SEQ ID NO: 214090 - protein, 137 aa, Glycine max
  Coding DNA Sequence Number=SeqID_97312
  Gene Ontology: Mol. function=oxidoreductase activity, acting on single donors with incorporation of molecular oxygen, incorporation of two atoms of oxygen; Biological process=electron transport
  Homolog annotation: Hit_ID=Q9FMG0; Match level="QueryCoverage=88%, HitCoverage=36%, E-value=5e-37, Identity=60%"; Hit description=2 -nitropropane dioxygenase-like protein
MGWRGILGFEYGIVQAPLGPDISAPPLVAAVANAGALGLLRAPDWESPDYLRELIKTTRTLTDKPFGVGVVLAFPFEENLNVILEEKVAVLQVYWGDCTRELVNKAHSAGIKVVPQVTNYTQIQQPRDLTQLVEYVA

SEQ ID NO: 214091 - protein, 172 aa, Glycine max
  Coding DNA Sequence Number=SeqID_97313
  Gene Ontology: Mol. function=nucleic acid binding
MQHASGTSYRDKERGKIWRMKMRREKKISGGQGFVFSKGNVSGGGYANEPPDGDEEYTPQPRLNFKQLFVKEVVTDRPKVDLIKENLERIEYEEGNKLKPKVILADSILEGLCAPWKEFFVVKLLGKNIGFTTMHDRLARAWKMPGGFEVLGLGNGYFMVKFDKDEDRKKSH

SEQ ID NO: 214092 - protein, 200 aa, Glycine max
  Coding DNA Sequence Number=SeqID_97314
  Homolog annotation: Hit_ID=Q9SU58; Match level="QueryCoverage=36%, HitCoverage=7%, E-value=7e-17, Identity=57%"; Hit description=ATPase 4, plasma membrane-type
  Pfam annotation: Domain name=Cation_ATPase_N; Domain location=1-71; Score=78.0; E_value=3e-20; Accession=PF00690.16; Description=Cation transporterATPase, N-terminus
MENVPLEEVFQRCDSNGLTTESVEERLVIFGHNKLEEKKESKVLKFLGFMWNPLSWVMEAATIMVIALADGEGNMVPKASTFPSGIKALAHYVHDVSFGGVFRCTTGLADQFGKKRVFNTPLWDGKTQQLGPKLWEIVGEQQGILKITGIGEHAHIRTFTEHSTKILAEESYSIDKEVHNPKKDYDEFVKFVLTIDKRRI

SEQ ID NO: 214093 - protein, 574 aa, Glycine max
  Coding DNA Sequence Number=SeqID_97315
  Gene Ontology: Mol. function=signal transducer activity; Cellular component=membrane; Biological process=signal transduction
  Homolog annotation: Hit_ID=Q8LLE5; Match level="QueryCoverage=98%, HitCoverage=94%, E-value=6e-46, Identity=28%"; Hit description =Coiled-coil protein
  Pfam annotation: Domain name=DUF869; Domain location=6-479; Score= -244.3; E_value=8.3e-06; Accession=PF05911.2; Description=Plant protein of unknown function (DUF869)
  Pfam annotation: Domain name=KID; Domain location=120-130; Score=3.0; E_value=1.1e+02; Accession=PF02524.5; Description=KID repeat
  Pfam annotation: Domain name=KID; Domain location=189-199; Score=2.6; E_value=1.4e+02; Accession=PF02524.5; Description=KID repeat
  Pfam annotation: Domain name=KID; Domain location=224-234; Score=2.1; E_value=1.8e+02; Accession=PF02524.5; Description=KID repeat
  Pfam annotation: Domain name=KID; Domain location=279-289; Score=1.3; E_value=2.5e+02; Accession=PF02524.5; Description=KID repeat
  Pfam annotation: Domain name=KID; Domain location=314-324; Score=1.3; E_value=2.5e+02; Accession=PF02524.5; Description=KID repeat
  Pfam annotation: Domain name=KID; Domain location=398-408; Score=4.1; E_value=64; Accession=PF02524.5; Description=KID repeat
  Pfam annotation: Domain name=KID; Domain location=50-60; Score=0.2; E_ value=4.3e+02; Accession=PF02524.5; Description=KID repeat
  Pfam annotation: Domain name=KID; Domain location=85-95; Score=2.3; E_ value=1.6e+02; Accession=PF02524.5; Description=KID repeat
  Pfam module annotation: Pfam domain module=DUF869::KID::KID::KID::KID: :KID::KID::KID::KID; Domain location=6-479::120-130::189-199::224 -234::279-289::314-324::398-408::50-60::85-95
EFEIMKQQMDELKEKLEKVEADKAELEIALMNSEECIEESQHQLRETQEKLEELQRELENAYKSKQRVENHLLDMVAEAETLSVKVEFLEAEVDKERAVSSEIAMKYRDLEEEFERKSAKVDILEVELDKKDLSSEIAMKCRDLEEELERKSAKVDILEAEVAKEKDLSSEIVMKCMDLEEELERKSAEVDILEAELDKKKDLSSEIALKFRDLEKDLERKSAKVNILEAELDKKDMPNEIAMKCKDLKEELESKSTKVDLLEAEVAKERDVSDKIAKKCKDLEEELQRKSAKVELLEAEVAKERDVSDKYAKKCKDLEEELQRKSAKVELLEAEVAKERDVLDKIAKKCKDLEEVLESKSAKVELLDAEVDNERAVSDEISMKCKDLEEKLERKSAKVDLLEEELHKERANSEEIAMKCRELEEELLRSTASSYGEKKIKQEDLALAAGKLAECQKTIASLGNQLKSLATLEDFLIDTASIPASPSLIGQAGGELWKLHSNGTFLPKRDSICSRLADGSSYPSLNKNEETSPLSSSSSTSSPALQNHVSSERSRNGFAKFFSRTKSGIRVYVF

SEQ ID NO: 214094 - protein, 135 aa, Glycine max
  Coding DNA Sequence Number=SeqID_97316
  Gene Ontology: Mol. function=DNA binding; Biological process=DNA integration
  Homolog annotation: Hit_ID=Q6VPE6; Match level="QueryCoverage=83%, HitCoverage=29%, E-value=5e-20, Identity=43%"; Hit description =Putative integrase
  Subcellular localization annotation: CTP_CleavageSite=26; ConfidenceScore=5.07e-01
MGVKPSKVINNGPWMKLGNDRFPTKRKSKLSPRGDGPFQVLKRINNNAYRLDLPEEYGVSTTFNISDLIPFVGGADIEEEEPTYLRSNPLQGRGDDAILPRKGPVTRAMSKTLQEDWARGVEEGPRVLMNLKVDF

SEQ ID NO: 214095 - protein, 43 aa, Glycine max
  Coding DNA Sequence Number=SeqID_97317
MESHFGYDRHHERALSKPRGRWEMLARLGEQGCFRWGFLSFGG

SEQ ID NO: 214096 - protein, 90 aa, Glycine max
  Coding DNA Sequence Number=SeqID_97318
  Gene Ontology: Mol. function=ribonuclease H activity; Biological process=DNA integration
MIVSYKDWHEMLPFTLHDYRTYVRTSSKATSFSLVVYGMEVVLPFEMEIPSLRIMVELGLEEAEWAQACFDQLNLIKRKRLAAMSHGRLY

SEQ ID NO: 214097 - protein, 120 aa, Glycine max
  Coding DNA Sequence Number=SeqID_97319
  Subcellular localization annotation: CTP_CleavageSite=32; ConfidenceScore=5.26e-01
MTTKILEDESNMSHLLRSFSRISFRSNSSSSSSSMNSTNKLLNEQDNQIHEVVPKYNLFDEEVRFEDINQNMDDWNIPEIPQDKLYIPETIEDKHNFDYIIKILENSIPLGQDIGEEFHL

SEQ ID NO: 214098 - protein, 66 aa, Glycine max
  Coding DNA Sequence Number=SeqID_97320
MPLRTLFLLPHQALIPEISGDGPNGQIRSIKGTPETGLKIPGFHKQRNRSGGRAAQDRYKRERGDV

SEQ ID NO: 214099 - protein, 156 aa, Glycine max
  Coding DNA Sequence Number=SeqID_97321
  Gene Ontology: Mol. function=nucleic acid binding; Cellular component= nucleus; Biological process=biological_process
  Homolog annotation: Hit_ID=Q9FJN9; Match level="QueryCoverage=77%, HitCoverage=55%, E-value=4e-35, Identity=65%"; Hit description =Poly(A)-binding protein II-like
  Pfam annotation: Domain name=RRM_1; Domain location=19-88; Score =56.7; E_value=7.7e-14; Accession=PF00076.12; Description=RNA recognition motif. (a.k.a. RRM, R
PSCSAKEGCKRRNNQSLVVLPKKVDYSCTPEEVQQHFQSCGTVNRITIRTDKFGQPKGYAYVEFLEVEAVQEALLLNESELHGRQLKVTAKRTNIPGMKQYRPRRSTNPYMGGLRGRTPYAAPFIYSPYGYGFQGSEWQCATAPTIDSPILVGWTE

SEQ ID NO: 214100 - protein, 51 aa, Glycine max
  Coding DNA Sequence Number=SeqID_97322
MYNWTPISVIDSYFQIDPANASASQANKEEIDSRSVFVGNVMLPSTSFLVL

SEQ ID NO: 214101 - protein, 81 aa, Glycine max
  Coding DNA Sequence Number=SeqID_97323
MQHTNRHYNTLLAKCKQLCQYRFCPCGCMIHPLKCKLCCNLEQLDGYWDVLPCVIWKPLFLSEWYMGWLLHLQLSSISILN

SEQ ID NO: 214102 - protein, 283 aa, Glycine max
  Coding DNA Sequence Number=SeqID_97324
  Homolog annotation: Hit_ID=O82659; Match level="QueryCoverage=22%, HitCoverage=36%, E-value=1e-18, Identity=78%"; Hit description =Centrin
  Pfam annotation: Domain name=efhand; Domain location=248-276; Score =40.7; E_value=5.1e-09; Accession=PF00036.22; Description=EF hand
MMLDGVKPSHITYFVGCGPWQEKSWGCGEVYVEGRDVLYETCEYVTEEDTRFECVRPGLVLHLIVYTFAIPDSLDTLKLVVEVSLDAFMKLDRNMIEQQYMKPWGAAENKCCQGLWQKSVATDLLSCFIQAGLVTTLSTRTVFGATNPKGQYDPDQRITYIMSEVVYYDFSSITIASVLYLSDLTQGSTVRQYNSLWSFIKQEELDRTTNDEDLLNRWPLPTLKRGESRRYNNKPRGRHNLTTQKKQEIKEAFELFDTDGSGTIDAKELNVAMRALGFEMTEE

SEQ ID NO: 214103 - protein, 301 aa, Glycine max
  Coding DNA Sequence Number=SeqID_97325
  Gene Ontology: Mol. function=methyltransferase activity; Cellular component=nucleus; Biological process=DNA methylation
  Homolog annotation: Hit_ID=Q8LER4; Match level="QueryCoverage=80%, HitCoverage=57%, E-value=9e-61, Identity=52%"; Hit description=DNA methyltransferase PMT1-like protein
  Pfam annotation: Domain name=DNA_methylase; Domain location=1-268; Score=-131.5; E_value=0.0047; Accession=PF00145.8; Description=C-5 cytosine-specific DNA methylase
MNLGFRLLRHTDKENIKCLTAADLDKYGADAWLLSPPCQPYTRQGEFFFFFGKKLLNNLVLGLQKDTGDARAFSFLQILELMPFLLRPPSMLFVENVVGFETSDTHAKLIEILEKTNFITQEFILTPLQFGIPYSRPRYFCLAKRKPSSFVNECLNNLLIQSSPPLFGHFDTVADDDNSSKEDRQNLLQSCQPIEKFIELKNLSNDIAVESEALRTDLSNDAPRTLGENNGHEYESLDQYYIHPSLIDRWGSAMGILALLSIATVVATIAAGRSGAAPVHDGHVWSGAGCGAVFRAVTSKH

SEQ ID NO: 214104 - protein, 85 aa, Glycine max
  Coding DNA Sequence Number=SeqID_97326
  Homolog annotation: Hit_ID=Q1S6Z6; Match level="QueryCoverage=97%, HitCoverage=13%, E-value=3e-12, Identity=49%"; Hit description=Las1 -like
MVNNPSIRISHWRSEFQESHYLSSLSAWLVGILSKVPSVAANMPKRVLLELLCRCLLTSQLCNKQLVDSTLQLAELIDERYLVDK

SEQ ID NO: 214105 - protein, 365 aa, Glycine max
  Coding DNA Sequence Number=SeqID_97327
  Gene Ontology: Mol. function=hydrolase activity; Cellular component =cytoplasm; Biological process=pyrimidine base catabolic process
  Homolog annotation: Hit_ID=Q1S703; Match level="QueryCoverage=87%, HitCoverage=69%, E-value=1e-139, Identity=69%"; Hit description =Metallo-dependent hydrolase, composite
MAMGLMSQLLLLASSLSRSNQFCDAGTSSKLLIKGGTVVNAHHQQVADVYVEDGIIVSIKSTIMVGDEVTVIDATGKFVMPGGTDPHTHLEFEFMGTETVDGFFGGQAAALAGGTTMHIDFVIPRKGSLTAGIEAYEKKARKSCMDYGFHIAITKWDETMSREMELMVKEKGTNSFKFFMAYKGALMINDEFLLEGFKKCKSLELGITGPEGQALSWPAVLEGEATARAIHLADFVNTPLYVVHVMSIDAMEEIAKARKSGQRVIGEPVASGLALDESWLWHPDFETAANFKNISHLVGTDRCAFNSTQKALGIDDFQKIPNGVNGIEERMHLVWDIMVIGMNSRLHFREPPKRPQLRWARGVRN

SEQ ID NO: 214106 - protein, 528 aa, Glycine max
  Coding DNA Sequence Number=SeqID_97328
  Gene Ontology: Mol. function=transporter activity; Cellular component= membrane; Biological process=sodium ion transport
  Homolog annotation: Hit_ID=Q8L7Z8; Match level="QueryCoverage=86%, HitCoverage=78%, E-value=0.0, Identity=79%"; Hit description =Glutamate/malate translocator
  Pfam annotation: Domain name=CitMHS; Domain location=92-460; Score= -106.3; E_value=0.0029; Accession=PF03600.6; Description=Citrate transporter
  Pfam annotation: Domain name=DctM; Domain location=91-516; Score= -236.9; E_value=0.041; Accession=PF06808.2; Description=DctM-like transporters
  Pfam annotation: Domain name=Na_sulph_symp; Domain location=58-528; Score=590.6; E_value=1.5e-174; Accession=PF00939.9; Description =Sodium:sulfate symporter transmembrane region
  Pfam module annotation: Pfam domain module=CitMHS::DctM::Na_sulph _symp; Domain location=92-460::91-516::58-528
  Subcellular localization annotation: CTP_CleavageSite=41; ConfidenceScore=5.68e-01
SQFNQSQSLSLRSPITISQRFSFPSSTFKFNPFSKPHYPIQASPSSPPPPPPPTPIQGAKPIPFIISISIGLIVRFLVPKPVQVTPEAWQLLSIFLSTIAGLVLSPLPVGAWAFLGLTASVVTKTLTFTEAFGAFTNEVIWLIVISFFFARGFVKTGLGDRIATFFVKWMGKSTLGLSYGLTFSEVLIAPAMPSTTARAGGVFLPIIKSLSLSAGSEPASPTSKKLGAYLIQNQFQSAGNSSALFLTAAAQNLLCLKLAEELGVIVPNPWVTWFKAASLPAIVCLLLTPLILYKLYPPVIKDTPEAPALAAKKLESMGPVTKNEWIMVGTMLLAVSLWIFGDTIGIASAVAAMIGLSILLLLGVLDWNDCLNEKSAWDTLAWFAILVGMASQLTNLGIVSWMSDCVADNLRSFSLSWPASLAVLQAAYFFIHYLFASQTGHVGALYSAFLAMHRAAGVPGILAALALGYNTNLFGAITHYSSGQAAVYYGAGYVDLPDIFKMGFIMAFINAIIWGGVGSVWWKFLGLY

SEQ ID NO: 214107 - protein, 143 aa, Glycine max
  Coding DNA Sequence Number=SeqID_97329
MKVMLVVIAPYALFLTLSTGPLCAKLSAESSTVVMFAKCPRVQPPMLDYTYPCLYPTQPWENISWTETQSCDHQSEWVFRSDVHMTQLNLSECTSLTGNHGRSSDEVNFDSCKLLWMFDCGEHRLKGIQKGTVEEERLIASQK

SEQ ID NO: 214108 - protein, 174 aa, Glycine max
  Coding DNA Sequence Number=SeqID_97330
  Gene Ontology: Mol. function=transmembrane receptor activity; Cellular component=membrane; Biological process=defense response
  Homolog annotation: Hit_ID=Q1S092; Match level="QueryCoverage=92%, HitCoverage=90%, E-value=1e-54, Identity=65%"; Hit description=TIR
  Pfam annotation: Domain name=TIR; Domain location=17-149; Score =169.4; E_value=9.4e-48; Accession=PF01582.10; Description=TIR domain
MASTCSSSFSVTKKYDVFISFRGEDTRADFTSHLHAALRRNNIDTYIDYRIHKGDEIWVEIMKAIKESTLFLVIFSENYASSSWCLNELIQLMEYKKHEDVDVIPVFYKIDPSEVRKQSGSYHMAFAKHEKDRKVTEDKMQKWKNALYEAANLSGFLSDAYREKEMRIQRLADF

SEQ ID NO: 214109 - protein, 1001 aa, Glycine max
  Coding DNA Sequence Number=SeqID_97331
  Gene Ontology: Mol. function=protein binding; Cellular component =membrane; Biological process=defense response
  Homolog annotation: Hit_ID=Q1S091; Match level="QueryCoverage=94%, HitCoverage=98%, E-value=0.0, Identity=50%"; Hit description=IMP dehydrogenase/GMP reductase
  Pfam annotation: Domain name=LRR_1; Domain location=445-466; Score =4.0; E_value=50; Accession=PF00560.23; Description=Leucine Rich Repeat
  Pfam annotation: Domain name=LRR_1; Domain location=491-513; Score =4.5; E_value=41; Accession=PF00560.23; Description=Leucine Rich Repeat
  Pfam annotation: Domain name=LRR_1; Domain location=515-534; Score =7.9; E_value=9.3; Accession=PF00560.23; Description=Leucine Rich Repeat
  Pfam annotation: Domain name=LRR_1; Domain location=538-559; Score =4.8; E_value=36; Accession=PF00560.23; Description=Leucine Rich Repeat
  Pfam annotation: Domain name=LRR_1; Domain location=633-654; Score =6.1; E_value=21; Accession=PF00560.23; Description=Leucine Rich Repeat
  Pfam annotation: Domain name=LRR_1; Domain location=656-677; Score =7.8; E_value=10; Accession=PF00560.23; Description=Leucine Rich Repeat
  Pfam annotation: Domain name=LRR_3; Domain location=445-464; Score =41.0; E_value=4e-09; Accession=PF07725.3; Description=Leucine Rich Repeat
  Pfam annotation: Domain name=NACHT; Domain location=46-199; Score= -22.7; E_value=0.0034; Accession=PF05729.3; Description=NACHT domain
  Pfam annotation: Domain name=NB-ARC; Domain location=16-300; Score =122.4; E_value=1.3e-33; Accession=PF00931.13; Description=NB-ARC domain
  Pfam module annotation: Pfam domain module=LRR_1::LRR_1::LRR_1::LRR _1::LRR_1::LRR_1::LRR_3::NACHT::NB-ARC; Domain location=445-466::491 -513::515-534::538-559::633-654::656-677::445-464::46-199::16-300
MIEDIIKVILQKLNHKYPNDFRGQFVSDENYASIESLLKIDSEEVRVIGIWGMGGIGKTTIAEVIFHKISSRYEGSSFLKNVAEESKRHGLNYICKELLSKLLREDLHIDTPKVIPSIITRRLKRKKVLIVLDDVNTSELLENLVGVGRDWLGAGSRVIVTTRDKHVIMGEVVDKIHEVKKMNFQNSLELFSLNAFGKTYPQKGYEELSKRAMGYAKGIPLALKVLGSLLRSRSENEWDSALSKLKKIPNPEIQAVFRLSYEGLDDDEKNIFLDITCFFKGQRRDRVTKILNDCNFSADIGIRSLLDKALITITSDSNCIDMHDLIREMGREVVREESMKNPGQRSRLWDPEEVIDILTNNGGTDTVEGIWLDMTQISYINLSSKAFRKMPNMRLLAFQSPKGEFERINSVYLPKGLEFLPKNLRYLGWNGYPLESLPSSFCPEKLVELSMPYSNLEKLWHGVQNLPNLERIDLHGSKHLMECPKLSHAPNLKYVSMRGCESLPYVDESICSLPKLEILNVSGCSSLKSLSSNTWPQSLRALFLVQSGLNELPPSILHIKNLNMFSFLINNGLADLPENFTDQISLSESREHKCDAFFTLHKLMTNSGFQSVKRLVFYRSLCEIPDNISLLSSLKNLCLCYCAIIRLPESIKDLPKLKVLEVGECKKLQHIPALPRSLQFFLVWNCQSLQTVLSSTIESSKRPNCVFLLPNCIKLDAHSFDAILKDAIVRIELGSKPLPATELENEDASLENEDGDFYYFQLARNGKICYCLPARSGKVRDWFHCHFTQALVTVELPPNLLGFIFYFVVSQVQSCNIGCYGSIGCECYLETSRDERKNISSFFVQENILSCLDPPFGFTEDHVFIWYDEQFCKQVIEIIKERKAINDKSTTHHPKLTFKFFVQTENNNDEVVIKECGFRWMYSFEEGGCKYKESREIHEVEPSVVQNKVKESESNEQETFPPTKEFKQCVFRTSNFEAEETEDLSCLLEELLHIGFGGDLM

SEQ ID NO: 214110 - protein, 208 aa, Glycine max
  Coding DNA Sequence Number=SeqID_97332
  Gene Ontology: Mol. function=nucleic acid binding; Cellular component= nucleus; Biological process=DNA integration
  Homolog annotation: Hit_ID=Q1RXN8; Match level="QueryCoverage=99%, HitCoverage=16%, E-value=7e-36, Identity=38%"; Hit description =Peptidase S8 and S53, subtilisin, kexin, sedolisin; Integrase, catalytic region; Zinc finger, CCHC-type
MGNNAPCKSIGIGSIQIKMHDGIVRTLTKVHHVLELKKNLVFVGVMDSKGFFCWIEGGVMQIRRKGKFMVIQGTKQGNLHILQGSTMASSVSTISQAERHASNGSSNDNSQWHICLGHMSEKGLEILSKQGLLGNHKVEPLHFCKHYFYRKQHQTKLPKVHLRVPSWGEARYFLSIIDDYSRMTWLFMMKQKFEAFKCFKHLTILKKN

SEQ ID NO: 214111 - protein, 86 aa, Glycine max
  Coding DNA Sequence Number=SeqID_97333
MEDNALVLLLYVGRHKWKLLMSPLLLMLLRISPLASSFSEEEKVEEDTKATIFISFSSQTEKLEEDTKAAIFISKLSHFHLKQFSQ

SEQ ID NO: 214112 - protein, 96 aa, Glycine max
  Coding DNA Sequence Number=SeqID_97334
MVVSFFLTHLLFEVEYPLNSSSSPFHVIKIQEAKDSIDEEDPRPTSSNGATSLCVEKHPRKAKTVKVCRRTLCVSRNGMNIVLGYKCEVKSHIEQK

SEQ ID NO: 214113 - protein, 472 aa, Glycine max
  Coding DNA Sequence Number=SeqID_97335
  Gene Ontology: Mol. function=4 iron, 4 sulfur cluster binding; Biological process=pyrroloquinoline quinone biosynthetic process
  Homolog annotation: Hit_ID=P27507; Match level="QueryCoverage=57%, HitCoverage=75%, E-value=1e-126, Identity=86%"; Hit description =Coenzyme PQQ synthesis protein E
  Pfam annotation: Domain name=PqqD; Domain location=143-203; Score =78.8; E_value=1.7e-20; Accession=PF05402.3; Description=Coenzyme PQQ synthesis protein D (PqqD)
  Pfam annotation: Domain name=Radical_SAM; Domain location=198-356; Score=118.6; E_value=1.8e-32; Accession=PF04055.11; Description =Radical SAM superfamily
  Pfam annotation: Domain name=TENA_THI-4; Domain location=1-125; Score= 12.4; E_value=4.5e-05; Accession=PF03070.6; Description=TENATHI-4 family
  Pfam module annotation: Pfam domain module=PqqD::Radical_SAM::TENA _THI-4; Domain location=143-203::198-356::1-125
LGEAVGLDRKVLLSEKLVLPGVRFAVDAYVNFARRANWQEAACSSLTELFAPQIHQSRLDSWPQHYPWIKEEGYFYFRSRLSQANRDVEHGLALALEVFTSAEQQNRMLEILQFKLDILWTMLDAMTMAFALQRPPYHTVTDQWEVAQDSHVVLYPEGMAKLNETAAAILELVTGKQDVAAIIATLNARFPEAGGVDDDLTYRCPLQCPYCSNPLDFSQQEQELSTEQWIEVFRQARAMGSVQLGFSGGEPLTRKDLPELIRAARDLGFYTNLITSGIGLTEKKLDAFADAGLDHIQISFQASDETLNAALAGSQKAFQQKLAMAKAVKKHGYPMVLNFVLHRHNIDQIDKIIDLCIELEADDVELATCQFYGWAHLNRQGLLPTREQIARAEAVVARYRERMGSSGNLTNLLFVTPDYYEERPKPCMGGWGSIFLSVTPEVPFSAGAEPGGYLVQLVLASIAIAASTGCRN

SEQ ID NO: 214114 - protein, 1134 aa, Glycine max
  Coding DNA Sequence Number=SeqID_97336
  Homolog annotation: Hit_ID=Q2NSU4; Match level="QueryCoverage=37%, HitCoverage=71%, E-value=0.0, Identity=76%"; Hit description=Peptide ABC transporter periplasmic component SapA
  Pfam annotation: Domain name=BPD_transp_1; Domain location=476-717; Score=192.4; E_value=1.1e-54; Accession=PF00528.12; Description =Binding-protein-dependent transport s
  Pfam annotation: Domain name=SBP_bac_5; Domain location=1-342; Score =185.2; E_value=1.6e-52; Accession=PF00496.12; Description=Bacterial extracellular solute-binding proteins, family 5
  Pfam module annotation: Pfam domain module=BPD_transp_1::SBP_bac_5; Domain location=476-717::1-342
MNADDVVFSFARMFDRQHPWHNVNGGSYPYFDSLQFADSVQSVKKLDNDTVEIRLNSPDASFLWHIATHYAPVLSQEYASQLSAAGQQEQLDRQPVGTGPFQLSEYRTGQYLRLARNPHYWKGVPRLQQVVIDLGVGGTGRLSKLLTGECDVLAYPAASQLSILRDDPRLRMTLRPGMNIAYLAFNTRKPPLDRPEVRHALALAINNERLMESIYYGTAETAASILPRASWAYDNDARVTEYNPAKAREALKALGIEDLHLRLVVPTTSMSWNPSPLKAAELLQADLAQVGVRVTIAPVEGRFQEAQLMAMNHDLTLTGWATDSNDPDSFFRPLLSCAAIRSQTNYAHWCSPAFDEALQRALLSQQLSARIDSYDRAQQMLAQALPVLPLASSLRLQAYRHDIKGLVLSPFGNASFAGVYRDEHGEDLSYFTPNAPLEGASLFDAWWFWFKGLLQFDFGVSSTNGQAIDIQLREVFPATLELCVLAFMLALLVGIPLGICAGVMRNKWQDKAISALALLGFSMPVFWLALLFTLLFSLTLGWLPVSGRFDLLYPVQNITGFALIDAWLSPSPWRHEMLVSALTHLILPVIVLAVAPTTEVIRLLRNSTSDVMDKNYVKAAATRGLSRFTVIRRHVLHNALPPVIPRLGLQFSTMLTLAMITEVVFNWPGLGRWLINAIRQQDYAAISAGVMVVGGLVILVSVLSDIIGAALNPLKHKEWSQAGVELSNHRLQIMDEADLRDFECYVSVRGDHTKQLENGIMARNIAPGYCVVERAGSLDYQAREIFRDIRSPAVNMFMQLNADTPWLRPGQILIVADPDTPAPLTMQALTTLKQAKSRTNNALIGVNVEEAGFMQKHYGMIAALTSAVDKIFGTAGDAGEKYFNAIEQTLKKIEASYQNQFRTQGTLIGQQFFVERNQLLNQLKELVNKPLLKNLARYSIKFQQYESMKRALNLSSRSIVHEWSTVGIGAIPGYSYYVGNAAKAARFMKMGGFIGIGFSFAGTTNDVVDACSKGREGECGKIAVKDYSKFAFTTGGGMLGGVWGSSAALAGCAAIGIVTAGAGGVACAVVGSVAGGECGKIAVRDYSKFIVGSAGGVVGGAYGGAAMAGVCAAVGGYLGSTGAEAIVNKVTELL

SEQ ID NO: 214115 - protein, 82 aa, Glycine max
  Coding DNA Sequence Number=SeqID_97337
MSSVEAYYENGKQLKDGKGKRKICNLSGHNRDKFQERLDFKFYDFQALEIEKGWNNLFVSIISIETGETIAKSGKAAVNFVA

SEQ ID NO: 214116 - protein, 110 aa, Glycine max
  Coding DNA Sequence Number=SeqID_97338
EKDSLQQENEEYKNKVKDLEKKLKQKKDVKQDQYDGKDCSTSTTALHDLKFLQSNWRTKDNGVHNFGFYCRKRIIEEAAPNPVKGHCCRISSNVTHNKNDIPSWFNHFSL

SEQ ID NO: 214117 - protein, 382 aa, Glycine max
  Coding DNA Sequence Number=SeqID_97339
  Gene Ontology: Mol. function=3,4-dihydroxy-2-butanone-4-phosphate synthase activity; Cellular component=chloroplast; Biological process=riboflavin biosynthetic process
  Homolog annotation: Hit_ID=P47924; Match level="QueryCoverage=93%, HitCoverage=58%, E-value=1e-153, Identity=77%"; Hit description =Riboflavin biosynthesis protein ribAB, chloroplast precursor [Includes: GTP ...
  Homolog annotation: Hit description=cyclohydrolase-2 (EC 3.5.4.25) (GTP cyclohydrolase II); 3,4-dihydroxy-2-butanone 4-phosphate synthase (DHBP synthase)]
  Pfam annotation: Domain name=DHBP_synthase; Domain location=1-122; Score=112.4; E_value=1.3e-30; Accession=PF00926.10; Description=3,4 -dihydroxy-2-butanone 4-phosphate synthase
  Pfam annotation: Domain name=GTP_cyclohydro2; Domain location=127 -329; Score=365.6; E_value=7.7e-107; Accession=PF00925.11; Description=GTP cyclohydrolase II
  Pfam module annotation: Pfam domain module=DHBP_synthase::GTP _cyclohydro2; Domain location=1-122::127-329
DAKHGTTTGVSAHDRATTVLALASRDSTPGDFNRPGHIFPLKYREGGVLKRAGHTEASVDLAVLAGLDPVAVLCEIVDDDGSMARLPKLRQFAEHENLKIVSIADLISKEINTYCYCRYRRKRDKLVDRSSAAQIPTMWGPFTAYCYRSLLDGIEHIAMVKTNLGFMKVPLSDQSTTNIYASAFKEQHRKLIADGEIGDGQDVLVRVHSECLTGDIFGSARCDCGNQLALAMQQIEAAGRGVLVYLRGHEGRGIGLGHKLRAYNLQDDGRDTVEANEELGLPVDSREYGIGAQMLRDLGVRSMKLMTNNPAKYIGLKGYGLTVSGRIPLLTLITSENKRYLETKRVKMGHIYGTEFNGRLSTHDSGNGNATRIEDSNAVTGL

SEQ ID NO: 214118 - protein, 311 aa, Glycine max
  Coding DNA Sequence Number=SeqID_97340
  Gene Ontology: Mol. function=metal ion binding
  Homolog annotation: Hit_ID=Q6K9X4; Match level="QueryCoverage=88%, HitCoverage=32%, E-value=2e-12, Identity=29%"; Hit description =Ubiquitin-protein ligase-like
MTDFQPLQQKPEPADAHAEFELGLEEFMRGHLDDCMSFASCSSSRAPDDEDDEGDQLVRRRRRSDLEGDDLAESSAARRRHSRILSRWAARQAQEMITTIERRNRESELMALAGLHTVSMLDSSFLRGSQSPTSGQEGAVERPSTQASAILQMWRELEDEHLLNRARERMRVRLRHQRNSDSHTNVSSTMSDSRGSENQGSLGDASESENDYGTWSHDQTGSRNAHGDHNGSSREQSLDLGEVERERVRQIVQGWMESGISDHSSNVSQINNSRRAEWLGETERERVRNIREWVQMISQQRGSRGSRRDAQ

SEQ ID NO: 214119 - protein, 124 aa, Glycine max
  Coding DNA Sequence Number=SeqID_97341
MGTADIGLVYHGDTSCALAGYLDFDYAVDLDARRTMTRIRGEMRRHLLEDKPWKEKLHHQKSALDKKLTEEASMKEENERDRVMQSYPLRALDRRLQEDWARDAREGPTVLMSLKVDFRPMTWA

SEQ ID NO: 214120 - protein, 425 aa, Glycine max
  Coding DNA Sequence Number=SeqID_97342
  Gene Ontology: Mol. function=polyphosphate kinase activity; Cellular component=polyphosphate kinase complex; Biological process =polyphosphate biosynthetic process
  Homolog annotation: Hit_ID=Q7VZ62; Match level="QueryCoverage=98%, HitCoverage=60%, E-value=0.0, Identity=85%"; Hit description =Polyphosphate kinase
  Pfam annotation: Domain name=PP_kinase; Domain location=10-425; Score= 168.1; E_value=2.2e-47; Accession=PF02503.7; Description =Polyphosphate kinase
MESGMTTRPPAEPLLLNRELSLLKFNERVLAMAENPGTPLLERLRYVCIVSSNLDEFFEIRISSLKEQQRQSPNLVGPDGMTPDQAFENVQQAVHELVGRQYALLNDAILPALQAEGIALHHASEWNAEQQEWAREVFNRDVMPLLTPIGLDPAHPFPRVYNKSLNFIVSLSGADAFGRQASIAVVQAPRALPRLIKMPQELSGHPEGYILLTSLLRAFVGELVPGLEMLGCFQWRVTRNSDLFVDQEEVSNLRHALQGELSQRNFGAAVRLEIDKLTPVELESFLHREFSLNPEDTYRVPGPVNLSRLMLLCYSPNRPDLLFPDYRAPVPAPFDRVGDKPAELFEAVAKHDRLLLHPYHSFHPVIYFLTAAALDPDVMAIKQTIYRTGEDSELMKILLAAARAGKEVTVVVELMARFDEQTTIN

SEQ ID NO: 214121 - protein, 127 aa, Glycine max
  Coding DNA Sequence Number=SeqID_97343
  Gene Ontology: Mol. function=ATP binding; Biological process=defense response
  Subcellular localization annotation: CTP_CleavageSite=23; ConfidenceScore=5.31e-01
MASPPSSPPPPPPSPSDTSVSPSAVKRTQIKNIFGGIVARDKVDVTYENWKEVPTAQKDLIWEDIQVEFEIPEASDDRTKKKLLHTIGERWRQFKSDLIRKWALAADQDGVDDTVCEKYGISKEKWS

SEQ ID NO: 214122 - protein, 249 aa, Glycine max
  Coding DNA Sequence Number=SeqID_97344
  Gene Ontology: Mol. function=transferase activity; Cellular component= membrane; Biological process=biosynthetic process
  Homolog annotation: Hit_ID=Q9RQ94; Match level="QueryCoverage=91%, HitCoverage=82%, E-value=1e-66, Identity=55%"; Hit description =Putative beta-glycosyltransferase
  Pfam annotation: Domain name=Glycos_transf_2; Domain location=7-165; Score=118.0; E_value=2.7e-32; Accession=PF00535.16; Description =Glycosyl transferase
MNNLKVSIITVCYNSAKTIEDTIVSVASQQYRNKEHIIVDGASTDNTMDIVKNAASVSSYISEPDRGIYDAMNKGLKLAKGDVIGLLNADDFYADDDVLANIAEIFKDHDVQACFADLVYVDQRESSRVVRYWKSEPYQKGLFKSGWMPAHPTFFVRREVYEKYGLFNLDYKIAADFELLFRFIEQYQIKTVYLDKVLVKMRTGGTTNKSLKNIWAQNKEIIQTLRLTYPDFSASIYKIKGMTLRLSNE

SEQ ID NO: 214123 - protein, 91 aa, Glycine max
  Coding DNA Sequence Number=SeqID_97345
MAKGGVFSKKRCANSNQAHLDLLGCSNRRWCLQASWAATTSLFSPIIRGKRAEQIRSALLIFRIHLKLVKKLFPRRKSKPRRFRNASETFP

SEQ ID NO: 214124 - protein, 170 aa, Glycine max
  Coding DNA Sequence Number=SeqID_97346
  Gene Ontology: Mol. function=heat shock protein binding; Cellular component=Golgi apparatus; Biological process=visual perception
  Homolog annotation: Hit_ID=UPI0000D66BFF; Match level="QueryCoverage =51%, HitCoverage=83%, E-value=3e-14, Identity=34%"; Hit description =PREDICTED: similar to SPT transcription factor family member (spt-5)
MKDCISLFIKVGDLPPPQVMLAQLATLQDQGVAQELIKGNYGPFTWEHKPRLSIKEEDLEFSEGVDVESSKGKDVQPSKDEGVQPSEGEGVQPSEGEGVQPSEGEGVQPFEGEGVQPSEGEGVQPSDGEDVQTTEGEGVQPSEGEGVHPSVGEDAQPVGSSGLGIIKKRG

SEQ ID NO: 214125 - protein, 109 aa, Glycine max
  Coding DNA Sequence Number=SeqID_97347
MHLCLIPTLLLFLHHFNVPLDDEPYVKWVRKQDLPPPIPNERTPFPPPQRDASSSLLTEVLTELCDLRAFMGEHFDAMDTHFDGIGTRITRLEDDISFIRRCFDPPTDF

SEQ ID NO: 214126 - protein, 65 aa, Glycine max
  Coding DNA Sequence Number=SeqID_97348
MWKIEEMKEMEELVWVGLQRFLGGSGQQRWWWRKIPFTSLMILPFEGVSTGFDQWEYPVTIGAYW

SEQ ID NO: 214127 - protein, 72 aa, Glycine max
  Coding DNA Sequence Number=SeqID_97349
MENPYIFKWEQGGPKFLDSSTYETPNVHGEDNATHGETQFNYEADNEELPNAMQTASNVNAKRKRGEKGKKI

SEQ ID NO: 214128 - protein, 397 aa, Glycine max
  Coding DNA Sequence Number=SeqID_97350
  Gene Ontology: Mol. function=ATP-dependent helicase activity; Cellular component=phycobilisome; Biological process=regulation of transcription, DNA-dependent
  Homolog annotation: Hit_ID=Q94JY9; Match level="QueryCoverage=98%, HitCoverage=43%, E-value=1e-121, Identity=60%"; Hit description =Putative helicase
  Pfam annotation: Domain name=CarD_TRCF; Domain location=141-281; Score=39.5; E_value=1.1e-08; Accession=PF02559.6; Description=CarD -likeTRCF domain
  Pfam annotation: Domain name=DEAD; Domain location=309-397; Score= -43.5; E_value=0.026; Accession=PF00270.19; Description=DEADDEAH box helicase
  Pfam module annotation: Pfam domain module=CarD_TRCF::DEAD; Domain location=141-281::309-397
  Subcellular localization annotation: CTP_CleavageSite=96; ConfidenceScore=5.63e-01
MASSSSLLPRPHIPTPLISKLTSSPRTWSLFILKYPSHPKTNSNNNKRLILSPTNAVYTQSPHTPSTPSKTELHNDAITVLNERIRRDFSKKEAFRTVMDSEEAGKYMQMVKVQQQRGLQKLKGDRGTKDGVFSYKVDPYTLRSGDYVVHRKVGVGRFVGMRFDVAKNSSQHTEYVFIEYADGMAKLPVHQAAKMLYRYSLSFTNAVRALVSKILEVNKKGKYSGFTTTLLNQPNLTPWPNETKKPKALSKLSDTSAWERRKVKGKVAIQKMVVDLMELYLHRLKQRRPPYPKSPAMAKFAAQFRYEPTPDQKRAFIDVERDLTERETPMDRLICGDVGFGKTEVALRAISCVVSAKKQAMVLAPTIVLAKQHFDVISERFSVYPDIKVGLLSRFQS

SEQ ID NO: 214129 - protein, 772 aa, Glycine max
  Coding DNA Sequence Number=SeqID_97351
  Gene Ontology: Mol. function=potassium ion transporter activity; Cellular component=integral to membrane; Biological process =potassium ion transport
  Homolog annotation: Hit_ID=Q9LD18; Match level="QueryCoverage=99%, HitCoverage=99%, E-value=0.0, Identity=73%"; Hit description =Potassium transporter 4
  Pfam annotation: Domain name=K_trans; Domain location=26-772; Score =1299.7; E_value=0; Accession=PF02705.7; Description=K+ potassium transporter
MEPESGTSTSRNPSQLSWVNLSRNLLLAYQSFGVVYGDLSTSPLYVFTSTFRGKLQNHHDEETIFGTFSLIFWTLTLIPLLKYVFILLGADDNGEGGTFALYSLLCRHAKFNLLPNQQAADEELSSYKYGPSSQAVASSPLKRFLEKHKRLRTALLIVVLFGACMVVGDGVLTPAISDELVLLACVILVGLFALQHCGTHKVAFMFAPIVIIWLVSIFSIGLYNTIYWNPKIVRAISPYYIIKFFSKTGKEGWVSLGGILLCITGKNNYLLYIYYAGDYYALFGVQLAFAFVIYPCLVVQYMGQAAFLSKNLGSVANSFYDSIPDPVFWPVFVIATLAAIVGSQAVITATFSIIKQCHALGCFPRVKVVHTSKHIYGQIYIPEINWILMILTLAITIGFQDTTIIGNAYGLACMTVMFITTFLMTLVAIFVWQKSVLIAVVFLLFFWVIEGVYLSAAFIKVPQGGWVPLVLSFIFMIVMYVWHYGTRRKYSYDLHNKVSLKWLLGLGPSLGIVRVPGIGLIYTELATGIPAIFSHFVTNLPAFHKVLVFVCVKSVPVPYVSPKERFLIGRVCPRPYRMYRCIVRYGYKDIQRDDGDFENHLIQSIAEFIQMEAVQPQFSSSEASSSLDGRMAVISSRNYDYASSLVVSEHEDIGVDMSVPSSRSATLQSLQSVYNDDTPQVRRRRVRFQLPENPGMDPDVREELLDLIQAKEAGVAYIMGHSYVKARKSSSFLKKLVIDIGYSFLRKNCRGPAVALNIPHISLIEVGMIYYV

SEQ ID NO: 214130 - protein, 96 aa, Glycine max
  Coding DNA Sequence Number=SeqID_97352
MVLCLVVLCQAMVIMLEESVGHYMPFCFNFEAGCIVRGGSFAVCGCHHGGCYNATAEEEMRLAEEEKRLVKEARMRRRGVKRRSDNVGCTVAAAVM

SEQ ID NO: 214131 - protein, 345 aa, Glycine max
  Coding DNA Sequence Number=SeqID_97353
  Gene Ontology: Mol. function=DNA binding; Cellular component =chromatin; Biological process=DNA integration
  Homolog annotation: Hit_ID=Q1SAI8; Match level="QueryCoverage=75%, HitCoverage=18%, E-value=4e-90, Identity=62%"; Hit description =Integrase, catalytic region
MTSSTASYTPTDIEAAMHALSFSQPDGNYYMDIGATSHMTADAGILSSYFNSSSKNHNIVVGSGHLIPVVGHGSTNLPPPHPPFVLQSVLHAPKLIKNLISVRKFTTDNMVSISFDPFGFLVNDLQTGTRLMRCDSVGDLYPLFSNSQATSPKNSAFTTMSHDIWHNRLGHPGNTIINSLRRNKFIDCNKACKTFCSSFPLGKHAKLPFYDSLSYTFLPLDIIHSDLWTSPIASSSGHRYYVLFLDDYSKFLWTFPIAKKSQPDPTSHAAQSRPTPHVAPTLQQPPPTSSPILASPTSRVPVPASTPNPMLHRLTTRSMSGIHKPNPKYSTNCHTTTTKEISPIP

SEQ ID NO: 214132 - protein, 74 aa, Glycine max
  Coding DNA Sequence Number=SeqID_97354
MAKVICKEITASPMSSLTPRRKEMAICWTPLPTPSVKINVDGSYKASSIKFVVEQSFGVLDWVLKLLEILIYMM

SEQ ID NO: 214133 - protein, 40 aa, Glycine max
  Coding DNA Sequence Number=SeqID_97355
MTRVLSSSETRRFLRQNPLNGSASVSREGMGFVQELYVHG

SEQ ID NO: 214134 - protein, 100 aa, Glycine max
  Coding DNA Sequence Number=SeqID_97356
  Gene Ontology: Mol. function=nucleic acid binding
  Homolog annotation: Hit_ID=Q1T6D0; Match level="QueryCoverage=99%, HitCoverage=19%, E-value=3e-31, Identity=61%"; Hit description=Zinc finger, CCHC-type; Lipocalin
DRLSRIWRLADFDILDIGNNFYMIKFDMEADRTKIMEGDPWMIFYHYLTVQTWSLEFISSTAKIDKTLVWVKFPSLNLVYYDESILLALATAIGKPIRVD

SEQ ID NO: 214135 - protein, 337 aa, Glycine max
  Coding DNA Sequence Number=SeqID_97357
  Gene Ontology: Mol. function=RNA-directed DNA polymerase activity; Biological process=RNA-dependent DNA replication
  Homolog annotation: Hit_ID=Q1S4N5; Match level="QueryCoverage=71%, HitCoverage=42%, E-value=1e-43, Identity=42%"; Hit description =Peptidase M, neutral zinc metallopeptidases, zinc-binding site
MNIVWYYTAIYASPIPSNRHHLWDHLRDIRNQIRGSWLLIGNFNDIIFASEVSRGQFNSSRACLMPDIMNACGVMDLEMVGGSFTWRKIIQAGGHAAWMSHPDYAALVQHTWVSTIGNVHRKLDYIQKKSTKFNERVLGDIFKRNCQIEARIKGVHKQLDTFPYSHFIIWRNNFRPNIIRYSIRSEFCGIKNQGNNGLSLITRIPHFSIHKQSSEEEEIGYYTLILENLFQSRDQCYPQSLQFFHVPYVDQELFDDHIKPVSMKDVRHVIFSISSYKALGLYGFQPIFFKSYQDVVANDVLSMVATAFATGTFDTILAETLIVPIPKVDAPMTFKDF

SEQ ID NO: 214136 - protein, 49 aa, Glycine max
  Coding DNA Sequence Number=SeqID_97358
MEMATMIKVLEWVACCVSNGALLHNGLANDGEATNMARMMIQQLGIEGN

SEQ ID NO: 214137 - protein, 107 aa, Glycine max
  Coding DNA Sequence Number=SeqID_97359
MQAHTARMLRTEVVKKEQNNKNIIVVQGRGPRETTTIKGHDDNNEGVPKYTIDNNEELRLAAKRIELPSFHGEDPWWVSIAKTYFVFQATPREMRIQLAQISMEGPI

SEQ ID NO: 214138 - protein, 93 aa, Glycine max
  Coding DNA Sequence Number=SeqID_97360
MTKARQKGVRKFDFGNLPIEDRRTNEERRRTVENLREITHGNVTEAPRLGFSVEDRRTTKNVEERLKIFAKSPMEMLRKRLGLDFLHGNNFSH

SEQ ID NO: 214139 - protein, 380 aa, Glycine max
  Coding DNA Sequence Number=SeqID_97361
  Gene Ontology: Mol. function=oxidoreductase activity; Cellular component=extracellular space; Biological process=flavonoid biosynthetic process
  Homolog annotation: Hit_ID=Q0PGJ6; Match level="QueryCoverage=67%, HitCoverage=89%, E-value=5e-50, Identity=43%"; Hit description=Aldo -keto reductase
  Pfam annotation: Domain name=Aldo_ket_red; Domain location=25-258; Score=40.8; E_value=1.3e-11; Accession=PF00248.11; Description =Aldoketo reductase family
  Subcellular localization annotation: CTP_CleavageSite=45; ConfidenceScore=5.59e-01
MDATFATLNVTANLVTKGIGSRNRTSSGFWGENTRGSFNMRFCTVQSHKSLKISSTQEFFEDGVVKREDLWITSKLRFYCLLTLLKIVMFLNVENGAVGVKPENVIQHDIPSTWRAMEELYDSGKAKAIGVTNFSSKKPQDLWDIAGVPPTVNQVECHPQWQQLKLHEFCASKEIHLSGFSPLGSKDFSTMICLRILLSISLLRNWGRHLHKYPFSGAYKWDNVLPKTSDEARIKENFDVFNWSIPEELIAKFTEIKQAIFHGPICQNPKANPKNVAIIILGEGAGTRLFPLTSTRAKQVVPIAGCYRIIDIPMSNCIKNGIRKVYVLTQFNSFYLNGHLCRSYNFGNRVNFGGGFVEDAKNKDIENILTIFKLPPTTNY

SEQ ID NO: 214140 - protein, 157 aa, Glycine max
  Coding DNA Sequence Number=SeqID_97362
  Homolog annotation: Hit_ID=Q0GLD8; Match level="QueryCoverage=17%, HitCoverage=15%, E-value=4e-07, Identity=77%"; Hit description=Dof14
MTCKRYWTKGRALHNVPIGGGCRKNKKVKSSRLSCDSKDSGSSFSELGGLKFLHSLSLSMNFHLGGLPFPRLHHHHPPTTYNHFFSFGDTSNASSCFNLDPSPGTTLSHSFVVVNNNPFLTMVQSKVEHLPPNHFNWFGIRARDMFMHTILSKIHPN

SEQ ID NO: 214141 - protein, 286 aa, Glycine max
  Coding DNA Sequence Number=SeqID_97363
  Gene Ontology: Mol. function=RNA-directed DNA polymerase activity; Biological process=RNA-dependent DNA replication
ISSRCLLKIDLHKAYDSISWEFLDWMLKYVGFPAQFCSWIMECISTTSFSVAINGSIYGHFKGQRAPASHPSTQQELAKMCFLISSSSLDLAWAAFPLDTWVFHFYLPGKVELIRAVIQGIANFWMVEVGKNKPLVAWSDVCSSKKEGGTKTVFNWSYVIWNPTIPPKMSFILWLATKNRLLTLDRAAFLNKGLLCPLCTNETESHSPLFFSCRITRRVWANIRDWIPLHRQIISLQCTINSFIRGRATSGTLGKFRCLALATSVYCIWMSRNLLLFENSPLSVID

SEQ ID NO: 214142 - protein, 545 aa, Glycine max
  Coding DNA Sequence Number=SeqID_97364
  Gene Ontology: Mol. function=RNA-directed DNA polymerase activity; Biological process=RNA-dependent DNA replication
TFPPWAFPSGFATVGELLQTSVDVGGASEAQVSPTTGLARGIVVDQDARTACPAPQGNSATLVLDKKPGSSSAVTKVVAHQVFDKLSDCTAGTETSPDDSYTLGEDDSSTNEDSSPSSGSNSAPQVSNGEASTPWINLFKDNRKPSKGFGLKFSPPSSEGVGTQPYRLCDWPFPRKESFARMLSKMRRTYFIFQRPLLLKVMHAFFDFGNEELDHLTTSKGSISFARALVEVDASLELIEEVCFRLHSAKHDHKITTTKGPFTAQSQVTEATNNVHVLQTPADNAGAVNFESVNPDDGFVQTVILTLGWGALTVMDHTPLVVTTEVVVPRGNSPFKFNNAIVDHPNFLSIVSDDWSHQVNGCSMFKQAEAEYNSLLNSLRKNPLDTSLLTQVNRTRGHIILLRKAESRNVAQLIKNRYLLQADRCSKFFHALIKRNRHNRFIAAIRLDNGQSTSSQSKIGHAFVNHFKDLFSAKELQHAASLAICNSRPKVPTDCFAALLSPITTQDVWNVISGMDNNKAPGPDGFNALFFKKAWNIIGDDIFCS

SEQ ID NO: 214143 - protein, 401 aa, Glycine max
  Coding DNA Sequence Number=SeqID_97365
  Gene Ontology: Mol. function=calcium ion binding; Cellular component =mitochondrial inner membrane; Biological process=transport
  Homolog annotation: Hit_ID=Q69X19; Match level="QueryCoverage=91%, HitCoverage=70%, E-value=1e-131, Identity=63%"; Hit description =Putative small calcium-binding mitochondrial carrier 2
  Pfam annotation: Domain name=Mito_carr; Domain location=104-187; Score=98.4; E_value=2.1e-26; Accession=PF00153.17; Description =Mitochondrial carrier protein
  Pfam annotation: Domain name=Mito_carr; Domain location=197-288; Score=108.5; E_value=1.9e-29; Accession=PF00153.17; Description =Mitochondrial carrier protein
  Pfam annotation: Domain name=Mito_carr; Domain location=295-400; Score=78.1; E_value=2.8e-20; Accession=PF00153.17; Description =Mitochondrial carrier protein
  Pfam annotation: Domain name=efhand; Domain location=48-76; Score =25.3; E_value=0.00022; Accession=PF00036.22; Description=EF hand
  Pfam module annotation: Pfam domain module=Mito_carr::Mito_carr::Mito_ carr::efhand; Domain location=104-187::197-288::295-400::48-76
MFIFLETCVKFREVLATFADVECVWFPVEIPTFQDEKVEASIKIDDEELARFVERVDKDNNGVITFQEWRDFLLLYPHEATIENIYHYLERMCMVDIGEQTVIPAGIGGVAGAASRTATAPLDRLKVVLQVQTTRAQIMPAIKDIWKEGGLLGFFRGNGLNVLKVAPESAIRFYSYEMLKTFIVRAKGEEAKAADIGAMGRLLAGGIAGAVAQTAIYPMDLVKTRLQTYACKSGRIPSLGTLSKDIWVQEGPRAFYRGLIPSLLGIIPYAGIDLAAYETLKDMSKQYILHDGEPGPLVQLGCGTVSGALGATCVYPLQVVRTSNFNRFGFLWKLENERHVDFRMQAQRSYKGMADVFRKTLEHEGLRGFYKGIFPNLLKVVPSASITYMVYESMKKNLDLE

SEQ ID NO: 214144 - protein, 135 aa, Glycine max
  Coding DNA Sequence Number=SeqID_97366
MASGNQLPRGCNRLPGLEMKWDVEVASGFHVLKLCNSSLASGSLGDPRRQCEVPIPWHDSTHGYFIGTSRGTRTHASTNCGVDITYTYSISTSGARPSDREGDEDPFPDVDSPKDVMSTSEADSTEESGPGGITT

SEQ ID NO: 214145 - protein, 156 aa, Glycine max
  Coding DNA Sequence Number=SeqID_97367
MCLPHGLSDMCMIRLWLLALNGYGCGVIDVLIGSMCNIGWRIVGRQAIWWEGMLVLNLHKMGAARTSQSFASLAYHIRGSMIYLIAGWVSWVHLSGSTCGNDCSRVDLHHFSYTHHDFHHCGHFLFHGLHVSLRLLLHLLYFTHYSSSDMRSVRAL

SEQ ID NO: 214146 - protein, 68 aa, Glycine max
  Coding DNA Sequence Number=SeqID_97368
MTMQGTDGSTFMMKNVRDQPYIESGCATDNSRTALLSSPVKRVIGIGQNNNDQAFLAVLISKKSVNHR

SEQ ID NO: 214147 - protein, 287 aa, Glycine max
  Coding DNA Sequence Number=SeqID_97369
  Gene Ontology: Mol. function=aminomethyltransferase activity; Cellular component=cytoplasm; Biological process=tetrahydrofolate metabolic process
  Homolog annotation: Hit_ID=Q8U8M1; Match level="QueryCoverage=59%, HitCoverage=17%, E-value=4e-96, Identity=99%"; Hit description =Sarcosine oxidase alpha subunit
  Pfam annotation: Domain name=SoxD; Domain location=3-87; Score=151.0; E_value=3.1e-42; Accession=PF04267.3; Description=Sarcosine oxidase, delta subunit family
MLLIHCPYCGEDRSELEFRWAGEAHIARPENIADISDEAFAEYFFIRDNDKGLVFERWRHIHGCGRFFNAARDSVSDRFLTTYKAGSRAMSGDYRIKGAGRLTPARTARFTFDGKIYPALEGDTVASALLANGVHLIGRSFKYHRPRGFLSAGPEEPNALIDVSRDSLRKQPNVRATVQEVFDGAIIASQNRFPSLSFDLSAINDLLSPMFAAGFYYKTFMWPKAAWHKIYEPLIRRAAGLGKAPSEPDADHYSGRYAHCDVLVAGAGVAGLTAALSAAKTGASVIL

SEQ ID NO: 214148 - protein, 71 aa, Glycine max
  Coding DNA Sequence Number=SeqID_97370
MKNNVEVNYDHNSVEPRPRFLFFLLLLTSFSQNLSMLNLGTLYSASLTSIYNNKGHLVDLQLAQASWFLHL

SEQ ID NO: 214149 - protein, 56 aa, Glycine max
  Coding DNA Sequence Number=SeqID_97371
  Gene Ontology: Mol. function=ribonuclease H activity; Biological process=DNA integration
  Homolog annotation: Hit_ID=Q1S8I9; Match level="QueryCoverage=98%, HitCoverage=16%, E-value=4e-21, Identity=68%"; Hit description =Probable integrase-common tobacco
MESQPPQGVLLPYHTPKRTGLPLLKYALKCDTHAKHTPQLRHSSEVCKEKNCDAQS

SEQ ID NO: 214150 - protein, 219 aa, Glycine max
  Coding DNA Sequence Number=SeqID_97372
  Gene Ontology: Mol. function=RNA-directed DNA polymerase activity; Cellular component=intracellular; Biological process=RNA-dependent DNA replication
MADALATLSSMYEVSHRNNLPTIRIQRLERPAHAFAVEEVVDDKPWFHDIKCFLQSQEYPPGASNKDRRTLRRLSDKQEAELLMHEVHEGSFGTHSNGHAMTRKLLRAGYYWMSMETDCCKHARKCHKCQIYADRIHVPPTTLNVLSSPWPFSMWGIDMIGRIEPKASNGHRFILVAIDYFTKWVEAASYANVTKQVVVRFIKNQIICRLWCAQQNHYR

SEQ ID NO: 214151 - protein, 34 aa, Glycine max
  Coding DNA Sequence Number=SeqID_97373
MEESRGLPSEQGVKFAHWALKRLLPNSLGDLCSV

SEQ ID NO: 214152 - protein, 279 aa, Glycine max
  Coding DNA Sequence Number=SeqID_97374
  Gene Ontology: Mol. function=transporter activity; Cellular component= outer membrane; Biological process=nutrient import
  Homolog annotation: Hit_ID=Q79AD2; Match level="QueryCoverage=53%, HitCoverage=16%, E-value=6e-33, Identity=50%"; Hit description=HasR protein
  Pfam annotation: Domain name=TonB_dep_Rec; Domain location=141-279; Score=21.1; E_value=0.0041; Accession=PF00593.14; Description=TonB dependent receptor
MSSIFTDLTLQNDFYTVSASLRYESYRLKGKTQLPGGTKSVYESRLARFEQTVCGQGGVNAGFPDKAAVYEKACRLAVAGDEAGLAAWWESNPVYHSRRGAPVRVNSLQTKYAEDARHAPRWVERPADYDYEVDRSAGMLLPSMSAAVRPTGWLELYGSWGKSWRPPAINESLMRGGHPGDGFATIYPNPNAEPETSRTWEVGANTIFHDVALDGDRLSLKLDYFDTRADNYLVSSLSNNLPGLNMDVPMGLGITAFVNNRTLTRFRGLELEGRYEAGW

SEQ ID NO: 214153 - protein, 162 aa, Glycine max
  Coding DNA Sequence Number=SeqID_97375
  Gene Ontology: Mol. function=nucleoside-triphosphatase activity; Cellular component=membrane
  Homolog annotation: Hit_ID=Q8L5U8; Match level="QueryCoverage=99%, HitCoverage=41%, E-value=9e-37, Identity=53%"; Hit description =Rubisco expression protein, putative
ARELRNLGNYYSGILKNKGSSEPLRHAVKPKLKWMSLRRNYQILSVLNDLKDNYASGQRACFWMRNVDLLGLHVGRRRPPHMAFLGNPGTVQRTDLVGEFVGHTGPKNKEEAYRLIPMQKSDDKDYGLEALEEIMSVMDSGKIVVIFAGYCEPMKRVIASNE

SEQ ID NO: 214154 - protein, 100 aa, Glycine max
  Coding DNA Sequence Number=SeqID_97376
MGKDDLMRQFEVAAQDGHDVATLHISKVLYDLMLEEDASLVQDEVNSLLEVSYPNFVWGLSLDDMQPLVSRFDLLGVLCCTINEVSRRVKNQKEAGLRDP

SEQ ID NO: 214155 - protein, 81 aa, Glycine max
  Coding DNA Sequence Number=SeqID_97377
MSSTPDMSRNYHGLPNDGRQVQNDHNLSLRAIGHDRAWMERRRMTIICLYVPLDTIASGWRKGVWNDHNLSPPTTRLTAPE

SEQ ID NO: 214156 - protein, 70 aa, Glycine max
  Coding DNA Sequence Number=SeqID_97378
MGARHLEAVKQRLHAIKQWSRTKLGYGNGVNGLMPGIYAKLHPMAFLCFLSTSNNFSSCATGFNSGVGGG

SEQ ID NO: 214157 - protein, 69 aa, Glycine max
  Coding DNA Sequence Number=SeqID_97379
MRLVLPFVSNRFPSAISAYKHHKHHPKNPKTEWKWAPKVEALCGASMENEEEENGNVREREGCLKFLFC

SEQ ID NO: 214158 - protein, 117 aa, Glycine max
  Coding DNA Sequence Number=SeqID_97380
  Gene Ontology: Mol. function=DNA-directed RNA polymerase activity; Cellular component=mitochondrion; Biological process=transcription
  Homolog annotation: Hit_ID=O47884; Match level="QueryCoverage=91%, HitCoverage=12%, E-value=2e-27, Identity=63%"; Hit description=RNA polymerase
MDAVDKGTKASKTRAYPFGTALVEFLVSRGLLRLVTYNVDLLNFSDDSGPKTVVKNVVKKGHNYYRSSLVYAECLFNPALLPIKLNLPMVFPPKDWEPHKPEQKPTLRAKSTALNGV

SEQ ID NO: 214159 - protein, 73 aa, Glycine max
  Coding DNA Sequence Number=SeqID_97381
MSQGNFNGEVLPKSALDRQPKLLNLRSLIRLNIQASSTDPSCKTTLDLDIPLRFRLTSTEFHPQIPYVRLDSV

SEQ ID NO: 214160 - protein, 203 aa, Glycine max
  Coding DNA Sequence Number=SeqID_97382
  Pfam annotation: Domain name=zf-CCHC; Domain location=145-162; Score =14.7; E_value=0.0037; Accession=PF00098.13; Description=Zinc knuckle
MSHHSSSVNGEGTSHKDPLSRILDQLSSLKLWKEKLERKEKGNEKLTPIGEKRREKERKSQKANINLPYFHGKDNVEAYLDWEISVEQQLKRKSTSKSYGSHFYPKKDQGQGILGLTPSKPKDDKGKTIEKQSLKASMQEKTSSITCFKCLGRGHITSQFPTKKTMIMRGQDIYSSQDEATTSPSSSQSEEAKGEESSEEIYP

SEQ ID NO: 214161 - protein, 138 aa, Glycine max
  Coding DNA Sequence Number=SeqID_97383
  Gene Ontology: Mol. function=transferase activity; Cellular component= 1-2nm peptidoglycan-based cell wall; Biological process=transport
  Homolog annotation: Hit_ID=Q6D0M3; Match level="QueryCoverage=51%, HitCoverage=17%, E-value=2e-15, Identity=54%"; Hit description =Putative membrane protein
  Pfam annotation: Domain name=PTS_IIB; Domain location=3-87; Score =73.1; E_value=8.8e-19; Accession=PF02302.8; Description=PTS system, LactoseCellobiose specific IIB subunit
MKKVLIVCGNGLGSSFIVEMNVKKIIKELGKEAEVGHTDLTSAKSEQADIIISAKDIADQLSSHSAQKPVSDVISGTLKTIMGFVILIAGANLIAATLTIFSQLFEHSFNIQGVVPNTDAMAALAQKNYGTETARSWF

SEQ ID NO: 214162 - protein, 353 aa, Glycine max
  Coding DNA Sequence Number=SeqID_97384
  Gene Ontology: Mol. function=superoxide dismutase activity; Cellular component=cellular_component; Biological process=superoxide metabolic process
  Homolog annotation: Hit_ID=Q71S33; Match level="QueryCoverage=56%, HitCoverage=97%, E-value=2e-99, Identity=86%"; Hit description =Manganese superoxide dismutase
  Pfam annotation: Domain name=Sod_Fe_C; Domain location=96-206; Score =197.5; E_value=3.2e-56; Accession=PF02777.8; Description =Ironmanganese superoxide dismutases, C-term
  Pfam annotation: Domain name=Sod_Fe_N; Domain location=7-94; Score =194.3; E_value=2.8e-55; Accession=PF00081.12; Description =Ironmanganese superoxide dismutases,
  Pfam module annotation: Pfam domain module=Sod_Fe_C::Sod_Fe_N; Domain location=96-206::7-94
MERKNMSYSLPSLPYAYDALEPHFDKQTMEIHHTKHHQTYVNNANAALEGTEFANLPVDELITKLDQLPADKKGPLRNNAGGHANHSLFWKGLKTGTTLQGDLKAAIEKDFGSVEKFQEEFEKAAATRFGSGWAWLVKKGDKLAVVSTANQDNPLMGEAIAGVSGFPIIGLDVWEHAYYLKYQNKRPDYIKAFWNVVNWDEAAALSGKLRPNKLWNSQQFRLKFALSQGLLPAKPHRPYLRAGFSVAQRAQAILDHYQLMDKLANNQLRQLLLSPSGNLLARFTGKNEEQGRGNIFPVTLFAMPPKAAHGVFPKRLLMESGIYSGGTVRRTGHYRGWRYHPCFPQSALPSQQR

SEQ ID NO: 214163 - protein, 373 aa, Glycine max
  Coding DNA Sequence Number=SeqID_97385
  Gene Ontology: Mol. function=nucleoside-triphosphatase activity; Cellular component=HslUV protease complex; Biological process =protein folding
  Homolog annotation: Hit_ID=P0A6H5; Match level="QueryCoverage=63%, HitCoverage=53%, E-value=1e-116, Identity=90%"; Hit description=ATP -dependent hsl protease ATP-binding subunit hslU
  Pfam annotation: Domain name=AAA; Domain location=3-190; Score=-31.0; E_value=0.047; Accession=PF00004.19; Description=ATPase family associated with various cellular activities (AAA)
  Pfam annotation: Domain name=AAA_2; Domain location=4-136; Score =157.2; E_value=4.3e-44; Accession=PF07724.4; Description=ATPase family associated with various
  Pfam module annotation: Pfam domain module=AAA::AAA_2; Domain location=3-190::4-136
DDSQLQSMFQNLGGQKQKPRKLKIKDAMKLLIEEEAAKLVNPEELKQDAIDAVEQHGIVFIDEIDKICKRGGQSSGPDVSREGVQRDLLPLVEGCTVSTKHGMVKTDHILFIASGAFQVASPSDLIPELQGRLPIRVELQALTVNDFERILTEPNASVTVQYKALMGTEGVNVEFTEDGIRRIAEAAWQVNETTENIGARRLHTVLERLMEDISYDASDRHGESITIDAEYVGQHLDELRPAGRAESQRTAAAGSGRCRKAWRAAERERDAGAGDRASAQREHGRAEEKRARPGGGTPDDRAGTRDGAEGDDRLREAAVLIAVTRRGPRRVLPRQPAAPAAPAYPARHSGGDTPRASCWQSLPDLYVPCSAAA

SEQ ID NO: 214164 - protein, 159 aa, Glycine max
  Coding DNA Sequence Number=SeqID_97386
MGIEASLETTNAEQTFLDQSTSSSGQVAIDDGNDDIDALIQPFESLAAGMDLWKFFLSSNGQQRSKHELEGSSSNTMAARGNEARSLREWLESKKGVRWGIEALPNDGGIGGFESKENEDCGCPDHGTACVGQNEMTMFLVFDCVFAVFDNVNVFALFE

SEQ ID NO: 214165 - protein, 110 aa, Glycine max
  Coding DNA Sequence Number=SeqID_97387
MEQIWLVDLVWVVGANLGSWGCGGGWWCAQTMERDCVVGGICVEFGSLRRLMVLVWAECGFGSTEVVVVSGGARWCLFGLCGGWRCRGCGMMLAMSWVAVLVMVVGGFLG

SEQ ID NO: 214166 - protein, 470 aa, Glycine max
  Coding DNA Sequence Number=SeqID_97388
  Gene Ontology: Mol. function=transporter activity; Cellular component= integral to membrane; Biological process=transport
  Homolog annotation: Hit_ID=Q652I7; Match level="QueryCoverage=76%, HitCoverage=70%, E-value=3e-91, Identity=47%"; Hit description=SEC14 cytosolic factor-like
  Pfam annotation: Domain name=CRAL_TRIO; Domain location=190-373; Score=35.2; E_value=1.3e-08; Accession=PF00650.10; Description =CRALTRIO domain
  Pfam annotation: Domain name=CRAL_TRIO_N; Domain location=103-177; Score=31.1; E_value=3.9e-06; Accession=PF03765.5; Description =CRALTRIO, N-terminus
  Pfam annotation: Domain name=EMP24_GP25L; Domain location=383-459; Score=16.1; E_value=0.022; Accession=PF01105.14; Description =emp24gp25Lp24 family
  Pfam module annotation: Pfam domain module=CRAL_TRIO::CRAL_TRIO _N::EMP24_GP25L; Domain location=190-373::103-177::383-459
MNDANECCCNDEYGEIVVGVPLVINFFDKNNNNDEKSLKVQEKKNQEDHDCDQEDDDDDLDATALGDAGAPSPAEIKLKMKKSLLEFRCKVEDAILGNYLLGEQDHEKLAPQEIAVAREQIREITLWGVPLLLSKAHEGTDVVLRKFLKAKDFKVNEAFDMLQKTLVWRRENNVDGITDEDLGSEFGNNAGFLCGKDREGRPVCYHACEIFKDRRVYKKTFGSDNTCDKYLRWRIQMIEKAVKKLCFREGGVESILQVFDLRNTPMQGTKELNSVSKKALILFQNYYPEIIHKNIIVYAPFWFYTSQVLLSGFMNQRNKKKFILARSQKVTQTLLKFIAPEHLPTEYGGLRRNNDEDFSPSDKVSELKIKGSTVSKVEFPIQQLGVTIMWDVTVVGWDVSYKEEFIPDDEGSYTVLLQNQSVDGSSTRNSFYISEPGKIVITVENRTYKKKKMFYRSTARTTVPMFFLLQ

SEQ ID NO: 214167 - protein, 111 aa, Glycine max
  Coding DNA Sequence Number=SeqID_97389
MAEDLAAGRDDGRPDYGPGRSKGGGIYANGQLVYRNCSINLCAYVKNACPYELKYLHVYHRGKPKKGRGGARDAKRARASTIVAAIVVPAIISICHATGSQGGDRMYEDEC

SEQ ID NO: 214168 - protein, 149 aa, Glycine max
  Coding DNA Sequence Number=SeqID_97390
  Gene Ontology: Mol. function=RNA-directed DNA polymerase activity; Cellular component=chromatin; Biological process=RNA-dependent DNA replication
MRRRPLEFETDDHVFVRVTPTMGVEKEIKSNKLTLKFLGPYPILRHVGPMAYEMVLLPFLANLHNIFHVSQLRKYIPDPTHVLEVDIVQMCEDLTYKTQLARTEDQRIKQLRGKTISLVKVIWSDNTGGMTWKLEDKMCEQYPRLFPNQ

SEQ ID NO: 214169 - protein, 267 aa, Glycine max
  Coding DNA Sequence Number=SeqID_97391
  Gene Ontology: Mol. function=transcription factor activity; Cellular component=nucleus; Biological process=regulation of transcription, DNA-dependent
  Homolog annotation: Hit_ID=Q1SZK5; Match level="QueryCoverage=63%, HitCoverage=64%, E-value=5e-34, Identity=48%"; Hit description =Pathogenesis-related transcriptional factor and ERF
  Pfam annotation: Domain name=AP2; Domain location=110-175; Score =138.1; E_value=2.3e-38; Accession=PF00847.10; Description=AP2 domain
  Subcellular localization annotation: CTP_CleavageSite=22; ConfidenceScore=5.27e-01
MDFDSSFFQYQNFNSSFVNSSVCAEPFSWENFLFFNEENTTTTTLNSFTITDHSSQSRIKESSSSDYSNSSGSLVSTESQLEVSSNLTHASHQLETHASPQPPKEGNKDKRPFRGVRRRPWGKFAAEIRDSTRNGVRVWIGTFDTAEAAALAYDQAALSTRGSMAVLNFPEEVVRESLKDMQNNNKPSLEDGSSPVLALKRKHTMRRKSKATNKKTKRGHGMELENIVLSQNVLVLEDLGSEYLEQLLSLTSSDDDFLCYLYKVNKF

SEQ ID NO: 214170 - protein, 158 aa, Glycine max
  Coding DNA Sequence Number=SeqID_97392
  Gene Ontology: Mol. function=inorganic phosphate transporter activity; Cellular component=integral to membrane; Biological process=phosphate transport
  Homolog annotation: Hit_ID=Q9ARI9; Match level="QueryCoverage=98%, HitCoverage=36%, E-value=1e-69, Identity=69%"; Hit description =Phosphate transporter 1
MGKEQVEVLNALDAAKTQWYHFTAIIIAGMGFFTDAYDLFCISLVTKLLGRIYYHVDGAAKPGPLPPNVSAAVNGVAFVGTLSGQLFFGWLGDKMGRKKVYGMTLVLMITIMSEYSNKKTCGAFIAAVFAMQGFGILAGGVFPIIIASLFKAKFDAPP

SEQ ID NO: 214171 - protein, 53 aa, Glycine max
  Coding DNA Sequence Number=SeqID_97393
MASSFWLIQVRKLLVLVFGSSLAVQIKLARSQWKKRVKLTRLTFSFEVETGYG

SEQ ID NO: 214172 - protein, 302 aa, Glycine max
  Coding DNA Sequence Number=SeqID_97394
  Gene Ontology: Mol. function=RNA-directed DNA polymerase activity; Cellular component=intracellular; Biological process=RNA-dependent DNA replication
MLSWKMLPEEIVLAFVTPGKLVRNWDAVDIPSVVHASKTKAQLCRAVLFQALLLLMENVVYPDIYAYCSFWKMSALFTHFLNQSSIICRLGIYEPVEHNNPALSPNYESPVYEAEEEEDDEIPEELARLLEYEKKTIQPHEELVEVINLGTEEDKKEVKIGASLEAAVKRKVIELLKEYADVFAWSYQDMPGLDPRIVEHRLPLKPECPPVKQKLRRTRPDMALKIKEEVQKQIDAGFLVTSEYPQWLANIVPVPKRDGKVRMCVDYRDLNKASPKDDFPLPHIDVLVDSAAKSKVPLTKEA

SEQ ID NO: 214173 - protein, 93 aa, Glycine max
  Coding DNA Sequence Number=SeqID_97395
MSLECYELRFQYEHLVILHDSIGHPRKRLSSLEFAQSLRFQRRVSQYITGFIRTSEKKFCRGIVLRASVSIKSVSVYYGINRHPIKVIVIEFA

SEQ ID NO: 214174 - protein, 202 aa, Glycine max
  Coding DNA Sequence Number=SeqID_97396
  Gene Ontology: Mol. function=RNA-directed DNA polymerase activity; Biological process=RNA-dependent DNA replication
MVIPKFKVPNFDKYKGTTCPENHLKMYCRKMRAYAKDGKLLIHFFQESLTGAVITWYTNLEPSRVHSWKDLMVAIVRQYQYNSDIAPDRMQLQSICKRGHESFKEYTQRWRDLAAQVVPSMTEKEMITMIVDTLQVFYYEKWANEEGENEGETHVVTAIPIRPSFPPTQQCHYSVNNNPSPYPPHSYRQRLSLNQPQNPPTT

SEQ ID NO: 214175 - protein, 64 aa, Glycine max
  Coding DNA Sequence Number=SeqID_97397
MAFILQYAGVYQFCIHSLHSRMDNKYCLGDLYSLDSDFSTALVISTPWILISQILPIVSTFHWP

SEQ ID NO: 214176 - protein, 82 aa, Glycine max
  Coding DNA Sequence Number=SeqID_97398
MSLPTVVHVSSIFEFGAMLHDCLSVDTQVQSSIHHFFRSPMKKNCLALFMCPPPSSLELCFMIAYVWTLKCNPPFSTFFGAP

SEQ ID NO: 214177 - protein, 91 aa, Glycine max; identical to SEQ ID NO: 128676
  Coding DNA Sequence Number=SeqID_97399

SEQ ID NO: 214178 - protein, 132 aa, Glycine max
  Coding DNA Sequence Number=SeqID_97400
  Gene Ontology: Mol. function=DNA binding; Biological process=DNA integration
  Homolog annotation: Hit_ID=Q1SXQ3; Match level="QueryCoverage=51%, HitCoverage=9%, E-value=3e-15, Identity=51%"; Hit description =Integrase, catalytic region
GYIYLVVQREQGRVHPLWIFACKGFYKVIGNLKNRGLLGDWTPLDPTKLSSFLLKNGFEQGKTEFKMSMMRKLKFFLGLQIRQTSQGYIHQTKYVKELLKKFNLSGTKEMQTPMHFIPWVGRGINEGGQDSI

SEQ ID NO: 214179 - protein, 70 aa, Glycine max
  Coding DNA Sequence Number=SeqID_97401
MNSTSFQGLENQKTSESFWYKEEEEVQRDSRLVKDWDGLRLRVHPEAMGHATLPPLSCYSCLNMRPPSAR

SEQ ID NO: 214180 - protein, 107 aa, Glycine max
  Coding DNA Sequence Number=SeqID_97402
  Gene Ontology: Mol. function=transition metal ion binding; Biological process=cytoskeleton organization and biogenesis
  Pfam annotation: Domain name=Transposase_21; Domain location=1-91; Score=-102.0; E_value=6.7e-06; Accession=PF02992.5; Description =Transposase family tnp2
MLFCTINYFPAYGNLSGYSVKGGACPICEEDTSYAQLKHGRKTIYTRHRCFLTPYHPYQRLEKAFNGSKEHESAHILLTSQHVFQRVEHLNTIFGKTQKKDKKKNAP

SEQ ID NO: 214181 - protein, 249 aa, Glycine max
  Coding DNA Sequence Number=SeqID_97403
  Subcellular localization annotation: CTP_CleavageSite=92; ConfidenceScore=5.03e-01
MTLAQVWSVLSYSNLARTSHTLNLTVDRARLIFGLVTQLDMNVGALISWQITSMAQSNSLRLGFPALITTLCWTREVASNSLVFERLSPVINLAYIRKNSWNPDDPTIIIRGARRPRARPAKAPSTAIAPHLASTSTAPPPARIAASHSTPSPEDFQCFEAMLRSIHQGQIILLQTWPGTQPPPHRDDKNPATQVPHQPADESSESSTPKPLIRKRRVVVTQEATTTPEKSPKATPEPPAPMADTTSPQ

SEQ ID NO: 214182 - protein, 198 aa, Glycine max
  Coding DNA Sequence Number=SeqID_97404
YPHQGNKNPCEGDILPRRRHAIGQGKSPSERKVAKPKAQSMKNKPPTRREKQHQQRKRVMQKLRGMFQMLEENHKMDRTNVASPPRLNLFIEMLGDKKELELSDDDTLIPITVVGILTMEFANQDRLTDTLEGDVLDDEVEWASLAKDLNVEKGVSKLYKAQEDDKAVASGGSNPARLGELSSPGRAGRQPPPLSCYK

SEQ ID NO: 214183 - protein, 68 aa, Glycine max
  Coding DNA Sequence Number=SeqID_97405
PDGCRETRGTGTREAARKPRRKGDLPFGERATRGLRVRLPWEENAWSRHQRLFEENVRKTGKGVVYEL

SEQ ID NO: 214184 - protein, 132 aa, Glycine max
  Coding DNA Sequence Number=SeqID_97406
  Subcellular localization annotation: CTP_CleavageSite=64; ConfidenceScore=5.33e-01
MKVRGKRSEAPSTSASEAPAPSSSTVPPSSSTQIPVIPSAPLHIPLLAPLSAGLEDFIFTPQMLHSMLQSIHRGQSIIMQSLQGLSLPSIMSMEEFETQVVWPGDQPSSFGRGGASAAQELDIEEPPAPAED

SEQ ID NO: 214185 - protein, 65 aa, Glycine max
  Coding DNA Sequence Number=SeqID_97407
EAGCLSEIEEECFLKQLDENKKGFSISPAPPLLASSYVQFRAEFDLVMYVLVLDHSNHDKLEWAK

SEQ ID NO: 214186 - protein, 110 aa, Glycine max
  Coding DNA Sequence Number=SeqID_97408
MNCVFVHGSSTHDFGAMHSDCLVQFSIINPFSEPMNCVFIHASSTFEFGAMRSDCLVQFSILNPFSEPMNCVFVHASSTFKFGAMRSDCLVQFSILNPFLETHKNCVFVH

SEQ ID NO: 214187 - protein, 88 aa, Glycine max
  Coding DNA Sequence Number=SeqID_97409
MKVKHMRYTTNTLDSSLHGMWYHFSMKNLVGHLGVHDRTCLTMGRLVRVTLFCENAPTMWDRHKLTGALKPDDPQGLHSEESIWASPS

SEQ ID NO: 214188 - protein, 86 aa, Glycine max
  Coding DNA Sequence Number=SeqID_97410
MSTFFMWSLLITGGFIELSGVADSDDEGSTDLRTNHLQERGDDAILPRRGPITRAMARRLQEYWGRDAREDPRVLMRLRVDFGLIG

SEQ ID NO: 214189 - protein, 198 aa, Glycine max
  Coding DNA Sequence Number=SeqID_97411
  Gene Ontology: Mol. function=hydrolase activity; Cellular component =intracellular; Biological process=regulation of transcription, DNA -dependent
  Homolog annotation: Hit_ID=Q0K0G2; Match level="QueryCoverage=77%, HitCoverage=53%, E-value=6e-65, Identity=78%"; Hit description =Putative extracytoplasmic hydrolase precursor
MVISQAGDEPEVKGLVYIAARAPEAGEDYPALTKKFPAAPVAAGLKWRDDGFGALSEQAFIHDFAGDLPESEARAYYAVQQPMGKAITQAKTSVAAWHSKPSWYAVSTEDHTINPDLQRFMAKRMHAQTIELKASHVSLISQPQAVANLIMKAAHVPGAGRNAARYRDSAYPAAASPGGKQDFPDVPPPPDNPRQSAR

SEQ ID NO: 214190 - protein, 309 aa, Glycine max
  Coding DNA Sequence Number=SeqID_97412
  Gene Ontology: Mol. function=adenosylmethionine-8-amino-7 -oxononanoate transaminase activity; Biological process=biotin biosynthetic process
  Homolog annotation: Hit_ID=Q8U8T8; Match level="QueryCoverage=61%, HitCoverage=49%, E-value=1e-65, Identity=60%"; Hit description =Adenosylmethionine-8-amino-7-oxononanoate aminotransferase
DQEMLGDRFSSSRPQHQRIYQQGSNITVATVSFQRIECFLFSARWKRDGIDLEQEGLISRVEHPARAGGHGADRIAVIAILHHHDARARLVSVIIIAKRHLDRHLDRSGTTVGIEHMRKVRRCELDQFFRQPFCRFMGELGKDDLVELFRCMPDRRHDFRMSVPIGAVGFDDLAESRFCGVLRKWMPDGERMPGVASGQSARAAKLKDNFFGVGLSVTDKGDAKHGYIAPVQGLERKQCMIDGAEAGSRTEDDRLLPARKNIDKCCAARQGHMQSSSTFDHQWSIDCRYFQRFRIDINPVDPCRKMWRS

SEQ ID NO: 214191 - protein, 53 aa, Glycine max
  Coding DNA Sequence Number=SeqID_97413
MTNANCPQESMHSVSNGNLRFDTAQTLVSRFLQVSSFFEDEGESPVESLMKNK

SEQ ID NO: 214192 - protein, 181 aa, Glycine max
  Coding DNA Sequence Number=SeqID_97414
  Gene Ontology: Mol. function=chitin binding; Cellular component =extracellular region; Biological process=chitin metabolic process
  Homolog annotation: Hit_ID=UPI000044A8F0; Match level="QueryCoverage =98%, HitCoverage=99%, E-value=4e-24, Identity=27%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MKGLHVLTFRGIHVLAIRGLHAYTFRGLHVLAIRGLHALTFRGLHFLAIRGLHALTFKGLHFLPIKGLQALTFRGLHVLAIRRLHALTFRRQHFLAIRGMHALTFRGLHVLAIRGLHDLTIRGLHVLAIRGSHALTFRGLHVLTIRELHVFTIRWLHVHATRGLHTLNFRGLEILAFREPH

SEQ ID NO: 214193 - protein, 100 aa, Glycine max
  Coding DNA Sequence Number=SeqID_97415
MASYGEDPRPTSSTWSYITHLLLEVASPIIFLLLHSAAIKLLEAKDSIDEEDPRPTSSTWSYINTQRPTWSSASFVEDVTSIDEDYFSLFFSSSRDNQVR

SEQ ID NO: 214194 - protein, 61 aa, Glycine max
  Coding DNA Sequence Number=SeqID_97416
MWVQAIGLFAQATCAPEFGLPRPFNQRLLVLHVGGAAVKQQVCLLERSELSRIGCWTNGLS

SEQ ID NO: 214195 - protein, 49 aa, Glycine max
  Coding DNA Sequence Number=SeqID_97417
MAKEFNILSVTKEDGPSRSDDQFEGPTTQSNPPQRLRQGLKTEEAKYEQ

SEQ ID NO: 214196 - protein, 73 aa, Glycine max
  Coding DNA Sequence Number=SeqID_97418
MDVYASIRFMLVWVIAMRFPNIMLMAEAEAATFEVTERKATTGVGESESKRGFLTSFSHSKPCMRLSSRTAPK

SEQ ID NO: 214197 - protein, 96 aa, Glycine max
  Coding DNA Sequence Number=SeqID_97419
MGLRKTVRKGNCTKQSLCMAPNSKIENGELHYAITTHGSKLEGGGHMNENTIHGASKKGGGHMNENAIRGAPKRMRMENCTKQSLRIAPNSKVEDT

SEQ ID NO: 214198 - protein, 211 aa, Glycine max
  Coding DNA Sequence Number=SeqID_97420
  Gene Ontology: Mol. function=nucleoside-triphosphatase activity; Cellular component=membrane; Biological process=ion transport
  Homolog annotation: Hit_ID=Q217E6; Match level="QueryCoverage=64%, HitCoverage=57%, E-value=4e-19, Identity=41%"; Hit description=ABC transporter related
  Subcellular localization annotation: CTP_CleavageSite=41; ConfidenceScore=5.04e-01
RRRQEQPVAPGRRLGAAQRRLLAQRFSPRRADVPGAAAAALASRVGQRGVATACCRPCARQGAGAGGAMAGPGGAGRGDAVVAGRVVGRHGAACRPGPRVGAGTRPADAGRTLQRARSGAAPPAGRQLPRGIGPQRRGLAVHQPRPRGIAGPGRPLRAGAARERHCHRAGRHWRLVGRAPARPVAGGRRRAVTRPLPGFPPFRFPRSPAPP

SEQ ID NO: 214199 - protein, 57 aa, Glycine max
  Coding DNA Sequence Number=SeqID_97421
MEDAPVSLASLARKRKKPFTTGETCPGELELAQASCLLKAEGISSPKQVAFLGLKAS

SEQ ID NO: 214200 - protein, 127 aa, Glycine max
  Coding DNA Sequence Number=SeqID_97422
  Gene Ontology: Mol. function=nucleoside-triphosphatase activity
  Homolog annotation: Hit_ID=Q1SFG1; Match level="QueryCoverage=94%, HitCoverage=40%, E-value=6e-27, Identity=72%"; Hit description=AAA ATPase
MEKSLLIVEEANLSSRSFSGRVSDDKANRSGRKGMVLPFQPLSLTFDEIKYSLDMPHEMKKQGVFEERRELLKGVSGVFRPRVLTALMGAIQGVPKIKEGYNPATCMLEVTSAGIEASLKIFQTKGY

SEQ ID NO: 214201 - protein, 53 aa, Glycine max
  Coding DNA Sequence Number=SeqID_97423
MAYAFSHQMNLVISNLKELPTVHPKIRLSCPLLLEWLVSLVPTPWERYLGPLD

SEQ ID NO: 214202 - protein, 205 aa, Glycine max
  Coding DNA Sequence Number=SeqID_97424
MRSDCLVQFSILNFYSEPQELIVLHASSTNESGAMRKYCLVKFSVLHFYSEPHELIVVHGSSTNESGTTRSDCLVQFSMLHFYSEPHDVIVVHASSTNESGAMRSDCLVQFSILNFYSEPHELIVVHGSSTNESGATRSDCLVQFSILHFYSEPNELIVVHASSTNESGSMRSDCLVKFSMLHFYSEPHELIVVHASSTNESGAT

SEQ ID NO: 214203 - protein, 314 aa, Glycine max
  Coding DNA Sequence Number=SeqID_97425
  Gene Ontology: Mol. function=RNA-directed DNA polymerase activity; Biological process=RNA-dependent DNA replication
MELYDNSSNSNDHLSMLSYKGAYASIVCLRNQQGGAKDRGQSKRGLLARDSVKEGSFFFISILKMPPNTLEEFFKKAEKYINYENVLEARKMKMVGQITTNLSMIDQLAINNRKGQEVLTDTKERDVLGVFSEVIYVIARGSTSRGPLNIAQKRHAREVLTNTLGRRNYESAKRRPPPLTFNDKDMDMSIFPNHDYPLLVKAFINNKQVHWLLVDIGSTADIMFYDFFKNLRILQSELLPYKEDLIGFSSHHITPLGKVKFHITFGKARDQNHHHQVHCGNATIILQHHTGQTNLECPESCDFDSSLGHEVPHQ

SEQ ID NO: 214204 - protein, 69 aa, Glycine max
  Coding DNA Sequence Number=SeqID_97426
MTVASVARIGRSSSTRGRRLGEVDEAPLSVALQQIRVARQRVRCVWWWKSAGLGIGTFGCLGMLRDGKS

SEQ ID NO: 214205 - protein, 33 aa, Glycine max
  Coding DNA Sequence Number=SeqID_97427
MVGAGSMIYFTGKVSGSRPGWPSCVKEKNRKLT

SEQ ID NO: 214206 - protein, 388 aa, Glycine max
  Coding DNA Sequence Number=SeqID_97428
  Gene Ontology: Mol. function=protein serine/threonine kinase activity; Cellular component=integral to membrane; Biological process=protein amino acid phosphorylation
  Homolog annotation: Hit_ID=Q2HV99; Match level="QueryCoverage=89%, HitCoverage=46%, E-value=1e-119, Identity=63%"; Hit description =Protein kinase; Type I EGF
  Pfam annotation: Domain name=Pkinase; Domain location=56-339; Score =154.4; E_value=3e-43; Accession=PF00069.15; Description=Protein kinase domain
  Pfam annotation: Domain name=Pkinase_Tyr; Domain location=56-327; Score=140.2; E_value=5.5e-39; Accession=PF07714.7; Description =Protein tyrosine kinase
  Pfam module annotation: Pfam domain module=Pkinase::Pkinase_Tyr; Domain location=56-339::56-327
MTYLIYQKRKLAKLKEKFFQQNGGLILLRKLSRREDTSQTTQVFKEEQLKKATNNFDESSIIGKGGYGTVFKGFLADRNRTVAIKKSRIIDESQKEQFINEVIVLSQINHRNVVKLLGCCLETEIPLLVYEFVQNGTLYEFIHTERMVNNGTWKTRLRIAAEAAGALWYLHSAASIAIIHRDVKTANILLDDTYTAKVSDFGASRLVPLDQTELATMVQGTFGYLDPEYMLTSQLTEKSDVYSFGVVLVELLTGEKPLSFSRPEEERSLANHFLSCLKEDRLIDVLQFGLLNEENKKEIMEVTVLAANCLRLNGEERPSMKEVAMELEAIRQMEKHPWINREKNLEETQYLLHDAPSKIYEHRDSSSLQYNGYDSIRDHVLIALDNGR

SEQ ID NO: 214207 - protein, 906 aa, Glycine max
  Coding DNA Sequence Number=SeqID_97429
  Gene Ontology: Mol. function=DNA binding; Cellular component=beta -galactosidase complex; Biological process=DNA integration
  Homolog annotation: Hit_ID=Q1SLU3; Match level="QueryCoverage=99%, HitCoverage=90%, E-value=1e-142, Identity=42%"; Hit description =Integrase, catalytic region
  Pfam annotation: Domain name=zf-CCHC; Domain location=238-255; Score =12.0; E_value=0.01; Accession=PF00098.13; Description=Zinc knuckle
  Pfam annotation: Domain name=zf-CCHC; Domain location=273-290; Score =11.4; E_value=0.013; Accession=PF00098.13; Description=Zinc knuckle
  Pfam module annotation: Pfam domain module=RVT_2::Retrotrans_gag::zf -CCHC::zf-CCHC; Domain location=508-763::69-184::238-255::273-290
MESYLYLHPSKNPATALISPILDSTNYHSWSRSMVTALSAKNKVEFIDGSAPGPLKIDRMHGAWRRCNNMVVSWIVHSVATSIRQPILWMDKAEEIWRNLKSRYSQGDLLRIFDLQQEASTMKQGSLTVTEYFTRLRVIWDEIENFRPDPICSCNIRCSCNAFTIIAQRKLEDRAMQFLRGLNEQYANIRSHVLLMDPIPAISKIFSYVAQQERQLLGNTGPGINFEPKDISINAAKTVCDFCGRIGHVESACYKKHGVPSNHDARNKSNGRKACTHCGKIGHTVDVCYRKHGYPPGYKPYSGRTTVNNVVAVESKATDDQAQHHESHEFVRFSPEQYKALLALIQEPSAGNTTLTQPRQVASISSCIDNTPTNPGYLVYDLHSNDVTVSRNVTFYEDHFPYYSETQHINSEHSAPSPGPFFGKSLDPQIENRSSQPTISVPSSNEPSNEQPLPHLRRSTKAKNTPTYLQDYHRDLASSTPNTSAVVRYPLSSVLSYSPSRHDCWIKAMKVELQALQTNNTWRLTPLPPHKTTIGCRWIYKIKYRADGSIERHKARLVAKGYTQMEGLDYLDTFSPVAKLTTVRLLLAIVALNQWHLRQLDVNNAFFHGELDEEVYMQIPPGLSVDNPQLVCRLQRSLYGLKQASRQWFMKLSSFLSSHGFQQSNADHSLFLRFIGDITTILLVYVDDIILTGNNIAEIQTMITLLDREFRIKDLEDLKFFLGLEIARTSKGIHLCQRKYTLDILSDSGMLGCKPNSTPMDYSTKLQADSGSLLSAESSSSYRRLIGKLIYLTNTRPDITYVVQQLSQYMATPTNAHLQAAFRILRYLKGTPGSGLFFVAAGTPQLRAFSDSDWAGCKDSRKSTTGYLVYFGSSVVSWQSKKQSTVSRSSSKAEYRALASTTCELQ

SEQ ID NO: 214208 - protein, 87 aa, Glycine max
  Coding DNA Sequence Number=SeqID_97430
MKRKGCPALKGLPLIVGSRMRRSFLCTGSKTIIETRPMPNMSLIMICQRKKRDARTRFLHFGRDGVGLFQEGLVTFSVYMGWIVVDG

SEQ ID NO: 214209 - protein, 70 aa, Glycine max
  Coding DNA Sequence Number=SeqID_97431
MVKLESLRPTMSKMWVRRRAKSPQPRVGGCRWWLTVKRPIGWMSGRTPREVKVFASLIEIIESNNVEGCA

SEQ ID NO: 214210 - protein, 585 aa, Glycine max
  Coding DNA Sequence Number=SeqID_97432
  Gene Ontology: Mol. function=protein serine/threonine kinase activity; Cellular component=integral to membrane; Biological process=protein amino acid phosphorylation
  Homolog annotation: Hit_ID=Q2HV99; Match level="QueryCoverage=99%, HitCoverage=79%, E-value=1e-146, Identity=48%"; Hit description =Protein kinase; Type I EGF
  Pfam annotation: Domain name=EGF_CA; Domain location=141-183; Score =36.4; E_value=9.6e-08; Accession=PF07645.6; Description=Calcium binding EGF domain
  Pfam annotation: Domain name=Pkinase; Domain location=262-538; Score =168.5; E_value=1.7e-47; Accession=PF00069.15; Description=Protein kinase domain
  Pfam annotation: Domain name=Pkinase_Tyr; Domain location=262-532; Score=133.6; E_value=5.4e-37; Accession=PF07714.7; Description =Protein tyrosine kinase
  Pfam module annotation: Pfam domain module=EGF_CA::Pkinase::Pkinase _Tyr; Domain location=141-183::262-538::262-532
MGCLTRCDSRESVRNMQRDGKCTGIGCCQIDIPPGMKNISLQTFTYNNFNSSSDFNKCSYSFVVKNGNYTFSMDHLKGLPFNKAPFVVDWTVGNQTCGISKGKLDYACRNNSDCVDSGYGYRCKCKEGFEGNPYHPDGCKDVDECKIGNHACISEKNCLNTNGSYICFCPKGQSGNGTKGEGCHQQDVVTKVVIGVAAGIVILFVGTTSLYLTYQKRKLIKLREKYFQQNGGSILLQKLSTRENSQIQIFTKQELKKATNNFDESLIIGKGGFGTVFKGHLADNRIVAIKKSKIVDKSQNEQFVNEVIVLSQINHRNVVKLLGCCLETEVPLLVYEFVNNGTLFDFIHTERKVNDATWKTRVRIAAEAAGALAYLHSEASIPIIHRDVKTANVLLDDTYTAKVSDFGASKLVPLDQTELATIVQGTIGYLDPEYMQTSQLTEKSDVYSFGAVLVELLTGEKPYSFGRPEEKRSLANHFLSCLKEDCLFDVLQDGILNEENEKEIKKVAFLAAKCLRVKGEERPSMKEVAMELEMHQWINTDANLKESDYLVHKVSSIVSEPGDSSSHQEYDSIRDQVLPSLGDGR

SEQ ID NO: 214211 - protein, 390 aa, Glycine max
  Coding DNA Sequence Number=SeqID_97433
MPKGHGNCGYKVWEDELLHIRTNDQDDHDFDEGVNLAVNHSKKMRIMDSSEEDPTPMAVSEAELSQSEDEALEKASQLSCLSESTPSRIGGDRQHVFPRHIFAGAGAGAGADPSFAPLGRLGRLLFSPPQSLKSPSSQTPQSIFCCVFPSFNPIDVPKQPSITNVPCAEHNQLDVIRLSQQSQLSSSERKLMSRAQRQRQLAFAAQKQLLNDLETSKPHEHESMKEAAQDTFAILDNLGANDTQFFEHVLYFIKLTSSVVQMTKSIECLEEDNKRLEDENAKLAHIRDLYAKTEDQFQASDQRRQLLSKEISDFEAMLVEKRNQLKSCELETSNMRIELGGLRRTMLEADTALKARMKQAEIAGKLRKEREAKQIAAKTALEKARLKSEY

SEQ ID NO: 214212 - protein, 111 aa, Glycine max
  Coding DNA Sequence Number=SeqID_97434
  Gene Ontology: Cellular component=membrane
  Homolog annotation: Hit_ID=Q5VRN3; Match level="QueryCoverage=53%, HitCoverage=16%, E-value=3e-10, Identity=51%"; Hit description =Putative MtN21
MRSTCDEWKPFLVMIAIDFSFAAVNILLKKVLEEGMNHLVFITYRLSIATIFIAPIGYFRDRSGDSTARIWKIVDGACDSSVQNEPVNVVHVVVLQHFKESTNEKSKEPIY

SEQ ID NO: 214213 - protein, 203 aa, Glycine max
  Coding DNA Sequence Number=SeqID_97435
  Gene Ontology: Mol. function=drug transporter activity; Cellular component=membrane; Biological process=response to nematode
  Homolog annotation: Hit_ID=Q6K702; Match level="QueryCoverage=59%, HitCoverage=21%, E-value=9e-38, Identity=62%"; Hit description=MATE efflux protein-like
  Pfam annotation: Domain name=MatE; Domain location=1-113; Score=12.8; E_value=0.00038; Accession=PF01554.9; Description=MatE
MGSALETLCGQAYGAGQVHMLGVYMQRSWVIVNATAILLSLLYIFAGPMLRAIRQTEAISAAGGEFAVWMIPQLFAYAVNYPAQKFLQAQSRIMVMAWIAAAALVLHTLFSWLLILEFWWGLKTTQVRHQSLKMRGQRVFLLSPALTMTAMKSQDRRKTGFDMLEIALVALQDITPWKRFFMTMERKLGSKFPQIMPVRNLQK

SEQ ID NO: 214214 - protein, 62 aa, Glycine max
  Coding DNA Sequence Number=SeqID_97436
MVRAKEETREKVEEKEREIEEMRQRIEDVEKVRVVEMKEKGESGWFHLSSKGLQCPIDVLPM

SEQ ID NO: 214215 - protein, 215 aa, Glycine max
  Coding DNA Sequence Number=SeqID_97437
  Gene Ontology: Mol. function=protein kinase activity; Cellular component=integral to membrane; Biological process=protein amino acid phosphorylation
  Homolog annotation: Hit_ID=Q5F1Y5; Match level="QueryCoverage=68%, HitCoverage=19%, E-value=2e-17, Identity=33%"; Hit description =Putative wall-associated kinase 4
MAKGTKPLWVLSNFLICDLPLPMELVMKHLQLRRVLMVALALVVVAVAPHQTLSATTPKQALPGCKSTCGDIEIPYPFGIGNSSTPDHRSCFLEPKFKLTCNNSRLIAGNITVSNISILAHQMDVWFFVAKVCNGTNSTIPWLGTGYFSISSKDNKLLTVGTHSYGYVNSYFNGESYSTGCLTSTHGNTRKIQNGTCSGIGCCQVDIPTGMRNIT

SEQ ID NO: 214216 - protein, 486 aa, Glycine max
  Coding DNA Sequence Number=SeqID_97438
  Subcellular localization annotation: CTP_CleavageSite=7; ConfidenceScore=5.10e-01
MAGTTMPAPSKGYASNTSNFLIFLFVPPPFKYPHCACSAGVCKRVKGTYSKYYFICPIKQGQGSCGYIVSEDDVKLLSRKSTVPVQQSRQRTHDDFWEGCLNDEMGDELGKGDGLHVQIKRMRIADSPASPFPVNLSETLGKKDAGAALNAANSKRDGFPDLVFDDDDDLEFANSVSWETVEAEAFLLLSCLSTPSRICWRQIMFQRRIFSNVDSVSLIITGVFPSYNPIIVPKKTSIPDCPVECNQLAISRVSQHTQLSTVKTEVSGDVVSPSKSPDGKRKSILSKAQRHREVVLFTQQRLLIDLETLAPHEHESMREAAKNTFELLNVIGVDYKQFSDNVLDYINFVSSIAEIDRSMENSLTMEERIKLFEEEKMRFVQLQDDYVKTKALLEASYRHRQLLCEQVSNLKAMLNEKQKQLKHRELETLKIETHLRDLKRNILETDATLKERAEQTEVARKHSEERQAKQIAAKEALAKAKLELEN

SEQ ID NO: 214217 - protein, 63 aa, Glycine max
  Coding DNA Sequence Number=SeqID_97439
MALTKQYGSQFRFQRNKKVGAIQQQPILATFDPLNDLGKTGGVEPKTQVVSWKLSCRETQGRH

SEQ ID NO: 214218 - protein, 250 aa, Glycine max
  Coding DNA Sequence Number=SeqID_97440
  Gene Ontology: Mol. function=RNA-directed DNA polymerase activity; Cellular component=chromatin; Biological process=chromatin assembly or disassembly
MEPWASLSEEAISLVAEDIPDPGQSSKEESVREEEAKHAEHFHLSSAAFHGQPSPCTLYVAGKVKELNVNILIDSSSSHNILQPQVVEFLGLPLVAIKSFSIIVGHGNTIQCFRCCPDVPVIMAGQFAPIFAMPHGLPLDRTQNHNIDLLPHSQLVNIKLYRCPQYQHTIMTRLIAEMLQDVKDRFSIPMDKLLDELHGFMIYSKLNLRSGYYQVLLNPDDSLKTAFHIIDCHFEFLVMPFGLTNDPSTF

SEQ ID NO: 214219 - protein, 156 aa, Glycine max
  Coding DNA Sequence Number=SeqID_97441
MGFSVEGKEHMENTVDRYMYLKVSGSKVIFPILYVDYILLATNDLGLLHETKKFLSSNFEMKDMVMSYVTNLQPTTWSLCRHVGLMADVALVDEMELATFREQVQLVTMNSVFASRNIPVRATKAMLAPFDGSNPLEWIFQAESYFELNQVAIPQH

SEQ ID NO: 214220 - protein, 1554 aa, Glycine max
  Coding DNA Sequence Number=SeqID_97442
  Gene Ontology: Mol. function=RNA-directed DNA polymerase activity; Biological process=RNA-dependent DNA replication
  Pfam annotation: Domain name=RRM_1; Domain location=29-99; Score =41.4; E_value=3.2e-09; Accession=PF00076.12; Description=RNA recognition motif. (a.k.a. RRM, R
  Pfam module annotation: Pfam domain module=RRM_1::RVT_1; Domain location=29-99::851-1089
MSGERNSKNGHQHSYTRANWRDQKDVTSFYFTRFPEDATKKDLWHHFKQAGDVREIFISRKRNKNGRKYGFVRFKGVEEVHKLERKLDNIIFGGLKMYVNIPKFGRAKSGKSQTTTRGREYVEQNEEEIRGAYPRMKPGVSAEDDILWNIGANISKYIGDDMVLLLGLIDDKTWQMMDEEDKGGVSLFHSLETRNLRMRSGYRLTWVHCWGIPLIAWDTQQIKKIMANISDMVDVDDDVEELRKLDMAQILIKTPWKPLLQHTESGSPFNTCQCRRRTEFNSSEEIQSEDSDAGTPRRVSSLTRQNEHGVQDMAASIGNPTSSSGTTDNNRAPGMEDNDCVTLTTGRNNKATLAEALMSCCGVTDAQEGTMHENAGAQNKGNRTPIGRRENLHERGNIEVEGDVGALGKKTFDLKKSHDQGDEDIMGLGFANYTLSKTSFQHIDSPPKPEVAPNNSYAATVQDEATPHPHLQEIVRKTTNDQEKIIICHDHTSTQAVLEEAKPTNNHIQEAKNLWKGGQMASNQKDGQQTTHKHVVYPGNKKGGGILCIWSEKTFKVERKVIGIGFIMLVGKWLQEAQPVHIINIYSPCDIQSKRVLWDRVKQLKNVNPGGLWCILGDFNNIRTHAERLGACQKGLVDGSIMEFNEWIVELEVEEAPWMGRKFSWFRPNGAARSKLDSFLCVDWGPKPFRILDFWLSDNSFKNTVHECWTSYQHNGWGAEQFGDTFKKYKKIEEDLNKLEEDTIDRHLVPHELVSRKQLQEDLWRFQEYDYDRPRLDGICFQTIGSQQNDMLVERFQEDEVRRVVWNCKSDESLGPDGLNFKFIKQFWHIIKPNLLRFLDEFYVNGIFPRGSNASFIALIPKVVDPQLLNDYRPISLIGCIYKIMAKVLANRLKKVMPLIIHKRQSAFIEGRHMLHSVLIGNEVVEEAKRCQKPCIVFKVDYQKAVPKINTVLVNSSPSSEFLPQKRLRQWDPLSSLFFNIAAEALNGLMSQAMGKRLFRGFLVGINMVEISILQYVNDTISFGEASMENVKAIKAILRTFELVSGLKINFAKSSFSAFGVSDQWKLDAANYLNCSLMFFPFVYLGVPIGANPRRYQTWDPIISKCERKLAKWKQRHLSFEGRVTLTQSVLTSIPIYFFSFFRVPKKVVDKLVNLQRSFLWDGGYEQNKIAWIKWDTVCLPKENGGLGIKDINTFNLALMGKWKWNLFQHQGELWARVLESKYGGWRSLNEAPRDNSESIWWRDLKLMTQHPQHSETMQNSTLWKVGSDDKFKFWEDNWIGGKGSLLAKYPRLYSISSQQNQLIQQMGAYKDTGWEWDFRWKRSLFDSEIDMEVSFLKDVEGIRIQPQASDEWVWAVDPCGQYSAKSAYNVLREETSKEIHKEALEDLWKLKVLTKISAFAWRLLKDRLPTKVNLRRRHIDLDDTTCPFCRSIEESASHLFFHCSKILPVWWESLSWVKLVGVFPHNPKQHFLRHIYGVTEGIRANRWKWWWLALTWTIWKQRNYIIFSNDTFNANKMLDDALFLLWTWLRNLEKDFGTHYNHWSSNLSAGFLK

SEQ ID NO: 214221 - protein, 137 aa, Glycine max
  Coding DNA Sequence Number=SeqID_97443
MCPPRSDTRCWIDKYGLFLINNNHKLLTTNESYVLVIQAQQVYYVKDIKDPDWLVVEKTKPRDLYDVLEKATLEAYNDRGLYLDRNDLVRPIIDGKLMIYSGVVDREEEESDDEIIDLTKDEESNYIDKANNNDDDY

SEQ ID NO: 214222 - protein, 162 aa, Glycine max
  Coding DNA Sequence Number=SeqID_97444
  Gene Ontology: Mol. function=adenosylhomocysteinase activity; Biological process=one-carbon compound metabolic process
  Homolog annotation: Hit_ID=Q9SWF5; Match level="QueryCoverage=41%, HitCoverage=15%, E-value=4e-22, Identity=70%"; Hit description =Adenosylhomocysteinase
MVYGTGSGIPDIRRIRGWDNKLKPVKYRLIGLDAFVNEEGSVTTVIDDEGTLGAPPVLLEGLPLPGKDDNTVTSSSGDVVVLGGEDVAGAPTDFGLGKVIDLVLETTCVVFSTNKAMVYALRKKERKKERKKESGVVRKGSGVVEDEDETKTTECDILSEAS

SEQ ID NO: 214223 - protein, 234 aa, Glycine max
  Coding DNA Sequence Number=SeqID_97445
MEILPLYKKIVGLQGCVYKIDSLYGGSLKLEDRDFPSYLSSLSERLSTWIDSFYSGSLKLEDRDFPSNLSSLSERLSTWIESPYGGSLKLEDRDFSSYLSSLSERLTQRDSILGLTHSTVAHSSLRIETSQAIYLLSQKGSLLGLSHPMVAHSSLRIETSQAIYLLSQRGLLKLEDRNFSSYLSSLSERLSTWIDSLYGGSLKLEDKDFPSYLSSLSERLFLTLRNGFTLVLDG

SEQ ID NO: 214224 - protein, 123 aa, Glycine max
  Coding DNA Sequence Number=SeqID_97446
  Subcellular localization annotation: CTP_CleavageSite=64; ConfidenceScore=5.09e-01
MNLTLDTTVGKNSMGGNTGEIPNVGLHLTLVIQHISPSSVSLFHMVASPFERKSSSTTTCGTCTAAPSAGHAAWTHHQEDFRYKGSPRLRSITAILLVRAGHQVEPSGSDTTVGKNSMGGNIG

SEQ ID NO: 214225 - protein, 216 aa, Glycine max
  Coding DNA Sequence Number=SeqID_97447
  Subcellular localization annotation: CTP_CleavageSite=65; ConfidenceScore=5.47e-01
YLALDGIYRPIGAAFPNNPTRRQRLVVRQGPGKTGLSPFLAPPSRGLGPGQPLRTLLQNTIRMPRATDFHGGLFPRVAPRDLRSLWERACTQRVVDGSRTDRLSRDWSRAWLIHHFITAKSPMNPDFNQPRGGCSREVSIHPAQQHCYMFALGKRCVTPRQACPRPNGFGRNLRSKTRWFTEILQFTPSIAFRYVLHRCKSRDIRCRESLYVNVVS

SEQ ID NO: 214226 - protein, 222 aa, Glycine max
  Coding DNA Sequence Number=SeqID_97448
  Gene Ontology: Mol. function=DNA binding; Biological process =regulation of transcription, DNA-dependent
  Homolog annotation: Hit_ID=Q1S9D7; Match level="QueryCoverage=54%, HitCoverage=36%, E-value=6e-41, Identity=65%"; Hit description =Transcriptional factor B3; Cupredoxin
  Pfam annotation: Domain name=B3; Domain location=59-154; Score=73.9; E_value=5.1e-19; Accession=PF02362.12; Description=B3 DNA binding domain
MKKLHVVYLDGKPLLLRKLLLFLVSPSTNLECTPLSRTVLLSSRMASTFPHQLQVKPIHFFKIITAQNLQDGKLMIPNKYVDKYGEGLPNSLFLKTPNGTEWNFNLKKRDGKIWFQKGWKEFAEYHSLAHGHLLVFRRHRTSHFQVHIFDLSALEIHYPSKGREEKSKVVVANQIIALDLKSSLKPCNPFFLVVMHPSYIHSNGSPQISRKERFGLLFVELT

SEQ ID NO: 214227 - protein, 228 aa, Glycine max
  Coding DNA Sequence Number=SeqID_97449
  Homolog annotation: Hit_ID=Q1T020; Match level="QueryCoverage=19%, HitCoverage=19%, E-value=1e-14, Identity=82%"; Hit description =Peptidylprolyl isomerase, FKBP-type
MDTPLKQQPSLGENLENFLAPAGVINVGDHQDHNVNVVIGGDTHHQNLMGMDPIVMPSQQEHWLQMQIPAAINIHQHGGVLVPKTYEQMGLWWPQLGSFGVVVLESVSGLKDVDFRQPEVLLVKKVHQFEVTKSPLEALADMGLNGEYNLKELMTLVSLGAEHGREHGEHGRLERNKYLPYEFTVGAPPGKERKLQFVDNPNGLFSAQATPKPPATVYTIPEGMHGSN

SEQ ID NO: 214228 - protein, 84 aa, Glycine max
  Coding DNA Sequence Number=SeqID_97450
  Gene Ontology: Mol. function=transferase activity, transferring groups other than amino-acyl groups; Cellular component=cellular _component; Biological process=flavonoid biosynthetic process
  Homolog annotation: Hit_ID=P51075; Match level="QueryCoverage=69%, HitCoverage=14%, E-value=5e-23, Identity=81%"; Hit description =Chalcone synthase
  Pfam annotation: Domain name=Chal_sti_synt_N; Domain location=2-83; Score=-82.7; E_value=0.03; Accession=PF00195.10; Description =Chalcone and stilbene synthases, N-te
MVTVEEIRNAQRSHGPATILAFGTATPSNCVSQADYPDYYFRITNSEHMTDLKEKFKRMLHQTDQSSPETLVLCYLCAVKILTA

SEQ ID NO: 214229 - protein, 761 aa, Glycine max
  Coding DNA Sequence Number=SeqID_97451
  Gene Ontology: Mol. function=nucleic acid binding; Cellular component= intracellular; Biological process=DNA integration
MAGSLSKIIPDMSKIEPLNGSNYRRWSQKLLILFEALEVDYVLFEDPPADVNASESSTPETPATPDVTPLPAETKKTDEEAKKKYEKDNKTARGHLLTHMADNLFDLFINQKSAKTIWDTLLKRYDDDDAGRKKYVVGNWLRFQMMDDKPIMEQIHEYENLVGDILNEGMKMCHKAYECKLRKGQQSNNSKPAAPHAPQAHLAENEEVIAAVVVEANMVNNKVDWILDTGASKHLCANKELFHQIEDADDGECVFMGNSATAGVLGKGKILLKLTSGKTLSLSDVLYVPSLRRNLISVWGCLAKVALPDFKRTNVVPLHLHTSSSVTNEPRRSKRKRIESSFGPDFVTAFVVENNDVDKINDVFVSTFLIEEDPKTYNEAVTSIDANFWKEAINSELDSIMYNHTWDLVDLPKGSKPIRCKWIFRKKLRTDGTIDKFKARLVVVGYTQKKEIDYFDTYSPVTKISTIRSLVALAAIHGLIVHQMDVKTAFLNGDLREEIYVEQPEGYVIQSQENKVLEKTKLFLSSHFDMKDLGEADVILGVKMRKSDNGFSLCQSHYIEKILKKFNCYDELPVRTPYDPSIHLKKNNGSSVSQTEYAKIIGSVMFLMNCTRPNIAYVVSRLSRYTHNPGGGAISWKSSKQTCIARSTMESEFIALDLAGQEAEWLRNLLADVPLWGKRSIPVSLYCDSEAAIGIAKNSVYNGKRRHIRIRHSSVRELLKNGVISLQFVRSENNLADPFTKGLTKKVVLESSRGMRLKPLC

SEQ ID NO: 214230 - protein, 292 aa, Glycine max
  Coding DNA Sequence Number=SeqID_97452
  Gene Ontology: Mol. function=transcription regulator activity; Cellular component=nucleus; Biological process=regulation of transcription
  Homolog annotation: Hit_ID=Q1SIA6; Match level="QueryCoverage=76%, HitCoverage=86%, E-value=4e-86, Identity=74%"; Hit description=Helix- loop-helix DNA-binding
  Pfam annotation: Domain name=HLH; Domain location=69-118; Score=43.3; E_value=8.3e-10; Accession=PF00010.16; Description=Helix-loop-helix DNA-binding domain
MENYYDSGWHMGTSNWAQCSDHSSSSSFAVPTQQILPHHVTDAASLQFGEFHSWSLPIEGAAEERAISASKSHRQAEKRRRDRINAQLATLRKLIPKSDKMDKAALLGSVIDQVKDLKRKAMDVSRAFTVPTEIDEVSIHHDHVLQDESCTEKVNKLKDNIVIKASVCCDDRPELFPELIQVLKGLRLTAVKADIASVGGRIKSILVLCSKDSESVCLATLKQSLKSAITKIASSSSMASSCPSRKKLQSDFLPMIQSKVHWESKKVKNVAGEKETKRAVEKQLIIALLVNY

SEQ ID NO: 214231 - protein, 111 aa, Glycine max
  Coding DNA Sequence Number=SeqID_97453
MTNANCLQESLHSVSNGNLRFDTAQTLVSRFLQVSSFFEDEGESLVESDETKVQTWSSQHYRNEPVVVVATPRLQKYSSFDDQSGEKPLLLPIRSLKSRLSEEDIDVQSLN

SEQ ID NO: 214232 - protein, 51 aa, Glycine max
  Coding DNA Sequence Number=SeqID_97454
MGALKLRSCLLVALDKPATCGNLNHIRTDGGNRSGQLTGIYDLTYIKSGLY

SEQ ID NO: 214233 - protein, 55 aa, Glycine max
  Coding DNA Sequence Number=SeqID_97455
MEQCSGFADTSFFLGDIMAILDTIMCPVYTRRDSYGNPTLYHWFSYPIVKTFCKY

SEQ ID NO: 214234 - protein, 186 aa, Glycine max
  Coding DNA Sequence Number=SeqID_97456
  Homolog annotation: Hit_ID=Q4VPE9; Match level="QueryCoverage=80%, HitCoverage=87%, E-value=1e-52, Identity=73%"; Hit description =Lateral organ boundaries-like 1
  Pfam annotation: Domain name=DUF260; Domain location=35-113; Score =118.9; E_value=1.4e-32; Accession=PF03195.5; Description=Protein of unknown function DUF260
MKLEDSTGPCRSQTCCYPLVTGTMINPAELIGDDTSDECKKFAKVHKVFGASNVSKILIEVPEEQREDTVNSLAYEAEARLRDPVYGCIGAIALLQRKMVELQHDLVIAKDRLARCHAAATAAATTTTTTSIPSPDILHANVSLPPFPDFYTSSSDFNDIFCHSSSSQLLSRHETVDDFNQIPYIF

SEQ ID NO: 214235 - protein, 583 aa, Glycine max
  Coding DNA Sequence Number=SeqID_97457
  Gene Ontology: Mol. function=protein serine/threonine kinase activity; Biological process=protein amino acid phosphorylation
  Homolog annotation: Hit_ID=Q9FFG4; Match level="QueryCoverage=99%, HitCoverage=98%, E-value=1e-122, Identity=44%"; Hit description =Arabidopsis thaliana genomic DNA, chromosome 5, P1 clone:MOP10
  Pfam annotation: Domain name=Mad3_BUB1_I; Domain location=4-158; Score=126.5; E_value=7.7e-35; Accession=PF08311.2; Description =Mad3BUB1 homology region 1
MANVDELLSSLISDIHTYTGKDPLLPWLRYPSIPSLSLFLCFPLNFSVYSLIIPNFTCSAIRKVKDTLPPKTLKEKLPAFLQKCAHTFELDRRYRNDMRYLRIWLHLMDFVDDPKTLLRTMEVNHIGTKRCEFYQAYALYYEKSKKYDEAEKMYHLGVKKYDIWLRCNPNYVSPFSLNTFTFDWISLAEPVDKLQKSYEQFLQRMERKNNKRIQVHQEAKGARRPLSTKSFPSLDNKTEGSKSNGACCVEGGVQKGPRIDNYAAKGVADDKNVKTKKDERKRFHGDDTVVVKFVDTAMVGKSEAEDACHHGLVDPTINMKEAMNAINSMFREPLETVPLGRKSHKNHPKEDPSTKNEFEVFVDENMDHGIKPSGSLSLQNRTEASQPHPEPLQIYVDDEENSETSDVNVNLFEGSSTSSASQPNGFVFLRPKDIPSEKSSDMDADIGRNSKFREDTVVCRFVGSAILDEPEVENVCHHGLVDPTINLKEAMDDINNMFGKPIDFVRRRRTTTKQEKAPQSNRGNDFGGFSILVDDEHPVQQVPQPPPPKLQEKSKESDLFEPTMLTKEAIDDINKMFNMPLDF

SEQ ID NO: 214236 - protein, 872 aa, Glycine max
  Coding DNA Sequence Number=SeqID_97458
  Gene Ontology: Mol. function=nucleotidyltransferase activity; Biological process=metabolic process
  Homolog annotation: Hit_ID=Q00XF0; Match level="QueryCoverage=75%, HitCoverage=95%, E-value=1e-149, Identity=43%"; Hit description =Homology to unknown gene
  Subcellular localization annotation: CTP_CleavageSite=37; ConfidenceScore=5.77e-01
MVHSTSLLPHNNQTFILSFRSKPSFFHSHSHSLSLPSSSSSSQSSCCHVARISTETLEVSPPPPPPPGFNFRREIARLASLRDRLAACTTLNEKLRVMDADSRVKRFFRSRHGLARVLASLQLSSDQLFLLKCVVAAGQEHVLCLGETESLESSASAAAATMSAVKSALYALAEMIENMDSFNGNGGAGLGMALGDHEIAELTMFLQTLAEIERFYDCIGGIIGYQITVLELAQKSFEMQNISWAHQRHDVKECQILGINAPNGLNLSEDTEYASQAALWGIEGLPDLGEIYPLGGSADRLGLVDPNTGECLPAAMLPYCGRTLLEGLIRDLQAREFLYFKLYGKQCITPVAIMTSSAKNNHKHVTSLCERLSWFGRGRSTFQFFEQPLVPVVGAEECQWLVTKPFSPLSKPGGHGVIWKLAYDKGIFKWFYCQGRKGATVRQVSNVVAATDLTLLALAGIGLRQGKKLGFASCKRISGATEGVNVLMEKKSLDGNWEYGVSCIEYTEFDKFGITTGPLAPKGLSNLECITQISTLFLYSSLQAEFPANTNILYIDLPSAELVGSSKSETSLPGMVLNTRKPIVYTDQFGRHHSVSGGRLECTMQNIADNYSNSYSSRCYNDVEDKLDTFIVYNERRRVTSSAKKKRRHGDKSLHQTPDGALLDILRNAHDLLSQCDIRLPEIEANENYADSGPPFLILVHPALGPLWEVTKQKFYGGSISEGSELQIEVAEFFWRNVQLNGSLIIIAENVMGSMKINENSESILHYGQRCGRCKLQNVKVLNKGIDWTCDENIYWKHDVQRSEVLQIILHGNAEFEATDVVLQGNHVFEVPDGYKLKIMPGSSGLAIQLDPIDQDMMESGSWHWDYKIEGL

SEQ ID NO: 214237 - protein, 45 aa, Glycine max
  Coding DNA Sequence Number=SeqID_97459
MYRGPRGSFGVKGRSKVGPSGQAEGIYTNAPDPIKTPQLSVLGRE

SEQ ID NO: 214238 - protein, 138 aa, Glycine max
  Coding DNA Sequence Number=SeqID_97460
  Gene Ontology: Mol. function=binding; Cellular component=nucleus; Biological process=regulation of transcription
  Homolog annotation: Hit_ID=Q6K2P5; Match level="QueryCoverage=99%, HitCoverage=58%, E-value=3e-38, Identity=41%"; Hit description =Putative pentatricopeptide (PPR) repeat-containing protein
  Pfam annotation: Domain name=PPR; Domain location=1-35; Score=15.3; E_ value=0.12; Accession=PF01535.11; Description=PPR repeat
  Pfam annotation: Domain name=PPR; Domain location=63-97; Score=34.3; E_value=4.2e-07; Accession=PF01535.11; Description=PPR repeat
  Pfam module annotation: Pfam domain module=PPR::PPR; Domain location =1-35::63-97
MSYNVMIPGYAQYKRMDMARELFEAMPFPNIGSWNIMISGYCQNGDVAQARNLFDMMPRRDSVSWAAIIAGYAQNGLYEEAMNRFVEMKRDGESLNRSTFCCALSACADISALELGKQVHGQVVKTGYEKGCLVGNVL

SEQ ID NO: 214239 - protein, 131 aa, Glycine max
  Coding DNA Sequence Number=SeqID_97461
  Gene Ontology: Mol. function=binding; Biological process=mRNA editing
  Homolog annotation: Hit_ID=Q6K2P5; Match level="QueryCoverage=99%, HitCoverage=39%, E-value=9e-20, Identity=36%"; Hit description =Putative pentatricopeptide (PPR) repeat-containing protein
  Pfam annotation: Domain name=PPR; Domain location=68-102; Score=11.7; E_value=0.3; Accession=PF01535.11; Description=PPR repeat
  Pfam annotation: Domain name=PPR; Domain location=7-41; Score=33.0; E_ value=1.1e-06; Accession=PF01535.11; Description=PPR repeat
  Pfam module annotation: Pfam domain module=PPR::PPR; Domain location =68-102::7-41
MPENDAVSWNAMLSGYVWSGHVDEARDVFDRMPHKSQEFRPSPGMGYLQHMFRVGDSRRLVAYLSPNQTGNCLMGGYVKTNMLGDAKQLFDQMPVRDVISWNTMISGYEQDRDLSQARRWFEESPVRDVFT

SEQ ID NO: 214240 - protein, 141 aa, Glycine max
  Coding DNA Sequence Number=SeqID_97462
MHKRQSILGAPNKSGEWRIALGNHFVLLETHWWRIHEQQSIHGAPNKSGEWRIALGNHFAWLQTHWWRMHERQSIHGAPNKSGEWTFALGNHFAWLQTHWWTMHERQSIHGASNKSGEWRIALGNHYAWLQTHWWRMHERQ

SEQ ID NO: 214241 - protein, 74 aa, Glycine max
  Coding DNA Sequence Number=SeqID_97463
MCLSGKESMLMKFLISINEILDVSISFLNDHLEETLGPTKIGENHSKCINLTQCVARKSLAHRILSAIKGRGPL

SEQ ID NO: 214242 - protein, 148 aa, Glycine max
  Coding DNA Sequence Number=SeqID_97464
  Gene Ontology: Mol. function=electron carrier activity; Cellular component=integral to thylakoid membrane; Biological process =electron transport
  Homolog annotation: Hit_ID=P49161; Match level="QueryCoverage=99%, HitCoverage=64%, E-value=1e-60, Identity=65%"; Hit description =Apocytochrome f precursor
  Pfam annotation: Domain name=Apocytochr_F_C; Domain location=89-148; Score=53.7; E_value=2.5e-14; Accession=PF01333.10; Description =Apocytochrome F, C-terminal
VVRIPYDMQVKQVLANGKKGALNVGAVLILPEGFELAPPDRISPEIKEKIGNLSFQNYRPTKKNILVVGPVPGGNRGRGQIYLDGSKSNNNVYNATAAVIDIIPPGPELLVSEGESIKLDQPLTSNPNVGGFGQGDAEIVLQDPLRVQ

SEQ ID NO: 214243 - protein, 71 aa, Glycine max
  Coding DNA Sequence Number=SeqID_97465
  Gene Ontology: Mol. function=hydrolase activity, acting on acid anhydrides, catalyzing transmembrane movement of substances; Cellular component=proton-transporting ATP synthase complex, coupling factor F(o); Biological ...
  Gene Ontology: Cellular component=process=ATP synthesis coupled proton transport
  Homolog annotation: Hit_ID=P56760; Match level="QueryCoverage=86%, HitCoverage=100%, E-value=2e-10, Identity=52%"; Hit description=ATP synthase C chain
MYVGYEEIIMNPIISAASVIAAGLAVGLASIGPGGWSRHCCRASCRKGLHDNPEAEGKIRALALLFANPFV

SEQ ID NO: 214244 - protein, 86 aa, Glycine max
  Coding DNA Sequence Number=SeqID_97466
MRFQMLAFVPKRPFRGNTGPNRIEENHSKCINLTQFSSEGRDYGKLGFWLKVCRTAGHDICQDVGLASGSGKKEMSHIISMIHMQH

SEQ ID NO: 214245 - protein, 668 aa, Glycine max
  Coding DNA Sequence Number=SeqID_97467
  Gene Ontology: Mol. function=protein-tyrosine kinase activity; Cellular component=integral to membrane; Biological process=protein amino acid phosphorylation
  Homolog annotation: Hit_ID=Q1RXR7; Match level="QueryCoverage=100%, HitCoverage=90%, E-value=0.0, Identity=38%"; Hit description =Tyrosine protein kinase, active site
  Pfam annotation: Domain name=LRR_1; Domain location=102-124; Score =16.1; E_value=0.12; Accession=PF00560.23; Description=Leucine Rich Repeat
  Pfam annotation: Domain name=LRR_1; Domain location=126-148; Score =18.4; E_value=0.025; Accession=PF00560.23; Description=Leucine Rich Repeat
  Pfam annotation: Domain name=LRR_1; Domain location=149-171; Score =7.5; E_value=11; Accession=PF00560.23; Description=Leucine Rich Repeat
  Pfam annotation: Domain name=LRR_1; Domain location=173-195; Score =15.2; E_value=0.25; Accession=PF00560.23; Description=Leucine Rich Repeat
  Pfam annotation: Domain name=LRR_1; Domain location=197-219; Score =12.1; E_value=1.6; Accession=PF00560.23; Description=Leucine Rich Repeat
  Pfam annotation: Domain name=LRR_1; Domain location=221-243; Score =11.6; E_value=1.9; Accession=PF00560.23; Description=Leucine Rich Repeat
  Pfam annotation: Domain name=LRR_1; Domain location=245-266; Score =19.1; E_value=0.016; Accession=PF00560.23; Description=Leucine Rich Repeat
  Pfam annotation: Domain name=LRR_1; Domain location=268-289; Score =13.4; E_value=0.86; Accession=PF00560.23; Description=Leucine Rich Repeat
  Pfam annotation: Domain name=LRR_1; Domain location=30-52; Score=7.0; E_value=14; Accession=PF00560.23; Description=Leucine Rich Repeat
  Pfam annotation: Domain name=LRR_1; Domain location=54-76; Score =10.6; E_value=3; Accession=PF00560.23; Description=Leucine Rich Repeat
  Pfam annotation: Domain name=LRR_1; Domain location=6-25; Score=5.3; E_value=30; Accession=PF00560.23; Description=Leucine Rich Repeat
  Pfam annotation: Domain name=LRR_1; Domain location=78-100; Score =10.2; E_value=3.6; Accession=PF00560.23; Description=Leucine Rich Repeat
  Pfam annotation: Domain name=Pkinase; Domain location=394-668; Score =144.6; E_value=2.6e-40; Accession=PF00069.15; Description=Protein kinase domain
  Pfam annotation: Domain name=Pkinase_Tyr; Domain location=394-668; Score=83.6; E_value=6e-22; Accession=PF07714.7; Description=Protein tyrosine kinase
  Pfam module annotation: Pfam domain module=LRR_1::LRR_1::LRR_1::LRR _1::LRR_1::LRR_1::LRR_1::LRR_1::LRR_1::LRR_1::LRR_1::LRR _1::Pkinase::Pkinase_Tyr; Domain location=102-124::126-148::149 -171::173-195::197-219::221-243::...
  Pfam module annotation: Domain location=245-266::268-289::30-52::54 -76::6-25::78-100::394-668::394-668
MSMLTALESLQLADNDFIGHLPQNICIGGTFKKISAENNNFIGPIPVSLKNCSSLIRVRLQRNQLTGDITDAFGVLPNLDYIELSDNNFYGQLSPNWGKFRSLTSLKISNNNLSGVIPPELAGATKLQQLHLSSNHLTGNIPHDLCNLPLFDLSLDNNNLTGNVPKEIASMQKLQILKLGSNKLSGLIPKQLGNLLNLLNMSLSQNNFQGNIPSELGKLKFLTSLDLGGNSLRGTIPSMFGELKSLETLNLSHNNLSGDLSSFDDMTSLTSIDISYNQFEGPLPNILAFHNAKIEALRNNKGLCGNVTGLERCSTSSGKSHNHMRKNVMIVILPLTLGILILALFAFGVSYHLCPTSTNKEDQATSIQTPNIFAIWSFDGKMVFENIIEATEDFDDKHLIGVGGQGCVYKAVLPTGQVVAVKKLHSVPNGKMLNLKAFTCEIQALTEIRHRNIVKLYGFCSHSQFSFLVCEFLENGSVEKTLKDDGQAMAFDWYKRVNVVKDVANALCYMHHECSPRIVHRDISSKNVLLDSEYVAHVSDFGTAKFLNPDSSNWTSFVGTFGYAAPELAYTMEVNEKCDVYSFGVLAWEILVGKHPGDDISSLLGSSPSTLVASTLDHMALMDKLDPRLPHPTKPIGKEVASIAKIAMACLTESPRSRPTMEQVANEL

SEQ ID NO: 214246 - protein, 161 aa, Glycine max
  Coding DNA Sequence Number=SeqID_97468
MRGQDIYSSQDEVTTSPSSSESEEAKGEESSEEIYPQEEGQPLMVKEECKETLVSIATPLRLEFIPQVKELLDEGLVRKSLNPCALLVPKIGLPMDPKRIKVIPPPTPLIELVRNYILLWEDDRERGVEERINEFQEPLDLRSNPFRGGGNDAILPPKGIG

SEQ ID NO: 214247 - protein, 134 aa, Glycine max
  Coding DNA Sequence Number=SeqID_97469
MGMGKGERSENGNRMGKGRTRGLKKQLIKEEGESDPKCILEALYTLLNKKFAFKVKTILGSITFSVFEVFEDEDTIKAIVAKIPVDEDLSTSLVTSKKDKLMSSIVKLDDICDNQTLSARVDYDPEALLTQTHC

SEQ ID NO: 214248 - protein, 48 aa, Glycine max
  Coding DNA Sequence Number=SeqID_97470
  Subcellular localization annotation: CTP_CleavageSite=35; ConfidenceScore=5.04e-01
MASELSTDTTKTSTSFDSSSATSKVFFVSYYSDLDLAMKQSLLSSSMF

SEQ ID NO: 214249 - protein, 146 aa, Glycine max
  Coding DNA Sequence Number=SeqID_97471
MYYVCSFHGLGDKIHAPVKKFEIEKWKEQLKDGISYILKNFEVEAKSEDYILTTHNYKFVFGKGTKVKVQGLLDISKIGYRFTKFEDINNGKASIDVLIGNFELFVHNSKYGSKLLINEKIPKTKDFIKSLGSNHTGGASYSQRMN

SEQ ID NO: 214250 - protein, 432 aa, Glycine max
  Coding DNA Sequence Number=SeqID_97472
  Gene Ontology: Mol. function=binding; Cellular component=clathrin coat of trans-Golgi network vesicle; Biological process =intracellular protein transport
  Homolog annotation: Hit_ID=Q9XFS0; Match level="QueryCoverage=79%, HitCoverage=30%, E-value=1e-80, Identity=73%"; Hit description=Gamma- adaptin 2
  Pfam annotation: Domain name=Adaptin_N; Domain location=14-432; Score= -23.9; E_value=5e-07; Accession=PF01602.10; Description=Adaptin N terminal region
MIRAIRACKTAAEERAVVRKECAAIRASIDENDPDYRHRNLAKLMFIHMLGYPTHFGQMECLKLIASPGFPEKRMGYLGLMLLLDERQEIPFYKYARELAIMVMGNISSAEMARDLAPEVERLLHFRDPNIRKKAALCSARIIKKVPDLAENFVNPATALLREKHHGVLITGVQLCTELCKISSEALEHVRKRVTTGTTVKVCLGDRLVIGSNMETASLHMQRATHKGVDQKGEEKHCRLQLLKCWFLGAYPRSVDPLLGHLHCHAPAYSPGYERATYGGGDKKESAYNAWAVFTLQDLANSPYSPEYDTAGFTDPFLHIRLLRLLRVLGEDHADASDSMNDILAQGGNRPGGIWLGGESLELDPNHEEAAKFYIEGNCTCTVENLNAANDTIDELDFPIALRKELDLVQLKIQSPPQSNAQKYGKLGDMEK

SEQ ID NO: 214251 - protein, 163 aa, Glycine max
  Coding DNA Sequence Number=SeqID_97473
  Gene Ontology: Mol. function=binding; Cellular component=clathrin coat of trans-Golgi network vesicle; Biological process =intracellular protein transport
  Homolog annotation: Hit_ID=Q9XFS0; Match level="QueryCoverage=90%, HitCoverage=17%, E-value=2e-63, Identity=78%"; Hit description=Gamma- adaptin 2
DSDASIRKRALELVCILVNETNVKALTKELVEYLEVSDPDFRADLTAKICSIVSKFSPEKIWYIDQMLKVLSEAGNFVKDEVWHALIVVISNASELHGYTVRALYKAFKMSAEQETLVRVAVWCIGEYGDILINNAGMLDVEDPVTVSEWFLLESLCIIYTVA

SEQ ID NO: 214252 - protein, 157 aa, Glycine max
  Coding DNA Sequence Number=SeqID_97474
  Gene Ontology: Mol. function=nucleic acid binding; Cellular component= signal recognition particle, endoplasmic reticulum targeting; Biological process=SRP-dependent cotranslational protein targeting to membrane
MIVRNNRDIESEYLSDAKMSLLEDCSDVKVVEPIHEVALVTRHALNIHPKENGDMEQREHIFYIKCHINDHVCSMIIDSGSYINVTNTLLIEKLNFKKHPNPYKLQCLNVRWRYRVTKQVLVLFSIDKYKDEVLCDVAPIRASIMDGLVRPIEPNNK

SEQ ID NO: 214253 - protein, 384 aa, Glycine max
  Coding DNA Sequence Number=SeqID_97475
  Gene Ontology: Mol. function=metal ion binding; Cellular component =integral to membrane; Biological process=ubiquitin cycle
  Homolog annotation: Hit_ID=Q8GW38; Match level="QueryCoverage=80%, HitCoverage=77%, E-value=6e-79, Identity=54%"; Hit description=RING -H2 finger protein ATL1D
  Pfam annotation: Domain name=PHD; Domain location=151-193; Score= -0.5; E_value=0.064; Accession=PF00628.19; Description=PHD-finger
  Pfam annotation: Domain name=zf-C3HC4; Domain location=149-190; Score= 36.6; E_value=8.4e-08; Accession=PF00097.15; Description=Zinc finger, C3HC4 type (RING finger)
  Pfam module annotation: Pfam domain module=PHD::zf-C3HC4; Domain location=151-193::149-190
  Subcellular localization annotation: CTP_CleavageSite=52; ConfidenceScore=5.20e-01
MNWVHSQICHSTDAINNPTSICSSSSESLPYSSAYKKQLAPPPPLDSSSGTRISPAVVFIFVILAIVFFISGLLHLLVRFLIRHRPSSSSSISQSNRYPNDMSESNDPYQRQLQQLFNLHDSGLDQAFMDALPVFLYKDIIGLKEPFDCAVCLCQFSEQDMLRLLPLCNHAFHIDCIDTWLLSNSTCPLCRGSLYDPGFAFENPVYDLEGVREEDGVSGSVAGEGSCVNKHAENHIMSGKRVFSVRLGKFRSSNIVEGVERSGGRGESSTSNLDVRRCYSMGSFQYVVADSDLQVALCPNRGDGGGVNGDSMRQLKGRLVNYGNSSTDDVEGKKINIARKGESFSVSKIWQWSKKDKVSISQENHLGGSNVTAALPWMHRAQGA

SEQ ID NO: 214254 - protein, 178 aa, Glycine max
  Coding DNA Sequence Number=SeqID_97476
MATITAHLIITTSQDHTTLLSPLHLKSIPSFVHDYDIIIHNFTSSQNTFVIATNLPFHFSLAQCTFPYPNLLPCKHSKLNNLPEPSSPSLHQPFLLKLLEPSTPQQHPPSSSKSRLSNTPPNLQIIPNITNVEGLEGGAHVGEVVGGEWTKGLRGRNLAMEAGVVAVGEGSEGERKLG

SEQ ID NO: 214255 - protein, 119 aa, Glycine max
  Coding DNA Sequence Number=SeqID_97477
  Subcellular localization annotation: CTP_CleavageSite=70; ConfidenceScore=5.01e-01
MATTPPVLLKNGIPGLPGHPWVASGGSNPARLGELRSPGRAGRQPPPPFSYKKAEGGCSKDPSAPWLCISAVLGEKNCFREENPSRGASVTLPRCFRKKIREGFRPFFIVLHPFFVLQR

SEQ ID NO: 214256 - protein, 56 aa, Glycine max
  Coding DNA Sequence Number=SeqID_97478
MKDRDTHVFEPVHGGWPPAGKPNAVNNALRPVTHLDWPAKVVAVRLRTDVHHPAPA

SEQ ID NO: 214257 - protein, 124 aa, Glycine max
  Coding DNA Sequence Number=SeqID_97479
  Gene Ontology: Mol. function=endonuclease activity; Biological process=RNA-dependent DNA replication
  Homolog annotation: Hit_ID=Q1RY72; Match level="QueryCoverage=81%, HitCoverage=27%, E-value=3e-16, Identity=44%"; Hit description =Endonuclease/exonuclease/phosphatase
MEVGDNNSNLKIDSLIDLIEALAIYALNKLDQRRTLWTDIECIHGNQHGPWVLLGDFNNVLKAKDRVGGNLVTESKYEDLAKMMRNTGTFEKDSTGDYYTWSNKQTDGMIYSRIDRVLGNVEWF

SEQ ID NO: 214258 - protein, 223 aa, Glycine max
  Coding DNA Sequence Number=SeqID_97480
  Homolog annotation: Hit_ID=Q1RTJ9; Match level="QueryCoverage=43%, HitCoverage=29%, E-value=9e-11, Identity=39%"; Hit description =Cyclin-like F-box; F-box protein interaction domain
MRKFGDDKSWIQLINFSYLHLNIRPYEEKSMILPLCMSNNGHFFMLKFTRNANDEYQTILYNQGDGKSQVLSFPQIVSERCCGATSRFLPKVWSYLIEILQIEIPEGYRVCFWNKETRVISRELPTLSFSPGIGRRTMFGFGYDPSSDKYKVVAIALTMLSLDVSEKTEMKVYGAGDSSWRNLKGFPVLWTLPKVGGVYLSGTLNWVVIKGKETIHSEIVIIL

SEQ ID NO: 214259 - protein, 217 aa, Glycine max
  Coding DNA Sequence Number=SeqID_97481
  Gene Ontology: Mol. function=DNA binding
  Homolog annotation: Hit_ID=Q1RTB4; Match level="QueryCoverage=57%, HitCoverage=27%, E-value=3e-15, Identity=35%"; Hit description=IMP dehydrogenase/GMP reductase
MGTNHTGKRFYQVKIKGLDVTSLKELGRLMGPLQMQAFRKAYGKILDLTIAEISTEVVDVLLGEGNRIFSPGCGKAREMENQEEWVPFMDVLALLIFGVVLFPNVHGLVDLAAIDAFLAYHHSKESPVVAVLANLFDTFDRRVDWDQLLAGIRGRTISWFPRWKEGREGVLFSCGEYPNIPLIGTRGCINYNPALAIRQLGYPTMGAPTEESLSPFL

SEQ ID NO: 214260 - protein, 113 aa, Glycine max
  Coding DNA Sequence Number=SeqID_97482
MRLSGKESLLMKSPITINEILDVSISFLNDHLEETLGSTKIEEIHSKCINLAQTLTLGPRIRFRCDKHPPFVVHAPSPISARHEGGVLGKYPSPTSVASILGVQLIYLLGNFT

SEQ ID NO: 214261 - protein, 57 aa, Glycine max
  Coding DNA Sequence Number=SeqID_97483
MVLRYALNEIAAEFERVHYANNNPSSYGCVMKTTHDRPCACELSRDHGYPPTRWVRN

SEQ ID NO: 214262 - protein, 66 aa, Glycine max
  Coding DNA Sequence Number=SeqID_97484
  Gene Ontology: Mol. function=4 iron, 4 sulfur cluster binding; Biological process=electron transport
  Homolog annotation: Hit_ID=Q2NS18; Match level="QueryCoverage=98%, HitCoverage=75%, E-value=1e-28, Identity=80%"; Hit description =Putative ferredoxin
  Pfam annotation: Domain name=Fer4; Domain location=2-25; Score=30.2; E_value=6.4e-06; Accession=PF00037.17; Description=4Fe-4S binding domain
MALIITERCINCDMCEPECPNQAISMGESIYQIDADRCTECVGHYDEPTCQSVCPIDNTILSDPQH

SEQ ID NO: 214263 - protein, 144 aa, Glycine max
  Coding DNA Sequence Number=SeqID_97485
MTTSASIVCLVIAVLSCMLNIQKGFSTPQQREYQLLSSAITESVPAEYSGQLYYRIDSDNLPAVAKSKKYDEFGSLSLGMPWTFAGMADAIKKEHAMKFSLPKAPRRPYFAYHATALLTVAWFSGYGATSDRLVAVTSPRSAGG

SEQ ID NO: 214264 - protein, 148 aa, Glycine max
  Coding DNA Sequence Number=SeqID_97486
  Gene Ontology: Mol. function=transition metal ion binding; Biological process=cytoskeleton organization and biogenesis
MTKLNYVKFTVCVFKCKWVDSNTGVHTDDIGFTLVDLKKLGYHNDPFIMAEQSRQVFYVQDPCDERWCVVLQGKTVGVNVEDDDSYMDTYVSPLTAQITGNVVGEEEADDRQRSPNLDFIQLMFVGPCGLNNLKRDRLRMQKKQQQSI

SEQ ID NO: 214265 - protein, 239 aa, Glycine max
  Coding DNA Sequence Number=SeqID_97487
  Gene Ontology: Mol. function=4 iron, 4 sulfur cluster binding; Cellular component=integral to membrane; Biological process=protein -chromophore linkage
  Homolog annotation: Hit_ID=P56766; Match level="QueryCoverage=98%, HitCoverage=42%, E-value=2e-76, Identity=81%"; Hit description =Photosystem I P700 chlorophyll a apoprotein A1
  Pfam annotation: Domain name=PsaA_PsaB; Domain location=2-239; Score=- 189.5; E_value=0.0017; Accession=PF00223.9; Description=Photosystem I psaApsaB protein
MVLVFPIYEAWLSDPTHIRPSAQVVWPIVGQEILNGDVGGGFRGIQITSALMLLLVGSLSQSCSKIGLVPRCRIYVESPFDRAPGGATPFFTLNWSKYAEFLTFRGGLDPVTGGLWLTDIIHHHLAIAILFLIAGHMYRTNWGIGHSIKDILEAHKGPFTGQGHKGLYEILTTSWHAQLSINLAMLGSLTIVVAHHMYSMPPYPYLATDYGTQLSLFTHHMWIGGFLIVGAAAHAAIFM

SEQ ID NO: 214266 - protein, 123 aa, Glycine max
  Coding DNA Sequence Number=SeqID_97488
MDRVTSLLRLLPNTFRTVDVCYFQFHLDKDVMDHVENLNRFNPMSCVKFRNTSTVHHSHTSMLFIEHTLRCPYQTRARARVMGEVEEVKEQMKTDMEAMKEQMATMMEAMMSMKKIMEANAVA

SEQ ID NO: 214267 - protein, 103 aa, Glycine max
  Coding DNA Sequence Number=SeqID_97489
RVHLLGDRYTENKRGYISCGSVQVEGTSTWFFKENKGRYIPCGSLACKGFYKVEQKSQEPQVAWGLDVGMNLAFRLTNINEKGLLVTQRETDVELMIGEGSLL

SEQ ID NO: 214268 - protein, 137 aa, Glycine max
  Coding DNA Sequence Number=SeqID_97490
MKLAKYRLNAQVEKDEGPSGEGQSPQVEKDEGPEAETLSRLLIVAEGNPCGVYPDLSSFTGSDVYLDLSSFTGSGVYLDLSSFTGSGVNPDLSSITGSGVYPDLSSFTGSGVTQNLCSLYQTIHSYSGSHHRPASVF

SEQ ID NO: 214269 - protein, 410 aa, Glycine max
  Coding DNA Sequence Number=SeqID_97491
  Gene Ontology: Mol. function=iron ion binding
  Homolog annotation: Hit_ID=Q4J5N0; Match level="QueryCoverage=86%, HitCoverage=78%, E-value=1e-72, Identity=42%"; Hit description=GGDEF
RYRRLCDLPAQALGDHGRLRFAGGHQYQHEFFAAIAEQVVAATRELAEQAGHMLQRAVAGIVAMAVVDCLEMIQVEQQQRERCAVARGQLDFPAQHGGQEAAVEQIGQGIAAGIQFADALEQQCQSGCGWRPGPRVWPAAPPVAVPGIAAGPLQVAVNAGHQLAQLLRFAAFAEAGDALVGEPQAELRGGQAGVVAGLHMTGECVEQGVLPVQQQCALTLAFRTDVLYQREQPVGGVGTGGALARMGVGQGHAFHGDVHDRAEAVDGGERGRAVGRVVAQAHEQLVLEHACTAGDQVDRDADPRVYVADHPLRGDGGGDAGGVGGQQLHQPALHGRLQALLDLVVGQEAACTPVLQQHFVKALGQRGWGIGGSGPEQRGGGRAGLQQAMLPGLGQRLAGIVQLGWFHVDL

SEQ ID NO: 214270 - protein, 67 aa, Glycine max
  Coding DNA Sequence Number=SeqID_97492
MGRRLPPSSPKRAGLLPPEATLLRKYSGTVQIRKFENCYLHPLLISSPPSFVILRKSYGSFTEAYRT

SEQ ID NO: 214271 - protein, 139 aa, Glycine max
  Coding DNA Sequence Number=SeqID_97493
  Subcellular localization annotation: CTP_CleavageSite=94; ConfidenceScore=5.10e-01
MVICPHTVAIQGPQVRLTRGDQIWSSAPFPEMSTSSSRDFLVSQTTSVNPDPWVRWQADIPKSGGRRTYPSDCPYNTTSVNLDPRVRWKAEIPRVVIRTKTTFVSPDPCVRWHAEMPRVVICTKTTFVNPDPCVRWQVE

SEQ ID NO: 214272 - protein, 187 aa, Glycine max
  Coding DNA Sequence Number=SeqID_97494
MGPVPARTCLGVVVHLSPVAGRPQAVVVPRPTLAWGAVLLDESPVNGGLMIRAGILGPCWTSSGPRDSSMLLSSNVIHICVRVVMLVRMIHTRVFAAAWVKSCLGQRTLSSLKARMWSPLKARACSPRKARACSPRKAIGFVPPDVSSIGACRPRIFFINGFLCFLEDEWQRNGEGRERGDATSRRR

SEQ ID NO: 214273 - protein, 122 aa, Glycine max
  Coding DNA Sequence Number=SeqID_97495
MVGDTRSNFVDLVFTGERIEVGLKRGKFDHLALMNEKIGTNGGDEEEEGNHVVAVIPRWPCFPPAQQCHYPPPNHPQGSSLNQPQSLPTAHPMPNTTFRTSQNINQGRNFAAKKPVQFTPIP

SEQ ID NO: 214274 - protein, 143 aa, Glycine max
  Coding DNA Sequence Number=SeqID_97496
  Subcellular localization annotation: CTP_CleavageSite=41; ConfidenceScore=5.31e-01
MHKYNSRTFHYKVRRSRLFPVFPTFSSNKRWWRLHAYSFLRTRTRESRVALPPKVLAIEIAIPCVTGLNQAHAFKKSTSTMHHSHRGRERESMCEVKELQEQIKADIEAVKEKMATMMEAMISMKKIMEVNAVVVAATSAIQR

SEQ ID NO: 214275 - protein, 133 aa, Glycine max
  Coding DNA Sequence Number=SeqID_97497
MGEVEEVREQKKADMEAMKEQMATMMEAMMSMKKDNADFEPCLGYATEGQAVGDIPLQNTLEGPQYHPQPHPLHSTPGKNPHAMAEMGELDHRKERLRAIEGGEDYAFANLEELFLVPNIITPPKFKVPDYFP

SEQ ID NO: 214276 - protein, 82 aa, Glycine max
  Coding DNA Sequence Number=SeqID_97498
MDNHSWCYPACLQCHRKTDIQTGPFTCGCGKDNDQPDRECAELIGQTADDVNRVKIEQDGDLDLNASPQALDRLLGHVLAFK

SEQ ID NO: 214277 - protein, 370 aa, Glycine max
  Coding DNA Sequence Number=SeqID_97499
  Gene Ontology: Mol. function=hydrogen ion transporting ATP synthase activity, rotational mechanism; Cellular component=proton -transporting ATP synthase complex, catalytic core F(1); Biological process=ATP synthesis coupled proton transport
  Homolog annotation: Hit_ID=Q6I8E6; Match level="QueryCoverage=51%, HitCoverage=58%, E-value=1e-101, Identity=100%"; Hit description =Pseudo-atpA
  Pfam annotation: Domain name=ATP-synt_ab; Domain location=46-272; Score=-5.0; E_value=1.8e-07; Accession=PF00006.15; Description=ATP synthase alphabeta family, nucleotide-binding domain
MLGRVVDALGVPIDGRGALSDHERRRVEVKAPGIIERKSVHEPMQTGLKAVDSLVPIGRGQRELIIGDRQTGKTAIAIDTILNQKQMNSRATSESETLYCVYVAIGQKRSTVALRYGLQFLLFFAVFYLISTNINMASVDTFESLVRRLAFYLGNQALSRLLLQRGCSVGLTVAIAVLFGDTPSVGNNMMDPSGSSGSSGGGGSESSWTGALLSSETLSGTGSVNQPAEGMPVPPANPVVEQAGPANPEDTTEIIGGDSIDSIRNRLLQSYGNPSAEQISRASYDADDLFQVKVEIIRGMTPLDPEGDWPGRGARALDNPRTSTGEDSLENLYRLKDDLNENGRDSETFKRLKDKVFRRPRPLEDANSTT

SEQ ID NO: 214278 - protein, 59 aa, Glycine max
  Coding DNA Sequence Number=SeqID_97500
MAELVDALDSKSSAARRAGSIPAPGTNVMHMALTDTQLRNAKSAGKDYRITYGQGFPYL

SEQ ID NO: 214279 - protein, 77 aa, Glycine max
  Coding DNA Sequence Number=SeqID_97501
  Subcellular localization annotation: CTP_CleavageSite=33; ConfidenceScore=5.01e-01
MASDLKVALLDQSKSALSWMGPVGCLGKSIASSCISVVELARGPVHVGKSAVIWLPSSKFRRRLGEEMETRDNKVVG

SEQ ID NO: 214280 - protein, 193 aa, Glycine max
  Coding DNA Sequence Number=SeqID_97502
  Gene Ontology: Cellular component=integral to membrane
EILGLEEENRSLMETRIEPLSQCLIQNISMESKLNGFSGFRGVLYAMRSVSSLLLMILLSGLAYSWSSSCFHQGYDGHMVFGSTGFMVSMAILQQKVAEEIDQNIEGGQPGILLFEFQKAKNAMEELKLELERIAISCYEEGHADHEIQEKIHNVKSCFGLLRCGVETITGQLDDFFDEIVEGRKKLLDMCSH

SEQ ID NO: 214281 - protein, 218 aa, Glycine max
  Coding DNA Sequence Number=SeqID_97503
  Homolog annotation: Hit_ID=Q1UG45; Match level="QueryCoverage=21%, HitCoverage=19%, E-value=7e-07, Identity=47%"; Hit description =Hypothetical protein precursor
  Pfam annotation: Domain name=Adeno_E3_CR2; Domain location=165-204; Score=7.0; E_value=0.095; Accession=PF02439.6; Description =Adenovirus E3 region protein CR2
MVVDDQINTNQKNGFNHCEKKEVGEKTGVPATLLWFSTYKPFRRNPEKLTMSSPHNSAPHNSSPDNSTPDDATPNNSIPDNSTPDNSIPDNSTPDNSTSNKSAPHNSTPDNATPDNSTPNNSNKSHKSSSVSPPSMEGQSTPTSGKDSSNKSLSNEKSLGSNNDSSNKVAMGAGIGVGFILLVLVIVCFIWSCRKKKRKQKYYYPNPSHGKGDNCLKH

SEQ ID NO: 214282 - protein, 525 aa, Glycine max
  Coding DNA Sequence Number=SeqID_97504
  Homolog annotation: Hit_ID=Q1S4F9; Match level="QueryCoverage=29%, HitCoverage=33%, E-value=2e-67, Identity=84%"; Hit description =Leucine-rich-associated
  Pfam annotation: Domain name=LRR_1; Domain location=120-142; Score =3.3; E_value=69; Accession=PF00560.23; Description=Leucine Rich Repeat
  Pfam annotation: Domain name=LRR_1; Domain location=49-69; Score=7.4; E_value=12; Accession=PF00560.23; Description=Leucine Rich Repeat
  Pfam annotation: Domain name=LRR_1; Domain location=71-92; Score=9.9; E_value=4; Accession=PF00560.23; Description=Leucine Rich Repeat
  Pfam annotation: Domain name=LRR_1; Domain location=96-116; Score =14.8; E_value=0.32; Accession=PF00560.23; Description=Leucine Rich Repeat
  Pfam module annotation: Pfam domain module=LRR_1::LRR_1::LRR_1::LRR _1; Domain location=120-142::49-69::71-92::96-116
MDEIWERAVETALDGEKDHAAARTLTLDGAVKCVQGRLPPPSLLERFQNLQHLSIANVGVSSLEQFPRLRNLQKLNLSDNRIASGLEFLVQAGLDSLRDLDLSNNRIQYIEDLAPLAQLKLVSLDLYECPVTRVKDYRSRVFGLIKSLKYLDKMDAEENERPESDDEEEDEEEEEEEDDPGSGEIDGGEEDRPFGINNGHSEGADGVVDADDEEESDADEEETESSRRMVVNGEGHRENGLGVAPVEGDDVEEEDDEDDSGEEIDEEEGDDDDVVEVHEIEDSDDEDGVEEYDEDDDDEDDDEEEEVDNDEGDFVEPERTGRLTSTEGEIDGHEQGEEDGDEDDNGETGEDEIGVEDDGDFEDDDEEEDYGAGYLVQPVGQSDAVNAAVADVDGGNDDGEEKDEVDDDDEDDVQVLPPPESSHLKRKRDDDEEDEDSDNDDDEDVASMCWKQGNLLSLDRRTMLSEVYRSVMCSMLVWCWLVKELVSGGKGFCLTFIILITMCKTWSRVGVVNCRVMGPSVANRQ

SEQ ID NO: 214283 - protein, 248 aa, Glycine max
  Coding DNA Sequence Number=SeqID_97505
  Homolog annotation: Hit_ID=Q852F8; Match level="QueryCoverage=46%, HitCoverage=70%, E-value=1e-19, Identity=44%"; Hit description =Expressed protein
  Pfam annotation: Domain name=DUF1195; Domain location=1-141; Score =229.5; E_value=7.3e-66; Accession=PF06708.2; Description=Protein of unknown function (DUF1195)
MKDKETFPIAKKEASDSGLFGRGSYKFWALAAMLLLAFWSMFTGTVSLRWSGTLNTFSHASLHDHLDVLEIEEREKLVRHMWDVYTNNRRIRLPRFWEKAFEAAYEDLTSDAADVRDVAVAEIVNMSLRSLDLQLPPGILGATVGVTYHVTRKVTGSVIIRTLKGKKKKLSRVKVFTENRQGSSLCEDMGEGYCTQSYPCICKEAVSGFEPMTNKSPRHNFTAAPGARKLSKNLKEVEKGKGATSERA

SEQ ID NO: 214284 - protein, 229 aa, Glycine max
  Coding DNA Sequence Number=SeqID_97506
  Homolog annotation: Hit_ID=Q1S4F6; Match level="QueryCoverage=45%, HitCoverage=35%, E-value=3e-23, Identity=56%"; Hit description=U1 snRNP-related
MAECYAYLLEKSDKEQQQSGLSRSEEPRAQEDHHGDRDREKSRERGKDRHRESEWSCERSSGRARDRDYRGDRHYRDWDRNMDRDRERERDRDVIVVESVIRIGIMTRTANMTVIVKEIGIMKLGNIMVKESMTMNLRMVVVGTTNLGMGIAMQIPTMILITRSIIEEGGNMMREMTMVTITTNILIVVGKKMTTILNMQNLNHVTGREIVIWTMNIVTQISHSQEYDY

SEQ ID NO: 214285 - protein, 125 aa, Glycine max
  Coding DNA Sequence Number=SeqID_97507
  Gene Ontology: Mol. function=nucleic acid binding; Cellular component= ribonucleoprotein complex
  Homolog annotation: Hit_ID=Q42404; Match level="QueryCoverage=62%, HitCoverage=19%, E-value=7e-17, Identity=51%"; Hit description=U1 small nuclear ribonucleoprotein 70 kDa
MGEDFNNNDPLIRNQNAAVQARAKDQNRANALQLKLAQKRARIHKLRLEKGAAKAAEELEKYDPHNDPNVSGDPYKTLFIARLSYESTDSRMKREFESYGAIKRVGVLNIPKGFSKDIVYARLLI

SEQ ID NO: 214286 - protein, 412 aa, Glycine max
  Coding DNA Sequence Number=SeqID_97508
  Gene Ontology: Mol. function=protein serine/threonine kinase activity; Cellular component=membrane; Biological process=protein amino acid phosphorylation
  Homolog annotation: Hit_ID=Q1S4F8; Match level="QueryCoverage=83%, HitCoverage=51%, E-value=1e-162, Identity=82%"; Hit description =Protein kinase
  Pfam annotation: Domain name=Pkinase; Domain location=69-341; Score =103.4; E_value=6.9e-28; Accession=PF00069.15; Description=Protein kinase domain
  Pfam annotation: Domain name=Pkinase_Tyr; Domain location=69-341; Score=155.6; E_value=1.3e-43; Accession=PF07714.7; Description =Protein tyrosine kinase
  Pfam module annotation: Pfam domain module=Pkinase::Pkinase_Tyr; Domain location=69-341::69-341
  Subcellular localization annotation: CTP_CleavageSite=63; ConfidenceScore=5.41e-01
MGMGMGMGGMGPHSGGWGAPPPHMMNSGEMMSSNYSLGMSSSSPGLSLALNANGGTFTYEELAAATKGFANENIIGQGGFGYVHKGILPNGKEVAVKSLKAGSGQGEREFQAEIDIISRVHHRHLVSLVGYCICGGQRMLVYEFVPNSTLEHHLHGKGMPTMDWPTRMKIALGSAKGLAYLHEDCSPRIIHRDIKASNVLLDQSFEAKVSDFGLAKLTNDTNTHVSTRVMGTFGYLAPEYASSGKLTEKSDVFSFGVMLLELITGKRPVDLTNAMEDSLVDWARPLLNKGLEDGNFGELVDPFLEGKYNPQEMTRMAACAAGSIRHSARKRSKMSQIVRALEGEASLDELKDGMKLKGSGNGNSSAPTSSSGSSEYDTMQYNADMIKFRQAIMSSQEFNDSSELSSKEMGYH

SEQ ID NO: 214287 - protein, 104 aa, Glycine max
  Coding DNA Sequence Number=SeqID_97509
  Gene Ontology: Mol. function=oxidoreductase activity, acting on the CH-CH group of donors; Cellular component=mitochondrion; Biological process=tricarboxylic acid cycle
  Homolog annotation: Hit_ID=O82663; Match level="QueryCoverage=87%, HitCoverage=14%, E-value=5e-17, Identity=51%"; Hit description =Succinate dehydrogenase [ubiquinone] flavoprotein subunit 1, mitochondrial precursor
MWRCVARAIRVPASERSIPNHQPLRSHISRFFSGGGGGGSSSYNVVDHKYDAVVVGAGGAGLRAAIGLSEHGFNTACITKLFPTRSHTVAAQVPDLHMHVTCLS

SEQ ID NO: 214288 - protein, 455 aa, Glycine max
  Coding DNA Sequence Number=SeqID_97510
  Gene Ontology: Mol. function=monooxygenase activity; Cellular component=integral to membrane; Biological process=electron transport
  Homolog annotation: Hit_ID=A0A1W4; Match level="QueryCoverage=97%, HitCoverage=91%, E-value=0.0, Identity=70%"; Hit description=Steroid 22-alpha-hydroxylase
  Pfam annotation: Domain name=p450; Domain location=1-450; Score =122.5; E_value=1.2e-33; Accession=PF00067.12; Description=Cytochrome P450
MGWPLLGETIGYLNPYPAVTLGEFMENHIARYGKIYKSNLFGGPAIVSADAGLNRFILQNDGKLFEISYPKSIRDILGKWSMLVLVGDMHKEMRNISLNFLSNAKLRTHLVKEVERHALLVINSWNNNSTFSALQEAKKFTFNFMAKRIMSLEPGNPETGQLRREYVSFMKGVVSTAPLNLPGTAYRKALKSRGAVKKIIEGKMEERNKRIQKGNASLEEDHDLLSWVMTHTNLSNEQILDLVLSLLFAGHETSSVAIALAIYFLPGCPRAIQQLREEHVEIVTSKKQTGEVELTWDDYKRMEFTHCVVNETLRLGNVVRFIHRKAIKDVHYKGYDIPCGWKVLPVVSAVHLDPALFDQPHQFNPWRWQDKNKSGSCENANVNMNLMAFGGGPRMCAGSELGKLEMAVFIHHLILNYNWELVGEDQPIAYPYVDFPKALPIKVQTHSSKHSSFSS

SEQ ID NO: 214289 - protein, 497 aa, Glycine max
  Coding DNA Sequence Number=SeqID_97511
  Gene Ontology: Mol. function=oxidoreductase activity, acting on the CH-CH group of donors; Cellular component=mitochondrion; Biological process=tricarboxylic acid cycle
  Homolog annotation: Hit_ID=Q6ZDY8; Match level="QueryCoverage=99%, HitCoverage=79%, E-value=0.0, Identity=88%"; Hit description =Succinate dehydrogenase [ubiquinone] flavoprotein subunit, mitochondrial precursor
  Pfam annotation: Domain name=FAD_binding_2; Domain location=1-346; Score=423.5; E_value=2.9e-124; Accession=PF00890.14; Description=FAD binding domain
  Pfam annotation: Domain name=Succ_DH_flav_C; Domain location=398-497; Score=167.6; E_value=3.2e-47; Accession=PF02910.10; Description =Fumarate reductasesuccinate dehydroge
  Pfam module annotation: Pfam domain module=FAD_binding_2::Succ_DH _flav_C; Domain location=1-346::398-497
MTEDDWRWHMYDTVKGSDWLGDQDAIQYMCREAPKAVIELENYGLPFSRTEDGRIYQRAFGGQSLNFGKGGQAYRCACAADRTGHALLHTLYGQAMRHNTQFFVEYFALDLLMNSDGTCQGVIALNMEDGTLHHFQASSTILATGGYGRAYFSATSAHTCTGDGNAMVARAGIPLEDLEFVQFHPTGIYGAGCLITEGSRGEGGILRNSEGERFMERYAPTAKDLASRDVVSRSMTMEIREGRGVGPLKDHIYLHLNHLPPDVLKERLPGISETAAIFAGVDVTKEPIPVLPTVHYNMGGIPTNHHGEVITIKGDDPDAVVPGLMAAGETACASVHGANRLGANSLLDIVVFGDKNAPVSRFAGEKQKPLEKDAGMKTIAWLDKLRNSNGSLPTSKIRLNMQRIMQNNAAVFRTQETLEEGCQLIDKAWESFHDVKLKDRSLIWNSDLIETIELENLLINACITMHSAEARKESRGAHAREDFTKRDDEKWMKHTLG

SEQ ID NO: 214290 - protein, 96 aa, Glycine max
  Coding DNA Sequence Number=SeqID_97512
MENSSSPKGQSKTLFYLFPEQLQVQYALEAIGICGTNNVVLGVEKKSTAKLLDSSNSSIFGQDVLDIVSDIVDPATSILHLTLYLALCIVQPDLIP

SEQ ID NO: 214291 - protein, 397 aa, Glycine max
  Coding DNA Sequence Number=SeqID_97513
  Gene Ontology: Mol. function=transporter activity; Cellular component= intracellular; Biological process=transport
  Homolog annotation: Hit_ID=Q1S4E3; Match level="QueryCoverage=70%, HitCoverage=96%, E-value=1e-130, Identity=80%"; Hit description =Cellular retinaldehyde-binding/triple function, N-terminal
  Pfam annotation: Domain name=CRAL_TRIO; Domain location=193-366; Score=83.0; E_value=9.5e-22; Accession=PF00650.10; Description =CRALTRIO domain
  Pfam annotation: Domain name=CRAL_TRIO_N; Domain location=106-180; Score=33.7; E_value=6.6e-07; Accession=PF03765.5; Description =CRALTRIO, N-terminus
  Pfam module annotation: Pfam domain module=CRAL_TRIO::CRAL_TRIO_N; Domain location=193-366::106-180
MCQVTIFLSFVLCLLPLSIVRNDTRVGVCVKRDFNAAKRSVKLLRVIADSAECTVRIGCLIPVLTFSSVNGSVSEEKKNKIEIQNVDILRLCWELVPLVIIMFLLRRQTQNNQENDSSYQDTKVAELKTGLGPLSGRRLKYCTDACLRRYLEARNWNVDKAKKMLEETLKWRATYKPEEIRWAEIAHEGETGKVSRANFHDRLGRTVLIMRPGMQNTTSAEDNIRHLVYLLENAILNLSEGQEQMSWLIDFTGLSLSTNMSVKTSRDIIHILQNHYPERLAIAFMYNPPRIFQAFWKAIRFFLDPKTVQKVKFVYPNNKDSVELIKSLFPTENLPSEFGGKTSLNYDHEEFSRLMTEDDVKTAKFWGLDEKPFNPPKKGHSGAEVAPEPVPVEAVVS

SEQ ID NO: 214292 - protein, 107 aa, Glycine max
  Coding DNA Sequence Number=SeqID_97514
MARRRHVLMVEAIQAIREMVAVMLQQTNQRNEEVAEFQGLSEFKRNNPSEFVGGYGPEKADLWIQEMEKIFCAMTCTNRQKEDINDALSVEDAKRDVVDIEESRTKW

SEQ ID NO: 214293 - protein, 60 aa, Glycine max
  Coding DNA Sequence Number=SeqID_97515
MNVEVCQCVLNVEVESLQHFNIEKVFNMNNGFTFRVDGGGIYGDDGHGRNNVLVGVYQGS

SEQ ID NO: 214294 - protein, 47 aa, Glycine max
  Coding DNA Sequence Number=SeqID_97516
MKKERTPEGGITRITRWDVVKGGMMMRKGSRGAMVMVVVAEEEEACW

SEQ ID NO: 214295 - protein, 502 aa, Glycine max
  Coding DNA Sequence Number=SeqID_97517
  Gene Ontology: Mol. function=ATPase activity, coupled to transmembrane movement of ions, phosphorylative mechanism; Cellular component=integral to membrane; Biological process=phospholipid transport
  Homolog annotation: Hit_ID=P98204; Match level="QueryCoverage=94%, HitCoverage=41%, E-value=0.0, Identity=68%"; Hit description =Phospholipid-transporting ATPase 1
  Pfam annotation: Domain name=E1-E2_ATPase; Domain location=146-433; Score=-117.2; E_value=0.0095; Accession=PF00122.10; Description=E1 -E2 ATPase
  Subcellular localization annotation: CTP_CleavageSite=54; ConfidenceScore=5.56e-01
MDPKTPYENSSNFDSFMFNSSSPRSDMSIQSRSSGRDNSTREVSFGHTGSKPVRHGSNSEGLSMSQKEISDEDARLVYVDDPEKTNERLKFAGNSIRTGKYSIFTFLPRNLFEQFRRVAYIYFLVIAILNQLPQLAVFGRGVSIMPLTFVLVVTAVKDAFEDWRKHRSDKIENNRLALVLVNGQFQEKKWKDVRVGEVIKISANETIPCDIVLLSTSDPTGVAYVQTINLDGESNLKTRYTKQETQSMFPEKERLNGLIVCEKPNRNIYGFQGYMEIDGKRLSLGSSNIVIRGCQLKNTNWALGVAVYCGRETKAMLNSSGAPSKRSLLETRMNSEIIMLSFFLIALCTVTSVCVAVWLKRHKDELNLSPYYRKMDVSEGEEDSYKYYGWVLEIVFTFLMSIIVFQIMIPISLYISMELVRVGQAYFMIRDSRMYDKATDSGFQCRALNINEDLGQIKYVFSDKTGTLTENKMEFQCASILGFDYSSAKMGPENEQVEYSVQ

SEQ ID NO: 214296 - protein, 52 aa, Glycine max
  Coding DNA Sequence Number=SeqID_97518
  Gene Ontology: Mol. function=RNA polymerase II transcription factor activity; Cellular component=transcription factor TFIID complex; Biological process=transcription initiation from RNA polymerase II promoter
  Homolog annotation: Hit_ID=Q6JAE2; Match level="QueryCoverage=89%, HitCoverage=16%, E-value=4e-11, Identity=72%"; Hit description=TATA sequence-binding protein 2
MVAKVCTGAKSEQQSKLAARKDFKIQIIVGSCDVKFPICWRVLHIPMVLSQV

SEQ ID NO: 214297 - protein, 332 aa, Glycine max
  Coding DNA Sequence Number=SeqID_97519
  Gene Ontology: Mol. function=oxidoreductase activity, acting on paired donors, with incorporation or reduction of molecular oxygen; Cellular component=integral to membrane; Biological process =carotenoid biosynthetic process
  Homolog annotation: Hit_ID=Q9FGZ1; Match level="QueryCoverage=91%, HitCoverage=44%, E-value=1e-130, Identity=73%"; Hit description =Phytoene dehydrogenase-like
MFCTVHTKSVNIMLFIPCRYVEGGMGSISKAIGNAAIEAGAHVVTNAEVSRLLIENSSTVCGVALADGTEVHSSIVLSNATPYKTFMELVSNDVLPDDFVRAIKHTDYSSATTKINVAVDKLPEFHCCKLEHPHAGPQHVATIHIGSESMEEIHSACQDAVNGVPSRRPVIEMSIPSILDKTISPPGKHVINLFVQYTPYKPLDGDWQDHDYRVSASLYLIYPPIQESFAQKCFTLIDEYAPGFSTSVIGYDMLTPPDLEREIGLTGGNIFHGAMGLDSLFLMRPAKGWSNYKTPLKGLYLCGSGAHPGGGVMGAPGRNAARLVLQEVGERT

SEQ ID NO: 214298 - protein, 159 aa, Glycine max
  Coding DNA Sequence Number=SeqID_97520
  Gene Ontology: Mol. function=transporter activity; Cellular component= coated vesicle membrane; Biological process=intracellular protein transport
  Homolog annotation: Hit_ID=Q8VZ37; Match level="QueryCoverage=85%, HitCoverage=81%, E-value=6e-54, Identity=81%"; Hit description =Putative clathrin coat assembly protein
  Pfam annotation: Domain name=Clat_adaptor_s; Domain location=20-152; Score=112.1; E_value=1.6e-30; Accession=PF01217.10; Description =Clathrin adaptor complex small chain
KKQDDKSSAGVEHAGEASSRQILRISDQSVEKQHDAIRNVFSVLCSRPEHVSNFVDAESFFGPDSRLVYKHFATLYFVFIFDSSENELAMLDLIQVLVETLDKCFRNVCELDIVFNYSKMHTILDEIILGGQVLETSSNEPSARIIRCKVNDFPGYSRD

SEQ ID NO: 214299 - protein, 344 aa, Glycine max
  Coding DNA Sequence Number=SeqID_97521
  Gene Ontology: Mol. function=sugar porter activity; Cellular component=integral to membrane; Biological process=carbohydrate transport
  Homolog annotation: Hit_ID=Q93YP9; Match level="QueryCoverage=99%, HitCoverage=75%, E-value=1e-117, Identity=59%"; Hit description =Sugar transporter ERD6-like 4
  Pfam annotation: Domain name=MFS_1; Domain location=2-303; Score= -22.9; E_value=0.0035; Accession=PF07690.6; Description=Major Facilitator Superfamily
  Pfam annotation: Domain name=Sugar_tr; Domain location=1-343; Score =141.6; E_value=2.2e-39; Accession=PF00083.14; Description=Sugar (and other) transporter
  Pfam module annotation: Pfam domain module=MFS_1::Sugar_tr; Domain location=2-303::1-343
SLIFAAVPNIFGWLAISIAKDTSLLFMGRLLEGFGVGIISYVVPVYIAEVSPRTMRGSLGSVNQLSVTIGIMLVYLLGLFVNWRVLAILGVIPCAVLIPGLYFIPESPRWLAEMGMLEKFEASLQTLRGPNVDITMEAQEIQVGIGLLVLQQLTGINGVFFYSSKIFASAGISSSDAATFGLGAMQVVMTGIATSLVDRSGRRMLLILSSSIMTLSLLLVATTFYLEGVATDDSNVHEILAMLSVMGLLALVIGFSLGIGPIPWIIMSEILPPNIKGLAGSAATFLNWFTASVITMTANLLLHWSSSGTFTIYAIFSAFTVAFSILWVPETKDRTLEEIQASFY

SEQ ID NO: 214300 - protein, 146 aa, Glycine max
  Coding DNA Sequence Number=SeqID_97522
  Gene Ontology: Mol. function=hydrolase activity; Biological process =aromatic compound metabolic process
  Homolog annotation: Hit_ID=Q672Q0; Match level="QueryCoverage=79%, HitCoverage=84%, E-value=2e-25, Identity=54%"; Hit description =Alpha/beta fold family protein
MASWIGAAMNNDNDPYRTREAGGSTEAIATLPHEDGSWGEALHRDEFLGTLRHHNEAEEKVREAQNHHEPQQARGGSGAWQYKVGALTKKYAVYVPDLVFFGGVSSAVCGTSMGEWWRLRWLGCTLKWLKRWLSQGSSGPPYIYQV

SEQ ID NO: 214301 - protein, 103 aa, Glycine max
  Coding DNA Sequence Number=SeqID_97523
MAKYQSAAAVHVVVNCEWRYAQMNWRDPEPVEWEREEKECNGFGHWVVKSGHVTVGNSILRSRGFISVSNPIPIKKTSVCIRITAIPQGKWNSTSLLSLTLPS

SEQ ID NO: 214302 - protein, 252 aa, Glycine max
  Coding DNA Sequence Number=SeqID_97524
  Gene Ontology: Mol. function=sequence-specific DNA binding; Cellular component=nucleus; Biological process=regulation of transcription, DNA-dependent
  Homolog annotation: Hit_ID=Q8LC79; Match level="QueryCoverage=97%, HitCoverage=93%, E-value=6e-41, Identity=38%"; Hit description=GATA transcription factor 19
  Pfam annotation: Domain name=GATA; Domain location=135-170; Score =74.1; E_value=4.6e-19; Accession=PF00320.17; Description=GATA zinc finger
MMHHCCGSSQGHVMGTCTCGMYHNHNSSEASSYGSMLFSMPNNNEYYQEHDIYSSFTPSHSSVDCTLSLGTPSTRLTQDEDDNKRHRHQRRSGVTSFCWDLLHSNHNNNNITQSQSKSSSRGSNNNNDSLLARRCANCDTTSTPLWRNGPRGPKSLCNACGIRFKKEQRRASAAGATSASAAVPGGAMESARVYGHHHNNSWYAHSQSQKMMGNELRFMDDSDDRDSDNNGIPFLSWKLNIPDRTSLVDERW

SEQ ID NO: 214303 - protein, 204 aa, Glycine max
  Coding DNA Sequence Number=SeqID_97525
  Homolog annotation: Hit_ID=Q2R2S2; Match level="QueryCoverage=89%, HitCoverage=87%, E-value=7e-65, Identity=67%"; Hit description=Maf family protein, putative, expressed
  Pfam annotation: Domain name=Maf; Domain location=8-204; Score=99.1; E_value=1.3e-26; Accession=PF02545.5; Description=Maf-like protein
MATKNPPFKIILGSSSKARKEILAEMGYEFAIMTADIDEKGIRREKPEDLVMALAEAKADAIVQRLPVGGPLEEDASTTLLITADTVVVYRGVIREKPTSEKEAHEFIKGYSGSHAAVVGSIVVTNLATGKRCGGWDSAEVYFLEIPDEVIDSLIDEGITFNVAGGLMLEHPLTLPFVDAVVGSTDTVMGLSKALTEKLLLEAL

SEQ ID NO: 214304 - protein, 316 aa, Glycine max
  Coding DNA Sequence Number=SeqID_97526
  Gene Ontology: Mol. function=hydrolase activity; Biological process =aromatic compound metabolic process
  Homolog annotation: Hit_ID=Q8LAL3; Match level="QueryCoverage=99%, HitCoverage=99%, E-value=1e-105, Identity=60%"; Hit description =Putative hydrolase
  Pfam annotation: Domain name=Abhydrolase_1; Domain location=89-303; Score=69.9; E_value=8e-18; Accession=PF00561.10; Description =alphabeta hydrolase fold
  Pfam annotation: Domain name=Abhydrolase_2; Domain location=48-208; Score=-77.8; E_value=0.053; Accession=PF02230.7; Description =PhospholipaseCarboxylesterase
  Pfam annotation: Domain name=PGAP1; Domain location=58-219; Score= -88.4; E_value=0.036; Accession=PF07819.3; Description=PGAP1-like protein
  Pfam module annotation: Pfam domain module=Abhydrolase_1::Abhydrolase_ 2::PGAP1; Domain location=89-303::48-208::58-219
MVNLVVAQRPLLHGLMKMAGIRPYTVEIEPGTTMSFWVPSETITKPKKKDEKPRIRAKPSKPAVILVHGFAAEGIVTWQFQVGALTKKYAVYVPDLLFFGGSTTDKAERSPRLQAECLVAALRKLGVEECVVVGFSYGGMVAFKMAEMYPEMVQGLVISGSILAMSESLSASSLQELGVSSSSELLLPTSVKGLKALLSIAAHKKLWFPNRLHKDYLEVMFTNRKERSELLEGLVITNRDVTIPNFPQRIHLLWGENDRIFKLELAQSMKEQLGNGATFEGIKKAGHLVHLERPCVYNRCLKHIIASFLDSNEPKK

SEQ ID NO: 214305 - protein, 232 aa, Glycine max
  Coding DNA Sequence Number=SeqID_97527
  Gene Ontology: Mol. function=sugar porter activity; Cellular component=integral to membrane; Biological process=carbohydrate transport
  Homolog annotation: Hit_ID=Q93YP9; Match level="QueryCoverage=93%, HitCoverage=42%, E-value=1e-84, Identity=74%"; Hit description=Sugar transporter ERD6-like 4
MSFREESGDARDLQKPFLHTGSWYKMGSRQSSIMGSSTHVIRDGAVSVLFCVLIVALGPIQFGFTCGYSSPTQGAIVRDLNLSISEVLVLNMLSSLQFSFFGSLSNVGAMVGAIASGQIAEYIGRKGSLMIAAIPNIIGWLAISFAKDSSFLYMGRLLEGFGVGIISYVVPVYIAEIAPQHLRGGLGSVNQLSITIGIMLAYLLGLFVNWRVLAILGVNLIVDGKHEYDPGF

SEQ ID NO: 214306 - protein, 104 aa, Glycine max
  Coding DNA Sequence Number=SeqID_97528
  Gene Ontology: Mol. function=sugar porter activity; Cellular component=integral to membrane; Biological process=carbohydrate transport
  Homolog annotation: Hit_ID=Q93YP9; Match level="QueryCoverage=94%, HitCoverage=23%, E-value=1e-24, Identity=54%"; Hit description=Sugar transporter ERD6-like 4
MPLGEDYEDARNHRKPFININNNNNAGSGNLFVVLCVLIVALGPIQFGFTCGYSSPTQADMIRDLNLSISRFSLFGSLSNVGAMVGATVSGQLAEYFGRKGVLY

SEQ ID NO: 214307 - protein, 241 aa, Glycine max
  Coding DNA Sequence Number=SeqID_97529
  Gene Ontology: Mol. function=sugar porter activity; Cellular component=integral to membrane; Biological process=carbohydrate transport
  Homolog annotation: Hit_ID=Q39416; Match level="QueryCoverage=99%, HitCoverage=52%, E-value=1e-79, Identity=58%"; Hit description =Integral membrane protein
  Pfam annotation: Domain name=Sugar_tr; Domain location=4-240; Score= -125.0; E_value=0.0059; Accession=PF00083.14; Description=Sugar (and other) transporter
MGMTDEFETSLQVLRGFDTDISVEVYEIKRSVASTGKRATIRFADLKRKRYWFPLMGVGTWESETEEGISSSEAATVGLGAVQVIATGISTWLVDKSGRRLLLMISSSVMTVSLLIVSIAFYLEGVVSEDSHLFSMLGIVSVVGLVVMVIGFSLGLGPIPWLIMSEILPVNIKGLAGSIATMGNWLISWVITMTANLLLNWNSGGTFTIYTVVAAFTIAFIALWVPETKGRTLEEIQFSFR

SEQ ID NO: 214308 - protein, 126 aa, Glycine max
  Coding DNA Sequence Number=SeqID_97530
  Homolog annotation: Hit_ID=Q7RS68; Match level="QueryCoverage=44%, HitCoverage=47%, E-value=1e-10, Identity=46%"; Hit description =Drosophila melanogaster CG14903 gene product
  Subcellular localization annotation: CTP_CleavageSite=53; ConfidenceScore=5.54e-01
MACGIPLRLSAFPSTTIRATLPHLHAPSISSRPSPLSSNSMSQPATTNHADVVVQYVVLRRDLIDTWPLGSVVTQGCHASVSAVWFNKDDPFTVDYCSPDKIDSMHKSGFGLLTLLGGAFGQEQMF

SEQ ID NO: 214309 - protein, 334 aa, Glycine max
  Coding DNA Sequence Number=SeqID_97531
  Gene Ontology: Mol. function=DNA binding; Cellular component=nucleus; Biological process=regulation of transcription
  Homolog annotation: Hit_ID=Q9ZPW7; Match level="QueryCoverage=65%, HitCoverage=69%, E-value=6e-48, Identity=48%"; Hit description =Expressed protein
  Pfam annotation: Domain name=Homeobox; Domain location=271-331; Score= -7.2; E_value=0.028; Accession=PF00046.19; Description=Homeobox domain
  Pfam annotation: Domain name=ZF-HD_dimer; Domain location=111-170; Score=133.4; E_value=6.4e-37; Accession=PF04770.3; Description=ZF-HD protein dimerisation region
  Pfam module annotation: Pfam domain module=Homeobox::ZF-HD_dimer; Domain location=271-331::111-170
MDMREQDKVIEMPSTLGYNNSSSGSKLSSPIGERSSDQLPPHQSHTLVFTDPPQTSSHHHNLYPPSLPPNPLQLPQPHHRPRRDPDPSSIISPPIISTTPTTAPPQPHTTTTLFRYRECLKNHAASMGGHVTDGCGEFMPNGEEGTPESLKCAACECHRNFHRKEPHQGVLVESQLQHVLLNKNNRNINTIIHSPDSHHHLQFPTPHSHLHGGPPVVQPVMLGFGGSGPAESSSEDLNMFQTNDHGGGGNNLLLSSVQQQPPLLSSSSSKKRFRTKFTQQQKDRMMEFAEKLGWKIQKQDEQELHQFCSQVGVRRQVFKVWMHNSKQALKKKQM

SEQ ID NO: 214310 - protein, 69 aa, Glycine max
  Coding DNA Sequence Number=SeqID_97532
  Subcellular localization annotation: CTP_CleavageSite=54; ConfidenceScore=5.35e-01
MAAPATRRGIHVSTSFTHKDFHTRWAQGTTTPDTTATRPTNTFTHESKLAEVAVAKLAFNRGPNRRIGC

SEQ ID NO: 214311 - protein, 49 aa, Glycine max
  Coding DNA Sequence Number=SeqID_97533
MENEQFLIEQTWRSILERSNGIKPRNPNESFETSNNNLQIAPSIMHSIA

SEQ ID NO: 214312 - protein, 445 aa, Glycine max
  Coding DNA Sequence Number=SeqID_97534
  Gene Ontology: Mol. function=protein-methionine-S-oxide reductase activity; Biological process=protein metabolic process
  Homolog annotation: Hit_ID=Q9ZQB9; Match level="QueryCoverage=69%, HitCoverage=44%, E-value=2e-75, Identity=47%"; Hit description =Putative glucosyltransferase
  Pfam annotation: Domain name=Glycos_transf_2; Domain location=248 -433; Score=-19.0; E_value=0.067; Accession=PF00535.16; Description =Glycosyl transferase
MSRTPNYEFQEWWNKQREKNTTNTNNLDSLDSLDDNLKNLDHAHSPSSPPFTALDISSSSAADTSADHDHDRSGRKERSRSARQLSWVFLLKFQQLAANLGWLSNGLLFLLRTGQRRIATDSASFGDGGDTSRLYRAIRFFLITVLLLLVFELLAYFKGWHFSPPDPSDVLGVIGVVYSTWLDVRASYLSPPLQSLANLCTVLFIVQSVDRVVLILGCFWIKFRRLKPVASVDYDGPVQSVEDFPMVLVQIPMCNERERDFVGKVQMLWLDWSGIVRVYQQSIGAVCILDWPKERMLVQVLDDSDEVDTQQLIKAEVHKWQQRGARIIYRHRLIRTGYKAGNLKSAMNCDYVKDYEFVAIFDADFQPTPDFLKKTVPYFKSHLCKASILELEHMLMLHKHMLLNKEFGPHLIEHIKKSIEGVCQNSVKQKPFLGQGGVTHLSWQR

SEQ ID NO: 214313 - protein, 200 aa, Glycine max
  Coding DNA Sequence Number=SeqID_97535
  Gene Ontology: Mol. function=transferase activity; Biological process= protein metabolic process
  Homolog annotation: Hit_ID=Q8LIY0; Match level="QueryCoverage=86%, HitCoverage=24%, E-value=2e-52, Identity=62%"; Hit description =Putative CSLC9
MFLPEAELPAWVVCYIPGIMSLLSVLPAPRSFPFIVPYLLFENTMSVTKFNAMISGLLRFGSSYEWVVTKKLGRSSETDLVAFEKEAEPLMRSNSLHRSSSDSGIEELSKLELSKKTGKTKKNRLFRKELYLAFILLAASVRSLLSAQGIHFYFLLFQGISFLVVGLDLIGEQAVRFWAHLSANMCSSFTINFIGCIYHS

SEQ ID NO: 214314 - protein, 78 aa, Glycine max
  Coding DNA Sequence Number=SeqID_97536
MEGFKRGRGSHIETQYRVSPEILCTRGVPLVARRRPGGKREKLPNVVAESGRCVCVGIFGRFDWYDGWDLYLVVDLTV

SEQ ID NO: 214315 - protein, 188 aa, Glycine max
  Coding DNA Sequence Number=SeqID_97537
  Gene Ontology: Mol. function=RNA-directed DNA polymerase activity; Biological process=RNA-dependent DNA replication
MAPMLDIATPIPFAMLQQLEIGWGLERRNDTTTNPRQEQVGVQMKLVGRSLYKKPYQEWINKIAPLSRGYKILDFTTFSSKDGKSTMEHVSCFTNGKSTMENWRAILGNRRAGHRRLEILRQDFVWNGSPPANMGTDRSLGDSSRASMSVGLDPIELEGGSIRRRQRLARRRDKKFKGDVRNLLGQLN

SEQ ID NO: 214316 - protein, 75 aa, Glycine max
  Coding DNA Sequence Number=SeqID_97538
GTLGRFSAFSLPTRDPVHPLKRIGSLVSVGGHLTPSKCDTMHSPFISMGLIEASARAKGKANAPDTTGIYLDYFQ

SEQ ID NO: 214317 - protein, 67 aa, Glycine max
  Coding DNA Sequence Number=SeqID_97539
MMAHQNPPYLAFCTPGQNETKNKIQGYQRETNKNIHIFLSEHQGMKGMDLESGSMQRLTSSSAPFVN

SEQ ID NO: 214318 - protein, 67 aa, Glycine max
  Coding DNA Sequence Number=SeqID_97540
  Subcellular localization annotation: CTP_CleavageSite=37; ConfidenceScore=5.09e-01
MWEKLASPSMVQVSYKSISSTFILRLEAAHPRSLPLSSSKVSSGVGVGLWWGWVLVGGVFQCGWGCI

SEQ ID NO: 214319 - protein, 172 aa, Glycine max
  Coding DNA Sequence Number=SeqID_97541
  Gene Ontology: Mol. function=unspecific monooxygenase activity
  Homolog annotation: Hit_ID=O04892; Match level="QueryCoverage=78%, HitCoverage=46%, E-value=2e-23, Identity=51%"; Hit description =Cytochrome P450 like_TBP
GPAAGRAPHVAWCPVRPRRPLKIRRTECLPRPVVLITASGLQGEQPLVDGTIPEPVGCRWTARAASAARAGRRVPVGGRIGNGPFGASSPGVEQSTQNCALNVKVKKFNQARIPTVPVYYPAKPQPRERAWRNQRGKEDPVELDSSPTFGALPLFLDPRSASAGRSGPEDIV

SEQ ID NO: 214320 - protein, 37 aa, Glycine max
  Coding DNA Sequence Number=SeqID_97542
QAGAVLVLQLAKTAQLVTVKGASSAALRIAIAKNAEL

SEQ ID NO: 214321 - protein, 241 aa, Glycine max
  Coding DNA Sequence Number=SeqID_97543
  Gene Ontology: Mol. function=aminoacyl-tRNA ligase activity; Cellular component=membrane fraction; Biological process=alanyl-tRNA aminoacylation
  Homolog annotation: Hit_ID=Q1H3U9; Match level="QueryCoverage=100%, HitCoverage=27%, E-value=1e-104, Identity=78%"; Hit description =Alanyl-tRNA synthetase
MARQKEQARAAGKFKMALNLEYEGAATTFHGYDKLETPAKVLALYKDGSAVQTLNEGDLGVVVLDHTPFYAESGGQIGDSGELKSANGIFAVEDTQKIQAAVFGHHGVLKTGTLSVGDDLTAKVNLQARASTMRNHSATHLMHKALREVLGEHVQQKGSLVDTEKTRFDFVHNAPITDAEIAKVEALVNAEILANVATQARLMDIESAQKTGAMMLFGEKYGDEVRVLDIGSSRELCGGTH

SEQ ID NO: 214322 - protein, 452 aa, Glycine max
  Coding DNA Sequence Number=SeqID_97544
  Gene Ontology: Mol. function=transporter activity; Cellular component= membrane; Biological process=transport
  Homolog annotation: Hit_ID=Q0X6P2; Match level="QueryCoverage=63%, HitCoverage=81%, E-value=1e-102, Identity=66%"; Hit description =Inner-membrane translocator
RAEDAADHRTQAADDDHEQQLQRAVQAEGRRFPGTQVNEAPQRAGHADDEAAHGKGAELGVGRADADHAGGHVHVAHGHPFAADGAAHQVLGGQAQQAQDAQAQQVLFHGRVDLPAHDGQRARAHRARGGVVRHPGGAAGQPVHEELGGQRGHGQVQAADAQAGQAEDHAEDHGQHAATDQGHQQRHALETHLQVVGRIRAHRHEGARAQRDLAAVAHQDVQADGGQRQDQERNQDGAQQVVAGQRRDGDERHRQQQPDEDAVLADREDLLVGAIAGLELAVFAIEHVFIPECLRSDAVDDLLAEQPLRTEQQEHQRQHIGEPDFDAAAHQRPQVDLGQLFAHADDQAAENGARHRGQAAQDHHRQRPQRRGRERELHAELGAPDDAGHQRHQAGDAPDDDPDAVQRNADGLRRLVVVRHRAQGAAGGGELEEQRQRRYQQCGDDGGGEVFE

SEQ ID NO: 214323 - protein, 108 aa, Glycine max
  Coding DNA Sequence Number=SeqID_97545
  Subcellular localization annotation: CTP_CleavageSite=43; ConfidenceScore=5.21e-01
MHGHAGKPPLSLVELATSAGDSGDAFLNRQSNWRFCFAGGAVSRSKRRHAGFFRERGVATPPGDLLASCHSSWRFRTEKIVNPVGDLGPINTKKNFSLTITALSFLKL

SEQ ID NO: 214324 - protein, 69 aa, Glycine max
  Coding DNA Sequence Number=SeqID_97546
MVQCRSEDANISGKGAGGDVIHCLLSCFDSYGYQMRLFRSVGSKDAHISGKGAGDDVSHWLLSCFESYG

SEQ ID NO: 214325 - protein, 300 aa, Glycine max
  Coding DNA Sequence Number=SeqID_97547
  Gene Ontology: Mol. function=oxidoreductase activity; Cellular component=endoplasmic reticulum; Biological process=electron transport
  Homolog annotation: Hit_ID=Q3SIJ8; Match level="QueryCoverage=99%, HitCoverage=85%, E-value=4e-98, Identity=61%"; Hit description =Putative NADH-dependent flavin oxidoreductase
  Subcellular localization annotation: CTP_CleavageSite=3; ConfidenceScore=5.63e-01
MPRASATMSACPCARMSSACCFSVIKPTVMFGATGIFRNGETPPLETSMNSQPNSLSRSANASVCAGSQPPSTQSVADTRTPSATDEGVTSRIARNTFQREAHAVFQRAAVVVVALVGQRRQELVQQIAMGRMQLDGVETQADGAASAVDEGVAHPRQAGRVERARRRLGRLVRQRRRRPALPAALLRRHQLAALPGRMARRLAAGVAQLDTELDRRIAPHRLHHAAQRGFGLVGPEAQVARGNAAIGLDRGRLGKQQRRAGQGQVAQVDHVPVGGAALVGRVFAHGRDDDAVGQFELAD

SEQ ID NO: 214326 - protein, 93 aa, Glycine max
  Coding DNA Sequence Number=SeqID_97548
MIMRGQDIYSSQDKATTLPSSSESEKAKGEESSVEIYPQEEGQPLVVKEKCKETLASIATPLGLEFIPQVKKLLDEDLVRKSLNPCALLVPKI

SEQ ID NO: 214327 - protein, 156 aa, Glycine max
  Coding DNA Sequence Number=SeqID_97549
  Homolog annotation: Hit_ID=Q1SKD7; Match level="QueryCoverage=88%, HitCoverage=44%, E-value=3e-07, Identity=25%"; Hit description =Ankyrin
SRIDATGEGSSAASEFDSHRFRSAEHQERRVQLREDEYTDFQEEIARRHWTPLETPMAKFDPEIALEFYVNAWPAEEGVRDMHSWVRGQWIPFDADALSQRSKADGLVEEAIAQLLCIPGQDFSRTAAGRRVRIMRTSMATLTQTMDDIAAQQCVA

SEQ ID NO: 214328 - protein, 94 aa, Glycine max
  Coding DNA Sequence Number=SeqID_97550
MGLNIEKLKNIVISLEMATTVEVEVRKVVVVSEPMVVVEVQERMTLRLANCIVMAFYTERQNYSFSYRWCPTKGSIAWPIMSGTSSRVTVVGCA

SEQ ID NO: 214329 - protein, 245 aa, Glycine max
  Coding DNA Sequence Number=SeqID_97551
  Gene Ontology: Mol. function=chitin binding; Cellular component =extracellular region; Biological process=chitin metabolic process
  Homolog annotation: Hit_ID=UPI000044A8F0; Match level="QueryCoverage =82%, HitCoverage=99%, E-value=2e-14, Identity=26%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MSKSCGFGMTGPLDELISCFLIRVDPWVLVPITFRGLHVLALRGLHVLAIRGLHVLAIRGLHVLAIRGLHALTSRGLPVLALRGLHALTLDISYPHQGLHALTFRGLHVLALRGLHALTLGTCTYHLERTTCPPHQRTACPQLERTTCPRHHRTSCPRLERQHVLTFRGLHALTSRGLRVLALRGLHALTLGTSYPQRQRTARPRLERTTRPHHQRAARPYLQRTTCPRLERATRPHLGYYFTLT

SEQ ID NO: 214330 - protein, 92 aa, Glycine max
  Coding DNA Sequence Number=SeqID_97552
  Subcellular localization annotation: CTP_CleavageSite=54; ConfidenceScore=5.61e-01
MNGESFWVMASTTPTWVSLGTSGKVIRASRNISSHLHVNTFFVKASGQVPTFARSMIISSHNQGMGGGVKEDKMAKPQPPPRVRLKTIKKHS

SEQ ID NO: 214331 - protein, 79 aa, Glycine max
  Coding DNA Sequence Number=SeqID_97553
  Gene Ontology: Mol. function=RNA-directed DNA polymerase activity; Biological process=RNA-dependent DNA replication
  Homolog annotation: Hit_ID=Q1SAS4; Match level="QueryCoverage=98%, HitCoverage=5%, E-value=2e-17, Identity=44%"; Hit description=RNase H, putative
MEVVLPFEVEIHSLIILVELGSEEAEWAQARFDQLNLIEVPQVQKDHRGKWAPNYEGSFVVNKAFSGGALLLMNMDDEE

SEQ ID NO: 214332 - protein, 192 aa, Glycine max
  Coding DNA Sequence Number=SeqID_97554
  Homolog annotation: Hit_ID=Q1SKD7; Match level="QueryCoverage=88%, HitCoverage=44%, E-value=2e-11, Identity=26%"; Hit description =Ankyrin
MALKKLLAKKARKATTGEGSSAAPQAEIEFDGHHFRSEEHQHRFKVISDWSFLKERQVQLREREYTEFQVEVSRRQWTQLIEPMAKYDPEIVMEFYANTWLTKERVMDKRSWVRGQWIPYDEDAINQFLGHALVLEKGQHCEYTKRRSQVLGFDEEAIGQQLCFPGQDFARSVTGRRVRIMRTSMTTLTQIG

SEQ ID NO: 214333 - protein, 333 aa, Glycine max
  Coding DNA Sequence Number=SeqID_97555
  Homolog annotation: Hit_ID=P24188; Match level="QueryCoverage=48%, HitCoverage=45%, E-value=2e-78, Identity=80%"; Hit description =UPF0176 protein yceA
  Pfam annotation: Domain name=Rhodanese; Domain location=1-80; Score =45.3; E_value=2e-10; Accession=PF00581.10; Description=Rhodanese -like domain
MRKHYEYEVGHFENAIEVPSDTFRDQLPMAVEMLQDSKDKNIVMYCTGGIRCEKASAYMLHNGFKNIYHVEGGIIEYARKAKEQGLPMKFIGKNFVFDERMGERISDDVIANCHQCGAPCDTHTNCKNDGCHLLFIQCPSCAAKFEGCCSEICREELKLPREEQRARRAGRENGPGRQAGLFYLFLAHAFYGDDQLNVLRRRAQIGGDAEIFQLDLAVGFKAGAVAAPRIVALANQFGVQRNRFGHAVQRQVTDHCITVAAFLHFGGFKLGLLVLLHVEELGAAQVLVAFGVVGVDAGGIDGHVDFVLGRIFFVEGEAAVEVFKAAVQPAVAQ

SEQ ID NO: 214334 - protein, 48 aa, Glycine max
  Coding DNA Sequence Number=SeqID_97556
MEESGIFFMEDAPMSLASLTCERGPYTQVPGNLRSGGESMVMLGLQLA

SEQ ID NO: 214335 - protein, 199 aa, Glycine max
  Coding DNA Sequence Number=SeqID_97557
  Gene Ontology: Mol. function=oxidoreductase activity; Biological process=electron transport
  Homolog annotation: Hit_ID=Q2NXX7; Match level="QueryCoverage=83%, HitCoverage=52%, E-value=6e-47, Identity=52%"; Hit description=FMN oxidoreductase
  Pfam annotation: Domain name=Oxidored_FMN; Domain location=1-177; Score=-165.7; E_value=0.015; Accession=PF00724.10; Description =NADH:flavin oxidoreductase  NADH oxid
MPRSGTQELDEARIAEVIAAFAASAVRAERLGFELIELHAAHGYLLHPVPVAAEQPPHRWLWWLAAEPACALLVEVFDASEALAQVLDARGCNFLHVSSGGLDERQKITVGPGYQVPFAAAIKAKVRMPVIAVGMITEPEQAESILRHRHADAVALARGILYDPRWPWHATAALRDSVEPAPQYLRCEPRDARGVFKAR

SEQ ID NO: 214336 - protein, 151 aa, Glycine max
  Coding DNA Sequence Number=SeqID_97558
  Subcellular localization annotation: CTP_CleavageSite=21; ConfidenceScore=5.18e-01
MKNGGKSSRNRPRKRLGSITKASRLGFSSRKIFFSLSLSESQIPGGGKEGGGCRPPRPEELYELRNDTCFLSVMSRNFTDYATIPPLTSGMLQNFMDCAIMLPFDSRHVAELHGLPNDGCQVPRSGQVKVASHQTDGPRMKLGYDTKVTYL

SEQ ID NO: 214337 - protein, 461 aa, Glycine max
  Coding DNA Sequence Number=SeqID_97559
  Gene Ontology: Mol. function=protein serine/threonine kinase activity; Cellular component=integral to membrane; Biological process=protein amino acid phosphorylation
  Homolog annotation: Hit_ID=Q2HV99; Match level="QueryCoverage=96%, HitCoverage=60%, E-value=1e-120, Identity=52%"; Hit description =Protein kinase; Type I EGF
  Pfam annotation: Domain name=EGF_CA; Domain location=17-59; Score =33.9; E_value=5.6e-07; Accession=PF07645.6; Description=Calcium binding EGF domain
  Pfam annotation: Domain name=Pkinase; Domain location=138-414; Score =174.7; E_value=2.3e-49; Accession=PF00069.15; Description=Protein kinase domain
  Pfam annotation: Domain name=Pkinase_Tyr; Domain location=138-408; Score=133.5; E_value=6e-37; Accession=PF07714.7; Description=Protein tyrosine kinase
  Pfam module annotation: Pfam domain module=EGF_CA::Pkinase::Pkinase _Tyr; Domain location=17-59::138-414::138-408
MTKNRKSSIYKGTTNDDIDECKTTNHTCISQNNCLNTNGSYECFCPKGRSGNGKKEEGCHQKDVTKVVIGVAAGIVILCVGTTSLYLIYQKRKLNKLRQKYFQQNGGSILLQKLSTRENSSQIQIFTQQELKKATNNFDESLIIGKGGFGTVFKGHLADNRIVAIKKSKIVDKSQSEQFANEVIVLSQINHRNVVKLLGCCLETEVPLLVYEFVNNGTLFDFIHTERKVNDATWKTRVRIAAEAAGALSYLHSEASIPIIHRDVKSANILLDDTYTAKVSDFGASRFIPLDQTELATIVQGTIGYLDPEYMQTSQLTEKSDVYSFGAVLVEMLTGEKPYSFGRPEEKRSLANHFLCCLKEDRLFDVLQVGILNEENEKEIKKVAILAAKCLRVNGEERPSMKEVAMELEMHQWINTDPNVKETDYLVHEASSNIYEPGDSSCHQEYDSITDQIPPALGDGR

SEQ ID NO: 214338 - protein, 78 aa, Glycine max
  Coding DNA Sequence Number=SeqID_97560
MGLMAMLMRMQLALIQVVLVIVLARMGTVAVNQTLLGCPSTCGSVPIPNPFGIGKSSETGDNCFLEGALELTCDDGTN

SEQ ID NO: 214339 - protein, 224 aa, Glycine max
  Coding DNA Sequence Number=SeqID_97561
  Homolog annotation: Hit_ID=Q2HVJ8; Match level="QueryCoverage=32%, HitCoverage=15%, E-value=4e-30, Identity=86%"; Hit description =Nuclear protein SET
MLLKHLESSLLATAVALRYTLPMPMPLATLNFGSIIFAEFRNADCVRAMLQKKKHHQLRTVLCRRCRLLSHGKMITVVGGHGGYLGGKLFATAEELREKLSHLRHEKALIVKLELLYLYGFVIDDNTDDYLMVHYPTETINTISFSESKTQLLEMQKAEMRCLLPKTSLDNGFFPLNTQNSEENNKSKADEDKARNKGKEPLEGLGGPMTRVRTKKAKEALQQC

SEQ ID NO: 214340 - protein, 61 aa, Glycine max
  Coding DNA Sequence Number=SeqID_97562
TCKRILQDSGTLKRVAWGLDVGTRGAGSVSAHLPTQGAESVSARLPTQLAIMLRVLEIAKE

SEQ ID NO: 214341 - protein, 96 aa, Glycine max
  Coding DNA Sequence Number=SeqID_97563
  Homolog annotation: Hit_ID=Q1SHY7; Match level="QueryCoverage=46%, HitCoverage=10%, E-value=9e-12, Identity=68%"; Hit description=U box
MSTSVFKKIEVNFTHIKLVFNFCYTLKTCLLLSFDPTPSPESPPSLLSTFLNGVTIGVEPTLDVELVVGDSSGEADRGFHDVEGDRALEEARNNYA

SEQ ID NO: 214342 - protein, 398 aa, Glycine max
  Coding DNA Sequence Number=SeqID_97564
  Gene Ontology: Mol. function=protein serine/threonine kinase activity; Cellular component=integral to membrane; Biological process=protein amino acid phosphorylation
  Homolog annotation: Hit_ID=Q2HV99; Match level="QueryCoverage=95%, HitCoverage=51%, E-value=1e-103, Identity=52%"; Hit description =Protein kinase; Type I EGF
  Pfam annotation: Domain name=Pkinase; Domain location=74-350; Score =165.2; E_value=1.7e-46; Accession=PF00069.15; Description=Protein kinase domain
  Pfam annotation: Domain name=Pkinase_Tyr; Domain location=74-344; Score=124.6; E_value=2.8e-34; Accession=PF07714.7; Description =Protein tyrosine kinase
  Pfam module annotation: Pfam domain module=Pkinase::Pkinase_Tyr; Domain location=74-350::74-344
MVIVGAAAGFVILFVGTAMPYLIYQKRKLVKLKEKFFQQNGGLILLQKLSTSEKSSRFMQIFTEEELKKATRDFDESSIVGKGGFGTVFKGFLEDNRTVAIKKSKIVDDNQKEQFINEVIVLSQINHRNVVRLLGCCLETKVPLLVYEFVNNGTLFDLIHTERTVNGATWKTRVRIAAEAAGALSYLHSEASIPIIHRDVKTANILLDNTYTAKVSDFGASILIPLDQTALSTFVQGTFGYLDPEYVQTGQLTEKSDVYSFGAVLIELLTGEKPYSFGKPGEKKNLANHFLSSLKEDRLVDVLQVGILNEENEKEIKKVAFLAAKCLRLKGEERPSMKEVAIELQKHHLINTDPNQKENEYQLVHEAPSNIYESGDSNSHQGLGSIGDQVLAAMNDGR

SEQ ID NO: 214343 - protein, 104 aa, Glycine max
  Coding DNA Sequence Number=SeqID_97565
  Subcellular localization annotation: CTP_CleavageSite=20; ConfidenceScore=5.14e-01
MPQLPVASYGPTPKGRAQCTCSVRATLHTIMLKGSWRKQCLLLTLLAFVVLSEGSRLPKEYWEQMMPKKLPSPSSSPSKGTNSVSPSSSLTTKNDGLPMSDGKV

SEQ ID NO: 214344 - protein, 491 aa, Glycine max
  Coding DNA Sequence Number=SeqID_97566
  Gene Ontology: Mol. function=protein serine/threonine kinase activity; Cellular component=integral to membrane; Biological process=protein amino acid phosphorylation
  Homolog annotation: Hit_ID=Q2HV99; Match level="QueryCoverage=93%, HitCoverage=63%, E-value=2e-89, Identity=39%"; Hit description =Protein kinase; Type I EGF
  Pfam annotation: Domain name=EGF_CA; Domain location=289-331; Score =28.3; E_value=2.7e-05; Accession=PF07645.6; Description=Calcium binding EGF domain
  Pfam annotation: Domain name=WAK; Domain location=167-277; Score= -44.0; E_value=0.057; Accession=PF08488.1; Description=Wall -associated kinase
  Pfam module annotation: Pfam domain module=EGF_CA::WAK; Domain location=289-331::167-277
MEHLQLSQTLMFALALVVVAVAPHQTLSAILNQNLPGCNSTCGNIEIPYPFGIGYSSTPDQRPCFFEPKFSLTCENSTLIWGNVEILSISLPAQQMDVLFWVSQFCNDTNDNFPWMQTFNFSISRKENKFMTVGCDSFGVLNSFSDNSTYSTGCLTRCYGNELKIDDGTCSGIGCCRMDIPPRMRDIEIRASIFSNSMPEWENCSYSFVAKQDSYNFSTSHLRGFPQTSFPLVLDWTVGHQKCKASESRDDYACRSNSYCDDTDSDIDYGYRCRCKDGYEGNPYLGCTDIDECKTGNHTCISEKNCLNSNGSHRCFCPKGQSGNGTKGVGCHQKDLVTKVVMGVGAGIFILFMGTTLLYLIYQKKKLIKLREKYFQQNGGSILLQQLSRRENSSQVTQIFTEEQLKKATNNFDESLIIGSGGYGTVFKGFLADNNRTVAIKKSKIVDESQKEQFINEIIVLSQINHRNVVKLLGCCLEREVPLLVYEFVNN

SEQ ID NO: 214345 - protein, 92 aa, Glycine max
  Coding DNA Sequence Number=SeqID_97567
MTIEESIHVSFDESDVISPRKDVLDDVSDFLEEMHTHERDSKRKRDESNEDSQDYETKVNNDLPKEWKASRNHPFDNIISNISKEVAFELPQ

SEQ ID NO: 214346 - protein, 180 aa, Glycine max
  Coding DNA Sequence Number=SeqID_97568
VISVLVHEANRVAHGKEHVREKDQTSSLRTEPRSSSPRAYLYSMLLKSEKETEWTGGTEVKLQKWLPIGGLTHLSRQGILSAWNMNAMRLGRESSQHLQQPVGQMPRRIPPDSRLGICLAGVQPMAFVFGCLAFKLRLRSTPLLSLSSLPFIYIDISFFSHSIGQRLERGARQGRAVQAV

SEQ ID NO: 214347 - protein, 71 aa, Glycine max
  Coding DNA Sequence Number=SeqID_97569
MSLPSAVHVFSLIKCEASGDWEARYSVVFQIGSFAKRKKRRSRDESRHCEKGKTDEISPIFAFLLSPMRGK

SEQ ID NO: 214348 - protein, 205 aa, Glycine max
  Coding DNA Sequence Number=SeqID_97570
  Gene Ontology: Mol. function=4 iron, 4 sulfur cluster binding; Cellular component=integral to membrane; Biological process=protein -chromophore linkage
  Homolog annotation: Hit_ID=P56766; Match level="QueryCoverage=99%, HitCoverage=46%, E-value=2e-71, Identity=83%"; Hit description =Photosystem I P700 chlorophyll a apoprotein A1
  Pfam annotation: Domain name=PsaA_PsaB; Domain location=1-205; Score=- 215.8; E_value=0.0041; Accession=PF00223.9; Description=Photosystem I psaApsaB protein
TNWGIGHSIKDILEAHKGPFTGQGHKGLYEILTTSWHAQLSINLAMLGSLTIVVAHHMYSMPPYPYLATDYGTQLSLFTHHMWIGGFLIVGAAAHAAIFMVRDYDPTIRYNDLLDRVLRHRDAIISHLNWGVLFARSSRLIPDKANLGFRFPCDGPGRGGTCQSDVWGSISDQGIVNHITGGNFAQSSITINGWLRDFLWAQASQ

SEQ ID NO: 214349 - protein, 152 aa, Glycine max
  Coding DNA Sequence Number=SeqID_97571
  Pfam annotation: Domain name=Transposase_23; Domain location=61-126; Score=-17.8; E_value=0.1; Accession=PF03017.5; Description=TNP1ENSPM transposase
MAPEELEQLTQQIKDQLEESITEKIHSQGLALPPEPKVCPSASRVGTKGSCVDPSPTDPDTGDSDKCGLYIEENPSRLVALGRVYEGSTVVHNIPLLHGQVKVAVEEVKDAEAPIPVPTDETAMSPAKPPDGPDPQVMWDATVFGVFNEHFP

SEQ ID NO: 214350 - protein, 104 aa, Glycine max
  Coding DNA Sequence Number=SeqID_97572
  Homolog annotation: Hit_ID=Q1SAS4; Match level="QueryCoverage=37%, HitCoverage=1%, E-value=2e-08, Identity=69%"; Hit description=RNase H, putative
MEAVLPFEVEVPSQKILAESGLEESEWAQTRYDQLNLIEGLFGGWGALVLTNMDGEELPSPVNSDVVKRPHFGFKPHAVCDNLSPFAQFMGGRIVLGNGQRSRQ

SEQ ID NO: 214351 - protein, 288 aa, Glycine max
  Coding DNA Sequence Number=SeqID_97573
  Gene Ontology: Mol. function=endonuclease activity; Biological process=DNA restriction-modification system
  Homolog annotation: Hit_ID=UPI000068B01A; Match level="QueryCoverage =77%, HitCoverage=20%, E-value=1e-104, Identity=86%"; Hit description= Type III restriction-modification system restriction subunit
  Pfam annotation: Domain name=DEAD; Domain location=119-288; Score= -36.3; E_value=0.0065; Accession=PF00270.19; Description=DEADDEAH box helicase
  Pfam annotation: Domain name=ResIII; Domain location=119-288; Score= -9.6; E_value=0.0003; Accession=PF04851.6; Description=Type III restriction enzyme, res subunit
  Pfam module annotation: Pfam domain module=DEAD::ResIII; Domain location=119-288::119-288
GAGALIVCLDDEITTETVEGIVKLKAELDPETTQVVFKDESFADDRVKTNAIQILKQANINDVKRQEIFQSNFSVSSNALASEQLGLFSRNNDIGVANALTLLPEELYENTRNVQLINGLPQTETSKQALPSLDFTIEMETGTGKTYVYLRSVFELNQKYGLTKFIIVVPSVAIKEGVYKSLQITEEHFRKEFKNVQYDYFVYDSSKREQVRNFATNDYIQIMVINIDAFSKSFTDPEKETTANLIHRTDDRLNGMKPIEFIQATNPVVLIDEPQSVTSTANRKNAIA

SEQ ID NO: 214352 - protein, 142 aa, Glycine max
  Coding DNA Sequence Number=SeqID_97574
  Subcellular localization annotation: CTP_CleavageSite=49; ConfidenceScore=5.61e-01
MRTSDKIGTTATNKTSNTEHGTTKSSNTSLHGTTNRLLKGPPPKQQQTKETNKANGRRNKANGRRNKANGRRNKESAKLLPEDNGILPEEASSGNIPDDVLPEIVCEYFRKTQINLPEEDSSGNFPEKLFPELFRKNLLPEE

SEQ ID NO: 214353 - protein, 144 aa, Glycine max
  Coding DNA Sequence Number=SeqID_97575
  Gene Ontology: Mol. function=RNA-directed DNA polymerase activity; Biological process=RNA-dependent DNA replication
  Pfam annotation: Domain name=AT_hook; Domain location=108-120; Score =14.9; E_value=0.061; Accession=PF02178.9; Description=AT hook motif
MTLLEFMSHEKFYRTAVRPAILYGTECWAVKSQHENKVGVAEMRMLRWMCGKTRQDKIRNEAIRERVGVAPIVEKMVENRLRWFGHVERRPVDSVVRRVDQMERRQTIRGRGRPKKTIREVIKKDLEINGLDRSMEKFLGLTAT

SEQ ID NO: 214354 - protein, 861 aa, Glycine max
  Coding DNA Sequence Number=SeqID_97576
  Gene Ontology: Mol. function=catalytic activity; Cellular component =alpha,alpha-trehalose-phosphate synthase complex (UDP-forming); Biological process=trehalose biosynthetic process
  Homolog annotation: Hit_ID=Q2TSD5; Match level="QueryCoverage=99%, HitCoverage=99%, E-value=0.0, Identity=79%"; Hit description =Trehalose 6-phosphate synthase
  Pfam annotation: Domain name=Glyco_transf_20; Domain location=59-546; Score=931.4; E_value=3.8e-277; Accession=PF00982.11; Description =Glycosyltransferase family 20
  Pfam annotation: Domain name=Hydrolase_3; Domain location=594-836; Score=-83.0; E_value=0.026; Accession=PF08282.2; Description =haloacid dehalogenase-like hydrolase
  Pfam annotation: Domain name=Trehalose_PPase; Domain location=595 -830; Score=373.0; E_value=4.5e-109; Accession=PF02358.7; Description= Trehalose-phosphatase
  Pfam module annotation: Pfam domain module=Glyco_transf_20::Hydrolase_ 3::Trehalose_PPase; Domain location=59-546::594-836::595-830
MASRSYANLFDLASGDFLDFPCPPRALPRVMTVPGIISDLDGYGCNDGDSDVSSSGCRERKIIVANMLPVQAKRDIETAKWVFSWDEDSILLQLKDGFSADTEVIYVGSLKVEIDACEQDAVAQRLLDEFNCVPTFLPHDLQKRFYLGFCKQQLWPLFHYMLPICPDHGDRFDRILWQAYVSANKIFADKVMEVINPDDDFVWVHDYHLMVLPTFLRKRYNRVKLGFFLHSPFPSSEIYRTLPVRDEILRGLLNSDLIGFHTFDYARHFLSCCSRMLGLDYESKRGHIGLDYFGRTIFIKILPVGIHMGRLESVLNLSSTSAKLKEVQEEFKDKKVILGVDDMDIFKGISLKLLAVEHLLQQNPDLQGKVVLVQIVNPARGSGKDVQEAKNETYSIAQRINDTYSSNNYQPVILIDRPVPHFEKSAYYAVAECCIVNAVRDGMNLVPYKYIVCRQGTAQLDEALGRKSDSPCTSMLVVSEFIGCSPSLSGAIRVNPWNIDAVADAMYAALTMSDSEKQLRHEKHYRYVSSHDVAYWARSFMLDLERACKDHYTKRCWGFGLGLGFRVVSLSHGFRKLSVDHIVSAYKRTNRRAIFLDYDGTVVPQSSISKNPSPEVISVLNALCNDPKNILFIVSGRGKDSLSEWFTSCQMLGLAAEHGYFLRWNKDSEWEASHLSADLDWKKMVEPVMQLYTESTDGSNIEVKESALVWHHQDADPDFGSCQAKELLDHLESVLANEPAAVTRGQHIVEVKPQGISKGLVAEQVLMTMVNGANPPDFVLCIGDDRSDEDMFESILRTVTCPSLPSAPEIFACTVGRKPSKAKYFLDDASDVVKLLQGLAASSNPKPRLLAHSQVSFESTV

SEQ ID NO: 214355 - protein, 321 aa, Glycine max
  Coding DNA Sequence Number=SeqID_97577
  Gene Ontology: Mol. function=nucleotide binding; Cellular component =nucleus; Biological process=transcription
  Homolog annotation: Hit_ID=Q10DY0; Match level="QueryCoverage=78%, HitCoverage=94%, E-value=1e-111, Identity=75%"; Hit description =Expressed protein
  Pfam annotation: Domain name=ATP_bind_1; Domain location=69-304; Score=351.5; E_value=1.4e-102; Accession=PF03029.7; Description =Conserved hypothetical ATP binding prot
MYLRKTLQNCNAYLKTIEHSERVENSNPSEASTVAVAHSHAAHRFMGYADVLNLLLAVVVLNSGYITIKSTYCSSLYEHCVAARRSIHVVNLDPAAENFDYPVAMDIRELISLDDVMEELGLGPNGGLVYCMEHLEDNLDDWLTEELDNYLDDDYLVFDCPGQIELYSHVPVLKNFVEHLKRKNFSVCAVYLLDSQFMTDVTKFISGCMACLSAMVQLELPHVNILSKMDLVTKKKDLEDFLDPEPTFLLSELNQRMGPQYAKLNKALIELVNNYSMVSFIPLDLRKEKSIQYVLAQIDNCIQYGEDADVKVKDFDPEDDE

SEQ ID NO: 214356 - protein, 124 aa, Glycine max
  Coding DNA Sequence Number=SeqID_97578
MNHFFRKVPGRGFSGSLPEEVFFRKTFGYFRKNPSSGNFLENVLPELPEEPLTGLPEVSAVSLLSPFFLASSPLVFYPKVTILSKGELGRLTSFAEKKKTRFALALPEKKKQFAEKGEEASRKE

SEQ ID NO: 214357 - protein, 418 aa, Glycine max
  Coding DNA Sequence Number=SeqID_97579
  Gene Ontology: Mol. function=protein serine/threonine kinase activity; Cellular component=chromatin; Biological process=protein amino acid phosphorylation
  Pfam annotation: Domain name=Transposase_21; Domain location=109-306; Score=253.2; E_value=5.3e-73; Accession=PF02992.5; Description =Transposase family tnp2
MNDIMEDQEDSHDDIDGLLYDTFRNIAEVEGLSERPNGDARKFFNLVNQAKQELYPGCKNFSILSFEFAQVNGEFERPKHEYKVPAKILRYFPLIPRLQRLFMCSRTTEQIRWHEHERVKDGKLRHPVDGQAWKDFDRLHSNFAFKCRNIRLGLSSGGFNPFRTMSISHSTWPVMMVVYNYPPWLCMKLEYTMLLLLIPGPCSLGNDINVYLQPLIEELKVLWDFGVKTYDASKNQVFQMRATLLWTISDYLGYAPLLLEGKNILESLTTFENKFGKEKGKKKKRIIGPWEKRTLLDISGKTKDHINARYDLQEMGIRKNLHPRDIGGGRVKFAKACFLMTTKKKSIFCGILKDAKLLDGSATNISKCMHITDKISGYKSHDTHIMLHYLLQIAIRSTMPSVVVDLLIHLGSFFRSLC

SEQ ID NO: 214358 - protein, 32 aa, Glycine max
  Coding DNA Sequence Number=SeqID_97580
MLLLNGSHSSILQRQLQTRFLRGGALHKEQLL

SEQ ID NO: 214359 - protein, 158 aa, Glycine max
  Coding DNA Sequence Number=SeqID_97581
ERKPQEANINLPYFHGKYNVEANLVWEIRVEQQLKKKSTSKSYGSHSYPKKDQGRGILGVTPSKPKDDKGKTIEKQVPKATTSPSSSESEKAKGEESSEEIYPQDEGQPLVVKDKCKETLASIATSLGLEFIPQVKKLLYEGLVRKSLNPCALLVPKI

SEQ ID NO: 214360 - protein, 123 aa, Glycine max
  Coding DNA Sequence Number=SeqID_97582
MKKKSLKRKCLLRLAKPDRKEKKVDEETQVAILKRKEEISSLKKEHANELNNWARRFEGLEALLRCFMKQSNPNLDDEALDDMIRNIVANENSNATMRSSASTNVPNFEKVGDQEDRVQDTGD

SEQ ID NO: 214361 - protein, 232 aa, Glycine max
  Coding DNA Sequence Number=SeqID_97583
  Homolog annotation: Hit_ID=Q1T6D0; Match level="QueryCoverage=43%, HitCoverage=22%, E-value=4e-14, Identity=45%"; Hit description=Zinc finger, CCHC-type; Lipocalin
QQKRTSFRDLMMGQKAPVAPRPKVDLLKYEDGNHLKPKVHLDKKVVEGLSTPWQDALVIKLLEKFVGFNTMKDRLTRLLKFWIFILNISWSSLIMRMTEGSILLAMPTTIGMPMKGDFGFKIIGIELNRKASIGFVLHAATMDTLRESGDKSTTMPPETLVANPRNVSTNNSATRAPQIDDALHGIEPTTFLQQNVNVETSLNMDEDTIAPQADMEVVPSSIPQETHSSGQQ

SEQ ID NO: 214362 - protein, 167 aa, Glycine max
  Coding DNA Sequence Number=SeqID_97584
  Homolog annotation: Hit_ID=Q6YWQ3; Match level="QueryCoverage=89%, HitCoverage=22%, E-value=3e-30, Identity=50%"; Hit description =Putative NHL repeat-containing protein
  Subcellular localization annotation: CTP_CleavageSite=60; ConfidenceScore=5.55e-01
MGKHKLLLLALTLHLLHVSAAPSATSPAKIVSGFLSNAVPAFTKWVWSLKATTKTAVSSRSMMKFESGYNVETVFDGSKLGIEPYAVEVLPNGELLILDSANSNIYRISSSLSLCKFVAVVENLKVQLPFAGSGMAISAPDEDNVRCNCADSRPKLVAGSAEGYSGH

SEQ ID NO: 214363 - protein, 74 aa, Glycine max
  Coding DNA Sequence Number=SeqID_97585
  Homolog annotation: Hit_ID=Q10B01; Match level="QueryCoverage=50%, HitCoverage=5%, E-value=4e-07, Identity=57%"; Hit description=Acyl -CoA binding family protein, putative, expressed
  Pfam annotation: Domain name=ACBP; Domain location=8-63; Score=-34.4; E_value=0.019; Accession=PF00887.9; Description=Acyl CoA binding protein
MGGFLGTLSSLFATKLGSIAIEGPCNIPKPRTWKLVEHSKWASWNQLGNMSSTEPLQTISGFGFWEPKLESSEG

SEQ ID NO: 214364 - protein, 178 aa, Glycine max
  Coding DNA Sequence Number=SeqID_97586
MVWQTISWQPDPDFLIDDVVQWIKRNVFGSKGVFFAIIWWFIWRSRNEEAHPRQSVLVHWSPPLQPFRELNTDESSLGNPGTSSFGGVIRDNLGQVTIANHWHHIKDNMFGTFIMWIPNMDSLETMMVDNIPYAEPNLPISAYEDDTGWPWPALNVIMSPQICIELLPLIPLQFARSG

SEQ ID NO: 214365 - protein, 70 aa, Glycine max
  Coding DNA Sequence Number=SeqID_97587
MVAPYIDMSNVQVQILDNENEEAEFVVVGTNEEGNDNVWTVRVIEEVEARDCEEEGSGIILIGEREEGGN

SEQ ID NO: 214366 - protein, 78 aa, Glycine max
  Coding DNA Sequence Number=SeqID_97588
MDKWREAKTAKVPLKPNMRKREVSVKVVFGIVQNVDEVKRWPLVCLNAGRKIPVLKVTQETLVPTRFHSAHLFPNSKQ

SEQ ID NO: 214367 - protein, 261 aa, Glycine max
  Coding DNA Sequence Number=SeqID_97589
  Homolog annotation: Hit_ID=Q6YWQ3; Match level="QueryCoverage=81%, HitCoverage=47%, E-value=5e-47, Identity=53%"; Hit description =Putative NHL repeat-containing protein
VTTIAGGKWSRGGGHVDGPSEEAKFSGDFDVAYVGSSCSLLVIDRGNRAIREIQLHFDDCAYQYGSGFPLGIAMLVGAGFFGYMLALLQRRLGTIVSSQEAQVPVTVTSSVPPSPYQKPFKSVRPPLIPAECEPDKQEEGFFGSLGKLIANTGKLCDPRRRPAPFHRHKGPNPTKNLSFHVQGCRENATTATKPSILQRMGWRSPAATATETPSSPSCRSRIGSRNLWLSSLWIMGNQCIEYITARKFRFLEVMISMEREE

SEQ ID NO: 214368 - protein, 55 aa, Glycine max
  Coding DNA Sequence Number=SeqID_97590
MKSTTATCAALKVLSSYGYDRSPTSAGTCLCNFKDTTSVVFDDGHLRSIGLIPNS

SEQ ID NO: 214369 - protein, 102 aa, Glycine max
  Coding DNA Sequence Number=SeqID_97591
MSKGGSLQKDVPWRASSSSAKPIPKIHHSPLLRVSQTPVSDYGISVMRHPDPIGGGLGHEAIVEPAGPDCLVPGQKMPIQLLGLQKMLEQASSVPRTEPLRK

SEQ ID NO: 214370 - protein, 241 aa, Glycine max
  Coding DNA Sequence Number=SeqID_97592
MAHGGHRWSWMVEKKVLGFGWDSTFGAKRKNSRSAQFPLRLEFALNATILAELNSSCTKRNNSRSTGVYPDLSSFTGSGVYPDLSSFIGSGVYPDLSSLFGSGVIQISIACIKRSAPSQDPMAQPYYSVHGGIPQDCNRGHMGVAKTLHRLQENFFWPNMCKDFQTYVAQCLVNKSIPYAIWEDFSLDFITDLPSSRGYNTILVVIYGKPLPSLSSYPLGLSQVEVVAEFISTGETIHAIL

SEQ ID NO: 214371 - protein, 147 aa, Glycine max
  Coding DNA Sequence Number=SeqID_97593
MLQPYGINIGLKEYSNPETPKAYTPKSPSGPLPPDSGGLHHTLSAKWRWYVSSPKSSFVCEYPKVQVWGGKIWKGSEKWVMEGRQGFGWTVEGGNESLVDRFPSKLQTTNGINEKCEKMGIRTSGIGYKMGQAHTQLLRHTRQYMHR

SEQ ID NO: 214372 - protein, 81 aa, Glycine max
  Coding DNA Sequence Number=SeqID_97594
  Subcellular localization annotation: CTP_CleavageSite=66; ConfidenceScore=5.05e-01
MRAQPEEEAGITPTRHPVDPKKSNRVLGFPALIMGPPVRSSGPLLTGLSSKSTAPPGRRRARHHISLGTTNSRQQKHRHHL

SEQ ID NO: 214373 - protein, 261 aa, Glycine max
  Coding DNA Sequence Number=SeqID_97595
MAVTIESRDNGGKPGQKNPKDIISVINDKEGALHDHPYHRAPQDLPSDLLTPIDSHKMMLTKMVADRMSSWILNLLEVVIEVLQTAYSNHNPLLLPCGGFPNLVARGPLDSLLHGAPMRTISMLSVMLGTYCHRIRSSFHILTSSSTSEQGFETTISYEIVVEQNRHPPQTFRTTVAMAGVSQSMNISCDLPILKGDNYKVWKERILLHLGWMNIDYAIRKDEPSIIAETSEPNVVDLYERWERSNCLSVMFIKINTSASI

SEQ ID NO: 214374 - protein, 170 aa, Glycine max
  Coding DNA Sequence Number=SeqID_97596
  Gene Ontology: Mol. function=electron carrier activity; Cellular component=anchored to membrane; Biological process=electron transport
  Homolog annotation: Hit_ID=Q8H998; Match level="QueryCoverage=94%, HitCoverage=96%, E-value=3e-42, Identity=51%"; Hit description =Phosphoprotein NtEPb2
  Pfam annotation: Domain name=Cu_bind_like; Domain location=38-122; Score=104.6; E_value=2.9e-28; Accession=PF02298.8; Description =Plastocyanin-like domain
MASSCSGSLLVLPFVISSTLLCFSVASNEFEVGGSKGWIVPPANDTNFFNDWASQNRFQAGDTIRFKYKKDSVMEVGEGDYTHCNATHPTLFSNNGNTVFKLNHSGTFYFISGASGHCEKGQKMIVRVMADESLSQHAKSSGHHVPVSPIGVSQMLYLQFVLTCVASYVV

SEQ ID NO: 214375 - protein, 358 aa, Glycine max
  Coding DNA Sequence Number=SeqID_97597
  Gene Ontology: Mol. function=DNA binding; Biological process=DNA integration
  Homolog annotation: Hit_ID=Q1RSZ9; Match level="QueryCoverage=95%, HitCoverage=25%, E-value=8e-92, Identity=51%"; Hit description =Polynucleotidyl transferase, Ribonuclease H fold
  Pfam annotation: Domain name=GRP; Domain location=207-285; Score= -29.3; E_value=0.076; Accession=PF07172.2; Description=Glycine rich protein family
  Pfam module annotation: Pfam domain module=GRP::Retrotrans_gag; Domain location=207-285::85-175
MASNKSSFHSALAVSNIRNHVSIILEMENVQYSTWAELFKIHARSTKVLDHIIPPANDTGTVPSTEEERELWSTLDATVLSWIYATISSDLLHTIIEPDSTTMEAWDRLRDIFQDNQHSRAVALEQEFSATSMENFPNVSSYCQCLKSLADQLKNIGAPVSDSRLVLQLVGGLTQPYRGVGTLIRQSNPLPPFYKARSILTLEEAGMAKEAATESAMIASSINDGSPQPTKSGHSKGKNGAQHSGGGRRNNGGGRKNAGSGGGQNSTSGKGGGWGQSSGGHGETTPPQWQQQQPFPWGWYNPTWPIPPCPFPNQGWVRPNTPQQRHADLLGPKLPQQAYVHQAASPNPHGQWFVHSKD

SEQ ID NO: 214376 - protein, 361 aa, Glycine max
  Coding DNA Sequence Number=SeqID_97598
  Gene Ontology: Mol. function=steroid hormone receptor activity; Cellular component=nucleus; Biological process=regulation of transcription, DNA-dependent
  Homolog annotation: Hit_ID=Q2HU72; Match level="QueryCoverage=85%, HitCoverage=54%, E-value=5e-92, Identity=56%"; Hit description =Steroid nuclear receptor, ligand-binding
MEPPTGFWASIWNFVCFLPFFVGLWLLGNIKVAGIVGSVIGGAAYGFFAPIFATFEAVEGGKENKLFHCFIDGTWSTIRKTFDIVKDVKNECYDSYFSFMDDLLQLNGKYYEIRLRYLPGAIVAAVLGIIIDMPVISVVAIFKGPYMLFKGWKRLFHDLMGREGPFLETICVPFAGLAIVLWPLAVVGAVLASVLASFVLGGYAGFITYQESSFLFGLGYIVAAVSLYDEYSNDILDMKEGSCFPRPRYRKITELKLSRTPSRSISLPKTKSLTKTLSHAYSLKDNIPEFKPFELLDGLFKECHQLGESLVSEGVITHEDIQEAKSGKGSRVIRIGLPAYCLLQVLLRSAKANSPGILISK

SEQ ID NO: 214377 - protein, 107 aa, Glycine max
  Coding DNA Sequence Number=SeqID_97599
MKWFYMISHPFMSPAQPGDPPRHPPVLHDDTFIEPDIPEHLVTTTAIDKAPEACQAIVERLEWLINLRIVIEGTKAYTVTKDCLTRGVTAKHNVYVRSRRRQRMEDV

SEQ ID NO: 214378 - protein, 286 aa, Glycine max
  Coding DNA Sequence Number=SeqID_97600
  Gene Ontology: Mol. function=chitin binding; Cellular component =extracellular region; Biological process=chitin metabolic process
  Homolog annotation: Hit_ID=UPI000044A8F0; Match level="QueryCoverage =98%, HitCoverage=99%, E-value=7e-45, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
NVLPFRGLHVLVVTGLQVLAFRGLHVLAFRGLDVLACRGLHVLAIRGLHVLLFRGLHVLALRGLHVLAFRGIHILLFRGLHVLAFRGLHVHAFRGLHILPYRGLHVLAVRGLHVLAFRGLHVLNFRGQHVLAFRGLHVHPISGLHILSFRGLHILGIRGLHILAFRGLHVIAFRGLHVLPDRGLHALAFIGLHTPTLRATRPRLKRTTFPRRLHPFAFRGLHVLTLRGLHVLAIKGLQVLNFGGLHALTFRGLHVLAFRGLHVLAFRGLQVLAFRGLHALTLRGLH

SEQ ID NO: 214379 - protein, 164 aa, Glycine max
  Coding DNA Sequence Number=SeqID_97601
  Gene Ontology: Mol. function=transcription factor activity; Biological process=regulation of transcription, DNA-dependent
  Homolog annotation: Hit_ID=Q6D192; Match level="QueryCoverage=95%, HitCoverage=50%, E-value=9e-27, Identity=38%"; Hit description=LysR -family transcriptional regulator
MEQQQADVVVTVGEETSHDLTREHIARAGFRTVWHRGQIDLAPPLTLTLAQFVQYQHALVSYRGVSESALDAALAREGLTRRVRYVTPHFSVLPLMLQRLPLFATVPQGLVQGWEQRFALSTAAVPIGMPDYALSLLWHNARAEEPAHRWLRATLRQLIERKLA

SEQ ID NO: 214380 - protein, 69 aa, Glycine max
  Coding DNA Sequence Number=SeqID_97602
  Gene Ontology: Mol. function=oxidoreductase activity; Cellular component=membrane; Biological process=metabolic process
  Homolog annotation: Hit_ID=Q13K43; Match level="QueryCoverage=98%, HitCoverage=29%, E-value=1e-18, Identity=65%"; Hit description =Putative short-chain dehydrogenase, oxidoreductase
MATASFAARHDDARTLLLLAPGWVRTDMGGAGARLSIEESILNLLNTVESQTGRGGLHYLDYLGRVVPW

SEQ ID NO: 214381 - protein, 64 aa, Glycine max
  Coding DNA Sequence Number=SeqID_97603
MAKSTLLFYNSSWTSRRREKAAKLNVENNKRDIPRIEESFCKAWDEGGGDPEGDKMVLQCSYKA

SEQ ID NO: 214382 - protein, 250 aa, Glycine max
  Coding DNA Sequence Number=SeqID_97604
  Homolog annotation: Hit_ID=Q5FAL6; Match level="QueryCoverage=52%, HitCoverage=42%, E-value=3e-39, Identity=58%"; Hit description =Putative Expressed protein
  Pfam annotation: Domain name=AT_hook; Domain location=206-218; Score =14.9; E_value=0.061; Accession=PF02178.9; Description=AT hook motif
  Pfam annotation: Domain name=DUF1637; Domain location=18-220; Score =55.5; E_value=8.7e-16; Accession=PF07847.3; Description=Protein of unknown function (DUF1637)
  Pfam module annotation: Pfam domain module=AT_hook::DUF1637; Domain location=206-218::18-220
MIAKLKGCFEELICGNLACCWILMSLILSNYSMSIEKYDSGQLLSDTIQPADVGLKEETADDDRGHGFFGTNALSRLARWAQPITYVDIHECDNFTVSFTILGHTSDTTMCIFCFPTSSVIPLHDHPGMTVFSKLLYGSLHVKAYDWVEPPCIIESKEPGYAQVRRVAPIVEKMVENRLRWFGHVERRPVDSVVRRVDQMERRQTIRGRGRPKKTIREVIKKDLELNDLDRSMVLDRTLWRKLIHVAHPT

SEQ ID NO: 214383 - protein, 66 aa, Glycine max
  Coding DNA Sequence Number=SeqID_97605
MVHYNSKILVVGEGKGRFRRKRGVRRGKGNEEEEGMKNFEMGIRIVFLPSVQLEIEYTTLVIRMTF

SEQ ID NO: 214384 - protein, 292 aa, Glycine max
  Coding DNA Sequence Number=SeqID_97606
  Homolog annotation: Hit_ID=Q9M6E8; Match level="QueryCoverage=44%, HitCoverage=21%, E-value=7e-53, Identity=76%"; Hit description=9-cis- epoxycarotenoid dioxygenase
MKLYFYTTHKAASRVVARVEAHHSEVPDGPRDRGPLRAGSRVGIEEEEAGDAGVVVEFTDGFGEHVAAEDFFLGEALGFGEVAGVAGGTRVELHDVDHVVAVKEVVPCDGLVEWVRTIANVDAFNGFRDFSNHREELMRQVLWHGGEVASDLDTRVGGFGEWVLPLMGDQGSITGLVSLAGVVAVVVVVVFVVVVLEEELIANESSGKQVVGETSVQINCSDGDGLTELEKLLKQNTFTKYPLNDGVMTEDVIQLRRSTGAPGMAVLQFAVVPIVDEWGSCTRLLHREDYIE

SEQ ID NO: 214385 - protein, 62 aa, Glycine max
  Coding DNA Sequence Number=SeqID_97607
MATSVVLTVSRVIIDQMPHPSPLITIGSATFLGDLHLAGNWSGLKTSVIFKTWKCPMMLMNL

SEQ ID NO: 214386 - protein, 317 aa, Glycine max
  Coding DNA Sequence Number=SeqID_97608
  Homolog annotation: Hit_ID=Q5XM22; Match level="QueryCoverage=43%, HitCoverage=92%, E-value=2e-23, Identity=40%"; Hit description =Resistance-like protein HAAS-2
MVRTRASQRRRPTAFARRQLEAIPIAENVHHVDDAVDEVHKQPQEAAIDDKVVDAQGFLGGPHDTLVLTAYVDHAAVIVWNEEERPELKLSSHGRKVQKFGRATVEIEGLVAAIGLSPLIACSLDTGDWRLISTFVESGHKETNNFHLSIGEVTTPSMIKCDVAHWTVATQAYLLHLLGCTLFANKSATHMHVVFLDTFRDLDQSGSYAWGTAALMHMYGNLNDASKSSDKQLLEYIILLQCWIYEHFPFVVEAITVEDYHERKPCACCWTSGKALPVSTYRKRLDRLTSDGVCWMPYGDHHAIREFELISLFSGHI

SEQ ID NO: 214387 - protein, 61 aa, Glycine max
  Coding DNA Sequence Number=SeqID_97609
MTTYVKPDIPQYSVDATTVEDACQEIAERLKRWLNLRIMTEGTRAYNVMEALPKDSQRCHY

SEQ ID NO: 214388 - protein, 145 aa, Glycine max
  Coding DNA Sequence Number=SeqID_97610
  Gene Ontology: Mol. function=hydrolase activity, hydrolyzing O -glycosyl compounds; Biological process=carbohydrate metabolic process
  Homolog annotation: Hit_ID=Q8RU06; Match level="QueryCoverage=94%, HitCoverage=28%, E-value=3e-29, Identity=46%"; Hit description =Putative Glucan 1,3-beta-glucosidase
MNEPKGVNLDILKKYYKEAYDAVRKHSSSAYAIMSNPLDADSKVILSFVKGFDRVVIDVHYYNLYSCKFNNMNAQQNIDFIREDPQMLSFVAHMKNKRVGNKWTGAWHASKEDLKRYAQAQLDVYSRATFGRAYWSNKCRFNDGC

SEQ ID NO: 214389 - protein, 223 aa, Glycine max
  Coding DNA Sequence Number=SeqID_97611
  Gene Ontology: Mol. function=chromatin binding; Cellular component =chromatin; Biological process=chromatin assembly or disassembly
  Homolog annotation: Hit_ID=Q1SAV4; Match level="QueryCoverage=58%, HitCoverage=52%, E-value=2e-28, Identity=45%"; Hit description =Integrase, catalytic region
MALWMIVKIHFRSYQILLTNDSTSYVVHLKMETFVLNMHNLTFPTSRDGLEMSNRVSNASTQGLDLLPQEEFLSLLGGAKTSPPVHQFLVNTLGGLMIKVKADIHPISNCKVSIAAMLVCHSFHSLLGLVQAALQGRVNCGPGRFAINNFKRGDVGAGMYGTQLLFQDAVKNFCLAVGLWMVSRTHPEFSTTQTKKLAPKATDEDGGEHRSEPPWKNGPRPPL

SEQ ID NO: 214390 - protein, 205 aa, Glycine max
  Coding DNA Sequence Number=SeqID_97612
  Gene Ontology: Cellular component=integral to membrane
  Homolog annotation: Hit_ID=Q9FF99; Match level="QueryCoverage=57%, HitCoverage=26%, E-value=6e-37, Identity=57%"; Hit description=Amino acid transporter
  Pfam annotation: Domain name=Aa_trans; Domain location=2-204; Score= -164.4; E_value=0.1; Accession=PF01490.8; Description=Transmembrane amino acid transporter protein
MDGKNSLQITRSGTGAYDDDGHAKRTGYKRTCVVGFLQFLTLYSTSVDYVLTTATSLRTLVALAKNGRIMGSLTGIPTDKIADKLWLVFQALGDIAFAYPYSILLLQIQSLLHENQTMKKASMIAIFIRTFFYLCCRCFGYASFGNDTLGNLLTGFGFFEPFWLIDLANAFIILHLVGGYQNLAGILLYNLLADESSLGSTLLTI

SEQ ID NO: 214391 - protein, 99 aa, Glycine max
  Coding DNA Sequence Number=SeqID_97613
MPEHHTRQVTSDKLKEAVNHLTQGQASLNQNHNNLNTKMDSLNAKINLILDRLATITVTPPSPSSSPHPPPSPAHRPHMKLDVPRFNGHDPLGWIFKIS

SEQ ID NO: 214392 - protein, 115 aa, Glycine max
  Coding DNA Sequence Number=SeqID_97614
  Homolog annotation: Hit_ID=Q6CQF3; Match level="QueryCoverage=48%, HitCoverage=59%, E-value=2e-08, Identity=72%"; Hit description =Kluyveromyces lactis strain NRRL Y-1140 chromosome D of strain NRRL Y- 1140 of Kluyveromyces lactis
MPERGEARGNSVSLRIAGARGRVLSGRCGCSVEPRHGIESSKWAIFGKQNWRCGMNRKLGYGAQLRANLDPTKGVGRLRQQDGGHGSRNPLRRRGGRCKTQGASPGGAVVGADLG

SEQ ID NO: 214393 - protein, 98 aa, Glycine max
  Coding DNA Sequence Number=SeqID_97615
MSFRTYEKVWVVQERKTNDQSEQRAISRILWELERIDGDPALRGTRIRVTWEYVSSVGGGKQGMVGLYVICGCGELSCTIARPPPSTTCDGYPIILQA

SEQ ID NO: 214394 - protein, 34 aa, Glycine max
  Coding DNA Sequence Number=SeqID_97616
FEGNAGALRNFEVLDFLRAKGASKDPTRVIAKVA

SEQ ID NO: 214395 - protein, 103 aa, Glycine max
  Coding DNA Sequence Number=SeqID_97617
QVAWPGVQPSPSGGDKASAAQEPVLEDDEPVPREPFVYETDPTSAQEEVASPEPVPHPSPAPVLDDSQPFAPAPVPDQPLAQDPPAAPVLDLNEHAEDHLQND

SEQ ID NO: 214396 - protein, 210 aa, Glycine max
  Coding DNA Sequence Number=SeqID_97618
  Gene Ontology: Mol. function=hydrolase activity, hydrolyzing O -glycosyl compounds; Cellular component=chitin- and beta-glucan -containing cell wall; Biological process=carbohydrate metabolic process
  Homolog annotation: Hit_ID=Q8RU06; Match level="QueryCoverage=97%, HitCoverage=41%, E-value=3e-64, Identity=57%"; Hit description =Putative Glucan 1,3-beta-glucosidase
  Pfam annotation: Domain name=Cellulase; Domain location=1-209; Score=- 50.2; E_value=0.00032; Accession=PF00150.8; Description=Cellulase (glycosyl hydrolase family 5
MSENGLNAVRIPVGWWIAKDPNPPKPFVGGSLEALDNAFIWAQNHGIKVIIDLHAAEGSQNRFEHSGTRDGEIEWGDSYIPNTVQVIDFLAERYGNKPNLGGIELMNEPFGVNLESLKKYYKEAYDAVRKHNSSAYVIMSNPLDADSKVLLSFVKDFDRVVIDVHYYNLFWNGFDSMTVQENIDFIRNERVSNLGGVSSTNALSFVVDLT

SEQ ID NO: 214397 - protein, 651 aa, Glycine max
  Coding DNA Sequence Number=SeqID_97619
  Gene Ontology: Mol. function=hydrolase activity, hydrolyzing O -glycosyl compounds; Cellular component=endoplasmic reticulum; Biological process=carbohydrate metabolic process
  Homolog annotation: Hit_ID=Q8RU06; Match level="QueryCoverage=99%, HitCoverage=92%, E-value=1e-139, Identity=54%"; Hit description =Putative Glucan 1,3-beta-glucosidase
  Pfam annotation: Domain name=Cellulase; Domain location=181-462; Score=-16.3; E_value=2.7e-06; Accession=PF00150.8; Description =Cellulase (glycosyl hydrolase family 5
  Pfam annotation: Domain name=Fascin; Domain location=49-161; Score =5.3; E_value=0.0021; Accession=PF06268.3; Description=Fascin protein
  Pfam module annotation: Pfam domain module=Cellulase::Fascin; Domain location=181-462::49-161
MGNVLPYKAVNLANWLVVEGWMQEPSLFDGIVNKDLLDGTQVQLKSTKFNKYLTSENGGGADVVANRGSASGWETFKLWRISDSSFNLRVFNKKFVGLENHGGGNKIISVSDSPSQPETFEIIRNNNDPFKIRIKASNGRFLQVRSETLVTADYEGTNWDESDPSVFRMNIVPDTTLQGEYQLTNGYGPDRAPQVMRDHWNTYITEDDFRFMSANGLNAVRIPVGWWIAKDPNPPKPFVGGSLAALDNAFIWAQNHGMNVIIDLHAAEGSQNGNDHSGARDGYTEWGDSYIPNTVQVIDFLAERYGTRPNLGAIELMSGPRGVNLESLKKYYKEAYDAVRKHNSSAYVIMSNPLDADSKVLLSFVQDFDRVVIDVHYYNLFSSDFNRMNVQQNIDVIRNGRASDLSVVSSSNALSFVGEWTGAWSIQGASKEDLKRINEWSLRWMIQNGYICLSCPQNLPYKAVNLGNWLVVEGWMQEPSLFDGIVNNDLLDGTQVQLKSTKFNKYLTSENGGGADVVANRGSASGWETFKLWRISDSSFNLRVFNKKFVGLENHGGGNKIISVSDSPSQPETFEIIRDNNDPFKIRIKASNGLFLQVRSETSVTADYHGTNWDESDPSVFRMTIVPGTTLQGEYQLTNGYGPDRAPQVMK

SEQ ID NO: 214398 - protein, 80 aa, Glycine max
  Coding DNA Sequence Number=SeqID_97620
MAVPINQHGAFQCVLSSFTRLLGNFLECHSSHNYSKPNTFNYVVLDIEILVSKVFLAVSPYTNIESLPSNMEARHRFPWL

SEQ ID NO: 214399 - protein, 333 aa, Glycine max
  Coding DNA Sequence Number=SeqID_97621
  Gene Ontology: Mol. function=protein binding; Cellular component =integral to membrane; Biological process=protein amino acid phosphorylation
  Homolog annotation: Hit_ID=O48705; Match level="QueryCoverage=100%, HitCoverage=70%, E-value=2e-26, Identity=37%"; Hit description =Putative disease resistance protein
  Pfam annotation: Domain name=LRR_1; Domain location=180-197; Score =3.2; E_value=71; Accession=PF00560.23; Description=Leucine Rich Repeat
  Pfam annotation: Domain name=LRR_1; Domain location=199-221; Score =6.0; E_value=22; Accession=PF00560.23; Description=Leucine Rich Repeat
  Pfam annotation: Domain name=LRR_1; Domain location=226-248; Score =6.1; E_value=21; Accession=PF00560.23; Description=Leucine Rich Repeat
  Pfam annotation: Domain name=LRR_1; Domain location=252-274; Score =7.0; E_value=14; Accession=PF00560.23; Description=Leucine Rich Repeat
  Pfam annotation: Domain name=LRR_1; Domain location=276-296; Score =9.0; E_value=5.8; Accession=PF00560.23; Description=Leucine Rich Repeat
  Pfam annotation: Domain name=LRR_1; Domain location=67-86; Score=6.2; E_value=20; Accession=PF00560.23; Description=Leucine Rich Repeat
  Pfam annotation: Domain name=LRR_1; Domain location=88-111; Score =16.5; E_value=0.099; Accession=PF00560.23; Description=Leucine Rich Repeat
  Pfam module annotation: Pfam domain module=LRR_1::LRR_1::LRR_1::LRR _1::LRR_1::LRR_1::LRR_1; Domain location=180-197::199-221::226 -248::252-274::276-296::67-86::88-111
LANCGIKMRLEDFKPSETQFYDFIDLSGNEISGSAIGLVNSTEYLVGFWVSGNMLKFDLGKLRFGERFKYLDLSGNSVFGKVPNSVVGLEKLDLSYNHLCGQLPKNKFPASAFVAYAYKFSAPIWSISWKERSKHFSHSNKDESVLMNQIFFSLGKLSKTAANGGLLEGLIPHQLGNLSNLHTLDLSWNIDISTNDLSCLVELHLDDCGLPDVNPKSLSHVNFSTTLEVLHLRSNNLSSSVFTWVGNVGGGSLMDLQLDSNQLKGPIPNVFACMSSLEYLDLSENEFEGSILNTKFIPGPVNNSFTGPFPDIAKFSSLKSFYANSNKLNGTLP

SEQ ID NO: 214400 - protein, 63 aa, Glycine max
  Coding DNA Sequence Number=SeqID_97622
LKHYIRIPNGEHSHNWTANVVLKFHDNPTVNKFEIVIFLRQVWWPTEKKERVLGEERRNEIVR

SEQ ID NO: 214401 - protein, 71 aa, Glycine max
  Coding DNA Sequence Number=SeqID_97623
MVQVEARDHNMAGLCGVSKGIFKREIDKKLKKSETLIRVDFVECPKVEVVYGSSWKSGDLKMEDLDIDLME

SEQ ID NO: 214402 - protein, 215 aa, Glycine max
  Coding DNA Sequence Number=SeqID_97624
  Homolog annotation: Hit_ID=Q8ZEH5; Match level="QueryCoverage=31%, HitCoverage=38%, E-value=6e-25, Identity=79%"; Hit description =Probable intracellular septation protein
VEHQRQGAEHQHHQEGDQRHLLDLAVFNPGEHQRQCGSDDQRAGSDVNVVQLVKSEKDNEREEIKKLLHKSIHHLFIGRLYRIRRALCTAGRCRLSAFGRRISAAKAGICINLREKARAHCQRAPQAAYMQWKSLQALTPGLTHLLGYQRSWLKPDIRAGLSVAAVALPVAIAYAELPGVSPLLGLYSCILPMVAYALFGSSRQLIVGPDAATCA

SEQ ID NO: 214403 - protein, 125 aa, Glycine max
  Coding DNA Sequence Number=SeqID_97625
MILGEERLKRILDFLSQGEYCQLVEESIDVVCKKIKELRLQAQCIDKNKDDVIALVINDDTKSKGFKQRPSIKRHNQKHLKNWPELQLKKKKKALTRGQSQSQTSKAPLDDRDISTLDDINIKNL

SEQ ID NO: 214404 - protein, 127 aa, Glycine max
  Coding DNA Sequence Number=SeqID_97626
  Gene Ontology: Mol. function=oxidoreductase activity, acting on the CH-OH group of donors, NAD or NADP as acceptor; Cellular component =nucleus; Biological process=regulation of transcription, DNA -dependent
  Homolog annotation: Hit_ID=Q53RP5; Match level="QueryCoverage=91%, HitCoverage=12%, E-value=2e-24, Identity=42%"; Hit description=FAR1 family, putative
MTKENGDWKPKSDLEFEDVEEAWELWSKYGEKVDFGVRKQVKNKRKEDGVITSCRYVCYKEGIRKPDKRNGQATKHRAETKTNCSVRIEKHNHPLQLSKTTHMFASYRKITQVHAHKIELGEDSGLC

SEQ ID NO: 214405 - protein, 94 aa, Glycine max
  Coding DNA Sequence Number=SeqID_97627
  Gene Ontology: Mol. function=zinc ion binding; Cellular component =nucleus; Biological process=regulation of transcription, DNA -dependent
  Homolog annotation: Hit_ID=Q1SDI6; Match level="QueryCoverage=78%, HitCoverage=11%, E-value=1e-26, Identity=72%"; Hit description=FAR1; Zinc finger, SWIM-type
MVLDYGYFGNVVSLDATYDQAMTKALVEVMSETHHGLCTWHLMQNGIKHLGNLMKRGSHFLRDFKKCMYEFDTEVEFEEAWTKLIANYNIQENN

SEQ ID NO: 214406 - protein, 166 aa, Glycine max
  Coding DNA Sequence Number=SeqID_97628
  Gene Ontology: Mol. function=catalytic activity; Cellular component =mitochondrion; Biological process=metabolic process
  Homolog annotation: Hit_ID=Q9SZ48; Match level="QueryCoverage=60%, HitCoverage=24%, E-value=1e-32, Identity=64%"; Hit description=Enoyl- CoA hydratase-like protein
IEVLDKCFCHDTVEEIVDAMENAASETNDAWCISTLNKLKEASPLSLKVALRSIREGRFQTLDQCLLREYRMTLQAIHRQISGDFCEGVRARVVDKDFAPKGVVHLPMLHNPLLEHGRYFLVTPPSCSASGVGGGGIAPCPVTRHESEKQSLSMKKMNAIVYDELG

SEQ ID NO: 214407 - protein, 40 aa, Glycine max
  Coding DNA Sequence Number=SeqID_97629
MRLKRGENPCVYLYGIRDERAKRDLLRLACSPQLLSAPVR

SEQ ID NO: 214408 - protein, 123 aa, Glycine max
  Coding DNA Sequence Number=SeqID_97630
  Gene Ontology: Mol. function=catalytic activity; Biological process =metabolic process
  Homolog annotation: Hit_ID=Q9FWQ0; Match level="QueryCoverage=60%, HitCoverage=15%, E-value=5e-15, Identity=52%"; Hit description =Putative enoyl-CoA-hydratase
MMMQSKRAGWWLLRKAKAKLSLNTDRNLSSSQHLILDNPNLNQVLVEGNGFSRMAILNRPSALNALNTNMAATLHKLYRSWEEDPDIGFVMLKGSGRAFAAGGDIVALYHLINKVELVNVGMM

SEQ ID NO: 214409 - protein, 94 aa, Glycine max
  Coding DNA Sequence Number=SeqID_97631
MTRGCHIHDVLGPQIGIPIWRIPWDRHKNGAIFDSDEEGGAVGEHHIGCRDQQLIIVEPHKNMSLRDWASWGLSLMVVVLRRMASCHRQLESEQ

SEQ ID NO: 214410 - protein, 96 aa, Glycine max
  Coding DNA Sequence Number=SeqID_97632
  Gene Ontology: Mol. function=catalytic activity; Cellular component =mitochondrion; Biological process=metabolic process
  Homolog annotation: Hit_ID=Q9FWQ0; Match level="QueryCoverage=86%, HitCoverage=17%, E-value=3e-34, Identity=79%"; Hit description =Putative enoyl-CoA-hydratase
MAELVDILNQVALLNGITMGGGAGISIPGTFRVATDKTIFATPEVLIGFHPDAAASFYLSHLPGQLGEYLALTGEKLNGVEMVACGLATHYSSSAV

SEQ ID NO: 214411 - protein, 115 aa, Glycine max
  Coding DNA Sequence Number=SeqID_97633
MEAMKEQMDTMMEAMMSMKKIMEVNAAAIAATSTIAEVDLPPPPPYGPNQKNHPTPYMGRLERKKLGGTNGPHLMEKKKHGFLAYGFFPHFTPPHGTYTPKENVNNSPPKLIESQ

SEQ ID NO: 214412 - protein, 701 aa, Glycine max
  Coding DNA Sequence Number=SeqID_97634
  Gene Ontology: Mol. function=RNA-directed DNA polymerase activity; Cellular component=chromatin; Biological process=chromatin assembly or disassembly
  Pfam annotation: Domain name=rve; Domain location=428-589; Score=3.8; E_value=0.0029; Accession=PF00665.16; Description=Integrase core domain
  Pfam module annotation: Pfam domain module=Retrotrans_gag::rve; Domain location=45-142::428-589
  Subcellular localization annotation: CTP_CleavageSite=71; ConfidenceScore=5.02e-01
MAEATRSKSTMDQLEDKQTNTTNTPASSAATPHTSTPSDSQHRLKLKVPRFDSSDPTGWISPSSLNIIIPRTMNLTSWSALLHALKARFAPSTYEDPTGLLFKLTQRASVNEYLSEFESLTNRIIGLPTPFLLSCFVSRLSPEIRREVQALQLLSLIQAASLARLQEEKFLDTRRPDRYKPPPITTVVDEDEATLETSLATLNPVLMRGQFSLKLPKCSFAQNQIKYLGHLVSKKGVEPGYATLATPLTKLLTCDQLVWSSEADLAFQSLKDTISNTPVLVLPNFNIPFVVEIEASGSRMGAVLSQDGHPSLSSTSSSVLSYCIPRPMFENSPLSRRPSRGGASAYFVNLRNVIQVDPAAYPDYSLTQDFIMQKGHMRVCKTLAHLKDNFTWSTIMEDTRKFIASCLDCQHTKYETQKPVGLLCPLPVPNRPWENLSMDFIVGLPVYRGHISILIVVDRFSKGLHLGMLHTHHTAHSVALLFMEIVGKLHGMPRSIVSDRDLLFISTSKIEAVDEKLGQRKAVFALLRRKLLNSQARMKHIADTHRRERKFQIGDWVMVKLRPHRQVLATRSSYSKLAKRFYGPFQVEDRIGNVAYKLKLRVASFSNGKPTCHYTFDLPCNKMDSFFFWAKANGIGSMVGLHPDETYWEEWSELKTTYNLEDKVLLDGLGNDTANTGGLQEARATRPKRKSGPPAYLKDYA

SEQ ID NO: 214413 - protein, 50 aa, Glycine max
  Coding DNA Sequence Number=SeqID_97635
MEKVWHFAWLPWGNQLVPHFLALHQPQSFHPAGPWNQVKNDNCLIEARVI

SEQ ID NO: 214414 - protein, 374 aa, Glycine max
  Coding DNA Sequence Number=SeqID_97636
  Gene Ontology: Mol. function=DNA binding; Cellular component=nucleus
  Homolog annotation: Hit_ID=Q8GXL3; Match level="QueryCoverage=47%, HitCoverage=40%, E-value=3e-52, Identity=60%"; Hit description =Squamosa promoter-binding-like protein 8
  Pfam annotation: Domain name=SBP; Domain location=196-312; Score =138.0; E_value=2.6e-38; Accession=PF03110.5; Description=SBP domain
MLDYEWGNPSTIMLSGNEDSSAAGSDQTHRQIFDHYASHTLIPDHFLHAPTHSTATTAAAATVDFTHHHHFTPQPHHHNQNHMNHHHHHAFFDPRAFHGASNTSYPPPHSMLSLDPLPHVNAVGPGHGPGSGPGGLLLVPKSEDVGRPMDFVGSRIGLNLGGRTYFSSSEDDFVSRLYRRSRPVEPGSTASSNSPRCQAEGCNADLSQAKHYHRRHKVCEFHSKAATVIAAGLTQRFCQQCSRLGLEGWGGKRRKCPWGSVDNDWVCRTWGNPDGICVPNMFHLLSEFDNGKRSCRKRLADHNRRRRKTQQPTQEIQKSQSSLENVARSPPDSGAQSSSSVTVAVSPPDYFRQRPYQSTNPSSTTSSSLFFSSG

SEQ ID NO: 214415 - protein, 213 aa, Glycine max
  Coding DNA Sequence Number=SeqID_97637
  Gene Ontology: Mol. function=RNA-directed DNA polymerase activity; Biological process=RNA-dependent DNA replication
  Pfam annotation: Domain name=Pectinesterase; Domain location=4-124; Score=-197.1; E_value=1e-06; Accession=PF01095.10; Description =Pectinesterase
MSVSDNRFVIHIKARAYFENVEVIRKKMNLMFVGDYIGKIVVKGSRNVVDGWTTFQSVTVCKYCQAYCIGSQNTCGILRGISRHISTLHVSPSTGAWMPNPWQSGSQTDSIGQHVTNLEEVFGELREYDKCLNPKKCTFGVGGDKFLGFMITHQGIEVNPNKCIAILEMCSPTNIQEVLKLNGILASQRRGRTRLDDPLQEFPNLGAIAFRQE

SEQ ID NO: 214416 - protein, 339 aa, Glycine max
  Coding DNA Sequence Number=SeqID_97638
MVVRNMFGLPLVEGLANQSRDSLSANLGFDEPLEKRPENCPSRVFGGIHQQAWCVQCVCRALAYIHGAFAYVLLVRWHILETWCRALAYMTLVKWHVLDAVVLLHTWHLHGALAYVSLVKFHVLETWCSCIHVPYEVARTRDLILEGRLTKHVPWVLRACVAMTMDAPVLTTQENYEKEGMSTEVELQACCDPKWAFLVRANHSRSGIFSGFTLDSPYEVTKLKGSRLNFCIESPYCLEFGSFFPDPSHFLDFVCCLKLYPHVFFILLLLEQQSLCRWFPDFNKNNGVCALCESGPEDDSISCLCLAVGLRMFDRGDKAIPANEVFPSEFLHLIGHNFP

SEQ ID NO: 214417 - protein, 36 aa, Glycine max
  Coding DNA Sequence Number=SeqID_97639
MSFSVSEDGEPKQVKVTVCCEDWAGLNREVAQAIRS

SEQ ID NO: 214418 - protein, 110 aa, Glycine max
  Coding DNA Sequence Number=SeqID_97640
  Gene Ontology: Mol. function=oxidoreductase activity; Cellular component=anchored to membrane; Biological process=lignin catabolic process
  Homolog annotation: Hit_ID=Q9SU40; Match level="QueryCoverage=67%, HitCoverage=12%, E-value=1e-20, Identity=57%"; Hit description =Putative monocopper oxidase precursor
  Pfam annotation: Domain name=Cu-oxidase_2; Domain location=9-102; Score=38.6; E_value=2.1e-08; Accession=PF07731.4; Description =Multicopper oxidase
MLSRDLEQKWAPKVEALFGASMENEGERKATMGEGDWNPESRSSYNLYDPIARSTVQVYPGGWSSVYVYPDNPGMWNLRSQNLQSWYLGEELYVRVYDADPNPAKEKPPP

SEQ ID NO: 214419 - protein, 239 aa, Glycine max
  Coding DNA Sequence Number=SeqID_97641
  Gene Ontology: Mol. function=oxidoreductase activity; Cellular component=anchored to membrane; Biological process=lignin catabolic process
  Homolog annotation: Hit_ID=Q655L8; Match level="QueryCoverage=84%, HitCoverage=33%, E-value=3e-37, Identity=42%"; Hit description =Putative multi-copper oxidase-related protein
MKLNCFCFLTVIPSTIFRHCNLYPQVNWMQIVYCELESLDVHVGQSYLVLVTTNQNIADYYIVASPKLSNATNNNTLVGVVVLHYDNSTTPAIGSLPSGPDPFDMQFSINQEKSIRWNLTTGAARPNPQGMFHVTNVTIIETFILNASTTTIYGLSCYSVNNVSYLIPDTPLKLADFFSNRTGVYELDAFSKNTSNANAVRGVFVASALHKGWTEIVLENNLDIIDTWHLDGYSFFVVG

SEQ ID NO: 214420 - protein, 134 aa, Glycine max
  Coding DNA Sequence Number=SeqID_97642
  Subcellular localization annotation: CTP_CleavageSite=12; ConfidenceScore=5.41e-01
MATPPTRSNLARCFSRKTASPLVAISAMRMTLTTTLFTTNRRVGEQKGQMKVQRHIEWRGTTIAHESCQRCEIDKKTKDSIAIDLFGFIPYLTTSRISLNLRLKEKKHGSGLVREWVALENCPGGSCMLVRGGM

SEQ ID NO: 214421 - protein, 220 aa, Glycine max
  Coding DNA Sequence Number=SeqID_97643
  Gene Ontology: Mol. function=nucleic acid binding; Cellular component= beta-galactosidase complex; Biological process=DNA integration
MIQITLRLRLARLIGTSTDQDVPKTSQEPLAVVDPPPPPCYPSFCLSLLPTKRLFLIPFGNRLRKSNFLPYIRQLLGMWYLFLQENMLLALVGFTRSKQSLMVASVCQWDIFQMDIKNSFLNGDLQEKVYIIPPLGISHNLGRCKLNKPLYGLKQAPRAWLEKFSIIIASRGFHSSDYDSALFLKTTPQGHIILSLYVDDMLITGDDEDEIAELKLQITR

SEQ ID NO: 214422 - protein, 88 aa, Glycine max
  Coding DNA Sequence Number=SeqID_97644
MTKLKTTLSPETKAVAPKWIEVKSHVQTGCYECGYYVMHWIWNIIASDIKSDWSMWFANDTPLDIDMITTIRKKWATFFLKMAISKNG

SEQ ID NO: 214423 - protein, 130 aa, Glycine max
  Coding DNA Sequence Number=SeqID_97645
VPQSIPHNEDAHVPKPTNVDADDPLRGLIKYSFDIYDNPLEINFDGSFLGIVDASASIFITYSDVSEIIAGDKSLNISIIQLWLMYIHEWSQIFSQGFMYAFLEPQSLVCSKERRSECEQYLLRWLKESD

SEQ ID NO: 214424 - protein, 137 aa, Glycine max
  Coding DNA Sequence Number=SeqID_97646
  Gene Ontology: Mol. function=structural constituent of ribosome; Cellular component=ribonucleoprotein complex; Biological process =translation
  Homolog annotation: Hit_ID=O50003; Match level="QueryCoverage=78%, HitCoverage=69%, E-value=3e-17, Identity=52%"; Hit description=60S ribosomal protein L12
  Pfam annotation: Domain name=Ribosomal_L11; Domain location=66-134; Score=37.3; E_value=5.3e-08; Accession=PF00298.9; Description =Ribosomal protein L11, RNA binding domain
MRNQIPNPYSCSLNQNLELQATTIASPETPPFGTHFEEDKRGHNGGNNDGEAHHAQPVGKGRDGALHPRTLVIKALKKHKEDRKNTKNNKHNGNISHDRIFDIARVMRSCSMAKDLNDTIKEMLGTCISIVCTLPTS

SEQ ID NO: 214425 - protein, 115 aa, Glycine max
  Coding DNA Sequence Number=SeqID_97647
MGTYIQIAIDPERDNVLLSTLALLQASALFGFGWTKLIYLEKQKVFSSSKFLDELRLRAPRKGEGEGAASEEGTEETHREKKTEVSTQWSGQSEKLRVFRVLEETGRLYCTISQA

SEQ ID NO: 214426 - protein, 415 aa, Glycine max
  Coding DNA Sequence Number=SeqID_97648
MDAQPEIPTTTNPKVVRINTNSAEINVGTSSTLKSLRNGDSITIFKIPIEITGVVLGMKVVISLTTIAYATRCVYKKLMEKVDENTKNAIIVKGKCKAIQQVFGSTNINQMKLGFEPINVMGIDKRIQKVMEMQASKRTTRKYFSTKKELKKYLYREMTSPGDFSEVMNRVQKEKDIAIKALVLATSRPGQRNPIQKKIIWQTGKFEPILRPQENSQDIVDPNDIIERDPQPFIEKVYQFASTPKWKRYEWYEHQSRKEYKALKKGKRKSKGKKKRKIASDEEIKELEEAIANSLKDITYAYTFTETKLIIRLSKLKFEPLHPMELGFYPTEEDLKCVGKAKTQVWVKKHVVAYPPTLQIRDSTEFKLRGYMHYNFDDIIACQSDFDNYLHIIVTNFQKKQDIVTFEFNVVMHFD

SEQ ID NO: 214427 - protein, 154 aa, Glycine max
  Coding DNA Sequence Number=SeqID_97649
MYCFLSISLAIKDPTTFHMIFSMQRRNRLLNIGIIEHSKKCLHWHHFHSQVWSKPNEKCRNPPSGGGAKRPLVRAKGASFIEGKLVESPPTFIRGKRRKNQKYDGLCILKMRVRELFTHGEDAAEDKGEEVRGGAIHEGISHGRRSFTTKMSLG

SEQ ID NO: 214428 - protein, 105 aa, Glycine max
  Coding DNA Sequence Number=SeqID_97650
MINDGTYEFGDPTVMLLRMPPDSRVMVTKGGVVDKSRAFAPTYPQFVMRNSDLRSSCYCETKNSLGVFFTKMRTCFSKETKLLTDQSNICFLDEKQCVYRGRRVC

SEQ ID NO: 214429 - protein, 118 aa, Glycine max
  Coding DNA Sequence Number=SeqID_97651
MVMRRFHQHTLLPRDKLWSFCVFCHPEAVGPVTCGDKLWLFRTPFRHSDTVVSDGRQRQIVVILRLLSSRGGGPGDMWRQIIAIPHTFSPFRHSRVRWHAETNYGHSVSFVIQRQRAQ

SEQ ID NO: 214430 - protein, 113 aa, Glycine max
  Coding DNA Sequence Number=SeqID_97652
MTRGDTLRLSAPLCHPEAADPMIREDTLRLSAPFCHPEAAGPMTSRDKIWSFCTLVSSRGGGPDDTRRHLTIICTLVSSRGGGPDDTRKYPSGYPYKISFAICKTERLIACRD

SEQ ID NO: 214431 - protein, 67 aa, Glycine max
  Coding DNA Sequence Number=SeqID_97653
  Homolog annotation: Hit_ID=O49543; Match level="QueryCoverage=51%, HitCoverage=7%, E-value=6e-10, Identity=85%"; Hit description =Cysteine desulfurase 1, mitochondrial precursor
MDVASKGRNFRTIVKKMENVVIVEEQRMICSMVELTVQQVEKLREMSPLYEFVKEGINIKDIQWAQH

SEQ ID NO: 214432 - protein, 704 aa, Glycine max
  Coding DNA Sequence Number=SeqID_97654
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=99%, HitCoverage=55%, E-value=1e-103, Identity=42%"; Hit description =Chromo
MALANRSEGLSNEVVLNCFLSRLNVDIRRDVIAQRPMTLIRVVSLSKLYEEKYQPVNSNRTHNYSHRYSLISAHTANFISTPSNAAENTTQTSLPPLLPTPNTLLLRNNYVKKISPAEMQLRREKGLCYFCDDKFTFNHKCPNRLMLMLQLEDDKGEAEMSFDVVSRDNNSIAETVIDNPHHLSLNALKGGLGGGTIRFVAHINTLPVKVLVDNGSSDNFLQPRVAKFFKLPIEPSPLFKVMVDNGNYMTPIGMIRELSIQAQGNRFQLPVFLLPISGADLILGAIWLKTLGSHIADYDSLQIKFLHDGKFITLQGDDDGTPTQAHLHHIRRMISTDSIAEVFSMQLIEPSNFQFPLSELPINLEPELALLLHTYEFVFETPTSLPPPKSHDHAIPLLEGSKPVKVKPYRHLHSQNDEIGKLVQGMLEEGIIQLNAFPIPIVDELILFGAEFFSKLDLSPTWNGHLSHLEFVLKTLQQHKLYARLSKCYFGVRQIDYLGHVLFSARVTMETTKLEAITNWPQPTIIKQLRGFLGLTVLSQSQHPIDYFSKNLSPRMQKQSTYTREFYAITESMAKFKHYLLGHKFIIRIDQKSLKELLEQTLQTPEQQQWLPEFLGYDFTIQYKSGRENIPADALSRSLFIAWSEPTNHWLAKVAAVTKEEKLLSELISRYAHGGTIDPKYDVKDGLIFRKGKLMIPEDSALRN

SEQ ID NO: 214433 - protein, 152 aa, Glycine max
  Coding DNA Sequence Number=SeqID_97655
MVNGDAEEIPQHQRSIVSAIRQRAVATVAEEVDRVDPPADEGFPSRLEDTSVMTNYVYHVAIRVWEEQASHGRKVEKFGRPTPEIEGIVAATGLSFLITCLLDTGYKGLIYVFVERRHKETCHPVVQRQLPPHGDQPRSQGSSKPSDMPSSS

SEQ ID NO: 214434 - protein, 156 aa, Glycine max
  Coding DNA Sequence Number=SeqID_97656
MTQIIVCQTRGGGVTTDKVDVTYVNWKQVPVTQKDLIWEDIQSNLNSTWALAKGKDDNDDKVCEKYGIGKDKLNQFCQSHRDPSWEDVLTTAIRRLDHLGRVRTVGADNIMDELEQSIIEKVMRQLMSFFSQMQFQGIVHPVEPEVVPAGCPWESL

SEQ ID NO: 214435 - protein, 106 aa, Glycine max
  Coding DNA Sequence Number=SeqID_97657
  Gene Ontology: Mol. function=aldehyde dehydrogenase [NAD(P)+] activity; Biological process=aldehyde metabolic process
  Homolog annotation: Hit_ID=Q1SCN9; Match level="QueryCoverage=69%, HitCoverage=15%, E-value=2e-21, Identity=65%"; Hit description =Aldehyde dehydrogenase (NAD) family protein
MQKIPETEAVEPIANEETNLIADTLPFGGVGEFGFGKYHGNFSFDVFSHHKAVARSYLTDIWFRFPPWTLDKLLLLEVSCNLDYLGILLVLLGLKKSKRSLFQACN

SEQ ID NO: 214436 - protein, 84 aa, Glycine max
  Coding DNA Sequence Number=SeqID_97658
MAFKLSCAASTFLVSRQISLLKQYRSMSIVTDFYHILLEKLPQDYCGSGVLASMCNVTLRTLCKKLVMLVSTPSSYSSKDECLR

SEQ ID NO: 214437 - protein, 62 aa, Glycine max
  Coding DNA Sequence Number=SeqID_97659
MDEDQWMYDNIMSKEVDMNEENEEEPGVNEENGEEHVVHQHVDCSDAFNTSHMFATRDYVLH

SEQ ID NO: 214438 - protein, 81 aa, Glycine max
  Coding DNA Sequence Number=SeqID_97660
  Gene Ontology: Mol. function=RNA-directed DNA polymerase activity; Cellular component=intracellular; Biological process=RNA-dependent DNA replication
MWPENGIHGCLERRRGIAEPKGHHSKFKMTVMGAKGGIANILFIHAYLVVPLEKGWSWVVDGCDDQLDGKGARIAVLGKGG

SEQ ID NO: 214439 - protein, 235 aa, Glycine max
  Coding DNA Sequence Number=SeqID_97661
  Gene Ontology: Mol. function=nucleic acid binding; Biological process= DNA integration
  Homolog annotation: Hit_ID=Q1SFD6; Match level="QueryCoverage=45%, HitCoverage=9%, E-value=1e-22, Identity=41%"; Hit description =Integrase, catalytic region
MVQLWICNSLSHSIRKSVIFMEFAYDVWKDLRLRFLQGDFVRMVKLQQQLYTCQQNSMSDPGAYREQDYVMRFLMGLNDNFDGVRSQILLMDPLPNVTRVFSMVIQHAVAPSSELQSLVNLAEVAGLSNEECRTLLALLQKSGFQKGDSQHDHSATVHICNSLGEFDSFHRITAISVRLPNGGVLLAEISSDVKDYTLKKIDSGSLKRGLYYMEKEKNLNSFVWACIFYKIENFV

SEQ ID NO: 214440 - protein, 123 aa, Glycine max
  Coding DNA Sequence Number=SeqID_97662
MVAKVAALETDVAALKTTLQTMQLLAEENHGKLIEMLSKTSGSNSGDDTKSPTTSLGALDKFRDIRTWFRGPVTSQEEEKRRKTQSGTQHKVHPRPPRIYRQETTHPIVPIPPILVKRSPTPV

SEQ ID NO: 214441 - protein, 189 aa, Glycine max
  Coding DNA Sequence Number=SeqID_97663
  Gene Ontology: Mol. function=RNA-directed DNA polymerase activity; Cellular component=chromatin; Biological process=chromatin assembly or disassembly
  Pfam annotation: Domain name=zf-H2C2; Domain location=99-140; Score =12.3; E_value=0.0084; Accession=PF09337.1; Description=His(2)-Cys(2) zinc finger
MAHVLSLPDFAVPFTVETNASGIGMGAVLSQNGHPSAFFNELKKHLLCNPQFIQLRRDIRAQPDAYSDYSIAQNLIIKEGRIWLPQGFQFIPTLLAEYHSTPSNGHMGVAKTVARLMENFTWQGLQRDVEDFVKACIDCQHAKYETKRGFAVPESLLAGAISLEWYSPEDELCISPPKRRPDLSIEPCH

SEQ ID NO: 214442 - protein, 36 aa, Glycine max
  Coding DNA Sequence Number=SeqID_97664
MAFGCGHMTCLECGSKIRKCHICRRKITIRIRLFPD

SEQ ID NO: 214443 - protein, 182 aa, Glycine max
  Coding DNA Sequence Number=SeqID_97665
  Gene Ontology: Mol. function=metalloendopeptidase inhibitor activity; Cellular component=outer membrane-bounded periplasmic space
  Homolog annotation: Hit_ID=Q03026; Match level="QueryCoverage=56%, HitCoverage=78%, E-value=3e-35, Identity=73%"; Hit description =Proteinase inhibitor precursor
RPRGHRHRGVRDARERPARPADARRGRGRRPRPGRDRRARHADQRAHPGDRQRCRGAGPRRPRGRSQPGELGRRAAQHQLPAVALLHPVVALALATEEHQGQAAAFEQRDPGRGRPPGARLAGQPARKAGGIAAQVVATGFRHFAVAQLQVADRGRLVLLQGPLPGEIGSAEKNQTAGHTDT

SEQ ID NO: 214444 - protein, 58 aa, Glycine max
  Coding DNA Sequence Number=SeqID_97666
  Gene Ontology: Mol. function=protein serine/threonine kinase activity; Biological process=protein amino acid phosphorylation
  Homolog annotation: Hit_ID=Q1SMH9; Match level="QueryCoverage=98%, HitCoverage=9%, E-value=2e-18, Identity=77%"; Hit description =Protein kinase
MEQYEILEHIGRGSFASALLVRHRHENKRYVLKKIRLARQTDRTHRSAHQEAPMYEYV

SEQ ID NO: 214445 - protein, 36 aa, Glycine max
  Coding DNA Sequence Number=SeqID_97667
MEKITADYYKTDCPRVSNYTEEGPTISTFTTILQIM

SEQ ID NO: 214446 - protein, 140 aa, Glycine max
  Coding DNA Sequence Number=SeqID_97668
  Gene Ontology: Mol. function=RNA-directed DNA polymerase activity; Cellular component=nucleus; Biological process=RNA-dependent DNA replication
  Homolog annotation: Hit_ID=Q2HRL2; Match level="QueryCoverage=87%, HitCoverage=30%, E-value=3e-27, Identity=44%"; Hit description=RNA -directed DNA polymerase
MVDWFALETILLETGIPKQFVKWIMLIVTSVTYRFNINGNYTKSMKANRGIRQRDPLSPVLFVIIMEYLNRLLHKMQRNPDFNHHSKCEKLNITNLAFADDVLLFARGDCRSVEMLMQTLNTFSETAGLVVVLTKVVKVL

SEQ ID NO: 214447 - protein, 176 aa, Glycine max
  Coding DNA Sequence Number=SeqID_97669
  Homolog annotation: Hit_ID=Q9FPS9; Match level="QueryCoverage=35%, HitCoverage=8%, E-value=6e-07, Identity=36%"; Hit description =Ubiquitin-specific protease 15
  Pfam annotation: Domain name=zf-MYND; Domain location=67-106; Score =29.9; E_value=9e-06; Accession=PF01753.9; Description=MYND finger
MEATITEEDKEFPGTQGLFFWLENKLSHNSSEANHYSKWKEHLQISDEINTLFCEQDENSTSAHCACSFCGRLSNIVTRCSRCKAAIYCSNACHVKHWRICHKYECVEKEGSQDQQESPFHGTHCLIMEPENGKFSFSEVIEQRSYKGDVYYVEGGENSAECVAIQALKYAQGAKP

SEQ ID NO: 214448 - protein, 221 aa, Glycine max
  Coding DNA Sequence Number=SeqID_97670
MVMKVSTRRGARQKVFDDGGRCSQWWPVVEWRPEERIRVITECFSIVFDTSKYDLGPLLVAIKKAIVADIGTDLLLQLCSPSRMKSDVSVFVCGDDSDDCGHVSNCNDDRDISNGHSDNNSGSVGRGNIGGGGDADSGGGNDVGGDNQWCDDGSNVSSVGCDSGDTNDDRVMVVAVLVVTTSGSNFFKSTKANMFIYVINCTRSATKEGHDRRAVNTPSHR

SEQ ID NO: 214449 - protein, 122 aa, Glycine max
  Coding DNA Sequence Number=SeqID_97671
  Gene Ontology: Mol. function=DNA-directed RNA polymerase activity; Cellular component=nucleus; Biological process=transcription
  Homolog annotation: Hit_ID=Q5D868; Match level="QueryCoverage=73%, HitCoverage=4%, E-value=3e-20, Identity=53%"; Hit description=DNA -directed RNA polymerase alpha subunit
MVESMKYLPYQVCTPTDLLICMILEYSHQDGNIELENQDPSMTILRKLLRKVEIIKSSRSGEPNFESHHVEANDLQSVVDQYFQIRGTSKPARHIETHFGVNKELTESSTKAWLEKMGIKYI

SEQ ID NO: 214450 - protein, 49 aa, Glycine max
  Coding DNA Sequence Number=SeqID_97672
MDIRVDEAAHTTEMHLVAISCQILMQAPAMYGQILAKYVDHSYNFFAIS

SEQ ID NO: 214451 - protein, 148 aa, Glycine max
  Coding DNA Sequence Number=SeqID_97673
MASISARSDRTWQLIWTSKAKPKCKTFVWRMAFDILQVREKLRIKHIVDNPSCPIMLCGPIDMVCFESELAGWSMNQKFLKGESIDVHNVLQRENDVMPRKRNDQNQIENHQEEPQIFRWKAPVKGVVKANFDVLVKENGGSSLRVIF

SEQ ID NO: 214452 - protein, 79 aa, Glycine max
  Coding DNA Sequence Number=SeqID_97674
  Subcellular localization annotation: CTP_CleavageSite=20; ConfidenceScore=5.02e-01
MASELSTDTTKTSTSSDSSSATSKKCPFFTTDNGHQPEYPEFVNFRYDGTIYQIRLRQYRTKVYFAEGLKEFRKDLSIF

SEQ ID NO: 214453 - protein, 268 aa, Glycine max
  Coding DNA Sequence Number=SeqID_97675
  Gene Ontology: Cellular component=mitochondrion
  Homolog annotation: Hit_ID=Q9LEV3; Match level="QueryCoverage=85%, HitCoverage=92%, E-value=2e-59, Identity=56%"; Hit description =Protein At5g10860, mitochondrial precursor
  Pfam annotation: Domain name=CBS; Domain location=77-229; Score=47.9; E_value=3.5e-11; Accession=PF00571.18; Description=CBS domain
  Subcellular localization annotation: CTP_CleavageSite=34; ConfidenceScore=5.15e-01
MQGGFQSFLSHGNVIRNAVLQRVRMVNPLLQPIVSSRFESVTPARIEEHGFESTTISDILNDKGKGADGSWLWCTTDDTVYDAVKSNQRKSGKNCLLMLFHLLLSILAIYDAKILYNLREIVSDAVKWSKYLQHCMLIMFVPGSLMLTIWSSFYPDYLRKIIVQGRSSKSTKVGDIMTEENKLITVTPDTKVLQAMQLMTDKRIRHIPVIDEKGMVGMVSIGDVVRAVMSDADACVIVASFTVAIEGLTKLIFSLGLGTDYEGLSRVK

SEQ ID NO: 214454 - protein, 285 aa, Glycine max
  Coding DNA Sequence Number=SeqID_97676
  Gene Ontology: Mol. function=cytochrome-c oxidase activity; Cellular component=integral to membrane; Biological process=electron transport
  Homolog annotation: Hit_ID=Q75HA3; Match level="QueryCoverage=69%, HitCoverage=77%, E-value=5e-45, Identity=44%"; Hit description =Expressed protein
  Pfam annotation: Domain name=DUF887; Domain location=44-278; Score =222.2; E_value=1.2e-63; Accession=PF05967.2; Description=Eukaryotic protein of unknown function (DUF887)
MSLQTATRSLEPCVFLMRAVWFCIIKMRLLGEGFVLDVDEILRMGKKIILREELKKWEAYTSTAILSSLLFKGYGKLSSEEKIEWNNRGFSTFHALFVSSASFYLLILSDVFNVNSQDDIVINRSSRLSDTVLGVSIGYFLTDLAMILWNFPALGGLEYVLHHGISIGSITLCLLSGQVHIYILMVLFSESTTPFVNLRWYLDVAGLKSSKLYIWNGIALFFGWLMQKLSPLMYNKIYARVSHLVVTFECFLVPVVVMELLFLVVPGCKDFPVHVPFLPHRDPFG

SEQ ID NO: 214455 - protein, 104 aa, Glycine max
  Coding DNA Sequence Number=SeqID_97677
  Homolog annotation: Hit_ID=Q69L71; Match level="QueryCoverage=28%, HitCoverage=28%, E-value=5e-08, Identity=83%"; Hit description =Hypoxia-responsive family protein-like
MVEDVCFLYKVLPFYFLIAPFYRQTRMRRWKNTLKLRFLSQKIQEYSVIVFLCRKEIHEAIEGCLWLSGISRSIAYNWSRPNMKIGVRIIHATSSYRNIPVSRK

SEQ ID NO: 214456 - protein, 414 aa, Glycine max
  Coding DNA Sequence Number=SeqID_97678
  Homolog annotation: Hit_ID=Q9FJV7; Match level="QueryCoverage=27%, HitCoverage=38%, E-value=5e-13, Identity=33%"; Hit description =Arabidopsis thaliana genomic DNA, chromosome 5, P1 clone:MFO20
  Pfam annotation: Domain name=DUF607; Domain location=138-395; Score =233.4; E_value=4.9e-67; Accession=PF04678.4; Description=Protein of unknown function, DUF607
MWSRWWCGGGVGSLRQRVSFVFNGSHGSVGKVHPFDPFRGFGGEYCGGVGFVLKQMKRSVCSSTLLSSPAGVGGNSNSCGSGSDDNDNNNNNNGNGTEGSISFGDAKKFMRLVNVESLKMKLGRDGKEIIPFCELLQECKSMGVARSSEEALAFAKVLDEAGVILLFRDKVYLHPDKVKPITMYLMPGDAIHYPFSWSPSLSAMFGSFENVYVVWLRLQPFFSRNSHAGDSWLPTIPLLVLRLQASEFGEESHVVDLVRRAVPLALTAEDDPMREELKKLQEKKEEIDVLAHKQVRRILWSGLGFGVVTVGLFFRLTFWEFSWDVMEPITYFTTATGLVVGYAYFLFTSRDPTYQDFMKRLFLSRQRKLYMRYNFDVERFKELQCKCKTPLNAKTILKNRMGLELDLDDALHRD

SEQ ID NO: 214457 - protein, 285 aa, Glycine max
  Coding DNA Sequence Number=SeqID_97679
  Gene Ontology: Mol. function=ATPase activity, coupled to transmembrane movement of substances; Cellular component=integral to membrane; Biological process=transport
  Homolog annotation: Hit_ID=Q9LF78; Match level="QueryCoverage=68%, HitCoverage=25%, E-value=7e-34, Identity=46%"; Hit description =Mitochondrial half-ABC transporter
  Subcellular localization annotation: CTP_CleavageSite=3; ConfidenceScore=5.13e-01
MLAAAASASRHLLQRDASIGACSGSGNRVRSLLTASAITTTYPIRIRKCYSNGYGISFNNPKHRTCPSLLFAVKGFLSDSSNSNSPHGRVTRPYLPHPVNSSNVDGRALFSTSTKTDDGSQSQKAAASTIGKSSPPPPPGGQAADVKILGTLASYLWMKDNLEFRVRIVAALGLLVGAKILNVQVPFLFKLAVDSLTAGTGSMGALASNSSGLVLFATPVAVLIGYGIARSGASAFNGSVIHAMSDEQDMRRMGGLASSFPFTYATHAYWIGPIFIVLIVEKKLD

SEQ ID NO: 214458 - protein, 827 aa, Glycine max
  Coding DNA Sequence Number=SeqID_97680
  Gene Ontology: Mol. function=binding
  Homolog annotation: Hit_ID=Q9FGN7; Match level="QueryCoverage=77%, HitCoverage=98%, E-value=0.0, Identity=57%"; Hit description =Arabidopsis thaliana genomic DNA, chromosome 5, P1 clone:MFG13
  Pfam annotation: Domain name=TPR_2; Domain location=23-56; Score =16.5; E_value=0.095; Accession=PF07719.7; Description=Tetratricopepti de repeat
  Pfam annotation: Domain name=TPR_2; Domain location=442-475; Score =5.1; E_value=8.5; Accession=PF07719.7; Description=Tetratricopeptide repeat
  Pfam annotation: Domain name=TPR_2; Domain location=522-555; Score =17.8; E_value=0.04; Accession=PF07719.7; Description=Tetratricopeptid e repeat
  Pfam annotation: Domain name=TPR_2; Domain location=563-596; Score =6.5; E_value=5.8; Accession=PF07719.7; Description=Tetratricopeptide repeat
  Pfam annotation: Domain name=TPR_4; Domain location=23-48; Score=9.7; E_value=2.6; Accession=PF07721.5; Description=Tetratricopeptide repeat
  Pfam annotation: Domain name=TPR_4; Domain location=522-547; Score =7.2; E_value=5.1; Accession=PF07721.5; Description=Tetratricopeptide repeat
  Pfam annotation: Domain name=TPR_4; Domain location=563-588; Score =6.7; E_value=6; Accession=PF07721.5; Description=Tetratricopeptide repeat
  Pfam module annotation: Pfam domain module=TPR_2::TPR_2::TPR_2::TPR _2::TPR_4::TPR_4::TPR_4; Domain location=23-56::442-475::522-555::563- 596::23-48::522-547::563-588
EKRRGLLAQQQHKKNRVWMEAVAEGLWGLAEYHEKRGEIGKAVKCLEAICQSDASFFPIVEVKTRLRIATLLLHHSHNVNHAKSHLERSQLLLKSIPSCFELKCRAYSLLSQCYHLVGAIPPQKQVLHKGLELAASVGYEISMKLWSCNFNSQLANALSIEGDYQGSISALECGYVCATEVCFPELQMFFATSILHVRLMQWDDDNLVEQAVNRCNQIWESIAPDKNAAPHVDNLDAAMKIDMQQTQRIQELVKELNTLDQSLSRSDLHYRDRTALSKKQTMIQEQLQNMTGLSSIGQESLQPVYFGNVRRIIGDKLQLAPPPIDGEWLPKSAVYALVDLIVVVFGRPKGLFKECAKRIQSGMNIIQDELLKLGITDGVREVDLQHSSIWMAGVYLMLLIQFLENKVAIELTRAEFVEAQEALVQMKNWFMRFPTILQACECIFEMLRGQYAHSVGCYHEAAFHFIEAVKLTDSKSMQAMCQVYAAVSYICIGDAESSSQALDLIGPVYGVMDSFVGVREKTGVLFAYGLLLMKQQDLQEARNRLARGLQLTHTYLGNLQFVSQYLTILGSLALALHDTVQAREILRSSLTLAKKLYDIPTQIWVLSVLTVHQLNDLDIKRAMADPTMGVNLDIPESIGLSAPLSAPSSSRLVDIDTRRRPSGLKSLADRVSTYQQGGGGVRIAMLEDGVFHKILQDLVMHDSVKVGIVALAKRSTRSGGSEKEKAEEGEVVEEGGGGGNNDRNHDNNKDNYNRMSYAKNIVVINALDSRRGWEGLECVKASVSSFRHATEVVMVVVVAANNADAAAAAENKIRMKRIMDCALSTLC

SEQ ID NO: 214459 - protein, 494 aa, Glycine max
  Coding DNA Sequence Number=SeqID_97681
  Gene Ontology: Mol. function=oxidoreductase activity, acting on the CH-OH group of donors, NAD or NADP as acceptor; Cellular component =glycerol-3-phosphate dehydrogenase complex; Biological process =glycerol-3-phosphate catabolic process
  Homolog annotation: Hit_ID=P52425; Match level="QueryCoverage=71%, HitCoverage=92%, E-value=1e-172, Identity=85%"; Hit description =Glycerol-3-phosphate dehydrogenase [NAD+]
  Pfam annotation: Domain name=NAD_Gly3P_dh_C; Domain location=222-382; Score=263.1; E_value=5.8e-76; Accession=PF07479.4; Description=NAD -dependent glycerol-3-phosphate deh
  Pfam annotation: Domain name=NAD_Gly3P_dh_N; Domain location=32-205; Score=240.2; E_value=4.4e-69; Accession=PF01210.13; Description=NAD -dependent glycerol-3-phosphate deh
  Pfam module annotation: Pfam domain module=NAD_Gly3P_dh_C::NAD_Gly3P _dh_N; Domain location=222-382::32-205
MAPALEEGGERETSVAQNNSLNSVVNDATHRSKVTVIGSGNWGSVAAKLIASNTLRLSSFHDEVRMWVYEETLLSGEKLTDVINRTNENVKYLPGIKLGKNVVADPDLESAVKDSNMLVFVTPHQFMEGICKRLVGKIREDAEAISLVKGMEVKMEGPCMISSLISQQLGINCSVLMGANIANEIAVEKFSEATVGYRLNREVAERWVQLFYTHYFIVTAVQDVEGVELCGTLKNVVAIAAGFVDGLEMGNNTKAAIMRLGLREMKAFSKLLFPSVKDSTFFESCGVADLITTCLGGRNRKVAEAYARNGGKRSFDELEAEMLQGQKLQALIKAENRKGVSTASEVYEVLSHRGWLELFPLFSTVHEISTGLLPPSAIVEYSEKLPRVCHKEISSSTPKITSYTFLERCLYLLDWPIRNAKYIIKTQKECPNALLVEGILRWAIDSCTSQVASNTSVLAFGMVNSKCCRKQLGGAGSNNHLDVVHALIYELVDG

SEQ ID NO: 214460 - protein, 65 aa, Glycine max
  Coding DNA Sequence Number=SeqID_97682
KRPELQEKAVNSIQKLVAEKGREGLKAFSASQAVADEARVMESADQVLSKEMATLKKLYEDLVMH

SEQ ID NO: 214461 - protein, 122 aa, Glycine max
  Coding DNA Sequence Number=SeqID_97683
MNSKRSDSNLRRGIYSSRENVQNNLAWNIGDGTSVDFWKHEWVPFRGKLLGIASCPIPVDRVSNKVCLYTNQNAYISSLDNNALCDDPLYSAIWNWRGPERVRVLLWKIGVNVFLKNENRCS

SEQ ID NO: 214462 - protein, 105 aa, Glycine max
  Coding DNA Sequence Number=SeqID_97684
  Subcellular localization annotation: CTP_CleavageSite=43; ConfidenceScore=5.74e-01
MSFLHDTAFYDPSPPSPCHPRSFGVSSFASWGSSLLPRDSGCSQRTKRSFFSCDSKPLCNFWKSRRGSSKDWRPIKCAGTYHMAVETWREIRQLVLTNPIARTFH

SEQ ID NO: 214463 - protein, 57 aa, Glycine max
  Coding DNA Sequence Number=SeqID_97685
MPYPHCIILLNPITQQMLRISHWSPSAPHEIGDINSPIIKYAPREQLEMRCTEISSN

SEQ ID NO: 214464 - protein, 177 aa, Glycine max
  Coding DNA Sequence Number=SeqID_97686
  Gene Ontology: Mol. function=RNA-directed DNA polymerase activity; Cellular component=chromatin; Biological process=chromatin assembly or disassembly
MADEDISKTAFRTHHGHYEYRVMPFGLCNMPSTFQAAMNNLLRPFLRKFTILPQVLIVPIWATPARLVGSRRLRKFVKGYAAIMAPLTKLLCKDAFHWVSESQTAFEKLKTTMTAAPVLALLDFVIPFALETSASSTVMGPVLHQQGHPIAYFSKPFCFHLQQASAYVMELHAIVAA

SEQ ID NO: 214465 - protein, 49 aa, Glycine max
  Coding DNA Sequence Number=SeqID_97687
MDEQVSEELCGNIGKGVLNNKVTIPSIKPISLVDVKVDEEYEIVITNPA

SEQ ID NO: 214466 - protein, 845 aa, Glycine max
  Coding DNA Sequence Number=SeqID_97688
  Gene Ontology: Mol. function=binding; Cellular component =intracellular; Biological process=metabolic process
  Homolog annotation: Hit_ID=Q1T265; Match level="QueryCoverage=92%, HitCoverage=87%, E-value=1e-120, Identity=26%"; Hit description =Tetratricopeptide-like helical
  Pfam annotation: Domain name=PPR; Domain location=115-149; Score =25.5; E_value=0.00019; Accession=PF01535.11; Description=PPR repeat
  Pfam annotation: Domain name=PPR; Domain location=218-252; Score =22.3; E_value=0.0017; Accession=PF01535.11; Description=PPR repeat
  Pfam annotation: Domain name=PPR; Domain location=255-289; Score =18.7; E_value=0.021; Accession=PF01535.11; Description=PPR repeat
  Pfam annotation: Domain name=PPR; Domain location=357-391; Score =40.5; E_value=5.9e-09; Accession=PF01535.11; Description=PPR repeat
  Pfam annotation: Domain name=PPR; Domain location=392-426; Score =45.2; E_value=2.2e-10; Accession=PF01535.11; Description=PPR repeat
  Pfam annotation: Domain name=PPR; Domain location=493-527; Score =44.3; E_value=4e-10; Accession=PF01535.11; Description=PPR repeat
  Pfam annotation: Domain name=PPR; Domain location=528-562; Score =37.0; E_value=6.6e-08; Accession=PF01535.11; Description=PPR repeat
  Pfam annotation: Domain name=PPR; Domain location=629-663; Score =38.3; E_value=2.7e-08; Accession=PF01535.11; Description=PPR repeat
  Pfam annotation: Domain name=PPR; Domain location=664-698; Score =16.6; E_value=0.081; Accession=PF01535.11; Description=PPR repeat
  Pfam annotation: Domain name=PPR; Domain location=699-733; Score=8.4; E_value=0.76; Accession=PF01535.11; Description=PPR repeat
  Pfam module annotation: Pfam domain module=PPR::PPR::PPR::PPR::PPR::PP R::PPR::PPR::PPR::PPR; Domain location=115-149::218-252::255-289::357- 391::392-426::493-527::528-562::629-663::664-698::699-733
  Subcellular localization annotation: CTP_CleavageSite=22; ConfidenceScore=5.32e-01
MHTLLSEALTHPPLLSHPPRTRSSSNRASLSLLPSNLNPHLTLLYHEPPSSTTYASILDSCGSPILGKQLHAHSIKSGFNAHEFVTTKLLQMYARNCSFENACHVFDTMPLRNLHSWTALLRVYIEMGFFEEAFFLFEQLLYEGVRVRLDFFVFPVVLKICCGLCAVELGRQMHGMALKHEFVKNVYVGNALIDMYGKCGSLDEAKKVLEGMPQKDCVSWNSLITACVANGSVYEALGLLQNMSAGECGLAPNLVSWTVVIGGFTQNGYYVESVKLLARMVVEAGMRPNAQTLVSVLLACARMQWLHLGKELHGYVVRQEFFSNVFVVNGLVDMYRRSGDMKSAFEMFSRFSRKSAASYNAMIAGYWENGNLFKAKELFDRMEQEGVQKDRISWNSMISGYVDGSLFDEAYSLFRDLLKEGIEPDSFTLGSVLAGCADMASIRRGKEAHSLAIVRGLQSNSIVGGALVEMYSKCQDIVAAQMAFDGVSERDLPTWNALISGYARCNQAEKIRELHQKMRRDGFEPNVYTWNGIIAGYVENKQYDSAMQLFTEMQIANLRPDIYTVGIILAACSRLATIQRGKQVHAYSIRAGHDSDVHIGAALVDMYAKCGDVKHCYRVYNMISNPNLVSHNAMLTAYAMHGHGEEGIALFRRMLASKVRPDHVTFLAVLSSCVHAGSLEIGHECLALMVAYNVMPSLKHYTCMVDLLSRAGQLYEAYELIKNLPTEADAVTWNALLGGCFIHNEVDLGEIAAEKLIELEPNNPGNYVMLANLYASAGKWHYLTQTRQLMKDMGMQKRPGCSWIEDRDGIHVFVASDKTHKRIDDIYSILNNLTNLIRIKHMNHL

SEQ ID NO: 214467 - protein, 354 aa, Glycine max
  Coding DNA Sequence Number=SeqID_97689
  Subcellular localization annotation: CTP_CleavageSite=59; ConfidenceScore=5.28e-01
MRFLLEFESESDHDKNDEPYVPSRRRKTTNNHKTPKKVMSSTKRKRNGGRSSTSRTNVSSRNGVPERNDHQQNVSNLPQRGDQNELHAEAEAEPDNPEMVPSSDKRPAASPSGESGQHTTTAADASSSPEFAGENINGTHSSALVEENNSTAQEPAAAKTTRASNQNLSFGEPFYGENSTPCLASDRHDQTNDKGKKVHQTIPAIVLDQSPNAELGCSDAPASGSRPSSLHLEGANTSCWSNPKNSLSSGLDLNLAPDEQGGDLQCLMSTNMNQPPQHSNTVLPFGYSDLQRGVGLLNPMGPFPMQQPNLLSAELLVPSGGRFIMEGRRMRNLDLNQPPPQEAQNEVENHNLRD

SEQ ID NO: 214468 - protein, 135 aa, Glycine max
  Coding DNA Sequence Number=SeqID_97690
  Subcellular localization annotation: CTP_CleavageSite=64; ConfidenceScore=5.38e-01
MRKIPKRRGKRVFLLSFLDPGSPRLASGLPGTSKDSRVSLRSPVQAALVPNALFSINRCRNLPSAGGRRGAHGCVFHGRKMRGVATNVYSRKTLEKTGKERNIKVLNINDLLGRSTKAGLLLLRILNCDEEIRPT

SEQ ID NO: 214469 - protein, 320 aa, Glycine max
  Coding DNA Sequence Number=SeqID_97691
MASRKRKRIGSRPTVHYDTRRLSSFEAWTRYTNNVLGRHILPERKVEIYHTELDEFKAELERRNFHKSLTNLVDNNIDLALVKEFYANLYSSEGPSPKQVKIIGHLVRIDADNLNTFLETPVVLAEGETLPTYSKYYRSSTDIREIKASLCIPSRGFILNSEGHPGKILRKDLTTLAQVWSVLSYSNLAPTSHTLDLTVDRARLIFGLVSEMDMNVGALISGQITSMAQSNSSRLGFPALITALCKSRGVASDSLIFERLSSVINLAYIRKNYWNPDDLTVTIRGARKVRTRLVEAPSTSTAPPLAHTLTVPFVTAFADS

SEQ ID NO: 214470 - protein, 152 aa, Glycine max
  Coding DNA Sequence Number=SeqID_97692
ADTNSTNANSTMWLQSRKRNPVCDKHELRQKEKQQECPGSTLSGTLSFPTFLRPAKDVPQSISGKDDLHNVVAVMEAQASLTQRRSQAEGERRRTIGFKRAGYAILEVYVAQNLVKEEKDESLKVVPNAANILKDSSVSGSKGDDTQMVETV

SEQ ID NO: 214471 - protein, 147 aa, Glycine max
  Coding DNA Sequence Number=SeqID_97693
  Gene Ontology: Mol. function=protein binding
MTMDRLSQSSSDSPTRGDPKVLSIECLKGSSKAHEWTGDMLQTGDIVEELRIGASPNALISFRSPFKNGKSGVNRILQDSYKKKDTSILVLVRRGPHEFAELQACIVPNDSSGKKHYVLRSITDPNYVVAFLDRTETECFQLQELTI

SEQ ID NO: 214472 - protein, 48 aa, Glycine max
  Coding DNA Sequence Number=SeqID_97694
MQGLRGSRQIKGQLRVSNTGKDLNLSALYQKAMSVMKNKYQVLKKLMR

SEQ ID NO: 214473 - protein, 338 aa, Glycine max
  Coding DNA Sequence Number=SeqID_97695
  Gene Ontology: Mol. function=protein binding; Biological process =defense response
  Homolog annotation: Hit_ID=Q109S4; Match level="QueryCoverage=72%, HitCoverage=18%, E-value=2e-62, Identity=50%"; Hit description=NB -ARC domain containing protein, expressed
MVNALTRTRLQDGYVSYPWERRMQELLSVPNSSNFLSILLLPKVSDRIAARYNDVEDTLARANTWLNAAQASGVPIVFMNVQTESLLTKISGETASSTVNAGSLSDLSNLANASLYGFEDYHGVDIGVVRAVRLWYAPIGGEISIEIKLKEDDAKLGFAISRTEEGFIFIQTVIEDNQENVPATRSGLSNLYKAAKDTSKLLVVSRLSNQRVLPWMVSSTGAIRCYDTVSLSQKLSLHRHTKVPILLHVFLWDRTLASSLESTRLSSLSPSVLPLPLSQEVQLAPHPNENQIQPLPHEGSDAGGGVSSVGSQPMQLERDTAGDLSFRFHNFSVSNCWL

SEQ ID NO: 214474 - protein, 82 aa, Glycine max
  Coding DNA Sequence Number=SeqID_97696
  Subcellular localization annotation: CTP_CleavageSite=55; ConfidenceScore=5.25e-01
MAIKKALILVIFIFLVSLPFLQSSTSSRIYQTNMAGTGSIATNKEVARFGNEAASAGIVEDSAREVPTGPDPLHHNNHPIGH

SEQ ID NO: 214475 - protein, 78 aa, Glycine max
  Coding DNA Sequence Number=SeqID_97697
  Homolog annotation: Hit_ID=Q8LSY4; Match level="QueryCoverage=49%, HitCoverage=21%, E-value=6e-10, Identity=70%"; Hit description =Phosphoribosyltransferase
MSDLAGNLLKKLSGTDGSLWRNLGCLSIKKPMRRERNGTKIKAVAVSEAESKSVKVKAVITVQPTVARSINSLGACSH

SEQ ID NO: 214476 - protein, 173 aa, Glycine max
  Coding DNA Sequence Number=SeqID_97698
  Gene Ontology: Mol. function=oxidoreductase activity, acting on single donors with incorporation of molecular oxygen, incorporation of two atoms of oxygen; Cellular component=chloroplast; Biological process=fatty acid biosynthetic process
  Homolog annotation: Hit_ID=P93698; Match level="QueryCoverage=85%, HitCoverage=16%, E-value=9e-56, Identity=68%"; Hit description =CPRD46 protein
  Pfam annotation: Domain name=PLAT; Domain location=17-108; Score =49.5; E_value=1.1e-11; Accession=PF01477.13; Description=PLATLH2 domain
MDPFPTWIQCDRTPEQCSGSGLQTKLEKETIKDYAHSTHRSAQEIKYKAEFEVPDSFGEVGAISVENEHHREMFIKDIVLDGFLLRPVKFTCESWIHSKYDNPVKRVFFSNKSYLPSETPEEVKRLREEQLEHLRDKGQGERKRLERIYEYDAYNDLGESTTTSVLIRNVLIN

SEQ ID NO: 214477 - protein, 589 aa, Glycine max
  Coding DNA Sequence Number=SeqID_97699
  Gene Ontology: Mol. function=carboxypeptidase activity
  Homolog annotation: Hit_ID=Q1SIS3; Match level="QueryCoverage=69%, HitCoverage=85%, E-value=9e-68, Identity=36%"; Hit description =Peptidase M14, carboxypeptidase A
  Pfam annotation: Domain name=DUF827; Domain location=218-380; Score= -107.9; E_value=0.021; Accession=PF05701.2; Description=Plant protein of unknown function (DUF827)
MAATTATSAQVSKDYKDSNNGNPEITRQEIQAAIAKAVELRALHAALMRGNSPANARFPSPSPASGPVSHFSAQDYPVFTPSYEDDSMVGYTQNSMKSLTVSESWDGSVLEGGNSVENIVAYYKGKSSSRKGLYAGFANLESHICPTEDTKSVTGSSANQITVLQTSPANDDFFKCRRRNSMEDFKSASSCNKCNPATLTSEFENARNSKSSNIVVPVTDSHSSLQSQPKSKGVISWLFPRLKKKHKNENSPNRAESEDVSQVLKDLGIMSIETLKKELVEANENRDVALMEVSEMRSSLGELKQKLEYLESYCEELKKALKQAMQTRDSQPCDQLSSLPQRGKSFEGNGENLMPVSEEVMVEGFLQIVSESRLSVKQFCKTLINHIEETDHSLTENLNLLLQPYKLSLNSKYSKAVLYHFEAFINQFLYQDFENCVFQKNGCSKFLDPQQDRQAQFSSFVALRNLSWSEVLRKGTKYYSEEFSKFCDQKMSCINTSLKWTRPWPEQLLQAFFVAAKCMWLLHLLAFSFNPPLGILRVEENKTFDPQYMEDMCPRSQGPSRVKIMVMPGFYVQDRVLRCKVLCRYKSAA

SEQ ID NO: 214478 - protein, 58 aa, Glycine max
  Coding DNA Sequence Number=SeqID_97700
MPCGRLDVELDPSAALALASWLTLPWCPMHAIKKVMRTFQLPVTKMMRQMRCMSDDMA

SEQ ID NO: 214479 - protein, 1491 aa, Glycine max
  Coding DNA Sequence Number=SeqID_97701
  Gene Ontology: Mol. function=oxidoreductase activity; Biological process=electron transport
  Homolog annotation: Hit_ID=Q1RYZ2; Match level="QueryCoverage=69%, HitCoverage=77%, E-value=0.0, Identity=74%"; Hit description=NAD -binding site; Serine/threonine dehydratase, pyridoxal-phosphate- binding site; ...
  Homolog annotation: Hit description=AMP-dependent synthetase and ligase
  Pfam annotation: Domain name=AMP-binding; Domain location=229-686; Score=249.9; E_value=5.4e-72; Accession=PF00501.18; Description=AMP -binding enzyme
  Pfam annotation: Domain name=Hexapep; Domain location=1005-1022; Score=2.4; E_value=74; Accession=PF00132.14; Description=Bacterial transferase hexapeptide (three rep
  Pfam annotation: Domain name=Hexapep; Domain location=1127-1144; Score=1.7; E_value=88; Accession=PF00132.14; Description=Bacterial transferase hexapeptide (three rep
  Pfam annotation: Domain name=Hexapep; Domain location=1182-1199; Score=5.6; E_value=30; Accession=PF00132.14; Description=Bacterial transferase hexapeptide (three rep
  Pfam annotation: Domain name=Hexapep; Domain location=958-975; Score =4.9; E_value=37; Accession=PF00132.14; Description=Bacterial transferase hexapeptide (three rep
  Pfam annotation: Domain name=Hexapep; Domain location=987-1004; Score= 10.3; E_value=7; Accession=PF00132.14; Description=Bacterial transferase hexapeptide (three rep
  Pfam annotation: Domain name=PP-binding; Domain location=830-888; Score=14.9; E_value=0.0063; Accession=PF00550.15; Description =Phosphopantetheine attachment site
  Pfam module annotation: Pfam domain module=AMP-binding::Hexapep::Hexap ep::Hexapep::Hexapep::Hexapep::PP-binding; Domain location=229 -686::1005-1022::1127-1144::1182-1199::958-975::987-1004::830-888
MDASDLEKDLFSKVETNDYYTTVLKIKGLEHLPVGFYYFSEYMEDPSTMGHPVAMQRFYSDTNIFLLWSYGNSVDIKEPTVMELVIKTIEAIGGEVEHVILQRALCIFLMLAAKLESELQGSRNTYYVGGLMAFELTERNSSYAMALICKNFAYRNDFPIFPYTKNLFPLQALCQKKNRRELGELPEVQFPNLPTLNSYLTHWGTHPITQNRALYTWINEEGTPVCQRTYGELYFNSSCIAHKLLTSQKPVIKPGDKVLLIYVPGLDFIDAFFGCLRAKVIPVPILPPDPMQRNGQALIRIENVAKSCNIVAILSTVAYHSAVRAGSLKNLISLTEKNGKSSARWPNLPWLHTGTWVKNSKSMILEHLDKQCEPQPGDICFLQFTSGSTSDAKGVMITHGGLIHNVKFMRTRYKSTSRTTLVSWLPQYHDMGLIGGLFTSLVSGGSAVLFSPMTFIKKPLLWLETISKYQATHSAGPNFAFELLIQRLESDKDKLQNLDLSSLTFLMVAAEPVRQKTMKRFIELTSPFGLSEKVMAPGYGLAENCVFVSCAFGEGKPIIVDWQGRICCGYVNHKDADVDIRIVDPETCEELQEDGKEGEIWISSPSAGIGYWGREELSQKTFRNELHNHPGRSYTRTGDLGRIIDQKLFITGRIKDLIIVAGRNIYSADVEKTVETSSEFLRPGCCAVIGVPEEILSAKGISTPDGSDQVGLVVIAEVRDGKPVSKDLIEKIKTRVVEEHGVNVASVKLIKPRTISKTTSGKIKRFECVKQFTDETLNLVPQGSKTILTKKSLLRPFTTGAWGEEKRPGTQQVRSILAPRKRISKNEIVEFLKGLISEQTGIPINDISVTDNLTSYGIDSIGVVKATQKLSDFLGTPVAAIDDLLSKSQPQLSSNLPNIPEAESDSTEFIVEAQEISSKILAIHLRGTVLLNYWFEMLGARIGSSVLLDTVDITDPSMVSIGDEVVISEGVLVQSHEVKNGILSFHPIRIGKCSSIGPYAVIQKGSVIGEGVEVQALRKVGQDQHVFKPAKLNNDNKKCYVQSLPTSYIFGSPSNLHHPNTSPFAYLLHGFILIILTTAFTRLLKTCQKKTQFKTQLQCQMITSCHLRCAKLLSGTEAFCIYLRLLGAKIGKHCSIRAINRVSNPELMSIGDGVHLGDFSCVITGFHSSSGYVSGEVEVQDNSVIGSQSLILPGSLVQKNVILGALSVAPMNSTLQEGGVYIGSQSQVVIRNSVKNAYDEGIEEMDMVSKKRVGNLAAALHKNDSQKVTLTRTWYQTFSALFTQPLLQTVLPHMVLGLAVFAPLNCVVYLKSAKNLPIYWLLPLFWIHSGALAALACVIAKWILAGKKKAGEAVPIWSQRITLDSTWQAIRTLVGDYFMDMTSGSFWFVLWMKLMGAKVDMEHAVYVDSMGALLNPEMVKIERGGCVGREALLFGHVYEGEGGMVKFGEIKIGEYGFAGSRAVAMPGVQIESEGNLSALSLAMKEEIIRSR

SEQ ID NO: 214480 - protein, 103 aa, Glycine max
  Coding DNA Sequence Number=SeqID_97702
MCFLRILFLQNLQKNPQYRPKTWTQLHRFRLWSIKIQEDVKLNYTNIYLAFDYWVLAVAKKHIYFKVSNPKLHTHLFAWAEVDLMAMKDRNVAVKRDVMETRC

SEQ ID NO: 214481 - protein, 116 aa, Glycine max
  Coding DNA Sequence Number=SeqID_97703
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q1RYZ9; Match level="QueryCoverage=55%, HitCoverage=14%, E-value=5e-26, Identity=76%"; Hit description =Glycoside hydrolase, family 1
MVYATTYNRKLSRNHAVFAGKSITKLHRSNPSYLLDTYRIDYFYRHLYYILIAIKDGVNVQGYFAWSLMDNFEWSAGYTLRFGINFVDYKDNLKRHQKALCPFGLGIFFKNTRLIV

SEQ ID NO: 214482 - protein, 56 aa, Glycine max
  Coding DNA Sequence Number=SeqID_97704
MKPEGKRLQFREETSRIGATACVIVTEELITRVKTPTRRRRMASTSVCCNLQASIK

SEQ ID NO: 214483 - protein, 737 aa, Glycine max
  Coding DNA Sequence Number=SeqID_97705
  Gene Ontology: Mol. function=oxidoreductase activity, acting on single donors with incorporation of molecular oxygen, incorporation of two atoms of oxygen; Cellular component=chloroplast; Biological process=fatty acid biosynthetic process
  Homolog annotation: Hit_ID=Q45HK6; Match level="QueryCoverage=99%, HitCoverage=81%, E-value=0.0, Identity=68%"; Hit description =Lipoxygenase LOX2
  Pfam annotation: Domain name=Lipoxygenase; Domain location=48-721; Score=1220.6; E_value=0; Accession=PF00305.9; Description =Lipoxygenase
MFLETIHLDGFPEGPIHFHCASWVHSKFDNPTNRVFFSNKCYLPQETPGGLRRLRAKELSNLRGNGEGERKSFERIYDYDIYNDIGDPDKSLELQRPPLGGNERPYPRRCRTGRPHSEADPLSEKRSRKFYVPRDECFSEVKQLTFSTKTLHSVLLILLPSLGKIIKEKDLAFSYFDDIDSLFSHGLDLPPEETEKGFLGKIMPRLVKSISGDRAHVLRFETPETMSRDRFFWFRDEEFARQTVAGLNPYSIRLVTEWPLKSKLDPEKYGPPESAITSEIINKEIGGIMSVEKAIEEKKLFMLDYHDVLLPYVNKVRKLKGKTLYGSRTLFFLNPEGTLRPLAIELTRPPSLSNKTGQWKQVFTPSWHSTSVWLWRLAKAHVLAHDSGYHQLVSHWLRTHCATEPYVIATNRQLSEMHPINKLLHPHFRYTMEINALAREALINADGTIESSFAPGKYALEISSAAYALEWRFDKQALPADLIRRGIAVEDPFSPHGLKLTIQDYPFANDGLLLWDAIKLWVTDYVNHYYPEPSLVESDEELQAWWTEIRTLGHADKKDEPWWPHLKTPKNLIGILNTIIWVTSGHHAAVNFGQYVYGGYFPNRPTIARTKMPSEDPTEEEWKKFIEKPERALLKCFPSQLQATRVMAVLDILSTHSPDEEYIGEKMEPSWGEDPVIKASFERFRERLKKLETLIDERNGNTKLKNRNGAGIVPYELLKPFSKPGVTGMGVPCSISI

SEQ ID NO: 214484 - protein, 179 aa, Glycine max
  Coding DNA Sequence Number=SeqID_97706
  Gene Ontology: Mol. function=RNA-directed DNA polymerase activity; Cellular component=nucleus; Biological process=RNA-dependent DNA replication
  Homolog annotation: Hit_ID=Q1S4N5; Match level="QueryCoverage=94%, HitCoverage=33%, E-value=1e-43, Identity=52%"; Hit description =Peptidase M, neutral zinc metallopeptidases, zinc-binding site
MAFLQQEAQNIFKSLFQSIERCTPSSLVLHDIPKVSQDFHDSLLNLVTSEEVCFATFSMAPYKAPGVNGFQPIFYQSYWHIISDGVWRLVNKAFYTGSIPPKLDETLIVPVLKVDNPTSFRGFRSINLCNVIFNVICKVLVNRMRPHLGSIIGPLQSSFIPNGGTFDNAMITHYMHKKK

SEQ ID NO: 214485 - protein, 78 aa, Glycine max
  Coding DNA Sequence Number=SeqID_97707
MTFSCHIVKFELQNELVHGMAPKKLLSKKARKDAVGEGSSAAPQVDVEFGGHRFEVRNTSAVLRQLRVGHSLRKDGSS

SEQ ID NO: 214486 - protein, 100 aa, Glycine max
  Coding DNA Sequence Number=SeqID_97708
MRKETRAYLRGETEATTCNNGCVWFACEKWQGEDEEELFSYLAASNRARLVVQPCPVTVEALDTVSHRSRTSMRVRCASDAGHAAEVPRPCFLGYNVPYC

SEQ ID NO: 214487 - protein, 45 aa, Glycine max
  Coding DNA Sequence Number=SeqID_97709
MNLDFLAHRIEISNSEGGGESTGQWAVRKAPSSDLHSFFSHPLFP

SEQ ID NO: 214488 - protein, 162 aa, Glycine max
  Coding DNA Sequence Number=SeqID_97710
MVDVHAFWELGLCASLKHTCLAEGLAQGFGVEACGPKSGGLSYMAFTKEVNHGDYLVCEPILKYVEGGITLLSEIDIGKWSFFEFVGFLKQDVKIKGDLKLWWEGVDVGLKELMLDCHVVETLNHGLADFANVVDVEEGVGVGIAKLEGVGGVAEGVLGMRC

SEQ ID NO: 214489 - protein, 132 aa, Glycine max
  Coding DNA Sequence Number=SeqID_97711
  Subcellular localization annotation: CTP_CleavageSite=78; ConfidenceScore=5.30e-01
MEEHKVPAQATFLSTQAKTPSFFTFSTLAFHSRLHLGIYKFTKLKLKALPRMATSSKRQLTSMDDTFLSLRLSTCRCCSPHLKPAKLKSLVKPALPFSLPDAPILMATTLSVLPVAVATCHVSPPPRRRQWR

SEQ ID NO: 214490 - protein, 107 aa, Glycine max
  Coding DNA Sequence Number=SeqID_97712
MEMSSFHQFLDESLSEALNCFHRLLRKTPTHGYNDPSRTHNLRCNTGLKQAIGPTDRGLDRDPQQAPSATTSGKLKSLSLFNHANKGMPHLWWSTRARVMHRPRRFF

SEQ ID NO: 214491 - protein, 115 aa, Glycine max
  Coding DNA Sequence Number=SeqID_97713
  Gene Ontology: Mol. function=nucleic acid binding
MKEQQEVQRNQEERGPSSSELSSPSRLIQGNLFHGLPNEDLYAHLATHIEICNMVKITGVPEDAIRLNLFSFSLTSEAKRWLHSFKRNSMWTWEEVVEKFLKKYFPESKTVEGKV

SEQ ID NO: 214492 - protein, 67 aa, Glycine max
  Coding DNA Sequence Number=SeqID_97714
MIDPCGVKIVPSGKWRLIDLSRAHYNHLVVEQGWEWILWVMLGRSLWLIGHSLLEGRRPGGEPILAK

SEQ ID NO: 214493 - protein, 98 aa, Glycine max
  Coding DNA Sequence Number=SeqID_97715
MGKLNSLKHNKFSMLSSNLFTNNYHKALPNQNCPSYLPKPHIHKNQRCASRLWKCLPFAIWSRNGDQRLELCWATMVDERKEEEGCVRERERASENWG

SEQ ID NO: 214494 - protein, 71 aa, Glycine max
  Coding DNA Sequence Number=SeqID_97716
MVTRSVKFCNVVETKRKYCYAIRVQIAIMPTWAFQILPPKAGCFWRKEPGSARRAELVWACWVASSSPILL

SEQ ID NO: 214495 - protein, 445 aa, Glycine max
  Coding DNA Sequence Number=SeqID_97717
  Homolog annotation: Hit_ID=Q0Z379; Match level="QueryCoverage=41%, HitCoverage=99%, E-value=2e-86, Identity=86%"; Hit description =Adenine phosphoribosyltransferase
RNRSAQRDRGHAGPGGQGPHGRGRDSRVLAGQRPERCRPGPGAFRGRAHTASRPARGRPRSGCDGGRGAPAPQAGHGAVRAHRRPGNGRIQDGRGGHARCSPWCGLCSCGARRRAPLGPLARAGRRRTRRGLSPQHAGPSGPGCHPVRRTALTGRRPDSVAGEIHQREQRQAAIVQQGGAAQFGQIHDGRALDHRGAQLFQQSLAGHHGAAGGDQVVDQQYAIAGLDGICVQLHRGAAVFELIGFLHRGERQLALLADGHKANAQLVGHHGTQDEAACIEPCHHVGAHAALHVAVHEGVGHHAKDLGILQQRRDVAELHAGRRPVGHGAYVRSQVVVDAEGGLHGAGSGAGKNGPVVLRLARDTLGIEADALLAMSQRLDGVFGEVVQRILSLSGRVVVMGMGKSGHVGRKVAGHPGIHGHSRLLRASGRGQPWRPGHGDRASIW

SEQ ID NO: 214496 - protein, 67 aa, Glycine max
  Coding DNA Sequence Number=SeqID_97718
MKLTSTPTVTVAVRLATSGSEKEESRCGEFVTERNMSCGEEDNAGDTRVMVEAKIRNRCESIRVWSQ

SEQ ID NO: 214497 - protein, 117 aa, Glycine max
  Coding DNA Sequence Number=SeqID_97719
MVIMCLVAQARSCPTKCRDKLWFHWQGGSLAEWCFARTKLVSYLYFPFISNKRQVKRGNCHTLISSGDHPLLGCDPHLTTSRYLAPIVRKFVKFRDVPEVKRKHCSTISEVPRHDGN

SEQ ID NO: 214498 - protein, 166 aa, Glycine max
  Coding DNA Sequence Number=SeqID_97720
MDIIPDKYPLSVQNIKFGSKLYVNTDITEIHEFCQSLSVPFYSGGMINDKDGSQSQSSQSNVVEKFLQNAQVVSIGQINNLRQDCYCLTVGTIDEIIIDAPWSYDNCPNCTTTFDPSKGGSACRSCHTSVVDTVPRLAMIIFCTNYLFTRFAVLANFLEISMDVKV

SEQ ID NO: 214499 - protein, 107 aa, Glycine max
  Coding DNA Sequence Number=SeqID_97721
MVKTRGLGRVLGRVVGKGLGRGDGDDSDGAPQCQRPTASARWRRVPITVADDVPIVPADSPVVPVATCPSRASEGEAHGCAFQRRKGRKKRGFCSYVPSFGEEIRPT

SEQ ID NO: 214500 - protein, 275 aa, Glycine max
  Coding DNA Sequence Number=SeqID_97722
  Homolog annotation: Hit_ID=Q41005; Match level="QueryCoverage=43%, HitCoverage=41%, E-value=3e-45, Identity=76%"; Hit description =Serine carboxypeptidase-like
  Pfam annotation: Domain name=Peptidase_S10; Domain location=8-185; Score=-216.3; E_value=0.075; Accession=PF00450.12; Description =Serine carboxypeptidase
MKNERAAPRGRMEEEEALEGGRSSSSRRRRITKKKKSLAEEGEEEKPRGKEEEMARWQQPFSSMEKFLNQNSVRDSLGVGKIHFVSCSTKVSLAMFVDWMRNLEIGIPPLLEDGTNLLVYAGEYDLMGNWLVGNSRLVRAMEWSGQKEFATSLKVPFVVDGSEAELLKIYGPLSFLKLKENWERKESQKGSSLSQIGLHFRDCNHIVEFVFVEFVSSTYRLSSKKTRKGKSPGKGWNRFWKSIVVGFKTPREAIKVAVKVRCCFCSVCWLVISAD

SEQ ID NO: 214501 - protein, 91 aa, Glycine max
  Coding DNA Sequence Number=SeqID_97723
  Subcellular localization annotation: CTP_CleavageSite=36; ConfidenceScore=5.06e-01
MATPRIFPPLESAPVSLASLARKRARCDKSFLQKAVASGGSNLARLGELGGKLLPYFAINRGRSEEENGSAFLALLPLSKLLRKIIFVKKI

SEQ ID NO: 214502 - protein, 68 aa, Glycine max
  Coding DNA Sequence Number=SeqID_97724
MSRGSGDLGDDRRAPGSQPIKEQRPQSKEVCVVAGQLWILSDIWDMASGNRLPRVGNRLQGLKVKTGS

SEQ ID NO: 214503 - protein, 150 aa, Glycine max
  Coding DNA Sequence Number=SeqID_97725
MAKYDPKKVMEFYVNAWPTEEGVRDKHSWDFARSEIWRRVQIMRTSMTTLTQIWMTLRLSNILPNNHNSDLPLPKCQPVYAILTQGLHRKLMYAKAGTTVGLGTAVGGGPSSASHRCTTTASSSASFLRVHLYSPAEDRAPDACIYATCD

SEQ ID NO: 214504 - protein, 154 aa, Glycine max
  Coding DNA Sequence Number=SeqID_97726
  Gene Ontology: Mol. function=nucleotide binding; Biological process =DNA replication
  Homolog annotation: Hit_ID=Q5W2V5; Match level="QueryCoverage=92%, HitCoverage=13%, E-value=2e-63, Identity=84%"; Hit description =Putative TraG protein
MEDEGFHPPQNTDLYRHGYVIGGTGAGKTTTIISLITAIKKAYNNTIIMIFDPHGDMAEEVASYFADDEKLIYFHPVDSGISINPLALPNIPHKEQALLLGFSNVMEIFEKLFGLKDTAVYVKYIIQVSMQLLYSKTPEPTFRDLYRIIYKLRT

SEQ ID NO: 214505 - protein, 383 aa, Glycine max
  Coding DNA Sequence Number=SeqID_97727
  Gene Ontology: Mol. function=protein binding; Cellular component =integral to membrane; Biological process=xylan catabolic process
  Homolog annotation: Hit_ID=Q949G7; Match level="QueryCoverage=93%, HitCoverage=84%, E-value=4e-94, Identity=33%"; Hit description =HcrVf3 protein
  Pfam annotation: Domain name=LRR_1; Domain location=103-125; Score =11.9; E_value=1.7; Accession=PF00560.23; Description=Leucine Rich Repeat
  Pfam annotation: Domain name=LRR_1; Domain location=127-149; Score =13.7; E_value=0.68; Accession=PF00560.23; Description=Leucine Rich Repeat
  Pfam annotation: Domain name=LRR_1; Domain location=199-221; Score =6.7; E_value=16; Accession=PF00560.23; Description=Leucine Rich Repeat
  Pfam annotation: Domain name=LRR_1; Domain location=223-245; Score =15.0; E_value=0.28; Accession=PF00560.23; Description=Leucine Rich Repeat
  Pfam annotation: Domain name=LRR_1; Domain location=247-269; Score =16.6; E_value=0.091; Accession=PF00560.23; Description=Leucine Rich Repeat
  Pfam annotation: Domain name=LRR_1; Domain location=271-292; Score =8.9; E_value=6.2; Accession=PF00560.23; Description=Leucine Rich Repeat
  Pfam annotation: Domain name=LRR_1; Domain location=30-52; Score=9.7; E_value=4.5; Accession=PF00560.23; Description=Leucine Rich Repeat
  Pfam annotation: Domain name=LRR_1; Domain location=54-76; Score =10.5; E_value=3.2; Accession=PF00560.23; Description=Leucine Rich Repeat
  Pfam annotation: Domain name=LRR_1; Domain location=6-27; Score=12.0; E_value=1.6; Accession=PF00560.23; Description=Leucine Rich Repeat
  Pfam annotation: Domain name=LRR_1; Domain location=78-101; Score =12.3; E_value=1.4; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1; Domain location=103 -125::127-149::199-221::223-245::247-269::271-292::30-52::54-76::6 -27::78-101
MDEPVQLKFLNLASNNLSGEIPDCWMNWTSLVYVNLQSNHFVGNLPQSMGSLADLQSLQIRNNTLSGIFPTSLKKNNQLISLDLGENNLSGTIPTWVGEKLLNVKILLLRSNSFTGHIPNEICQLSLLQVLDLAQNNLSGNIPSCFSNLSAMTLKNQSTDPRIYSQAQFGLLYTSWYSIVSVLLWLKGRGDEYRNFLGLVTIIDLSSNKLLGEIPREITYLNGLNFLNLSHNQLIGHIPQGIGNMRSLQSIDFSRNQLSGEIPPTIANLSFLSMLDLSYNHLKGTIPTGTQLQTFDASSFIGNNLCGPPLPINCSSNGKTHSYEGSDGHGVNWFFVSMTIGFIVGFWIVIAPLLICRSWRGRVAERKEGKDRRCGEMELRITK

SEQ ID NO: 214506 - protein, 114 aa, Glycine max
  Coding DNA Sequence Number=SeqID_97728
MGDRVRWHAETNYGHSVSRHPGSIVSNKTQRQIMVILRLVSTERNKFDSIRMMCRQVNRGNCHTLISFGDHPLLGYDPRLTTLRYLAPIVRQFVKFHDMPEVKRKHCSTIREVP

SEQ ID NO: 214507 - protein, 96 aa, Glycine max
  Coding DNA Sequence Number=SeqID_97729
MSLWGRIASFAHDPKVLHCKVRLMRTLGPSPASLAQSSWSLLSNAFGVWDCIKPHHDLEFRLTLAGLRRLRSTKKLLWQLEPSTEKEYDDLPEDMP

SEQ ID NO: 214508 - protein, 56 aa, Glycine max
  Coding DNA Sequence Number=SeqID_97730
MSKSEGNGEVVNSDMPVSVEQSGETEMMEEDKNKREDAKPSKHLFDTALARVKRMS

SEQ ID NO: 214509 - protein, 65 aa, Glycine max
  Coding DNA Sequence Number=SeqID_97731
MTSEAVKEIIEKIVRFFGGAGIKGSFVPHGRQDVLIAAIRRAEHPGRVRAAGVGITIKQYFGSTP

SEQ ID NO: 214510 - protein, 137 aa, Glycine max
  Coding DNA Sequence Number=SeqID_97732
  Gene Ontology: Mol. function=transcription factor activity; Biological process=regulation of transcription, DNA-dependent
  Homolog annotation: Hit_ID=Q5LQB6; Match level="QueryCoverage=79%, HitCoverage=52%, E-value=1e-20, Identity=48%"; Hit description =Transcriptional regulator, TetR family
  Pfam annotation: Domain name=TetR_N; Domain location=30-76; Score =76.1; E_value=1.1e-19; Accession=PF00440.13; Description=Bacterial regulatory proteins, tetR family
MNERSFIFTRWRQAPPSPFRELPMGNREKIVEAALHSFTHRGFHQTSMRDIAQAAGVSVGNLYNHFTGKEALIGEIALLENGVFAEFAAGLRADRTRPKQALSAFFTAYHAFVAEPANVQLSAEIVAEVARNPALAE

SEQ ID NO: 214511 - protein, 48 aa, Glycine max
  Coding DNA Sequence Number=SeqID_97733
MEPCVWTNEREQERPLSDAKTNRRRAHDRGCINLVGCPRWGNRVVKEF

SEQ ID NO: 214512 - protein, 159 aa, Glycine max
  Coding DNA Sequence Number=SeqID_97734
  Subcellular localization annotation: CTP_CleavageSite=74; ConfidenceScore=5.48e-01
MVFVSPSTSEWQYFQPGSALFFLVALAVAASDDGLTRVFFFVTSSSSFARLLRLVRALPGLVVGAHRCRSCVVRAHRDACACKLREGVVSQRRMGAAGAGVTQAEEVLKGWVGSAQLLPRTKTKQIPPFPPFPPPRHDRHDYGGRHPKPATPPLFGGVF

SEQ ID NO: 214513 - protein, 133 aa, Glycine max
  Coding DNA Sequence Number=SeqID_97735
  Pfam annotation: Domain name=zf-C2HC_plant; Domain location=20-75; Score=76.6; E_value=7.9e-20; Accession=PF07567.3; Description =Protein of unknown function, DUF1544
MDEPSSDAATASATRKNKADPGWKYCHSLVEGDTNTIVCNFCGKITKGGITRAKQHLIGKSGDVAACKKTPPNVVEELKEYMATKKSGTTYSTSGSGNMANIRDFEFGEPIGCDGSEEDEFADSFNAAASAKT

SEQ ID NO: 214514 - protein, 231 aa, Glycine max
  Coding DNA Sequence Number=SeqID_97736
  Gene Ontology: Mol. function=isopentenyl-diphosphate delta-isomerase activity; Cellular component=cytoplasm; Biological process =isoprenoid biosynthetic process
  Homolog annotation: Hit_ID=P95997; Match level="QueryCoverage=62%, HitCoverage=39%, E-value=3e-56, Identity=78%"; Hit description =Isopentenyl-diphosphate delta-isomerase
  Pfam annotation: Domain name=polyprenyl_synt; Domain location=135 -231; Score=-89.4; E_value=0.0013; Accession=PF00348.8; Description =Polyprenyl synthetase
METAQLRYSYGIKNFDTARQGGTYWIAIEMIRDIIRGNWKTESAKNFLEWGVPTAASIMEVRYSVPDSFLVGSGGIRSGLDAAKAIALGADIAGMALPVLKSAIEGKESLEQFFRKIIFELKAAMMLTGSKDVNALKKTSIVILAGGKRLRPLILVSSSDLIGGDRQRAYKAAAAVEILHNFTLVHDDIMDRDYLRRGLPTVHVKWGEPMAILAGDYFHAKAFEALNEALK

SEQ ID NO: 214515 - protein, 53 aa, Glycine max
  Coding DNA Sequence Number=SeqID_97737
MAQHRIGHNGVWVVHGGWQEVETGKEGHICPLCFLWGAGRKQIGAGTYLVLTD

SEQ ID NO: 214516 - protein, 222 aa, Glycine max
  Coding DNA Sequence Number=SeqID_97738
  Subcellular localization annotation: CTP_CleavageSite=75; ConfidenceScore=5.14e-01
MNYVFVHVSSIFEFGALRSDCLVQFSILKLFRSPMNCVFVHVSSTFEFGALRSDCLVQFSILNLFRSPMNCIFVHVSSTFEFGALRSDCLVQFSILKLFWSPMNCVFVHVSSTFEFGALRSDCLVQFSILNLFRSPMNCVFVHVSPTFEFGVMRMDCLGQFPILNLFRSPMNCVFVQGSPTFKFGAMRSDCLVQFSILNLFWSPMNCVFVHVSPTFKFGALR

SEQ ID NO: 214517 - protein, 159 aa, Glycine max
  Coding DNA Sequence Number=SeqID_97739
  Subcellular localization annotation: CTP_CleavageSite=67; ConfidenceScore=5.19e-01
MPISPCGSISWFVPSRHRGRAHKTPSGPREVQQGPEVSSSGYGPLSVLQGARTPPARSCHRDIGIAPAGHPVDPKKSNRVLGFPALIMGLCQFYGVPVTPSKVIRPPTNQAFIKKYCAPGQAEGETPQQPGDGQQHVTNAPPPPPEPLISSTKMLEYCL

SEQ ID NO: 214518 - protein, 139 aa, Glycine max
  Coding DNA Sequence Number=SeqID_97740
  Homolog annotation: Hit_ID=Q6EPN2; Match level="QueryCoverage=41%, HitCoverage=11%, E-value=7e-14, Identity=74%"; Hit description =Fringe-related protein-like
  Pfam annotation: Domain name=DUF604; Domain location=1-134; Score= -155.5; E_value=0.0071; Accession=PF04646.3; Description=Protein of unknown function, DUF604
MAYGGGGFAIGYPLAVALERMQDNCLQRYLHCLAQMIGSRLVWQSLVSLSLRRLVFTRPDNYLKGIINKSVFFFNTFASALGWKIKILIVQQASMFVFNSALKGLDGTQQSKSKPAARWIVVKCNRQKGSTECGYYVMH

SEQ ID NO: 214519 - protein, 76 aa, Glycine max
  Coding DNA Sequence Number=SeqID_97741
MENAKNVACVLPQRVVDKKEKIIWEPHQGYGTIEKSTSNYDEGQIDVSKFKVENLRGKRLGVRISRIVSETMRLGM

SEQ ID NO: 214520 - protein, 194 aa, Glycine max
  Coding DNA Sequence Number=SeqID_97742
MGDSDKYGLYIEENPPRLVALGRLYEGSTTVHNISFMHDQVKVGVEEVRDANTLIHVPTEEGAVEPMKLADRPDHDLDDPLYLMTLTIPQLFLKLLQVMWDATMFGVFNDNFPLYIKHEDLSEIAYGGQCLSISIIQLWILAHWQMVVILPKENVVIWFCSLHNRSDNYLKGIINSVLKGFDDTPQSKSKVVAR

SEQ ID NO: 214521 - protein, 82 aa, Glycine max
  Coding DNA Sequence Number=SeqID_97743
  Gene Ontology: Mol. function=endonuclease activity
  Homolog annotation: Hit_ID=Q9FF11; Match level="QueryCoverage=87%, HitCoverage=6%, E-value=5e-26, Identity=67%"; Hit description =Similarity to HepA-related protein Harp
ELFKIEHGVCTNCQFDCHKLVEDIRPLSLERRREYIEKVAPKVAKRKKMFEKLVNEPTEGNAWHADHIVPVYDGGGRIHFKV

SEQ ID NO: 214522 - protein, 146 aa, Glycine max
  Coding DNA Sequence Number=SeqID_97744
MEVEGISYLDSSLNSDNCEEQSARRDAVGETQLDKQPSAENSNESEANRDDKSDETFLNNSIQSSNIMAENISCQDLGKASVLDGTCDVDVFDGMERCPEKSFEDGDQEIRDLKKISTTEADDNQSVNLVEVNGHCSNQVDFLRFE

SEQ ID NO: 214523 - protein, 383 aa, Glycine max
  Coding DNA Sequence Number=SeqID_97745
  Gene Ontology: Mol. function=chitin binding; Cellular component =extracellular region; Biological process=chitin metabolic process
  Homolog annotation: Hit_ID=UPI00006A17C9; Match level="QueryCoverage =99%, HitCoverage=100%, E-value=2e-50, Identity=30%"; Hit description= UPI00006A17C9 related cluster
LTFRGLHALAFRGLHALAFRAVRILPLRGLNALAIVGLHALTFKGVHVLTFRGLHIVAIRGLQVIAFSGLHVLPFKGLQALTFRGLHILAFRGLHALAFRGLHVLAFRGLHIIALRGLHVLTFSGLHALAFIGLHALTFRGLLVPTFRGIHVLTFRELRVLNFIALQALAFRGLHALAFRGLHVLQVRGLHVLPFRGPHVPAFRELHTLTFRGLHALAIRELHVLTFRPLYALALIELHVLTFKGLHVLAFRGIHVLAFRGVHILPLRALHALAFVGLHALTFKGVQVLTFRRLYVVAIRGLHVLHFRGLHALTFRGLHVFVFRGLHVLAFRGQHVLPFRGLHAFAVVGLHALTFRGLQNLAFRGLHALAFVGLHALTFRGLH

SEQ ID NO: 214524 - protein, 361 aa, Glycine max
  Coding DNA Sequence Number=SeqID_97746
  Gene Ontology: Mol. function=succinate dehydrogenase activity; Cellular component=mitochondrion; Biological process=electron transport
  Homolog annotation: Hit_ID=Q97W79; Match level="QueryCoverage=99%, HitCoverage=68%, E-value=0.0, Identity=88%"; Hit description =Succinate dehydrogenase subunit A
  Pfam annotation: Domain name=FAD_binding_2; Domain location=1-209; Score=29.4; E_value=5.4e-10; Accession=PF00890.14; Description=FAD binding domain
  Pfam annotation: Domain name=Succ_DH_flav_C; Domain location=265-361; Score=128.6; E_value=1.7e-35; Accession=PF02910.10; Description =Fumarate reductasesuccinate dehydroge
  Pfam module annotation: Pfam domain module=FAD_binding_2::Succ_DH _flav_C; Domain location=1-209::265-361
MKTLTPFFFKTKAVVLATGGMGMLYRHTTNSYINTGDGFGIALRAGAALKDPEFVQFHPTALYPSDVLISEAARGEGGILKNVKGERFMTKYAPKKLDLAPRDIVSRAIITEIREGRGFPGGYVGLDLTHLGEEYIKERLALAVEAAKSFASVDAFTEPIPVRPAQHYYMGGIDVDIDGRNPDIAGLFSAGEAACVSVHGANRLGSNSLLDTLVFGQVTGRTVVQFLKSNPGNPTSNYEKEAEKVVDDAYKFVKSESGVHFGQILEKLRDTMWDYVGIYRDEGGLLNAMSEINKLRDLALTITKSALERKESRGAHYRTDYPDRDDNNWLKHTIAYLRGNTVEVTFKPVKITRWKPEPRVY

SEQ ID NO: 214525 - protein, 106 aa, Glycine max
  Coding DNA Sequence Number=SeqID_97747
MIHEILMILKKLHALSVPSHAHGRLHFYQPFFFLLFLAGASSPDVAEPPSWSLPRHLEPAPTIHSPFYGASTDDARGFSTRGDTSGMGDNGACDDYIADITTAQEA

SEQ ID NO: 214526 - protein, 244 aa, Glycine max
  Coding DNA Sequence Number=SeqID_97748
  Homolog annotation: Hit_ID=Q8S3F4; Match level="QueryCoverage=29%, HitCoverage=18%, E-value=1e-21, Identity=71%"; Hit description =Putative bHLH transcription factor
  Pfam annotation: Domain name=HLH; Domain location=31-80; Score=56.6; E_value=8e-14; Accession=PF00010.16; Description=Helix-loop-helix DNA-binding domain
MWEGDEIRDNQDDRDSKAEVGQSNSKRRSRTAAIHNQSERKRRDRINQKMKALQRLVPNANKTDKASMLDEVINYLKQLQAQIQMMNMTSMPQMMVPLAMQQQLQMSMLARMGVAGLGMGMGMNMAAAAQTAGGPIRSLPQFIQPTTTTVCAPPPATAPVFVAPSFMMPPSMIQAPPKPQQLPASSASIASIHLPHPYSAAGLTQPINMDILSNMAALYQQQISQNNHQALSSSMPQPHHEQGR

SEQ ID NO: 214527 - protein, 51 aa, Glycine max
  Coding DNA Sequence Number=SeqID_97749
MGKKEKLRILNIVAILGLGVFVLTKTLPFAGDGTEHRLGNVHDELVEVRAG

SEQ ID NO: 214528 - protein, 161 aa, Glycine max
  Coding DNA Sequence Number=SeqID_97750
  Pfam annotation: Domain name=Cyclin_N; Domain location=38-140; Score=- 26.6; E_value=0.031; Accession=PF00134.13; Description=Cyclin, N -terminal domain
MDNLLCDEVWLSKSANTFEEVISDPVALKSYENEEFEEVFAVCLEKEVLCLPEPDYTKYLHYNNFIFPSCRVIQWFIKDWEYWMLELLSIACLSIAIKLNEISGLSLHEIQWITVNSFVASRELMDIALNMNLFHDLVMSVLILLTTSGVPVRCTGRYFTS

SEQ ID NO: 214529 - protein, 227 aa, Glycine max
  Coding DNA Sequence Number=SeqID_97751
  Homolog annotation: Hit_ID=Q53NE3; Match level="QueryCoverage=27%, HitCoverage=36%, E-value=4e-15, Identity=70%"; Hit description =Histone H3-maize
MARTKQATRKSTEEKAPRKQLATKVAHKSAPLTGGVKKPHKFRSRIVALREIRLHNGNLENLSFFMACFISSLYPVLQKDELACGASMEVGSLNFNEEEGASPPRISLDKKLEEDALMEEKKERRGEHEIEGIKEGKKWNFEVYLIRLSFIKVTTRVTHASIYRLEIYPGIHENPKAFFSSSSPILLESSIQYPCGVGLHHQALVVEAKLLEHEKDGSKDLVMPGAG

SEQ ID NO: 214530 - protein, 100 aa, Glycine max
  Coding DNA Sequence Number=SeqID_97752
MAKLLERETTKIDKYRDNVHWSSGYGGIGPRSDYRILNIVLVAARDVKHLDFRIDVDDSDSGFAAVVDILLPLWESSSSSSSLSLVEGEDGRTYFVLGHK

SEQ ID NO: 214531 - protein, 77 aa, Glycine max
  Coding DNA Sequence Number=SeqID_97753
MESRKGKKQKETGWTNINKENEHKQRDNTRALKWQHTGMRKEEALNTTMSKRRPTTGQVSIGQRMGQWTGVNRIEKK

SEQ ID NO: 214532 - protein, 112 aa, Glycine max
  Coding DNA Sequence Number=SeqID_97754
  Subcellular localization annotation: CTP_CleavageSite=74; ConfidenceScore=5.12e-01
MKEENPSENRSKASKFSDQNQAPKPQNTKGANLNNNNKTRLWGAHIVKGFSADKKTKSFASKKLTSSTTTTAISENVVTNQNNSNKPFVPSSHSRVKRSLIGDLSCSINPAQ

SEQ ID NO: 214533 - protein, 261 aa, Glycine max
  Coding DNA Sequence Number=SeqID_97755
  Homolog annotation: Hit_ID=Q5JLH8; Match level="QueryCoverage=23%, HitCoverage=8%, E-value=4e-17, Identity=70%"; Hit description =Putative ERD4 protein
  Pfam annotation: Domain name=Ank; Domain location=68-100; Score=25.3; E_value=0.00022; Accession=PF00023.20; Description=Ankyrin repeat
MKCARDREGRMAFSVVAESEHEQSHARTCLVDLLGWGDTLLRAVRVDNVHDMKKCLGEGVSVNGRDQNRWTSLHWATFKGRIKSVKVLLEHSAEVETVDDAGYTLLHCDAEIPRKIGVSIPMKATLFMTYIMVDGWAGIAGEILRLKPLVIYHLRNMFLSIIEKCVSINTCGVHKVEYQLPNLIVGAITKESLYSAFENGITVEQGFHCTVSLNEGPPPPYNMLRNVLDMNAHVGGFNSAMLQAGNSIWVMNVVPLSGLNN

SEQ ID NO: 214534 - protein, 140 aa, Glycine max
  Coding DNA Sequence Number=SeqID_97756
  Homolog annotation: Hit_ID=O22260; Match level="QueryCoverage=24%, HitCoverage=4%, E-value=3e-08, Identity=74%"; Hit description =Putative kinesin heavy chain
MSIRKSWAHIVQASIADGVLSGNTDPKKNIELLQDAIASITLLGSIITSIPLSRNYSYNFQYFWHYLRKSNSLGTKLMNRCRKYFRIYNSTSVYRKNQYCKHVHSLAHATSGYHKVLEENSKLYNQVHDLKGKFLIGWLL

SEQ ID NO: 214535 - protein, 396 aa, Glycine max
  Coding DNA Sequence Number=SeqID_97757
  Homolog annotation: Hit_ID=Q1SDS1; Match level="QueryCoverage=55%, HitCoverage=40%, E-value=2e-24, Identity=33%"; Hit description=IMP dehydrogenase/GMP reductase
MASQEKWGPFADILALLIFGVVLFPNVDGLVDLAAIDAFLAYHHSKESPVVSILADLFDTFDRRCEKNSARIVCCLPALCVWLISHLFRQDTRHPCPLQSYRSCAEKGRVDWDQHLAGIGGSAINWFPRWKEGKEGVLFSCGDNPNVPLIGTRCCINYNPTLAIRQLGYPMRGAPTEESLTPCLVRNLGAQGLKVIQRIHKAWRYPLKKDKELRGIRNGVIGGYHGWLRIHARGLDWLSKLKVIDEENFEALEEDEEVRALKLELGKARLAKEKFKSAATHIRKECTELQEENAATAKALEQETKRARKEEYGREKFRGALRGSNNELKLRREERDRSRVHGMILKEELVACARSKRSLAQHLEAMEQSMLAIIGQYKEELNQSMAHEQKLVEDFA

SEQ ID NO: 214536 - protein, 531 aa, Glycine max
  Coding DNA Sequence Number=SeqID_97758
  Homolog annotation: Hit_ID=Q84UR3; Match level="QueryCoverage=99%, HitCoverage=67%, E-value=1e-157, Identity=56%"; Hit description =Proline-rich protein family-like
SDVVAKIKAEASLLRLTNEDLCKQVEGLQISRLNEVEELAYLRWVNSCLRNELKNTCSALDSDKPSSPHSVVSSSDDCVSSFSDQTNRYSNCGSANRFNMVKKPKKWPITSDDLSQVECQGSLIEKNRIESDVGGSPRRRHSISGSNYSEEEVSLSKRRQSDCFVCSKEMEKESVALSVQQSGLEIVQRPQYFSNCQEANKLLVSSDVEKRALRIPNPPPRPSCSISIKTKQETSAQVPLPPPPPPPPPPMNFASRSNMASVKRAPQVVELYHSLMKRDSRKDSSNGGLSDAPDVSDVRSSMIGEIENRSSHLLAIKADIETQGEFVNSLIREVNDAVYQNIEDVVAFVKWLDDELCFLVDERAVLKHFDWPEKKADTLREAAFGYQDLKKLESEVSSYKDDPRLPGDIALKKMVALSEKMERTVYNLLRTRDSLMRHSKEFKIPIEWMLDNGIIGKIKLSSVKLAKKYMKRVAMELQVKSALEKDPAMDYMLLQGVRFAFRIHQFAGGFDAETMHAFEELRNLASLLNKT

SEQ ID NO: 214537 - protein, 56 aa, Glycine max
  Coding DNA Sequence Number=SeqID_97759
MEEGNKDMWLQDEGRREQPSQEGDIAGGTPREWVEEGGANSLRAIGSVRFNSPSMD

SEQ ID NO: 214538 - protein, 265 aa, Glycine max
  Coding DNA Sequence Number=SeqID_97760
  Homolog annotation: Hit_ID=Q2QVF7; Match level="QueryCoverage=46%, HitCoverage=28%, E-value=6e-08, Identity=34%"; Hit description=RWP -RK domain containing protein
GVGNNVDPPQENQTQPPNNQDVRSLCPWPPPPEPFSCSCCEVLRQINYTNGVRFDKLEIHGTVGVINHAICHVEDKTSNRPPRDTYQIIDFCNKNTEEIRNFLNVYCKERIEAGFIPIEDPSMSAFYDALCTGMDWTEVSNDVDDDLANGTEQESESEPEAGNGRRASTSRPRRRDMAVQRQRVPRMTLSDLSGVFHLTISAAAVKLDVQSLAKKVRVLVRALNSPDPGVKRRTQDEIRRLQKEIIENCGGITPTGIPMLQFDEE

SEQ ID NO: 214539 - protein, 69 aa, Glycine max
  Coding DNA Sequence Number=SeqID_97761
MEDKLDLIIGNYTDGNLASMRLRFTDTMCVRFRDTMCVRMRERMVEEQRRMLETMAEGHNVQATSFRSF

SEQ ID NO: 214540 - protein, 165 aa, Glycine max
  Coding DNA Sequence Number=SeqID_97762
  Gene Ontology: Mol. function=hydrolase activity, acting on glycosyl bonds; Biological process=polysaccharide catabolic process
  Homolog annotation: Hit_ID=Q94EU9; Match level="QueryCoverage=54%, HitCoverage=17%, E-value=7e-23, Identity=61%"; Hit description=Beta -amylase PCT-BMYI
GVEFIDGESEVQGNEDRWLREGGFVAAESVQVVSAAGGSIDGVLGIHGRGGVRCRREGGEGEGEGTSAGVCDDAFGQRDDEECGELKKGDERGDGCTEERRGRGGDDGRVVGFGGERKAWGLVDTVNSWKWRRSMASRCRLLCHFTNVAVTSETLAHSRLIGFNN

SEQ ID NO: 214541 - protein, 203 aa, Glycine max
  Coding DNA Sequence Number=SeqID_97763
  Gene Ontology: Mol. function=nucleoside-triphosphatase activity; Cellular component=membrane
  Homolog annotation: Hit_ID=Q5W2W2; Match level="QueryCoverage=76%, HitCoverage=25%, E-value=5e-73, Identity=85%"; Hit description =Putative TrbE protein
MEELRGDEIVVEISAVKTELEKEFILIFLTICATWVFKTALFESMSFLNLFKKPSQQAVKKDKTKYYKLEGIPFFLLAPEDRDMKMKELSALLSQAEKGYIYISRKPDTYEFEGTKFPIITSSFNLITEKELDLETAEPPQRPKIVKEYAKYLQTTEGYARVLVSYAYSTKIYEGALGRIDFKSLRPELFELVVQFQKISPLS

SEQ ID NO: 214542 - protein, 70 aa, Glycine max
  Coding DNA Sequence Number=SeqID_97764
MSSAIIVASKVDNTGSSKLVGIEEDDSEDRILLSPWLPQSLNPEEPSPPLKFYLVYKKQTTTEQLTRTKD

SEQ ID NO: 214543 - protein, 60 aa, Glycine max
  Coding DNA Sequence Number=SeqID_97765
MFGNPTWEGQKEARGASIPDKVQSQAKGTPGTPKSNNMPRPSACTSNKHHSIAIITTKSA

SEQ ID NO: 214544 - protein, 142 aa, Glycine max
  Coding DNA Sequence Number=SeqID_97766
  Gene Ontology: Mol. function=helicase activity; Cellular component =mitochondrion; Biological process=protein amino acid phosphorylation
  Homolog annotation: Hit_ID=Q84TY4; Match level="QueryCoverage=97%, HitCoverage=69%, E-value=1e-13, Identity=29%"; Hit description =Putative pentatricopeptide repeat protein
  Pfam annotation: Domain name=PPR; Domain location=12-46; Score=11.6; E_value=0.31; Accession=PF01535.11; Description=PPR repeat
  Pfam annotation: Domain name=PPR; Domain location=47-81; Score=29.6; E_value=1.1e-05; Accession=PF01535.11; Description=PPR repeat
  Pfam module annotation: Pfam domain module=PPR::PPR; Domain location =12-46::47-81
MVSSGMKPDVKAYRVFVVNEYCKIRKPSEAVLLLWEMMVRGVKPSMSSFNAVFRVLVDEGKLDKGVLLLKQMPKMGCPPNFLFYCIVICGLCKVKGRMQQVEELILNMLQNGHNLDATMYNCLLAGYCEDGDEEMTPKTVMT

SEQ ID NO: 214545 - protein, 210 aa, Glycine max
  Coding DNA Sequence Number=SeqID_97767
  Gene Ontology: Mol. function=oxidoreductase activity; Cellular component=intrinsic to endoplasmic reticulum membrane; Biological process=electron transport
  Homolog annotation: Hit_ID=Q9FLK4; Match level="QueryCoverage=100%, HitCoverage=45%, E-value=9e-71, Identity=60%"; Hit description =Dimethylaniline monooxygenase (N-oxide-forming)-like protein
  Pfam annotation: Domain name=DAO; Domain location=12-208; Score= -60.7; E_value=0.065; Accession=PF01266.14; Description=FAD dependent oxidoreductase
MVSETLQSQTKNVCVVGAGPSGLVAARELRKEGHSVALLEQNHDVGGQWLYELNVEGEDPLGKKPFLKVHSSIYESLRLTSPREIMGFTDFPFLVKKGRDMRRFPSHTELLMYLKDFCDHFGLREMIRFNTRVDYVGMLDYGVCSNDLKWVVRSVDKKSEKVVEEVFDAVVVATGHYSQPRLPSIQGMDTWKRKQMHSHIYRTPEPFRNE

SEQ ID NO: 214546 - protein, 138 aa, Glycine max
  Coding DNA Sequence Number=SeqID_97768
  Gene Ontology: Mol. function=transferase activity
MIVENYYIHRGNLSERSTNQLKSRWPKIHYAIQKFNGCSKQVVALKKKRRGLSSLQKCIAAIRILAYELPVNSVDEYLKIGGSTVVKCLEAFVKGVNKIFGDEYLRRLNNNNINCLLQIREAHGFPGMLGSIDCMHWE

SEQ ID NO: 214547 - protein, 389 aa, Glycine max
  Coding DNA Sequence Number=SeqID_97769
  Homolog annotation: Hit_ID=Q2QN61; Match level="QueryCoverage=54%, HitCoverage=25%, E-value=8e-11, Identity=26%"; Hit description =Expressed protein
MALMGMSANRQCNSYFPGYHSPRYLVFGAEGSTCTSSNGNSERENDCYQLGSLPLSSACHLLGYNKELLKQTILQHEAIFRDQIQELHRIYQKQKELMDEIKRIELHKRSLRLETSLSSSSLYYSQNMPWLTSQSSVLNAELIQLPLASMQEKSRELCPTPLAVPAPTAIKESLEDTKLSGLTCRKVGKKILDLQLPADEYIDSEGESCENERVIKQPPLSTYTSNGISKVVYNTVEKPYRINSNGFADLNLPFKLQKETGVESDDFGASIPHRNHTFHGMLGRMTSGSHNFPNDVIPNLKRRQDHEAYPDLPLPNQGQKHGWLPSGQNGSNLGFLAKFNDMESQSVSIDFISKKLKQVNNCPCFHSTSQIVPGSRTKSPAGTHDPTSG

SEQ ID NO: 214548 - protein, 273 aa, Glycine max
  Coding DNA Sequence Number=SeqID_97770
  Homolog annotation: Hit_ID=Q84WN3; Match level="QueryCoverage=50%, HitCoverage=58%, E-value=3e-13, Identity=36%"; Hit description =Putative cytochrome c oxidoreductase
MSHKIECWDLVTLSTSDVFKFSSFVQNREVVGCFSIDYSWKNMIYPCLQIHVLSLVRPHQKLPHLFYHLEAPAHHAREYLVATVDGFGIVVETINVILFLIYAPKGIRGRTLILAVILDVAISIVAVVTTQLALQREARGGVVRVMGAGLNIVMYFSPLSAMETIRLPLLFSIYPTLTDFGNGSKSFEIRILCEFDSYCIAIIMGIGFLGGSIYLGSVLGAAIAVIGFYAIIWGKSQEQAKEECEVYDDSESYSMLSLFWRTREWRNRIIAII

SEQ ID NO: 214549 - protein, 161 aa, Glycine max
  Coding DNA Sequence Number=SeqID_97771
MASRDQVWSFCTHDTRRYLTVICTPLLGRHSCVRWHAETKFGLSAPKIRGDTLRLSAPFCHPEAGGPDDKQRPSLVILHPRYAEIPYGYLHPFARQTQLCPMASRDQVWSFCTQDTRRYLTVICTPLLGRHSCVRWQAETKFGHSAPKIRGDTLRLSAPLC

SEQ ID NO: 214550 - protein, 357 aa, Glycine max
  Coding DNA Sequence Number=SeqID_97772
  Gene Ontology: Mol. function=DNA binding; Biological process=DNA integration
  Pfam annotation: Domain name=Transposase_23; Domain location=123-193; Score=9.0; E_value=0.00012; Accession=PF03017.5; Description =TNP1ENSPM transposase
MDCETFLKKIGSFVPHGRQDVLAAAIGRLEHPGRVRAAGAGVTIKQYFGSAPRTSRSASSLPPDELHQLTQQIRHQLEESITEKMQSQGLAVPPEPLVGPGPSGPRVSTKGSCVDPSGNDPETGDSDRCGLYIEADPARLVAMGRVYEGSTLVHNTPLLPGKLKVSVDEVKDADAPVPVPTDEVSLVGQTLHTFLAWPTHLVKSLSHQVVVSPPKPPPKPDPEVDDPLYLMTLTIPELFLRPYQVRWDATVFGVVNPYFPLYIKHEDLSEIAHDAGNSDIYGFLEPQSIQSGHWQMVVILPKEHLVGLNDAPHPKSKAPARWIVIKYFNDPRPLEPERLKALRIQLTQFYLRVRDQA

SEQ ID NO: 214551 - protein, 358 aa, Glycine max
  Coding DNA Sequence Number=SeqID_97773
  Homolog annotation: Hit_ID=UPI0000E4A83E; Match level="QueryCoverage =18%, HitCoverage=8%, E-value=4e-07, Identity=34%"; Hit description =PREDICTED: similar to interleukin enhancer binding factor 3, partial
  Pfam annotation: Domain name=zf-C2H2; Domain location=233-257; Score =22.4; E_value=0.0016; Accession=PF00096.16; Description=Zinc finger, C2H2 type
  Pfam annotation: Domain name=zf-U1; Domain location=234-265; Score =7.7; E_value=0.012; Accession=PF06220.3; Description=U1 zinc finger
  Pfam module annotation: Pfam domain module=zf-C2H2::zf-U1; Domain location=233-257::234-265
MAGSSGKQENTMPVKFAIQRELEYRKIVAAFHLRPNSKFTKEVKSSNDASCPKLLPGPSSMKFSSLSGTKRKESPTRSTHHPRLKHQQPFHGSLNHEVQTGACDVRLNVKPSNDASLPKPLPGPSSIKFPSLSGTKRKESPTRSTDYLCLQHQQPFHGSRNHEMKTGARDFSLNVKSSNDASLPKSLPGPCTSKFSSLLGTKGKESPSSDHLRLQHHHPFHGTLNHEGELDDIYCKICQISCSSPSNLKQHLRGRKHKQMLQKGGSNSQMQWCEVCCIPCMNEDLLKMHFQGQKHKAKLQMLEISKQGVEAPNKPKWCALCKLWCSDEFAFRLHLGVISQQQVKLGNALIDLVAQKRW

SEQ ID NO: 214552 - protein, 1092 aa, Glycine max
  Coding DNA Sequence Number=SeqID_97774
  Gene Ontology: Mol. function=protein serine/threonine kinase activity; Cellular component=integral to membrane; Biological process=protein amino acid phosphorylation
  Homolog annotation: Hit_ID=Q9CA77; Match level="QueryCoverage=97%, HitCoverage=98%, E-value=0.0, Identity=57%"; Hit description =Putative receptor protein kinase; 10992-14231
  Pfam annotation: Domain name=APH; Domain location=804-990; Score= -10.6; E_value=0.032; Accession=PF01636.13; Description =Phosphotransferase enzyme family
  Pfam annotation: Domain name=LRRNT_2; Domain location=30-74; Score =29.7; E_value=1e-05; Accession=PF08263.3; Description=Leucine rich repeat N-terminal domain
  Pfam annotation: Domain name=LRR_1; Domain location=107-129; Score =15.2; E_value=0.24; Accession=PF00560.23; Description=Leucine Rich Repeat
  Pfam annotation: Domain name=LRR_1; Domain location=131-151; Score =7.5; E_value=11; Accession=PF00560.23; Description=Leucine Rich Repeat
  Pfam annotation: Domain name=LRR_1; Domain location=153-175; Score =6.1; E_value=21; Accession=PF00560.23; Description=Leucine Rich Repeat
  Pfam annotation: Domain name=LRR_1; Domain location=178-200; Score =10.2; E_value=3.5; Accession=PF00560.23; Description=Leucine Rich Repeat
  Pfam annotation: Domain name=LRR_1; Domain location=202-221; Score =6.8; E_value=15; Accession=PF00560.23; Description=Leucine Rich Repeat
  Pfam annotation: Domain name=LRR_1; Domain location=223-246; Score =7.9; E_value=9.3; Accession=PF00560.23; Description=Leucine Rich Repeat
  Pfam annotation: Domain name=LRR_1; Domain location=248-270; Score =6.6; E_value=17; Accession=PF00560.23; Description=Leucine Rich Repeat
  Pfam annotation: Domain name=LRR_1; Domain location=272-294; Score =16.3; E_value=0.11; Accession=PF00560.23; Description=Leucine Rich Repeat
  Pfam annotation: Domain name=LRR_1; Domain location=296-318; Score =10.2; E_value=3.5; Accession=PF00560.23; Description=Leucine Rich Repeat
  Pfam annotation: Domain name=LRR_1; Domain location=320-342; Score =7.3; E_value=12; Accession=PF00560.23; Description=Leucine Rich Repeat
  Pfam annotation: Domain name=LRR_1; Domain location=344-367; Score =5.1; E_value=32; Accession=PF00560.23; Description=Leucine Rich Repeat
  Pfam annotation: Domain name=LRR_1; Domain location=369-391; Score =14.8; E_value=0.31; Accession=PF00560.23; Description=Leucine Rich Repeat
  Pfam annotation: Domain name=LRR_1; Domain location=393-415; Score =14.1; E_value=0.51; Accession=PF00560.23; Description=Leucine Rich Repeat
  Pfam annotation: Domain name=LRR_1; Domain location=417-439; Score =13.6; E_value=0.72; Accession=PF00560.23; Description=Leucine Rich Repeat
  Pfam annotation: Domain name=LRR_1; Domain location=441-463; Score =15.0; E_value=0.27; Accession=PF00560.23; Description=Leucine Rich Repeat
  Pfam annotation: Domain name=LRR_1; Domain location=465-487; Score =8.2; E_value=8.4; Accession=PF00560.23; Description=Leucine Rich Repeat
  Pfam annotation: Domain name=LRR_1; Domain location=590-612; Score =5.9; E_value=23; Accession=PF00560.23; Description=Leucine Rich Repeat
  Pfam annotation: Domain name=LRR_1; Domain location=613-635; Score =10.7; E_value=2.8; Accession=PF00560.23; Description=Leucine Rich Repeat
  Pfam annotation: Domain name=LRR_1; Domain location=637-659; Score =12.4; E_value=1.3; Accession=PF00560.23; Description=Leucine Rich Repeat
  Pfam annotation: Domain name=LRR_1; Domain location=661-683; Score =6.0; E_value=22; Accession=PF00560.23; Description=Leucine Rich Repeat
  Pfam annotation: Domain name=LRR_1; Domain location=83-105; Score =1.1; E_value=1.8e+02; Accession=PF00560.23; Description=Leucine Rich Repeat
  Pfam annotation: Domain name=Pkinase; Domain location=802-1076; Score= 166.7; E_value=5.9e-47; Accession=PF00069.15; Description=Protein kinase domain
  Pfam annotation: Domain name=Pkinase_Tyr; Domain location=802-1076; Score=98.2; E_value=2.5e-26; Accession=PF07714.7; Description =Protein tyrosine kinase
  Pfam module annotation: Pfam domain module=APH::LRRNT_2::LRR_1::LRR _1::LRR_1::LRR_1::LRR_1::LRR_1::LRR_1::LRR_1::LRR_1::LRR_1::LRR _1::LRR_1::LRR_1::LRR_1::LRR_1::LRR_1::LRR_1::LRR_1::LRR_1::LRR _1::LRR_1::Pkinase::...
  Pfam module annotation: Pfam domain module=Pkinase_Tyr; Domain location=804-990::30-74::107-129::131-151::153-175::178-200::202 -221::223-246::248-270::272-294::296-318::320-342::344-367::369 -391::393-415::417-439::...
  Pfam module annotation: Domain location=441-463::465-487::590 -612::613-635::637-659::661-683::83-105::802-1076::802-1076
MSEQETDSWGFLFVCLLILFSGKLVVGDSLETDARVLLKLKSYLQTQTLANKGGYTSWNKNSSNPCDWSGIKCSSILNGTTRRVVKVDISYSDIYGNIFENFSQLTELTHLDISWNSLSGGIPEDLRRSHKLVYLNLSHNTLKGELNLKGLTKLQTVDLSVNRFVGGLGLSFPAICDSLVTLNVSDNHLNGGIDGFFDQCLKLQHLDLSTNHLNGTLWTGFSRLREFSISENFLTGVVPSKAFPINCSLEKLDLSVNEFDGKPPKEVANCKNLLVLNLSGNNFTGDIPSEIGSISGLDALFLGNNTFSRDIPETLLNLTHLFILDLSRNKFGGEVQEIFGKFKQLKFLVLHSNSYTGGLNTSGIFTLTNLSRLDISFNNFSGPLPVEISQMSGLTFLTLTYNQFSGPIPSELGKLTRLMALDLAFNNFSGPIPPSLGNLSTLLWLTLSDNLLSGEIPPELGNCSSMLWLNLANNKLSGKFPSELTRIGRNARATFEANNRNLGGVVAGNSECLAMRRWIPADYPPFSFVYNILTRKNCRALWDRLLKGHNIFPMCSSVPSSKPSHIAGYVQLSGNQMSGEIPSEIGNMVNFSMLHFGDNKFTGKFPPEMVGLPLVVLNMTRNNFSGELPSDIGNMKCLQDLDLSCNNFSGAFPVTLARLDELSMFNISYNPLISGAVPPAGHLLTFDKDSYLGDPLLNLFFNITDDRNRTLPKVLKNPTKWSLVLALALAIMVFGLLFLVICFLVKSPKVEPGYLMKNNTKKQAHDSGSTGSSAGYSDTVKIFHLNKTVFTHADILKATSNFTEERIIGKGGYGTVYRGMFPDGREVAVKKLQREGTEGEKEFRAEMKVLSGLGFNWPHPNLVTLYGWCLYGSQKILVYEYIGGGSLEELVTDTKRMAWKRRLEVAIDVARALVYLHHECYPSIVHRDVKASNVLLDKDGKAKVTDFGLARIVNVGDSHVSTIVAGTVGYVAPEYGQTWQATTKGDVYSFGVLVMELATARRAVDGGEECLVEWTRRVMMMSSGRQGLDQYVPVLLKGCGVVEGAKEMSELLQVGVKCTHDAPQARPNMKEVLAMLIRIYNPTGDSNGGHIV

SEQ ID NO: 214553 - protein, 52 aa, Glycine max
  Coding DNA Sequence Number=SeqID_97775
MARESLKTLIFSHKMWSKTNNQLLFISEFVTVIIPFQRGSHTKDKFAHSIQE

SEQ ID NO: 214554 - protein, 277 aa, Glycine max
  Coding DNA Sequence Number=SeqID_97776
GPEDDFVSYLCLSVSLRMFDRVTTVYGRSYMYMRCFQVNFSTLLAVISHNGLTSIHLVNEGTRGAQTVKIVKRSVWHICKLLASSAFPGKVEGIFPKCWPRLLYDSLEVPNLIGAGQLGEQHYFLGLVCVDNLSLDKLRALNFYDPCPASFYVGCTANVKGAPVWGGCVISIEFYQKIGTSKLKASSIIVVQLGVRACPCYLNLLGHKAKSMECNATSRRSRSCGETAGGVLHTESFDEGVEAVYGPRFACVKKASRCSSRSIVPSCHSRLSGFHPK

SEQ ID NO: 214555 - protein, 71 aa, Glycine max
  Coding DNA Sequence Number=SeqID_97777
VNHEPFNLTTSYGESEVKPEKNPQAGKFGLNWEDPFRVTTNLDNGAYRLQELDGKAIPKAWNATHLKFYFS

SEQ ID NO: 214556 - protein, 84 aa, Glycine max
  Coding DNA Sequence Number=SeqID_97778
MSLAICDIHWSDSSVLLRTCHSSWVARAGGLAWVVRARDTVICSCICASYKVAPTGDCMVEEGLTKGGPWVLRASELRLWMFLS

SEQ ID NO: 214557 - protein, 305 aa, Glycine max
  Coding DNA Sequence Number=SeqID_97779
  Homolog annotation: Hit_ID=Q47522; Match level="QueryCoverage=12%, HitCoverage=46%, E-value=2e-14, Identity=97%"; Hit description=LacZ protein
MTVKTSDTCSSRRRSQLVCKRMPGADKPVRARQRMRKEKIPHQAPFAIQAAQLLGRAIGAGLFAITPAGERGMCCKAIKLACPCYLNLLGHKAKSMECNATSRRSRSCGETAGGVLHTESFDEGVEAVYGPRFACVKKASRCSSRSIVPSCHSRLSGFHPKGMFASIIRSTKGCRWTVRPAGRCMRERLKSSTMLIMRRGCDSPWVRSGKVWTECSSPWGCLTRAFSWSCACVCHSCQVKIGVFERSLTFEARLSANHGSSQWAPNVLTKIQNCDMSGLRWLMWGLKPYTKQDMHVRANMLKLEG

SEQ ID NO: 214558 - protein, 366 aa, Glycine max
  Coding DNA Sequence Number=SeqID_97780
  Gene Ontology: Mol. function=isomerase activity; Cellular component =intracellular; Biological process=proteolysis
  Homolog annotation: Hit_ID=Q1RW53; Match level="QueryCoverage=91%, HitCoverage=86%, E-value=6e-37, Identity=35%"; Hit description =Cyclin-like F-box; F-box protein interaction domain
  Pfam annotation: Domain name=F-box; Domain location=1-47; Score=26.9; E_value=7e-05; Accession=PF00646.23; Description=F-box domain
  Pfam annotation: Domain name=FBA_1; Domain location=209-357; Score= -41.5; E_value=0.0084; Accession=PF07734.3; Description=F-box associated
  Pfam module annotation: Pfam domain module=F-box::FBA_1; Domain location=1-47::209-357
MKITLPEELIQVILLRLPLRNLLHLKRVCKSWLSLISDPQFAKSHFDLAAESTHKLLVRINNDPGSDVNFVNIEDGSAEPVYSLPNPKPNQIQKHECIPRVNVVGSCRGFLLLTTASYPFLYFLIWNPSTGLQKRFKKVWLKFSYICGIGYDSSTDDYVVVMITLPRSQTSCTTEAYCFSSRTNSWNCTMITVPSTTNYTFVQDQFKHGLFLNGALHWLACSDYNDCKIIAFDLIEKSLSDIPLPPELERSTYYLRAMGGCLCLCVKAFETALPTEMWMMNQYKVHSSWTKTFVFSSHEFLPICFTKNGDIVGQDRTAVMRLGDTGTDEGELPEHRTFKLGGGGWPTRLYLGYIVPDTDLVRSFLV

SEQ ID NO: 214559 - protein, 190 aa, Glycine max
  Coding DNA Sequence Number=SeqID_97781
  Gene Ontology: Mol. function=translation initiation factor activity; Cellular component=mitochondrion; Biological process=translational initiation
  Homolog annotation: Hit_ID=Q9AXQ5; Match level="QueryCoverage=99%, HitCoverage=100%, E-value=1e-75, Identity=75%"; Hit description =Eukaryotic translation initiation factor 5A-2
  Pfam annotation: Domain name=KOW; Domain location=27-63; Score=31.3; E_value=3.4e-06; Accession=PF00467.19; Description=KOW motif
  Pfam annotation: Domain name=eIF-5a; Domain location=85-184; Score =100.2; E_value=6.1e-27; Accession=PF01287.10; Description=Eukaryotic initiation factor 5A hypusine, DNA-binding OB fold
  Pfam module annotation: Pfam domain module=KOW::eIF-5a; Domain location=27-63::85-184
MSDEEHHFESKADAGASKTYPQQAGTIRKNGYIVIKGRPCKVVEVSTSKTGKHGHAKCHFVGIDIFTAKKLEDIVPSSHNCDVPHVNRTDYQLIDIAEDGFLSLLTENGNTKDDLKLPTDESLLTQPLCICKGKAAYNIPPPYLRIAKSFWAMGYEIKDGFAEGKDLVVSVMSAMGEEQICALKDIGPKN

SEQ ID NO: 214560 - protein, 67 aa, Glycine max
  Coding DNA Sequence Number=SeqID_97782
MGVGGFRKFWGTKIKEAKDADGAIMEGLVDFLLASVSLNTRQACMAESEDRVEYQEGVLGRRKIVKY

SEQ ID NO: 214561 - protein, 57 aa, Glycine max
  Coding DNA Sequence Number=SeqID_97783
MADEPRQVTLEDYSSTYVPQFFTSIVQPKNNLFHGLPNEDPYARLATYIEICNTCPE

SEQ ID NO: 214562 - protein, 155 aa, Glycine max
  Coding DNA Sequence Number=SeqID_97784
  Homolog annotation: Hit_ID=Q9AVH2; Match level="QueryCoverage=26%, HitCoverage=14%, E-value=7e-17, Identity=95%"; Hit description =Putative senescence-associated protein
VGGAGLWPRAKFRIGWPPPPPRDQFCCQDFANFGLRPGRIKATRAESQWIVAARPLCHLQYPVAYLSRLQRILPAARWELRFKASRRANPPHEGHQRHVPLGGRGPLLLVGKRTAGARVASNPDSDLEAFSHNPTHGSFAPLAFQPSAMTNCANQ

SEQ ID NO: 214563 - protein, 69 aa, Glycine max
  Coding DNA Sequence Number=SeqID_97785
  Gene Ontology: Mol. function=transcriptional activator activity; Cellular component=nucleus; Biological process=positive regulation of transcription
  Homolog annotation: Hit_ID=Q1SQ46; Match level="QueryCoverage=80%, HitCoverage=9%, E-value=1e-12, Identity=64%"; Hit description=IMP dehydrogenase/GMP reductase
MENFHQPLRLQVEELNTMAKEHEKNPMIMPGRGLKGCISKDLLCEHKEDSGVTHFALGLCEACYKGLKT

SEQ ID NO: 214564 - protein, 117 aa, Glycine max
  Coding DNA Sequence Number=SeqID_97786
MGIGLRLFLSYVSTQKLVRNNASCKLIGIGSIQIKMHDGICRNLPFGGRATPGLTGASSKKGKRAESPPTFIRGKRRKNRKRRGLRTLSVKGSGVVFTHGEGVTKLCVDFRLLKNPR

SEQ ID NO: 214565 - protein, 138 aa, Glycine max
  Coding DNA Sequence Number=SeqID_97787
MEVNTTTVVAASTTTEVDPTHPSGLNQLSRLVPDMVGQWGKVLGSMGGPHFAQVQSKHPFPPYGLPPNYAPPNIVHVLYENIDHSAPIPLESQQPQFGHAHGSQPMGETHEVPRDHTLADFEPYPGYAIEGQTFGGIP

SEQ ID NO: 214566 - protein, 230 aa, Glycine max
  Coding DNA Sequence Number=SeqID_97788
  Gene Ontology: Mol. function=NADPH:quinone reductase activity; Cellular component=membrane; Biological process=transport
  Homolog annotation: Hit_ID=Q390T9; Match level="QueryCoverage=97%, HitCoverage=67%, E-value=1e-96, Identity=82%"; Hit description=Zinc -containing alcohol dehydrogenase superfamily
  Pfam annotation: Domain name=ADH_zinc_N; Domain location=53-190; Score=122.0; E_value=1.7e-33; Accession=PF00107.16; Description=Zinc- binding dehydrogenase
  Pfam annotation: Domain name=adh_short; Domain location=55-216; Score= -60.8; E_value=0.055; Accession=PF00106.15; Description=short chain dehydrogenase
  Pfam module annotation: Pfam domain module=ADH_zinc_N::adh_short; Domain location=53-190::55-216
SFERPRQLRRIPRGRRKHRGQEARLAEPSGSGHLTLVGGTAWEALVVRAGLRVGESILVHGGAGGVGHVAIQLAKAVGARVFTTVRDSNVDFARSLGADVAIDYEKEDYVEAILRETGGRGVDVVFDTIGGNTLARSPDALAQLGRVVSIVDIAQPQNLIQAWGKNASYHFVFTRQNRGKLDELSALVARGQLRPHVGAVYPLADIPAAHARLESANNGLRGKIAIAVAD

SEQ ID NO: 214567 - protein, 140 aa, Glycine max
  Coding DNA Sequence Number=SeqID_97789
  Gene Ontology: Cellular component=hydrogen-translocating V-type ATPase complex; Biological process=proton transport
  Homolog annotation: Hit_ID=Q1S045; Match level="QueryCoverage=37%, HitCoverage=6%, E-value=2e-22, Identity=94%"; Hit description=V-type ATPase, 116 kDa subunit
MFQRQTEIIRLAATRVAKYQEANPTVYTVVTFPFLFAVMFGDWGHGICLLLAALYFIIREKKLSSQPMLVIKTLECTLLPYNYVISLRQLAKSILPEINVLKLRLNRLGTTQVQSLAETILAQALLTSRLNFGLVRVSFP

SEQ ID NO: 214568 - protein, 202 aa, Glycine max
  Coding DNA Sequence Number=SeqID_97790
  Gene Ontology: Mol. function=hydrolase activity; Cellular component =membrane; Biological process=proton transport
  Homolog annotation: Hit_ID=Q1S045; Match level="QueryCoverage=99%, HitCoverage=20%, E-value=1e-73, Identity=72%"; Hit description=V -type ATPase, 116 kDa subunit
METEKNVFVVFYAGEKAKAKILKICEAFGANRYPFAEELGKQAQMITESGQERIGSISKFFLDVSCNHKTLSECMHNSQKVSGRLLELKTTLDAGLLHRNNLLNTIGAQFEQWDVLVRKEKSIHHTLNMLSLDVTKKCLVAEGWSPVFATKQIQEALQRAALDSNSQVNAIFQVLQTRELPPTYFRTNKFTSSFQGIIDSYG

SEQ ID NO: 214569 - protein, 400 aa, Glycine max
  Coding DNA Sequence Number=SeqID_97791
  Homolog annotation: Hit_ID=Q1SDS1; Match level="QueryCoverage=54%, HitCoverage=40%, E-value=4e-26, Identity=33%"; Hit description=IMP dehydrogenase/GMP reductase
PRKGLEAKARTLASQDEWALFMDVLTLLIFEVVLFPNVDGLVDLAAIDVFLAFHDRKESLVVAILADLYDTFDQRCEKNSARIVCCTPVLYVWLVSHLFCQEVRHICPLEGHRSCTEKKEANWDRLLASKEGPSVSWFPRWKEGRTRILISCGGFPNVPLMGTRGCINYNLVIAIRQLGYPMRGAPLEEDLTPFIARGFNSSNAGVLQRVCKAWGMVQKKDEELMGSSNGPIGGYHKWLKAYAQGLDWLPNLRAIKEVEVEAPEEDEEVQALRTELEKARAIKEKFKSTAVRIRKENAELRDVNITTTMVVKLAILRRIVEVPPALQHDSYDDNHDDASSSTRVTLGGLLYDAVSGFHKLMDSEQTRESTQTRPSLRKIGRVYSGFDSTSDLTRQPLVES

SEQ ID NO: 214570 - protein, 597 aa, Glycine max
  Coding DNA Sequence Number=SeqID_97792
  Gene Ontology: Mol. function=nucleoside-triphosphatase activity; Cellular component=nucleus; Biological process=DNA replication initiation
  Homolog annotation: Hit_ID=Q1S047; Match level="QueryCoverage=99%, HitCoverage=71%, E-value=0.0, Identity=86%"; Hit description=MCM; Nucleic acid-binding, OB-fold
  Pfam annotation: Domain name=AAA_3; Domain location=232-373; Score= -12.0; E_value=0.0067; Accession=PF07726.2; Description=ATPase family associated with various
  Pfam annotation: Domain name=AAA_5; Domain location=232-379; Score =11.8; E_value=0.00022; Accession=PF07728.4; Description=ATPase family associated with various
  Pfam annotation: Domain name=MCM; Domain location=174-501; Score =687.7; E_value=8.4e-204; Accession=PF00493.13; Description=MCM235 family
  Pfam annotation: Domain name=Mg_chelatase; Domain location=212-384; Score=-133.7; E_value=0.0012; Accession=PF01078.11; Description =Magnesium chelatase, subunit ChlI
  Pfam module annotation: Pfam domain module=AAA_3::AAA_5::MCM::Mg _chelatase; Domain location=232-373::232-379::174-501::212-384
MVSLKGMVIRSSSIIPEIREAIFRCLVCGFCSEPVPVERGRITEPTICLKEECQSRNSMTLVHNRCRFADKQIVRVQETPDEIPEGGTPHTVSLLMHDKLVDTAKPGDRVEVTGIYRAMSVRIGPTQRTVKSLFKTYIDCLHIKKTDKSRMLVEDAMDVDGQDKNAEVLFDEEKVAQLKELSKRPDIYEILTKSMAPNIWELDDVKKGLLCQLFGGNALKLASGANFRGDINILLVGDPGTSKSQLLQYIHKLSPRGIYTSGRGSSAVGLTAYVTKDPETGETVLESGALVLSDRGICCIDEFDKMSDNARSMLHEVMEQQTVSIAKAGIIASLNARTSVLACANPSGSRYNPRLSVIDNIHLPPTLLSRFDLIYLMLDKADEQTDRRLAKHIVSLHFENPENVEQDVLDISTLTDYVSYARKHIHPQLSDEAAEELTRGYVEIRKRGNFPGSSKKVITATPRQIESLIRLSEALARMRFSEWVEKHDVMEAFRLLEVAMQQSATDHSTGTIDMDLITTGVSASERMRRESLQQATRNIIMEKMQIGGPSMRLLELLEELKKQDTGSEVHLNDLRNAIATLATEGFVTMHGDIVKRS

SEQ ID NO: 214571 - protein, 1193 aa, Glycine max
  Coding DNA Sequence Number=SeqID_97793
  Gene Ontology: Mol. function=protein transporter activity; Cellular component=COPI vesicle coat; Biological process=intracellular protein transport
  Homolog annotation: Hit_ID=Q1S9I3; Match level="QueryCoverage=99%, HitCoverage=100%, E-value=0.0, Identity=87%"; Hit description =Coatomer WD associated region; Coatomer alpha subunit, C-terminal; Cytochrome cd1-nitrite ...
  Homolog annotation: Hit description=reductase-like, C-terminal haem d1
  Pfam annotation: Domain name=COPI_C; Domain location=782-1193; Score =891.7; E_value=3.3e-265; Accession=PF06957.2; Description=Coatomer (COPI) alpha subunit C-termin
  Pfam annotation: Domain name=Coatomer_WDAD; Domain location=309-759; Score=847.3; E_value=7.9e-252; Accession=PF04053.4; Description =Coatomer WD associated region
  Pfam annotation: Domain name=WD40; Domain location=1-37; Score=2.2; E_ value=20; Accession=PF00400.22; Description=WD domain, G-beta repeat
  Pfam annotation: Domain name=WD40; Domain location=166-204; Score =39.6; E_value=1.1e-08; Accession=PF00400.22; Description=WD domain, G-beta repeat
  Pfam annotation: Domain name=WD40; Domain location=210-248; Score =36.2; E_value=1.1e-07; Accession=PF00400.22; Description=WD domain, G-beta repeat
  Pfam annotation: Domain name=WD40; Domain location=41-79; Score=41.6; E_value=2.7e-09; Accession=PF00400.22; Description=WD domain, G-beta repeat
  Pfam annotation: Domain name=WD40; Domain location=83-121; Score =46.8; E_value=7.5e-11; Accession=PF00400.22; Description=WD domain, G-beta repeat
  Pfam module annotation: Pfam domain module=COPI_C::Coatomer _WDAD::WD40::WD40::WD40::WD40::WD40; Domain location=782-1193::309 -759::1-37::166-204::210-248::41-79::83-121
MLTKFETKSNRVKGLSFHSKRPWILASLHSGVIQLWDYRMGTLIDRFDEHDGPVRGVHFHNSQPLFVSGGDDYKIKVWNYKMHRCLFTLLGHLDYIRTVQFHHEDPWIVSASDDQTIRIWNWQSPSLDQTVRVWDIGSLKRKAGPAADDILRLSQMNTDLFGGVDAVVKYVLEGHDRGVNWAAFHPTLPLIVSGADDRQVKLWRMNDTKAWEVDTLRGHMNNVSCVMFHAKQDIIVSNSEDKSIRVWDATKRTGIQTFRREHDRFWILATHPEMNLLAAGHDSGMIVFKLERERPAFAVSGDSLFYTKDRFLRFFEFSTQRETQVLTIRRPGSSSLNQSPKTLSYSPTENAILLCSDVDGGSYELYCISKDGTKDSFGRGDTQDPKKGLGGSAVFVARNRFAVLDKGSNQVCVKNLKNELVKKSALPIAADAIFYAGTGNLLCRSEDRVFIFDLQQRIVLGDLQTPFIKYVVWSNDMESVALLSKHAIVIASKKLVHQCTLHETIRVKSGAWDDNGIFIYTTLNHIKYCLPNGDSGIIKTLDVPIYITKVVGNTIFCLGRDGKNKAITVDATEYIFKLSLLKKKYDHVMSMIRNSQLCGQAMIAYLQQKGFPEVALHFVKDERIRFNLALESGNIQIAVASATAIDEKDHWYRLGVEALRQGNSGIVEYAYQRTKNFERLSFLYLITGNVEKLSKMLKIAEVKNDVMGQFHNALYMGDIRERVKILENAGHLPLAYITASVHGLHDVAERLAAELGDNAPSVPEGKVQSLLMPPLPVLCGGDWPLLRVMRGIFEGDFNNTDRDADDEEYEAADGDWVEELDMVDVDGLENGDVAAILDGVEVAEDDDEEGGWELEDLELPPEADTPKVSVSSRSSVFVAPTPGMAVSQIWIQRSSLAADHVAAGNFDTAIRLLNRQLGIRNFAPLKSMFLDLHTGSHSYLRAFSSAPVVSIAVERGWTESSSPNVRGPPALPFRLSQLDEKLKAGYKSTTAGKFTDALRTFVNILHTIPLIVVESRREVDEVKELIIIVKEYVLGLQMELKRREIKDNPARQQELAAYFTHCNLQTPHLRLALLNAMTVCYKAKNLSTAANFARRLLETNPTVENQAKTARQVLAAAEKNMTDALQLNYDFRNPFVICGATYVPIYRGQKDVACPYCTSRFVPSQAGQLCAVCELSVVGADASGLLCSPSQIR

SEQ ID NO: 214572 - protein, 158 aa, Glycine max
  Coding DNA Sequence Number=SeqID_97794
  Gene Ontology: Mol. function=nucleoside-triphosphatase activity; Cellular component=nucleus; Biological process=DNA replication initiation
  Homolog annotation: Hit_ID=Q1S047; Match level="QueryCoverage=69%, HitCoverage=13%, E-value=5e-29, Identity=60%"; Hit description=MCM; Nucleic acid-binding, OB-fold
  Subcellular localization annotation: CTP_CleavageSite=89; ConfidenceScore=5.87e-01
MASDSSPPNFNNGPSSPDDSLSSPIGNTFSSPASRRRRRSSTPSAFATPSERRSRFASSDATPTAPRSRQRSGGGRVPATSTSTTDDVPASSDGGDGFDMDDARPTFVWGTNISVEDVNDAIKRFLRNFRDASSSQGGDNDDGLHLHTEGKYEKLIRQ

SEQ ID NO: 214573 - protein, 215 aa, Glycine max
  Coding DNA Sequence Number=SeqID_97795
  Homolog annotation: Hit_ID=Q1S049; Match level="QueryCoverage=96%, HitCoverage=73%, E-value=3e-56, Identity=57%"; Hit description=Zinc finger, LRP1-type
  Pfam annotation: Domain name=DUF702; Domain location=2-138; Score =185.1; E_value=1.7e-52; Accession=PF05142.3; Description=Domain of unknown function (DUF702)
MEAQVVKGSKCEDCGNQAKKDCEYSRCRTCCKNKAFKCQTHIRSTWIPVDRRRHQKLEHQPLTTNLKADTIPKRHKHNPYSSLEEFKFPAVMSSMALFSCVQVRSMDDTVNEIAYQTSVNIGGHVFSGLLYDQGPQQQSFNVSKGDNNSSIDPFVQQHSLNLRSSASIHTRNGASANMPPLSATASAQEPFFPPPHPFPLASFRPDMRYLSHPKP

SEQ ID NO: 214574 - protein, 73 aa, Glycine max
  Coding DNA Sequence Number=SeqID_97796
MKGSLLKLMHSYDKVKTQQYLAHNEQAKEDGDKPGLEAMMQKVLQLYASIVLSKRSYAMKGKEVLKDEQFLEP

SEQ ID NO: 214575 - protein, 288 aa, Glycine max
  Coding DNA Sequence Number=SeqID_97797
  Gene Ontology: Mol. function=zinc ion binding; Cellular component =intracellular
  Homolog annotation: Hit_ID=Q1S9J1; Match level="QueryCoverage=82%, HitCoverage=99%, E-value=2e-71, Identity=60%"; Hit description=Zinc finger, B-box
  Pfam annotation: Domain name=zf-B_box; Domain location=1-47; Score =43.3; E_value=8.5e-10; Accession=PF00643.14; Description=B-box zinc finger
  Pfam annotation: Domain name=zf-B_box; Domain location=53-100; Score =62.0; E_value=2e-15; Accession=PF00643.14; Description=B-box zinc finger
  Pfam module annotation: Pfam domain module=zf-B_box::zf-B_box; Domain location=1-47::53-100
MKIQCDVCHNEVASFFCPSDEASLCHACDRTIHHANKLADKHKRFSLHHPTSKDSPLCDICHERRAYLFCKEDRAILCRECDLSIHGVNEHTKKHNRFLLTGVKIGADASDPTSLSSNDTAIEERTTSSSKINRPISSLSNENISSSPTVGDNMACDTGSVSTSSISEYLIQTIPGYCMEDLLDASFASNGLSKDYEHQSAFQNQDVQVSMCSFPLQSWVPQSQAGSPQLISTTSNLHPQINSLVGVMEMPKAKASEGYSNCIYNYDYSAYKVPSICPPLIKKCKRSR

SEQ ID NO: 214576 - protein, 378 aa, Glycine max
  Coding DNA Sequence Number=SeqID_97798
  Gene Ontology: Mol. function=kinase activity; Cellular component =cytoplasm; Biological process=carbohydrate metabolic process
  Homolog annotation: Hit_ID=Q1S9J5; Match level="QueryCoverage=99%, HitCoverage=82%, E-value=1e-153, Identity=73%"; Hit description =Probable xylulose kinase [imported]-Arabidopsis thaliana-related
  Pfam annotation: Domain name=FGGY_C; Domain location=161-376; Score= -74.0; E_value=0.028; Accession=PF02782.6; Description=FGGY family of carbohydrate kinases, C-terminal domain
  Pfam annotation: Domain name=FGGY_N; Domain location=9-158; Score= -129.1; E_value=0.092; Accession=PF00370.11; Description=FGGY family of carbohydrate kinases, N-
  Pfam module annotation: Pfam domain module=FGGY_C::FGGY_N; Domain location=161-376::9-158
MSVRAGERLYLGLDFGTSGARFAIIDKDGIIQAEAKREYPLYLAEVSVCLVLERVESHMIGDSGEPLWRPLLYNESCPDALATVKSIAPPNHTVGYDPEVDSYPSWLVSQPYYHLLPSVVAPGTPIACLKEEIGNKYGFQKDCVVCSGTTDSIAAFLAARATQPGKAVTSLGSTLAIKLLSNTRIEDSRFGVYSHRLDDKWLVGGASNTGGAILRQLFTDDQLDKLSEQINPSQPSLLDYYPLPKAGERFPVADPNLAPRLLPRPENDVEFLHGILESIARIEFCKNKWIFTHPLEPNAKNSSMLFFLSANAKAYGLLKELGATQVDEVFTAGGGAKNEKWIKIRERVIGLPVSRANQTEAAYGAALLAMKGDQQNIL

SEQ ID NO: 214577 - protein, 828 aa, Glycine max
  Coding DNA Sequence Number=SeqID_97799
  Gene Ontology: Mol. function=calmodulin binding
  Homolog annotation: Hit_ID=Q1S042; Match level="QueryCoverage=99%, HitCoverage=99%, E-value=0.0, Identity=48%"; Hit description =Calmodulin-binding, plant
  Pfam annotation: Domain name=CaM_binding; Domain location=693-804; Score=169.5; E_value=8.2e-48; Accession=PF07839.2; Description=Plant calmodulin-binding domain
MVLSKLGIHADHAKSDKCLANLKPYSSQYQDGKTKGTDKVKKMMKSRSFQLSDFEPPQSLPSVRSLSQPRKLSPLHVPTAEASPQQQKALVRRSPNYMKPTSSSYAKKELLPVSHRNTQSSSDGKSLPQKCMRNSKASFVSCKEPAKTLSRSSSLNSMRTLTKTPSFKPCKACSREFTSAVLFEDVNAPERATCSSTLKDCKFPEYLMLHPGGTESKGVSLMKVCPYTYCSLNGHGHGHGHAPLPPLKSFMSARKHLLETQKKIKPEAASPQRWKVPPCDTKKDSYSEQMVFHGKPACDEADTGNPTITPLAQEIAMDFFFEIYAKEREGADEMGKFNSFKDLEKQEDIKFTNEENGFATEDDGVKQVTPGVTHDLSKSQINFEEDFKNYFADAAAIEADIKGSFYLGQNAEDGDENHPPNWFHEETCTGSYCNEASYDGEHMDNSELDESNSQYSDMDWEEEEHFCEFNHEDDTDSSIYSMEETNSKLESLLESSHDISEMRLHNIFSSQYAYILVEEALQEAEEEKMTSFSSQYADILVKALQEAKEEKRTSFDAQPCCTNSVLEDTSESIKFVTQETDYLSNGTSFEYEQSTLTEEVFQYLANAEHNSRENEKHVDYEACCVSMVLDEETVENSEGHKTSESCKIDESCEDRNARLENDDDDGISQENQIHSSEVPEENTIIVQEQKLLEENQVKGSKFLSTDGGEEQHTSKNWQWGTKRKRTVEEDEEMRKISPQNPNFLPLVAEPEPEKVELKHQMIDERKDAEEWMLDFALRQAVTKLAPAGKRKVSLLVEAFETVMSMPKCEACIINDSPFAHARPIQACR

SEQ ID NO: 214578 - protein, 244 aa, Glycine max
  Coding DNA Sequence Number=SeqID_97800
  Gene Ontology: Biological process=electron transport
  Homolog annotation: Hit_ID=Q9LW04; Match level="QueryCoverage=84%, HitCoverage=94%, E-value=7e-29, Identity=37%"; Hit description =Arabidopsis thaliana genomic DNA, chromosome 3, P1 clone: MSJ11
MYGRKEKEALMVSGVAASKGGKEASMAWGGVMEGRLAEELYAESLQLSKLELTSTSADDQENKANDCDDDDLSLWDDSDDKLESLSDLDREWQRRHDQFHTIGYRDGLIAAKEASAQEGFNIGFKQSVLDGYSWGVVRGVTSAFSHLPRQLKARLIETQEKRNEFQGLYESVHSLSTTDALRLFSKEIKAQEALEQSEHSEVSHHTAGLQEQPSHGSQLRSYRGQLESLLCDFPAIDIHLPEPK

SEQ ID NO: 214579 - protein, 189 aa, Glycine max
  Coding DNA Sequence Number=SeqID_97801
  Gene Ontology: Mol. function=cysteine-type endopeptidase activity; Cellular component=lysosome; Biological process=proteolysis
  Homolog annotation: Hit_ID=Q70I35; Match level="QueryCoverage=85%, HitCoverage=44%, E-value=9e-74, Identity=81%"; Hit description =Papain-like cysteine proteinase-like protein 2
  Pfam annotation: Domain name=Inhibitor_I29; Domain location=48-104; Score=90.1; E_value=6.9e-24; Accession=PF08246.2; Description =Cathepsin propeptide inhibitor domain (
  Pfam annotation: Domain name=Peptidase_C1; Domain location=131-189; Score=-130.3; E_value=0.025; Accession=PF00112.13; Description =Papain family cysteine protease
  Pfam module annotation: Pfam domain module=Inhibitor_I29::Peptidase _C1; Domain location=48-104::131-189
MNNPTLIIFFLVIFSVFFAASADGGDDEPLIMQVVEGSGVRLGAEHHFLDFKRRFGKAYASQEEHNYRFEVFKANMRRARRHQSLDPSAAHGVTRFSDLTASEFRNKVLGLRGVRLPSNANKAPILPTDNLPSDFDWRDHGAVTPVKNQGSCGSCWSFSTTGALEGAHFLSTGELVSLSEQQLVDCDHE

SEQ ID NO: 214580 - protein, 191 aa, Glycine max
  Coding DNA Sequence Number=SeqID_97802
  Gene Ontology: Mol. function=cysteine-type endopeptidase activity; Cellular component=lysosome; Biological process=proteolysis
  Homolog annotation: Hit_ID=Q1S044; Match level="QueryCoverage=90%, HitCoverage=48%, E-value=2e-94, Identity=90%"; Hit description =Peptidase C1A, papain
  Pfam annotation: Domain name=Peptidase_C1; Domain location=7-184; Score=164.7; E_value=2.4e-46; Accession=PF00112.13; Description =Papain family cysteine protease
MFPIYLSCLSWTLSYVQCDPEEAGSCDSGCNGGLMNSAFEYILKSGGVMREEDYPYSGTDRGNCKFDKAKIAASVANFSVISLDEDQIAANLVKNGPLAVAINAAYMQTYIGGVSCPYICSRRLDHGVLLVGYGSGAYAPIRMKEKPFWIIKNSWGENWGENGYYKICRGRNICGVDSMVSTVAAVHTTTQ

SEQ ID NO: 214581 - protein, 164 aa, Glycine max
  Coding DNA Sequence Number=SeqID_97803
  Gene Ontology: Mol. function=chitin binding; Cellular component =extracellular region; Biological process=chitin metabolic process
  Homolog annotation: Hit_ID=UPI000044A8F0; Match level="QueryCoverage =95%, HitCoverage=100%, E-value=2e-25, Identity=31%"; Hit description= PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Pfam annotation: Domain name=Cornifin; Domain location=1-162; Score= -39.5; E_value=0.019; Accession=PF02389.6; Description=Cornifin (SPRR) family
MSSPSEDYAPTLSWGYTPFPSEDYTSSPSEGYRLLPSEEYTLSPSEDYMSSPSEDYTCSPSENYTFSPSEGYTPSPSADYTLSPLEGYTPSPLEDYTSLPSEGYTSLPSDGYTHSPSKDYTSSPSEGYTSLPSEGYTSSPSMDFPCSPSEDYTASPSEGYTPSP

SEQ ID NO: 214582 - protein, 83 aa, Glycine max
  Coding DNA Sequence Number=SeqID_97804
MARTKKTGQMTSEVAKRIADKIDSLEEQASQGSFVAHGSGVTIKKYFGPAPRTSHTSSSMAPEDQEQLTQQIRDQLEESITEK

SEQ ID NO: 214583 - protein, 221 aa, Glycine max
  Coding DNA Sequence Number=SeqID_97805
  Gene Ontology: Mol. function=transferase activity, transferring phosphorus-containing groups; Cellular component=membrane; Biological process=peptidyl-histidine phosphorylation
  Homolog annotation: Hit_ID=Q1XPJ6; Match level="QueryCoverage=98%, HitCoverage=47%, E-value=6e-47, Identity=46%"; Hit description=ATP -binding region, ATPase-like:Histidine kinase, HAMP region:Histidine kinase A-like precursor
  Pfam annotation: Domain name=HATPase_c; Domain location=111-220; Score=113.4; E_value=6.6e-31; Accession=PF02518.16; Description =Histidine kinase-, DNA gyrase B-, and HSP90-like ATPase
  Pfam annotation: Domain name=HisKA; Domain location=1-64; Score=40.9; E_value=4.2e-09; Accession=PF00512.15; Description=His Kinase A (phosphoacceptor) domain
  Pfam module annotation: Pfam domain module=HATPase_c::HisKA; Domain location=111-220::1-64
NFINYVSHEFKTPLAAISGNLEVFAQKDRTPEEYRKVVKESLDNVYEIESILNNLLLMSGLTKLENSHQQVRIDELIWKIYEKLNPKAQENNSSIKINLLVNTPDLLEFPGNETLLYLALYNIVENAIKYSGHHSVEIVLSEEQDRHLLIEVKDQGRGISEDDLQKITETFYRGKNVDNIKGSGIGLSLSKSIFDHHHIQMKINSVVGSGTQVSLIFPVTK

SEQ ID NO: 214584 - protein, 142 aa, Glycine max
  Coding DNA Sequence Number=SeqID_97806
MMIWKQREKLVMATARWALKHPVYGIVILQLGIYTNRPNVSKLCSFTSSMNSSILISVIQENKLLASVPCFQKICLLSTNDLCFLTITCRPSRTTFLNEKLYTVPEFQQTLLTTTKMKHKKNMNLGIPRSYGSACHRSLGSR

SEQ ID NO: 214585 - protein, 54 aa, Glycine max
  Coding DNA Sequence Number=SeqID_97807
MKNKKVVVAGVSLSEALSRLSSLALSAPSSLNGNHLLALSTKMVLSEPSRIESP

SEQ ID NO: 214586 - protein, 137 aa, Glycine max
  Coding DNA Sequence Number=SeqID_97808
  Homolog annotation: Hit_ID=Q1S3Q9; Match level="QueryCoverage=60%, HitCoverage=16%, E-value=3e-09, Identity=40%"; Hit description =Cyclin-like F-box; F-box protein interaction domain
MLSLEVSEKTEMKVYGAGDSSWRNLKDLEKETCRSLFLLDDFCFFDTNIGVFRDSMCVWQDSNTHLGLWQMRKFGDDKSWIQLINFSYLHLNIRPYEEKSMILPFCMSNNGDFFMLKFTRNADDEYQTILYNQRDDV

SEQ ID NO: 214587 - protein, 100 aa, Glycine max
  Coding DNA Sequence Number=SeqID_97809
MSASYLLLKICELIAPELDASLSVERSSFDGLEALLVYGAPETEAIKLGSGTETFPLPHFNPLRAGVARPAALSVCPALGKGRRSIGRDPSLYLRPSLST

SEQ ID NO: 214588 - protein, 155 aa, Glycine max
  Coding DNA Sequence Number=SeqID_97810
  Gene Ontology: Mol. function=transition metal ion binding; Biological process=electron transport
MQSGSQSESFDVEMGDRLEDIIYDLGQESFQQAHARMYDTLKANSKKPLYMGCNNSLTLLSTNLHRLEASIVERYIPEEAIEFCSEYIERAKPVGLPESRHEERVRGLVKESNPKMSKSRVLKEHNKTFLNWFKDTIFGDDNASKTLRKLADGPE

SEQ ID NO: 214589 - protein, 130 aa, Glycine max
  Coding DNA Sequence Number=SeqID_97811
  Gene Ontology: Mol. function=nucleoside-triphosphatase activity; Cellular component=chloroplast
  Homolog annotation: Hit_ID=Q2PMM5; Match level="QueryCoverage=100%, HitCoverage=7%, E-value=2e-64, Identity=75%"; Hit description =Protein ycf2
MSHTNGFGSTTMGSNVRSVQDHGILFYQIGRAVSQNVLLSNCSIDPISIYMKKKSCDGGDSYLYKWYFELGTSMKKLTILLYLLSCSAGSVAQDLWSLPGPDEKNGITSYGLVENNSDLVHGLLEVEGAL

SEQ ID NO: 214590 - protein, 374 aa, Glycine max
  Coding DNA Sequence Number=SeqID_97812
  Homolog annotation: Hit_ID=Q0MGB5; Match level="QueryCoverage=47%, HitCoverage=64%, E-value=3e-55, Identity=56%"; Hit description =Hypothetical protein precursor
  Pfam annotation: Domain name=Extensin-like_C; Domain location=254 -374; Score=243.9; E_value=3.5e-70; Accession=PF06904.3; Description =Extensin-like protein C-terminus
HDWSRPRKAAPPPVSNVLRHDVHAKIVSVHDPPWQADFGKGMNLTGRRGVATLPKRSGVPRQMLHRLCLLVTTLALISASEPPAQVPVPQPKPGEGQSSTPSEKPSDKTPQRPAEAPKPVPKPQPEEQPVAKPDASGNQQSDGEKTPADKGSDDAKKEGEDKDGVEQKKPTVETAKPDEKPPEPVKPEDPAALQACLASLKGIGAEFKQLEPIRDTEQGCGIDAPIELSVVLPGIKLEPSGTMRCETALALSRWTKEMMVPAAALALPEKKVTAIANASTYICRNRNSAENGKISEHAKGNAVDISTISFDKGEPLVMKPRGEDRTPEGAFQRTITAAACLFFRTVLSPGSDATHQDHLHLDVLERKGGYLYCR

SEQ ID NO: 214591 - protein, 63 aa, Glycine max
  Coding DNA Sequence Number=SeqID_97813
FYGVPVAPSKVIRLPTNRAFIKKYCVPMQAQGKTPQQPGGGRQRATGAPPSTLEFTSAHPKKG

SEQ ID NO: 214592 - protein, 71 aa, Glycine max
  Coding DNA Sequence Number=SeqID_97814
  Subcellular localization annotation: CTP_CleavageSite=30; ConfidenceScore=5.15e-01
MRVEIATRPTWALQKAVASGGSHLARLVIRSALLKSEPRCFRNVSVGIFAKIFSRSSTFFIRSSSFFGLQP

SEQ ID NO: 214593 - protein, 56 aa, Glycine max
  Coding DNA Sequence Number=SeqID_97815
MAKRAQNDHNLSLRAIGHDCLRMAKRHDCLRMAKRAQNDHNLSLRAIGHDCVWMAK

SEQ ID NO: 214594 - protein, 66 aa, Glycine max
  Coding DNA Sequence Number=SeqID_97816
MSRNFTDCLTRGVKYLEVVKRRCIMTIICLCMPSNTIVSGWQKVRNDQNLSLRAIGHNRIWMAKGA

SEQ ID NO: 214595 - protein, 92 aa, Glycine max
  Coding DNA Sequence Number=SeqID_97817
MTKAHQKGVRKGKVGEACHLARPSELGCFLQKAPPSGGISWKAQNFTDRATRLSFDFRHVMELHVLCNNGCQVSRSGQAKVACHQTMVPGRN

SEQ ID NO: 214596 - protein, 300 aa, Glycine max
  Coding DNA Sequence Number=SeqID_97818
  Gene Ontology: Mol. function=oxidoreductase activity; Biological process=aromatic compound metabolic process
  Homolog annotation: Hit_ID=Q93L50; Match level="QueryCoverage=99%, HitCoverage=83%, E-value=1e-106, Identity=60%"; Hit description =TetX1 protein
MGIIFADQQGNTLHTRKPTPENRYDNPEINRNQLRKILLESLAPNTVIWNRKLTNLTEHNGKWLLQFENQPDATADLVIVANGGMSKVRNYVTDAEIEETGSFIIQGDVPQPEINSPQMYGLCDGSRLMTSNQGSLFVANPYNNGSLTYGLIIQKPQEWDQGHALDFQDKEIVIQFLSERLPDWGKPYQEVFQATSFFVGLPTRKLPLKQWKDSRSLPITLIGDAAHLMPPFAGQGVNIGLVDALTLSENLTEGSFETVEAAIKDYELKMIKYAAEAQQESAVNEAEMRDPDFSFLQLFE

SEQ ID NO: 214597 - protein, 83 aa, Glycine max
  Coding DNA Sequence Number=SeqID_97819
MAFVCRASAEDAIQRMQGKVIGQQVIQISWGSTLTARQWFGCLVVERCLEDKSRLYLTIMRLMPMKVITIAYANWVWSHFPFP

SEQ ID NO: 214598 - protein, 69 aa, Glycine max
  Coding DNA Sequence Number=SeqID_97820
MYWTIWILKYQKSSELVKKFGDMMPKTKNSTGIKVMLKRHKPNDSSKKPRDVTARTMNTQSKFVAHSCK

SEQ ID NO: 214599 - protein, 86 aa, Glycine max
  Coding DNA Sequence Number=SeqID_97821
MLSWLKFLGCPRIIIMLSLTFNPILHSYRMHSLTRKFEGKRVTAMLFTGSDWPGAVVSEYWTLAESKRDVGTLDPKHRVQRLLVNP

SEQ ID NO: 214600 - protein, 97 aa, Glycine max
  Coding DNA Sequence Number=SeqID_97822
  Pfam annotation: Domain name=Agenet; Domain location=18-69; Score =27.8; E_value=3.7e-05; Accession=PF05641.3; Description=Agenet domain
MEIKPEEYSRRQLKESKFKKGIVEEVSRDDKGKDRFQVEYRDLKTNGGTQLLKEEIDARLIRPCPPEVSFAGPFKQFQEVDAWYKMTGGGKPLLMKY

SEQ ID NO: 214601 - protein, 138 aa, Glycine max
  Coding DNA Sequence Number=SeqID_97823
  Subcellular localization annotation: CTP_CleavageSite=74; ConfidenceScore=5.38e-01
MQKFLYVPSMSNCALSAVCFDKCTKIPIVTSSSSFCLLHSFIMLLSSHSFILVRGEVLHCRAYFGLGASVTVVRQQVMVGVSINDKSKMEEDQWMHDNVMFEEVDVNEANGEEPGVHQHVDSFDAFNIFQVKLVVGGE

SEQ ID NO: 214602 - protein, 67 aa, Glycine max
  Coding DNA Sequence Number=SeqID_97824
MMIYGVDLIAGGGVRGECSWKSIREQRHRKLRACGSQDETKKHNVGEEQMKESGVGEEQVREKGKEK

SEQ ID NO: 214603 - protein, 154 aa, Glycine max
  Coding DNA Sequence Number=SeqID_97825
  Gene Ontology: Mol. function=structural constituent of ribosome; Cellular component=intracellular; Biological process=translation
  Homolog annotation: Hit_ID=Q9LSN0; Match level="QueryCoverage=52%, HitCoverage=23%, E-value=7e-15, Identity=47%"; Hit description =Arabidopsis thaliana genomic DNA, chromosome 3, TAC clone:K14A17
  Subcellular localization annotation: CTP_CleavageSite=68; ConfidenceScore=5.53e-01
MEAKSLLKGSSLKPSYPIHKLSKTTMMTPNCVRFSFNYNSCLIFANGYPSSSLPLSLQNKPRKSASVVVSARRKDKKEDTHSSVPKPDEVTGFFPEAVLLKKRTVEEEGKLLPEFEDADERELFEALMLELDSDMDVDIYSNNVMNHSLRRFVL

SEQ ID NO: 214604 - protein, 769 aa, Glycine max
  Coding DNA Sequence Number=SeqID_97826
  Gene Ontology: Mol. function=heat shock protein binding; Cellular component=integral to membrane; Biological process=protein folding
  Homolog annotation: Hit_ID=Q7Y151; Match level="QueryCoverage=95%, HitCoverage=97%, E-value=1e-168, Identity=44%"; Hit description =Putative heat shock protein
  Pfam annotation: Domain name=DnaJ; Domain location=439-503; Score =95.0; E_value=2.2e-25; Accession=PF00226.21; Description=DnaJ domain
MARKGNQQKNGVDRHGLNNKKGVSGGMLPGMKDLGKGGPVKVFLREELAETNCIGVSQTACDASSSGDECNNEQRSVKVSRKEKQGMAGKHDLEESSFFEGNSGDGSLNSEAEASIQEENGTLPRSNQGQQSIKSRLSCILDSLHLKSVVEKVELADNVIIRRLRLLVFSIFTAVSEWLTRQTPLFVSLRTIVFEACHNVRTKFVLAYPIVLKCLMHFGNIMLLLSVFWLDCALRGVDSFIRMGTTSFFSVIWCSIFSVISMIGMLKFLAVLGLAALIGCFLGLMLAILVVAIIGVITLWFYGSFWTTAFFIILGGLTFMLSHERVALLITTVYSVYCARLYAGWLGLLLAFNLAFISSDVLIYFLKKNIEQQSRSNPFEQRAGMHGQPGFSDEPTHASSSENGQGPSADRNAGIPSTSGVDSDLTSEDEVVRLLNCSDHYAALGFTRYQNIDVSILKREYRKKAMLVHPDKNMGNEKAAEAFKKLQNAYEILMDSLKRKAYDDELRREEILSVFRRFHDASRKGTMLFGSNTLWSGIIFISIGDNNHEENGRHGFFPSGFARSDADGKDPFGDSRRIACKRCAGFHVWIHTKKQKSRARWCQDCQDFHQAKDGDGWVEQSSQPFLFGLLQKVDAPSAYVCAGSRIYDATEWYICQGMRCPANTHKPSFHVNTNLMSKHNSGKGTSSGQRGGHMPTPNIEETMTEEELFEWLQNAVHAGAFDNFSGTATESPSPKSGNGMKSPGSSSAGASAGAGGSSSKRKKKGKKQW

SEQ ID NO: 214605 - protein, 313 aa, Glycine max
  Coding DNA Sequence Number=SeqID_97827
  Gene Ontology: Mol. function=transition metal ion binding
  Homolog annotation: Hit_ID=Q8LAU8; Match level="QueryCoverage=88%, HitCoverage=87%, E-value=1e-105, Identity=70%"; Hit description =Dessication-related protein, putative
MAPQISRGRVSIVVLLASLVLPLLFPECYYSSVFIASAAAPESDVDLLEFPLNLEYLEAEFFLFGSLGYGLDVVAPNLTEGGPPPIGARLARLDSLVRDIILQFGFQEVGHLRAIKSTVRGFPRPLLDLSTASFAKVMNSAFGRPLVPPFDPYANSINYLLASYVIPYVGLTGYVGANPLLQNATSKRLVAGLLGVESGQDAVIRALLYEYRTLSVQPYNVTVAEFTNRISMLRNNLGGSGLKDEGLVVPREQGAEGRVTGNILVGDKDSLSYPRTPREILRIIYGGGDEHVPGGFYPKGASGRIAKYYLKTT

SEQ ID NO: 214606 - protein, 182 aa, Glycine max
  Coding DNA Sequence Number=SeqID_97828
  Gene Ontology: Mol. function=structural constituent of ribosome; Cellular component=intracellular; Biological process=translation
  Homolog annotation: Hit_ID=Q2QNJ6; Match level="QueryCoverage=45%, HitCoverage=26%, E-value=2e-36, Identity=79%"; Hit description =Ribosomal protein S6 containing protein, expressed
  Pfam annotation: Domain name=Ribosomal_S6; Domain location=6-80; Score=49.4; E_value=1.2e-11; Accession=PF01250.8; Description =Ribosomal protein S6
MLGSPVSMLHRTDGDFLREKKGQVWRLNDWGMRRLAYKIKKANNAHYMLINFELDAKYINDFKTLLDQDERVIRHLVIKRDEAITEDCPPPPDFHTLRGNADDDEDEEFDEDYDGDWDGEDEEDGDEGEDDIIFVDGDEDDIDSRKQTSANVRQPDIRKLRAENVLSAEGIEPAIFPSYLTS

SEQ ID NO: 214607 - protein, 106 aa, Glycine max
  Coding DNA Sequence Number=SeqID_97829
  Subcellular localization annotation: CTP_CleavageSite=61; ConfidenceScore=5.05e-01
MEFDSPTSRPIRSDVVLDPPPPFPTIYTFLPPPPSTVLLPLPINPSLFFTMDNQRSISLFQFMADEGLVPWLEDYLYGLGINIYAVIISTSLNSNVNFGNLTHNHI

SEQ ID NO: 214608 - protein, 143 aa, Glycine max
  Coding DNA Sequence Number=SeqID_97830
  Gene Ontology: Cellular component=integral to membrane
  Homolog annotation: Hit_ID=Q9FGZ2; Match level="QueryCoverage=61%, HitCoverage=55%, E-value=2e-27, Identity=65%"; Hit description =Arabidopsis thaliana genomic DNA, chromosome 5, TAC clone:K6M13
  Pfam annotation: Domain name=DUF1328; Domain location=36-75; Score= -11.2; E_value=0.04; Accession=PF07043.3; Description=Protein of unknown function (DUF1328)
  Pfam annotation: Domain name=DUF786; Domain location=11-125; Score =121.2; E_value=2.9e-33; Accession=PF05646.4; Description=Protein of unknown function (DUF786)
  Pfam module annotation: Pfam domain module=DUF1328::DUF786; Domain location=36-75::11-125
MAVHSDSASSEKKSSNGVNELLTFNAENMQSNMKIIYYSRTFLSIIGGVVAGILGFTGLKGFVFYLLLMAFTSLGLVAKAKFSTHTYFDSWNRVLLDGFLGGLMDVPELVVHVKFPVAGVGLVVFEPGLERRECYSVELVAGG

SEQ ID NO: 214609 - protein, 189 aa, Glycine max
  Coding DNA Sequence Number=SeqID_97831
  Gene Ontology: Mol. function=enzyme inhibitor activity
  Homolog annotation: Hit_ID=Q9LSN4; Match level="QueryCoverage=78%, HitCoverage=83%, E-value=2e-27, Identity=42%"; Hit description =Arabidopsis thaliana genomic DNA, chromosome 3, TAC clone:K14A17
  Pfam annotation: Domain name=PMEI; Domain location=37-182; Score =98.7; E_value=1.8e-26; Accession=PF04043.6; Description=Plant invertasepectin methylesterase inhibitor
MRRIPTSVSSFAIHILLLLASISIPFTLCQPSFPWKDGNGDLVDQVCKKTPFYDLCSSILHSNPLSPKPDLKGVALLMVNNILANATDTLSYIEGLIKQTPDRELEQSLAFCAESYIPIVKYILPQAADAISQGRFGFASYCISDALKEVSSCDKKFSGATQAPLGDRNDIVQKLVNVASAIVKLLLKG

SEQ ID NO: 214610 - protein, 281 aa, Glycine max
  Coding DNA Sequence Number=SeqID_97832
SGESLEEILQNNNNQEVGLGFCEFGMDHRSAMDRATEFDLESGLPLIGDDSKKVSAPSTASSAKQGKALFAKVSGGFAGGSVKGDDGPSLCCNEPSLSEVYADVMRVTNKPMMGRDSANRAQQTPVREKRKKASNKKAPKPPRPPKAPSLDAADHKLIREISELAMLKRARMERMKTLKKMKIAKSSAPSSSNASSLLAMIFTVVFFVVIILQGMSSGKTSVASFQGSPVSAGESEDGLISVHYQLNPSAIDSNAPGSESHTFVQQVAGSDLPEKLRRDSG

SEQ ID NO: 214611 - protein, 86 aa, Glycine max
  Coding DNA Sequence Number=SeqID_97833
MVDVIKAIPNETLNKINELLKEGDVQQTTQALKLGDPSLQKMEQVINLLRLLLVRRASVGNHGSPRRTIMHSDVANVTRAIVRLLL

SEQ ID NO: 214612 - protein, 212 aa, Glycine max
  Coding DNA Sequence Number=SeqID_97834
  Gene Ontology: Mol. function=nucleotidyltransferase activity; Cellular component=intracellular
MTRKVHNEMISTRPKEYDELPGSDIPTDEERAESINRRISNLIVAEIFSIPRAHAYVSPLRHSVTEALRYDRFHRIPREALEAEPQIQRIHRHLQLVLRTRELKAIGVVPESDEGVRRIVQERAEALRHVVGVRELEDEAAAADAELKRVRRRIVAAASPLHAEADNEALLVDEVAVEVERGGEPPLDHGGAGGDGDGDVVFGETDGVDVVV

SEQ ID NO: 214613 - protein, 153 aa, Glycine max
  Coding DNA Sequence Number=SeqID_97835
MRKKFVVKRVDPLAKALTSVYDESQIERQGKISGGVVEANSCNVDSTMNMEFTDGSETIMSDVDMTRTGDMANVASILGRLWPTLIKPLNEESMLLEFPSYQRRQTLWEELINFVDDVDGPLAFVGDYNVVLHVSMNEVGAVLDICSKHGSLS

SEQ ID NO: 214614 - protein, 281 aa, Glycine max
  Coding DNA Sequence Number=SeqID_97836
  Homolog annotation: Hit_ID=Q2QVB3; Match level="QueryCoverage=64%, HitCoverage=43%, E-value=9e-31, Identity=39%"; Hit description =Expressed protein
MENSEDFLTLSPPGNNSDAKSARLFLTINPPPTMQKHLSLISPLLEPYKPSYQNTDNIVAGDMHLNAPSTALSLSISPMLSPYTASNPNKDNASDLHPNVPVPGFSSSPRTRSRRGKSKTITPPFPWATNRRATVHSYKYLLQNKIVTITGKVKCKRCDERFEMELDLKSKLGELLKFIQKKKCIMHDRAPNVWVVPVLPKCEHCGRENSVEPFLGDTKRRAINWLFLLLAQMLGFCNLKQLQYFCKHNNNHRTGAKDRIVYSTYMGLCKQLLPELFDSRS

SEQ ID NO: 214615 - protein, 365 aa, Glycine max
  Coding DNA Sequence Number=SeqID_97837
MCILPRLKIIHFNPSRTLLKELMFTFMMNLSSNSSKENGKRKEKGYHCSYCEKAFENSQGLGDHQRLYEVEIKQHNNQMIHFQNSKDVTKSNPGHGDALMKALSRGTTNNPYVTKGNYYGGYSREDHNSLFMPPNYSSARTDNASLVTSIQYKETIPFSQSVDYPIYMSSFSNHIGGASSSINHQFDASNPQFFIDSFSKPFKSNFWKNEHNDPNLTYPVLVRNSSLPGYHMADFSLWNFNTNKFPSPIEPNVVDTQINFVGSNNSYSYNVDQIYEKVKNHNRDEVQEKIPMMNPPKMPNINFGPLVNHGIEMLQKKEAWFSTKETKLKAVEAIFGKDEGKNASTSKSANFIKEQEVDLDLSLHL

SEQ ID NO: 214616 - protein, 122 aa, Glycine max
  Coding DNA Sequence Number=SeqID_97838
  Gene Ontology: Mol. function=RNA-directed DNA polymerase activity; Biological process=RNA-dependent DNA replication
MGRNGPRISHLIFVDDLLLCGQADYEQMQCLKELLQLFRDIDQLVSGEKTLSNPYLFFGFMEVSSLGSYLGIPLLGKTPRQRDFQDLMDKVSNKLANTLNSCQWLTTSLLLALSFKPYLLTL

SEQ ID NO: 214617 - protein, 210 aa, Glycine max
  Coding DNA Sequence Number=SeqID_97839
  Gene Ontology: Mol. function=RNA-directed DNA polymerase activity; Cellular component=extracellular region; Biological process=RNA -dependent DNA replication
MKVEKTKIFFSENINWHIKEDLTAKIGFQCTLGKYLGVPIFHKKVKKESFEFLLDKVNHILSGWKSKMLSMAGRLSLAKYVIKAFPSYVMQIVKIPAYICGEIYKNVEHFYLGDDENRRRVHIVAWSELCMPKNAGGLGLRSSTDMNKSLVYEGYSQVIDEGDPYFKRIWDWKGPKRIRIYYGRGEASRPLPMQENPYIRKKLQKQNERS

SEQ ID NO: 214618 - protein, 79 aa, Glycine max
  Coding DNA Sequence Number=SeqID_97840
MVESNDEVGAHWVWYLRSLRKTKIITRVPGWETHCFSDAVTELYLTRSVVALLLSRYAWELHGRDSRSNEGDDDEKFHR

SEQ ID NO: 214619 - protein, 341 aa, Glycine max
  Coding DNA Sequence Number=SeqID_97841
  Gene Ontology: Mol. function=nucleic acid binding; Cellular component= intracellular; Biological process=regulation of transcription
  Homolog annotation: Hit_ID=Q1SHX5; Match level="QueryCoverage=88%, HitCoverage=87%, E-value=5e-95, Identity=55%"; Hit description=Zinc finger, C2H2-type
  Pfam annotation: Domain name=zf-C2H2; Domain location=185-207; Score =20.3; E_value=0.007; Accession=PF00096.16; Description=Zinc finger, C2H2 type
  Pfam annotation: Domain name=zf-C2H2; Domain location=269-291; Score =14.1; E_value=0.31; Accession=PF00096.16; Description=Zinc finger, C2H2 type
  Pfam annotation: Domain name=zf-C2H2; Domain location=295-320; Score =7.0; E_value=1.8; Accession=PF00096.16; Description=Zinc finger, C2H2 type
  Pfam module annotation: Pfam domain module=zf-C2H2::zf-C2H2::zf-C2H2; Domain location=185-207::269-291::295-320
  Subcellular localization annotation: CTP_CleavageSite=51; ConfidenceScore=5.32e-01
MTNSYTSNDLNFWLDLNSPCLLSSPSPSSINPPFYFPSNYHNSNNYTSAISSNTHHQFQPSPPQRKALPLLHPRHEEEEDLESSFSVMEVDKKKKELSSSSSFLDEEDAAVTVALHLGLPSTSIASSADLASSSLYSTEASSDKEEEEEKVVLTDASGLLLSNRINRGQYWIPTSSQILIGPTQFPCPLCFKTFNRYNNMQMHMWGHGSQYRKGPESLRGTQPTAMLRLPCYCCAPGCKNNIDHPRAKPLKDFRTLQTHYKRKHGTKPFVCRKCCKAFAVRGDWRTHEKNCGKRWYCSCGSDFKHKRSLKDHIKAFGYGHTACGNDCNLDQDDDQVGSEIE

SEQ ID NO: 214620 - protein, 95 aa, Glycine max
  Coding DNA Sequence Number=SeqID_97842
MYNVWFVRFFEVHYLLSLVPLVVAASGREDSDIGGGVRCGGTDRDDTKLGVASDVHEAKVVGGVTGDLKERDDKLVEGVGRVRRSDQERNWRRTW

SEQ ID NO: 214621 - protein, 44 aa, Glycine max
  Coding DNA Sequence Number=SeqID_97843
MEVLKPPTDESATPSKTCESITIMNEDNVSVEGKPNEREREFEY

SEQ ID NO: 214622 - protein, 379 aa, Glycine max
  Coding DNA Sequence Number=SeqID_97844
  Gene Ontology: Mol. function=DNA binding; Biological process=DNA integration
MACYLLNRSSRASLDEKVAKEDPVSNKMVINRHAMFDEQSMLPEIVETIVPVSDGASLGSMEVQATPTYGPGSMSPSGLHQEYNLIKDRDCRNINPVVQYQFEELAKSTAFALLTSATYPFTFQEAMNNQEKKKRICTKETSISEKEEEKFKALPIEKGRKFTWSSQNGSIKVDQVNCLDDDYFIFLLLYVEDMLIASSLLHDVNELKSLLNKEFDKKDLGPAKKILGFNTSNTKPMSTPLEKHFKLYVDQCPKTNVEVKYMSKVPYASAVGCLMEATLRNSEVDIEGDPSVVKYVDSDYASDLDDRRSTTGYVFSFGAEYMALVEASKEVVFFIELMNKLGKVGVEYKGHLLLGYKAGNINEAIVKAMNLKMESNLKK

SEQ ID NO: 214623 - protein, 210 aa, Glycine max
  Coding DNA Sequence Number=SeqID_97845
MTYLKQESCPRHDDPSDYRGTSQNMLLLLARFGYTFWQQWRITGAKSGVGKLDGIENFGLWHRRVKDLLTQQGLLKVDSKLEKMEDLDWEELQERVAATIRLYLVDEVLYHVTKLASLGARQNAMGSSKGDGLHLKGKHECGRTQDKDYGGRQRKSLSLENANGFSYRTDEDQDTFRVCKGARYVWVLTVMKAHGAIGNIFGLLESIVVG

SEQ ID NO: 214624 - protein, 75 aa, Glycine max
  Coding DNA Sequence Number=SeqID_97846
MVMGNNASCMITGTGIVQIKMFDGVIRTLGDVMHVLDVKKSLISLCTLDSKGTSTLVKVESWRLAKGDSMLYMVL

SEQ ID NO: 214625 - protein, 213 aa, Glycine max
  Coding DNA Sequence Number=SeqID_97847
  Gene Ontology: Mol. function=sequence-specific DNA binding; Cellular component=nucleus; Biological process=regulation of transcription
  Homolog annotation: Hit_ID=Q2PJR6; Match level="QueryCoverage=75%, HitCoverage=53%, E-value=2e-40, Identity=52%"; Hit description=WRKY54
  Pfam annotation: Domain name=WRKY; Domain location=66-125; Score =153.7; E_value=4.8e-43; Accession=PF03106.6; Description=WRKY DNA -binding domain
AIGAGLFAITPAGERGMCCKAIKLGNARVFPVKTLLKAKKKKKKKNQKKQREPRFAFMTKSEVDHLDDGYKWRKYGQKAVKNSPYPRSYYRCTSAGCGVKKRVERSSEDPSMVVTTYEGQHTHPCPASARSSLGFVTQPAAFGPSHFMLPHQAQASALSVVSSSSNYINTTSFGGFVQDHSTRRGFGHEALLRDNGLLQDIIVPTQVTKEEMD

SEQ ID NO: 214626 - protein, 397 aa, Glycine max
  Coding DNA Sequence Number=SeqID_97848
  Gene Ontology: Mol. function=actin binding; Cellular component =microtubule; Biological process=cytoskeleton organization and biogenesis
  Homolog annotation: Hit_ID=Q9LTT4; Match level="QueryCoverage=94%, HitCoverage=86%, E-value=1e-82, Identity=43%"; Hit description=WD domain protein-like
  Pfam annotation: Domain name=WD40; Domain location=258-296; Score =38.5; E_value=2.3e-08; Accession=PF00400.22; Description=WD domain, G-beta repeat
  Pfam annotation: Domain name=WD40; Domain location=301-339; Score =4.7; E_value=10; Accession=PF00400.22; Description=WD domain, G-beta repeat
  Pfam annotation: Domain name=WD40; Domain location=346-382; Score =0.8; E_value=29; Accession=PF00400.22; Description=WD domain, G-beta repeat
  Pfam module annotation: Pfam domain module=WD40::WD40::WD40; Domain location=258-296::301-339::346-382
MEMEDNETIGVLIENSDNTTSLEARSGKDIQGITWKTETSDYKSRDEFRRFRLERLWIVEPRPLIVEQAKQGCQPTLKGGIYYDYFKYNNCLMPFKQDYSPDYGGMLWCTSRHDLYFCSRYKIGHLNALTSRTTEVLDVKGHVVPSKEHPGNHMHGFTKTCIEAMAVGHKLLIIGGNYGELICKHLNRPGVSFCFQLENEAKINSIEIFKRPTATRSLFTFSLIIEVAAKHASSSPDGRQLVVVGDDPEGRLVDSESGSTIQSFRGHFGCSCSSAWHPDGNMFATGNTDRTCRIWDVRNLLQPVAALEGNATAISSISFTSDGRFMAMCEDVDFVHVYDVQDAFRREQEIDLFGHVSGLSFSPDTEYLFISVSIDTVPTLLSYQRRHRIYHYLDSMN

SEQ ID NO: 214627 - protein, 55 aa, Glycine max
  Coding DNA Sequence Number=SeqID_97849
MRVQRRVKFIAHALHVRDVGQCRGLLAGGEGKRQRWSNYMGMNNPHKIPRSCLVV

SEQ ID NO: 214628 - protein, 181 aa, Glycine max
  Coding DNA Sequence Number=SeqID_97850
  Gene Ontology: Mol. function=unfolded protein binding; Cellular component=prefoldin complex; Biological process=protein folding
  Homolog annotation: Hit_ID=P57741; Match level="QueryCoverage=97%, HitCoverage=67%, E-value=1e-45, Identity=58%"; Hit description =Probable prefoldin subunit 3
  Pfam annotation: Domain name=Prefoldin; Domain location=1-164; Score =50.7; E_value=4.8e-12; Accession=PF02996.8; Description=Prefoldin subunit
MKLLAQQRDLQAKIPDIEKCLDVVATLKAKKGTGEELIADFEVSEGIYSRARIEETNSVCLWLGANVMLEYSLEEVLVSEKNSSPTLARNKANIEYISGGQPSPYELAFGVELGPDSHFIMATGLLQKNLDNARASLEVLIADLQFLRDQVTITQVTIARVYNWDVHQRRVQQAVATTAQD

SEQ ID NO: 214629 - protein, 153 aa, Glycine max
  Coding DNA Sequence Number=SeqID_97851
  Subcellular localization annotation: CTP_CleavageSite=54; ConfidenceScore=5.18e-01
MAEEKRQEQVANPNNSSSTTMPFSDQIPNNNNSIMMTFPFQQPSTIFDLMMMPSSSSFMDLLAVQDYNVPLFDWLPAGVAHHPSPSPASSNVPDSSEVLNTPASPNFSSISSSSNEATVNNNSEQQSGKELQEEEGGNGGRGDNQDQDKTKKQ

SEQ ID NO: 214630 - protein, 36 aa, Glycine max
  Coding DNA Sequence Number=SeqID_97852
MAFHTPRLSSLKVLVLGGSETGVKPLTSSICPRGKA

SEQ ID NO: 214631 - protein, 479 aa, Glycine max
  Coding DNA Sequence Number=SeqID_97853
  Gene Ontology: Biological process=polysaccharide catabolic process
  Homolog annotation: Hit_ID=Q029P0; Match level="QueryCoverage=79%, HitCoverage=57%, E-value=5e-69, Identity=41%"; Hit description =Hypothetical protein precursor
  Pfam annotation: Domain name=DUF1680; Domain location=106-479; Score =293.9; E_value=3e-85; Accession=PF07944.3; Description=Putative glycosyl hydrolase of unknown funct
MEALVFALVAILLCGCDAAKECTNIPTQSHTFRYELLMSTNATWKAEVMDHYHLTPTDETAWADLLPRKLLSEQNQHDWGVMYRKIKNMGVFKSGEGFLKEVPLQDVRLHKDSIHGRAQQTNLEYLLMLDVDSLIWSFRKTAALSTPGTPYGGWEGPEVELRGHFVGHYLSASALMWASTQNDTLKQKMSSLVAGLSACQEKIGTGYLSAFPSEFFDRFEAVQPVWAPYYTIHKILAGLLDQHTFAGNPQALKMVTWMVDYFYNRVQNVITKYTVNRHYQSMNEETGGMNDVLYRLYSITGDSKHLVLAHLFDKPCFLGLLAVQANDIADLHANTHIPIVVGSQMRYEITGDPLYKQIGTFFMDLVNSSHSYATGGTSVREFWSDPKRIADNLRTTENEESCTTYNMLKVSRHLFRWTKEVSYADYYERALTNGVLSIQRGTDPGVMIYMLPLGFAVSKARTGHSWGTQFDSFWCCYGT

SEQ ID NO: 214632 - protein, 705 aa, Glycine max
  Coding DNA Sequence Number=SeqID_97854
  Gene Ontology: Mol. function=binding; Cellular component =intracellular; Biological process=metabolic process
  Homolog annotation: Hit_ID=Q1RXQ0; Match level="QueryCoverage=92%, HitCoverage=88%, E-value=1e-128, Identity=30%"; Hit description =Tetratricopeptide-like helical
  Pfam annotation: Domain name=PPR; Domain location=117-151; Score =39.5; E_value=1.1e-08; Accession=PF01535.11; Description=PPR repeat
  Pfam annotation: Domain name=PPR; Domain location=152-186; Score=0.3; E_value=6.9; Accession=PF01535.11; Description=PPR repeat
  Pfam annotation: Domain name=PPR; Domain location=218-252; Score =42.4; E_value=1.5e-09; Accession=PF01535.11; Description=PPR repeat
  Pfam annotation: Domain name=PPR; Domain location=289-323; Score =14.4; E_value=0.15; Accession=PF01535.11; Description=PPR repeat
  Pfam annotation: Domain name=PPR; Domain location=351-385; Score =36.5; E_value=9.5e-08; Accession=PF01535.11; Description=PPR repeat
  Pfam annotation: Domain name=PPR; Domain location=386-420; Score=1.1; E_value=5.5; Accession=PF01535.11; Description=PPR repeat
  Pfam annotation: Domain name=PPR; Domain location=458-492; Score =45.0; E_value=2.5e-10; Accession=PF01535.11; Description=PPR repeat
  Pfam annotation: Domain name=PPR; Domain location=493-527; Score=6.0; E_value=1.5; Accession=PF01535.11; Description=PPR repeat
  Pfam annotation: Domain name=PPR; Domain location=529-563; Score=5.5; E_value=1.6; Accession=PF01535.11; Description=PPR repeat
  Pfam annotation: Domain name=PPR; Domain location=55-89; Score=12.4; E_value=0.25; Accession=PF01535.11; Description=PPR repeat
  Pfam annotation: Domain name=PPR; Domain location=595-629; Score=8.2; E_value=0.81; Accession=PF01535.11; Description=PPR repeat
  Pfam module annotation: Pfam domain module=PPR::PPR::PPR::PPR::PPR::PP R::PPR::PPR::PPR::PPR::PPR; Domain location=117-151::152-186::218 -252::289-323::351-385::386-420::458-492::493-527::529-563::55 -89::595-629
MGRHGFVQKLVGELCFLDSSPFAKLLDSCVRSKSGIDARRIHARIIKTQFSSEIFIQNRLVDAYGKCGYFEDARKVFDRMPQRNTFSYNAVLSVLTKFGKLDEAFNVFKSMPEPDQCSWNAMVSGFAQHDRFEEALRFFVDMHSEDFVLNEYSFGSALSACAGLTDLNMGIQIHALISKSRYLLDVYMGSALVDMYSKCGVVACAQRAFDGMAVRNIVSWNSLITCYEQNGPAGKALEVFVMMMDNGVEPDEITLASVVSACASWSAIREGLQIHARVVKRDKYRNDLVLGNALVDMYAKCRRVNEARLVFDRMPLRNVVSETSMVCGYARAASVKAARLMFSNMMEKNVVSWNALIAGYTQNGENEEAVRLFLLLKRESIWPTHYTFGNLLNACANLADLKLGRQAHTQILKHGFWFQSGEESDIFVGNSLIDMYMKCGMVEDGCLVFERMVERDVVSWNAMIVGYAQNGYGTNALEIFRKMLVSGQKPDHVTMIGVLSACSHAGLVEEGRRYFHSMRTELGLAPMKDHFTCMVDLLGRAGCLDEANDLIQTMPMQPDNVVWGSLLAACKVHGNIELGKYVAEKLMEIDPLNSGPYVLLSNMYAELGRWKDVVRVRKQMRQRGVIKQPGCSWIEIQSRVHVFMVKDKRHPLKKDIHLVLKFLTEQMKWAGYVPEADDDEICEEESDSELVLHFEMETEADTAVA

SEQ ID NO: 214633 - protein, 66 aa, Glycine max
  Coding DNA Sequence Number=SeqID_97855
MFKRFQKAATIAMENKHSEPLEGTVTILAKHNSDTKDSGSRTAGKHAMKPQKAAARLRMMKMLTSL

SEQ ID NO: 214634 - protein, 355 aa, Glycine max
  Coding DNA Sequence Number=SeqID_97856
  Gene Ontology: Mol. function=protein binding; Cellular component =integral to membrane; Biological process=response to DNA damage stimulus
  Homolog annotation: Hit_ID=Q9LT39; Match level="QueryCoverage=92%, HitCoverage=93%, E-value=1e-105, Identity=58%"; Hit description =Polygalacturonase inhibitor-like protein
  Pfam annotation: Domain name=LRRNT_2; Domain location=29-69; Score =35.8; E_value=1.5e-07; Accession=PF08263.3; Description=Leucine rich repeat N-terminal domain
  Pfam annotation: Domain name=LRR_1; Domain location=124-146; Score =12.4; E_value=1.4; Accession=PF00560.23; Description=Leucine Rich Repeat
  Pfam annotation: Domain name=LRR_1; Domain location=148-170; Score =17.2; E_value=0.059; Accession=PF00560.23; Description=Leucine Rich Repeat
  Pfam annotation: Domain name=LRR_1; Domain location=172-194; Score =12.8; E_value=1.1; Accession=PF00560.23; Description=Leucine Rich Repeat
  Pfam annotation: Domain name=LRR_1; Domain location=196-218; Score =4.1; E_value=48; Accession=PF00560.23; Description=Leucine Rich Repeat
  Pfam annotation: Domain name=LRR_1; Domain location=220-242; Score =12.6; E_value=1.2; Accession=PF00560.23; Description=Leucine Rich Repeat
  Pfam annotation: Domain name=LRR_1; Domain location=244-266; Score =6.8; E_value=15; Accession=PF00560.23; Description=Leucine Rich Repeat
  Pfam annotation: Domain name=LRR_1; Domain location=267-286; Score =6.2; E_value=20; Accession=PF00560.23; Description=Leucine Rich Repeat
  Pfam annotation: Domain name=LRR_1; Domain location=291-310; Score =5.5; E_value=26; Accession=PF00560.23; Description=Leucine Rich Repeat
  Pfam annotation: Domain name=LRR_1; Domain location=315-338; Score =2.3; E_value=1.1e+02; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1; Domain location=29 -69::124-146::148-170::172-194::196-218::220-242::244-266::267 -286::291-310::315-338
  Subcellular localization annotation: CTP_CleavageSite=13; ConfidenceScore=5.07e-01
MGGASVNFSMALVVMTLVGLTPLSVTSCPSSEWAALMSFKEALKEPYRGFFHSWRGTNCCYRWHGITCDPTTRRVADITLRGGDMMTGHISPSICNLTQLSSITISDWKGISGNIPPCITKLPLLQILDLSGNLIHGQIPSDIGRLTQLTMLNLADNHISGKIPNSLVHLSNLMQLDLRNNAIQGPIPMDLGRLKKLNRALLSHNLITGRIPRSISEIYGLADLDLSLNRLSGSIPAWLGRMAVLDSLNLKYNNLTGNIPWTVLGSRMSHVDLSRNALSGRIPNSFGEDSYFISLDLSYNNLRGSVPKSMALVNYIGYLDLSHNNCLCGRMPRGVAFNHLQPLKPCSRASGRMHA

SEQ ID NO: 214635 - protein, 127 aa, Glycine max
  Coding DNA Sequence Number=SeqID_97857
MFDFDASLFVPALLWFKEENGGFFVFVTLVLCGCAAGKECTNIPTRSHMLRFAAEEVLDGTTPTRLGSYDFSKKCLFKDVRLHKDSILGGAQQTNLEYLLIWSFRKTVGLSTPGTPYGGWEVVGVQV

SEQ ID NO: 214636 - protein, 203 aa, Glycine max
  Coding DNA Sequence Number=SeqID_97858
  Homolog annotation: Hit_ID=Q84VH5; Match level="QueryCoverage=99%, HitCoverage=27%, E-value=4e-56, Identity=61%"; Hit description =Envelope-like protein
  Subcellular localization annotation: CTP_CleavageSite=21; ConfidenceScore=5.08e-01
MATSPKETSSLGSPSVPSSPSSTKAPSNQEQPEFHIQPIQMIPGQAPVPEKLIPKRQQGVKTSENPSLAASPREVDTEMDKKIRSIVSSILKNASVPEADEDVPTSSTPNVSVLDADKDVPTSSTPNVSVPDADKDVPTSSTPNAEALPSPSEEESTEEEDQATEETPAPRAPEPAPGDLIDLEEVESDEEPIANKLAPGIAE

SEQ ID NO: 214637 - protein, 404 aa, Glycine max
  Coding DNA Sequence Number=SeqID_97859
  Gene Ontology: Mol. function=DNA-directed RNA polymerase activity; Cellular component=nucleus; Biological process=transcription
  Homolog annotation: Hit_ID=UPI00006693AC; Match level="QueryCoverage =80%, HitCoverage=22%, E-value=1e-155, Identity=86%"; Hit description= DNA-directed RNA polymerase beta'''' subunit
  Pfam annotation: Domain name=RNA_pol_Rpb1_1; Domain location=79-401; Score=301.0; E_value=2.2e-87; Accession=PF04997.3; Description=RNA polymerase Rpb1, domain 1
  Pfam annotation: Domain name=RNA_pol_Rpb2_7; Domain location=29-102; Score=103.8; E_value=4.9e-28; Accession=PF04560.10; Description=RNA polymerase Rpb2, domain 7
  Pfam module annotation: Pfam domain module=RNA_pol_Rpb1_1::RNA_pol _Rpb2_7; Domain location=79-401::29-102
MVDDKMHARSIGPYSLITQQPLGGKAQFGGQRFGEMEVWALEAFGASNILREILTVKSDDVIGRAKTYEAIAKGESMPEPASPESILQDSRGEVLKPETINYRTHKPERDGLFCEKIFGPIKDYECACGKYKRIRYKGIVCDRCGVEVTEKKVRRERIGHINLVVPIAHIWYFRSLPNKIGYLLGIPSKKLDMIIYYERYVVIQQGIAKKLDGSDFDKMEFLTEEEYLDIMDTLPVENQYLDDSDPNKFIAKMGAEAVEELLKRIDLDALSFDLRHKAHNEGSKQRRTEALKRLNVVEALRGANTRMINRPEWMIMRVLPVIPPELRPLVPLDGGRFATSDLNDLYRRVIIRNNRLKRLLEIKAPEVILRNEKRMLQESVDSLFDNTRKSSAVNLIKQTIKITF

SEQ ID NO: 214638 - protein, 133 aa, Glycine max
  Coding DNA Sequence Number=SeqID_97860
  Homolog annotation: Hit_ID=Q1SN45; Match level="QueryCoverage=43%, HitCoverage=3%, E-value=1e-10, Identity=44%"; Hit description=AAA ATPase
MDNHEHANHRDTAQARIKNKGIRQHKVNDQAQNIDFNIRDSSEDDSSKSTQVSSPENQNYMSSANEPAINREGYFDLGDQLMQCSHCNANMWYDERVSKDKRTTNPRFSLCCGNGKVELPLLQNPPKFLYQLL

SEQ ID NO: 214639 - protein, 96 aa, Glycine max
  Coding DNA Sequence Number=SeqID_97861
  Gene Ontology: Mol. function=protein binding; Biological process =response to DNA damage stimulus
  Homolog annotation: Hit_ID=Q9LT39; Match level="QueryCoverage=74%, HitCoverage=19%, E-value=7e-19, Identity=59%"; Hit description =Polygalacturonase inhibitor-like protein
  Pfam annotation: Domain name=LRRNT_2; Domain location=26-66; Score =49.6; E_value=1.1e-11; Accession=PF08263.3; Description=Leucine rich repeat N-terminal domain
  Subcellular localization annotation: CTP_CleavageSite=18; ConfidenceScore=5.36e-01
MARVWLTAPLTALLLFAFSSAVSSCPPSDLAALLAFKSAVRESNGGIFNSWTGTDCCRNWYGVSCDRNSRRVAEISLRAGPVYSTFEKPFRPGYMS

SEQ ID NO: 214640 - protein, 99 aa, Glycine max
  Coding DNA Sequence Number=SeqID_97862
  Gene Ontology: Mol. function=nucleic acid binding; Biological process= apoptosis
MPTCMTLQLADRSITRPYGVVEDVLVKVKHLIFLADFVVIDIEEDADIPLILGCPFMSTASCMEDKDQPSQNVCFKVHVMEEKRPEKKVLEVETLLDLG

SEQ ID NO: 214641 - protein, 110 aa, Glycine max
  Coding DNA Sequence Number=SeqID_97863
MATTSVFGCATAHRCRRCMPLASRSAALIIGIQIYHPTVREAGAVEHAGAKDTIGNGGKCIKEHYERELGGAECRRVPPHPYISDNRIPYPLSLWSKQIRIHDLIKFTSK

SEQ ID NO: 214642 - protein, 69 aa, Glycine max
  Coding DNA Sequence Number=SeqID_97864
MEILMRPYLFLKFLNFIQESCSDTTCWTLLMQSYPVRALARRLQVDWARDPRKGPRVLMSLRVDFEPMG

SEQ ID NO: 214643 - protein, 178 aa, Glycine max
  Coding DNA Sequence Number=SeqID_97865
  Homolog annotation: Hit_ID=Q2QNL3; Match level="QueryCoverage=77%, HitCoverage=18%, E-value=4e-08, Identity=27%"; Hit description=Zinc knuckle family protein
  Pfam annotation: Domain name=zf-CCHC; Domain location=131-148; Score =31.2; E_value=3.7e-06; Accession=PF00098.13; Description=Zinc knuckle
MYASIAGGFTNKSLGEKLFLKLPGKLGQKIRNSWDDDQIDLVMNNLTVIIQHIMKVMEDTLICKQIYTPQQYHKEIRRKRPQYKPPNKQPSRKKNPTCRYSIRASNSRKPTLNKERYVRKLRDNKTYTKQLECYACHQPGHYSKDCPSKTNLLTREAKLIKSCRMNLILIYETMSIDS

SEQ ID NO: 214644 - protein, 406 aa, Glycine max
  Coding DNA Sequence Number=SeqID_97866
  Gene Ontology: Mol. function=RNA-directed DNA polymerase activity; Biological process=RNA-dependent DNA replication
MTYSAPLIHTIQQEVEPIFQAENVVAFDKMEELQERFDGMQREVEALRGRDLFGKDACELCLVPNVTIPHKFKVPDFEKYKGNSCPRSHLVMYARKMSMYTDNHKLLIHFFQDSLTGAALKWYMNLDSASIRTFNDLGEAFIRQYKYNLDMAPDRDQLRAMTQKEKQTFKEYAQRWREVAAQIIPPLEEREMTKIFLKTLSQFYYEKMVASAPTDFTEMVNMGVRLEEGVREGRLTGESTPAASNAKKFGGHFAKKKDQEVGMVAHGKPQQNFTPYRQVANVASTIPNPSYHQQRPHYPYQYPPQQYPPQQYPPQQYHPQQYPPQQYHQPQYPQKQQNRPQTPQQPYHSQNRQKTTFDPIPMKYVDLLPALLAKNLVQVRTPPRTPDVLPPWFRHDLTCAFHQGAP

SEQ ID NO: 214645 - protein, 52 aa, Glycine max
  Coding DNA Sequence Number=SeqID_97867
MDKHCFKINTRLLQQTKPCFKINSRSSLALKQSVSKTSKATMFVIDYQQQNS

SEQ ID NO: 214646 - protein, 50 aa, Glycine max
  Coding DNA Sequence Number=SeqID_97868
MFVLNNALKGIDDTPQSKTKAVLLGGLLLNVIDKKEELSAGITSCTGCQL

SEQ ID NO: 214647 - protein, 151 aa, Glycine max
  Coding DNA Sequence Number=SeqID_97869
  Gene Ontology: Mol. function=unspecific monooxygenase activity
  Homolog annotation: Hit_ID=O04892; Match level="QueryCoverage=53%, HitCoverage=15%, E-value=2e-20, Identity=64%"; Hit description =Cytochrome P450 like_TBP
MSRRARRSLQNPGREPGRNGRRCRSWCLPTLETAQPEVGSSGWKSTARRVVSGAPPAALENPEDRVPPTPGKGSRQNGSVTSGKGLALRAGHGGPSPEPVGCRWTARAASAARAGRRVPVGGRIGNGPFGASSPGVEQSTQNWYGQGNPTV

SEQ ID NO: 214648 - protein, 358 aa, Glycine max
  Coding DNA Sequence Number=SeqID_97870
  Gene Ontology: Mol. function=endonuclease activity; Cellular component=extrachromosomal circular DNA; Biological process =polysaccharide catabolic process
  Homolog annotation: Hit_ID=Q1IZR2; Match level="QueryCoverage=80%, HitCoverage=23%, E-value=1e-60, Identity=45%"; Hit description =Endonuclease/exonuclease/phosphatase precursor
  Pfam annotation: Domain name=Exo_endo_phos; Domain location=2-253; Score=39.8; E_value=9e-09; Accession=PF03372.13; Description =EndonucleaseExonucleasephosphatase family
  Pfam annotation: Domain name=HemolysinCabind; Domain location=260 -277; Score=18.2; E_value=0.029; Accession=PF00353.9; Description =Hemolysin-type calcium-binding repeat
  Pfam annotation: Domain name=HemolysinCabind; Domain location=278 -295; Score=22.2; E_value=0.0018; Accession=PF00353.9; Description =Hemolysin-type calcium-binding repeat
  Pfam module annotation: Pfam domain module=Exo_endo_phos::HemolysinCab ind::HemolysinCabind; Domain location=2-253::260-277::278-295
MNADVVGLMEIQNNGATAAQNLVDGLNAALGTHTYAVIADPVTGTGTDAIKVAMIYKPAKLTPAAAALSDNDSINNRPTLAQTFVAANGEKFSVLVNHFKSKSCSDSAGANQDQGDGQGCYNPQRIAQANRLLQFINTVQTQSGDSDVVVIGDLNAYGKEDPILALTAGGLQDQVARFNGDTDYSYVFDGESGYIDHALASNSMAAQITGTLHWHINADEPFVIDYNTEFKPQDLYTDSPYRSSDHDPVIVGVQLVKAITGSSQRDTLVGTAGDDVITGGVGADTITGGAGRDTFVYQSMRDATDTITDFTPGEDQLDIAELLQSIGYTSSQPFADGVARWVNVAGGVQLPIDTDGTG

SEQ ID NO: 214649 - protein, 70 aa, Glycine max
  Coding DNA Sequence Number=SeqID_97871
  Subcellular localization annotation: CTP_CleavageSite=53; ConfidenceScore=5.03e-01
MFIRITTRVFPPVSVTQMLFVLQTAKKNVYTDNHSGISARQRDSNVSMTDLVSAEDDVNLRVSTGLVGRD

SEQ ID NO: 214650 - protein, 114 aa, Glycine max
  Coding DNA Sequence Number=SeqID_97872
  Homolog annotation: Hit_ID=Q8TGM5; Match level="QueryCoverage=31%, HitCoverage=53%, E-value=6e-07, Identity=75%"; Hit description =Uncharacterized protein ART3
  Subcellular localization annotation: CTP_CleavageSite=40; ConfidenceScore=5.37e-01
MGPELTGSHVIGLERGSSTILSRRSRAMNPRFQPTTRRVLAGGRRALGLMASGATCVQRLDGSRDSAIHTKYRISLRSSSMQEPRYPLPRVIVCKCCVVTTPAGHRLRAPGSRT

SEQ ID NO: 214651 - protein, 132 aa, Glycine max
  Coding DNA Sequence Number=SeqID_97873
  Gene Ontology: Mol. function=oxidoreductase activity, acting on single donors with incorporation of molecular oxygen, incorporation of two atoms of oxygen
  Homolog annotation: Hit_ID=UPI0000527367; Match level="QueryCoverage =95%, HitCoverage=33%, E-value=4e-32, Identity=47%"; Hit description =Cupin 2, conserved barrel domain protein
MKEKAALYSKLKEQNLVPLWLVEQDVLPLRPNPAAIPWLWKWDQLYELAATSGKLVNLEEGGDRRALGLSNPGLNGKPYATETLWMALQWLNGKEIAPPHRHISQASRFIIRSEGSYSTVEGNRIFLERGDY

SEQ ID NO: 214652 - protein, 233 aa, Glycine max
  Coding DNA Sequence Number=SeqID_97874
  Gene Ontology: Mol. function=chitin binding; Cellular component =extracellular region; Biological process=chitin metabolic process
  Homolog annotation: Hit_ID=UPI00006A17C9; Match level="QueryCoverage =96%, HitCoverage=100%, E-value=6e-37, Identity=36%"; Hit description= UPI00006A17C9 related cluster
PSPWVQLPSPLRGLHVLALRGLHVLTTRGLHALTSRGLHVLALRGLHVLTIRGLHALTSRGLHVLALRGLHALTLVRGLHVLAIRGLHALTFRGLHVLALRGLHALTLGLHALTLRGLHVLTIRGLHALTSRGLHVLALRGLHALTIRGLHALTSRGLHVLALRGLHALTLGLHVLTTRGLHALTSRGLHVLALRGLHVLTIRRLHALTSRGLHVLALRGLHALTLGTSYPHR

SEQ ID NO: 214653 - protein, 414 aa, Glycine max
  Coding DNA Sequence Number=SeqID_97875
  Gene Ontology: Mol. function=nucleoside-triphosphatase activity; Cellular component=integral to membrane; Biological process=response to antibiotic
  Homolog annotation: Hit_ID=UPI00005F8167; Match level="QueryCoverage =58%, HitCoverage=40%, E-value=1e-56, Identity=49%"; Hit description =COG0577: ABC-type antimicrobial peptide transport system, permease component
  Pfam annotation: Domain name=ABC_tran; Domain location=189-348; Score= 104.3; E_value=3.6e-28; Accession=PF00005.17; Description=ABC transporter
MADVDTMMVHTRISENDILQVKTGQPLWFYVAADPRRRYEGAMGAIQQAPAEALETDPLGRNSSQQTAAVYYNGVFAVANGERRLRTSMTAQVFIMTERAQGVVRVPMAALGAALDEGSYQVKVLEGGQTVVRRVRIGTRDRRYAEVLEGLNAGEQVLLEQQPDVEEGADAGEQKIAVLKRVSLSIQRGEMVAIVGASGSGKSTLMNIIGCLDKPSQGDVHINGVAIGQADADRLAQLRSRHIGFIFQRYHLMPYLTAGENVAIPALYTAMPAAERRLRAAHLLARLGLAQRGGHRPAQLSGALDSASGQALMTILHELNAIGHTVVIVTHDRRIAEQARRIIEIGDGEIVADRRHEASRHLSTFERPLAAPLKRMAPGAALKEAVGMAWRAIAGAPGPGIAIDARHHYRHCGG

SEQ ID NO: 214654 - protein, 299 aa, Glycine max
  Coding DNA Sequence Number=SeqID_97876
  Gene Ontology: Mol. function=transporter activity; Cellular component= membrane; Biological process=transport
  Homolog annotation: Hit_ID=UPI00005F8C10; Match level="QueryCoverage =96%, HitCoverage=65%, E-value=6e-73, Identity=51%"; Hit description =COG1538: Outer membrane protein
  Pfam annotation: Domain name=OEP; Domain location=108-288; Score =66.4; E_value=8.9e-17; Accession=PF02321.8; Description=Outer membrane efflux protein
MAGRRLGVGSAQYRVDLDRCYRARALAIARETLRLVAARHTAGDVGRFELLQAEQSLLARENQLHELERQREDARNSLALLFGRSPLLRYSERRSLPLDEVAVAQRQPAWVIARRPDVQAAERRLRAALAGAEAARLSFYPALSLEAGLDAGSGLFRQWFSEPSRSLGATLTLPFIEWRKMRLSSDKAALQAQRAEIQFRDAVYRALADVDNAMRQRLEAQRQIGNQRWHLAMSRQAVALARHQYQAGSVALQTLLDAQEAVLASENSLSALQFRYLNATMQLWLALGGNEAFASGQGE

SEQ ID NO: 214655 - protein, 292 aa, Glycine max
  Coding DNA Sequence Number=SeqID_97877
  Gene Ontology: Mol. function=hydrolase activity, acting on carbon -nitrogen (but not peptide) bonds; Biological process=carbohydrate metabolic process
  Homolog annotation: Hit_ID=Q11M30; Match level="QueryCoverage=98%, HitCoverage=89%, E-value=9e-88, Identity=55%"; Hit description =Polysaccharide deacetylase
  Pfam annotation: Domain name=Polysacc_deac_1; Domain location=59-246; Score=48.0; E_value=3.2e-11; Accession=PF01522.11; Description =Polysaccharide deacetylase
PRVIFTLHHVRPGGAVSAFAPNVQLSVTPEFLEEAVQAALESGLVPVHLHDLPALLAGSGEDRSFCAFTLDDGYRNNADYAAPIFRKYNVPYTIFITPGFVERTRGLWWETAAALTQKAASFDFDFGAGPEHVTCGTPLQKADAFARLENFVQSAAEDEAVERIDRAARQCGIDPVAIVDELIMDAAELRALSEDPLVHLGAHTMTHVNMRKIDAERLAYEIAESKRRAVGEREAKAVSDAGFSAAVTTQAGVLGLGSLEKPTLLPRVSLNGRFQKKRFVKALISGLPFRFV

SEQ ID NO: 214656 - protein, 46 aa, Glycine max
  Coding DNA Sequence Number=SeqID_97878
MKFHCHQASQRLSMTTDSPPLPMFPWTRFFGVDKSGALTPTYPQLR

SEQ ID NO: 214657 - protein, 142 aa, Glycine max
  Coding DNA Sequence Number=SeqID_97879
MPHSHRIEKERKPQVANINLSYFHGKENVEAYLDWEIKVEQQIKRKSTSKCYGLHSFPKKDQGQGILGAAPSKPKHDKGKTIEKQLHKAKETLLLNAPTKKTMIMRSHDIYSSQYEATTSPSSSESEAAKGEESTLKKKDNL

SEQ ID NO: 214658 - protein, 526 aa, Glycine max
  Coding DNA Sequence Number=SeqID_97880
  Gene Ontology: Cellular component=integral to membrane
  Homolog annotation: Hit_ID=UPI00005F8B44; Match level="QueryCoverage =53%, HitCoverage=96%, E-value=1e-123, Identity=83%"; Hit description= COG0861: Membrane protein TerC, possibly involved in tellurium resistance
QLGVAPQRAETGFRQRGSHQAEDAERRTADHRAHHQRDRMGHVVDQPLGGFGSVAQRQPQPDGPRQNTDVVGVNQRMERVGHHAHQQALHHLHNAARRGNVRRAGAQRQRGREDKADDDRHQRRGEGAQQAITSTSTSTGATAFSAPTNREPSRPTAEAAAGETSANRMPATRPTMICLTRLPCAIVATVDPGVNQQGERQDARHHAQRYADRDVEEVDNQHLDADKHQDHRQAVFQHRETLRHVGQQEVHGAQAHDGEQVGGQDDERVSGHGEDRRNAVHREDHVAQLYQDQHQHQRGGEQDAVAAHEEALAFQVVGHAQVAAQPFHQRLVADRRVIFLRQRHFDTGEQQEGAEQVQQPLELADQPAAGEDHDGTQDDRAQHAVDQHPPLQVGRHGEVAEQHQPDEHKPKLNSRERLTHTSDQLAACFRVMVCTPLRPCNRRSIASITTMTAAKLPHNHGVPTEFIIRGILQKQKRPTSEDASRSVNAASNLAFRQGLTYNVDEGGYTFDIRLPGNRMLAHRNDD

SEQ ID NO: 214659 - protein, 49 aa, Glycine max
  Coding DNA Sequence Number=SeqID_97881
  Homolog annotation: Hit_ID=Q9M5M5; Match level="QueryCoverage=64%, HitCoverage=10%, E-value=6e-08, Identity=90%"; Hit description=60S acidic ribosomal protein PO
MLGRVIKIVTGVHYVWWVGALAHVGLVAPIDVVVPLGNTGLDPSQTSFF

SEQ ID NO: 214660 - protein, 83 aa, Glycine max
  Coding DNA Sequence Number=SeqID_97882
MDNSVIGGGVITTALLKEEQSPPHHCQRRGLVVRFGHKGCSSPTRFGLRSKLNVVKPDLEVRSPTLMSPKRMSLALNISVWFY

SEQ ID NO: 214661 - protein, 175 aa, Glycine max
  Coding DNA Sequence Number=SeqID_97883
MWNATLFGLFNENFPLYIKHEDLSEIAHGVQCLSISVIQLWILHMTETSMRAGNIDVYGFLEPQSIQRSGQSQFESENYIKNWMQNSKWDVYLGAYLNGAHWQMVVILPKENVVIWFCSLHNKPDNYLKDIINRSVLFFNTFALALVSALKGLDDTQQSKSKPPARWIVVKYCVN

SEQ ID NO: 214662 - protein, 83 aa, Glycine max
  Coding DNA Sequence Number=SeqID_97884
THLLLEVASPFIFLLLHSAAIRPQEAKESIDEEDPRPTSFTWSYIRHSLKDACNNMAFVSLIEPKNINEAIIDEHWIISIKKN

SEQ ID NO: 214663 - protein, 178 aa, Glycine max
  Coding DNA Sequence Number=SeqID_97885
  Gene Ontology: Mol. function=dihydrodipicolinate synthase activity; Cellular component=cytoplasm; Biological process=diaminopimelate biosynthetic process
  Homolog annotation: Hit_ID=Q9PER5; Match level="QueryCoverage=67%, HitCoverage=39%, E-value=3e-42, Identity=73%"; Hit description =Dihydrodipicolinate synthase
HDRQPTLVGHRPLVRDQAGLGRPHVRRGDHQRVAGAERGGTTGLFDGLAGARKAGSGHDRDATADALDRAGQQQLVLGIGEGCRFTGRAGYDNAMDATFQLQVQQALPTVGIEGAVGPERGRQRGDEAGKGQGRAALGWEGKTPAMKGRGRLECYLRRESTGKYAGHRWIPASGGHSD

SEQ ID NO: 214664 - protein, 333 aa, Glycine max
  Coding DNA Sequence Number=SeqID_97886
  Gene Ontology: Mol. function=amino acid binding; Biological process =metabolic process
  Homolog annotation: Hit_ID=Q4UTS9; Match level="QueryCoverage=54%, HitCoverage=87%, E-value=2e-91, Identity=93%"; Hit description =Glycine cleavage system transcriptional repressor
MRLSGEIRKVLRSMPRTCLPYMFFILITSKCAAQRFVAIADQRKVEALLGTEVVVRLHRVARDTEYHRACLPELRQQRVEVDAFGGAAGGAVLGIEVQHQPVAGVVAESGLFATGQRQRQGEGGAVQGIAVVHEVLLSSLGSFYDNCMKRHAPVQVVAELEEIVAQRGDVHVGRHADGDLRAEHFRTGLHGAVARALQVLDGDALAVEEIGQLEQDARLVGGDHLDDVRQQVGLRLLGGGAVPDQLQAFLALEPGQHRFQLGHRVPRAGGQSGDRDIADDRGQACVHHIAAAVGDAAGDGQQGGLRMRRIGVDQEVVFARRGARGGVGQGDSG

SEQ ID NO: 214665 - protein, 68 aa, Glycine max
  Coding DNA Sequence Number=SeqID_97887
MKRGELSNWGALRNLPQEAPGRQAPPFFLINRRGGLFQNVPNPVENPSRGASVTLPRRFREQFHEDFP

SEQ ID NO: 214666 - protein, 50 aa, Glycine max
  Coding DNA Sequence Number=SeqID_97888
MTLVFMVMLIENDVVIDDNIDMRLLTKLDIPGGGNKVVKEFNHLWSEGTA

SEQ ID NO: 214667 - protein, 73 aa, Glycine max
  Coding DNA Sequence Number=SeqID_97889
MMASKKRKRTASRPQAQYDTRRFQSLEAWNRYIDNILDWRILLERNAKIYHTEFDEFKTELERRNLHKRLANL

SEQ ID NO: 214668 - protein, 55 aa, Glycine max
  Coding DNA Sequence Number=SeqID_97890
  Subcellular localization annotation: CTP_CleavageSite=26; ConfidenceScore=5.25e-01
MSFSSNRTSSFTSLKGSKRPKSRLIRQALKSVVFHLLAKPICWLSERPLSITLMG

SEQ ID NO: 214669 - protein, 46 aa, Glycine max
  Coding DNA Sequence Number=SeqID_97891
MEDAPVNPRIAVPLKGHSHIEPVEDPILAEEQRRVILEDYSSSTVP

SEQ ID NO: 214670 - protein, 329 aa, Glycine max
  Coding DNA Sequence Number=SeqID_97892
  Gene Ontology: Mol. function=DNA-directed RNA polymerase activity; Cellular component=intracellular; Biological process=transcription
  Homolog annotation: Hit_ID=Q26FU5; Match level="QueryCoverage=98%, HitCoverage=26%, E-value=1e-128, Identity=71%"; Hit description=RNA polymerase beta subunit rpoB
  Pfam annotation: Domain name=RNA_pol_Rpb2_6; Domain location=1-326; Score=38.9; E_value=5.9e-16; Accession=PF00562.18; Description=RNA polymerase Rpb2, domain 6
MVMLLEEGELALGRNLVVAFMPWKGYNFEDAIVINEKVVREDWFTSIHVDEYSLEVRDTKLGMEELTADIPNVSEEATKDLDENGMIRIGAEVKPGDIMIGKITPKGESDPTPEEKLLRAIFGDKAGDVKDASLKADSSLRGVVINKKLFSRNIKDKKKRTEEKLKLEEIENTYKAKFDELRNTLIEKLNTLVSGKTSQGVHNDLDEEIIGKGVKFTHKLLTSVEDYVNVSGADWTVDNDKNELIKQLIHNYKIKFNDIQGVKNREKFAISIGDELPAGDKMAGRHGNKGIVSRIVREEDMPFLEDGTPVDIVLNPLGGTFPYEHRTDL

SEQ ID NO: 214671 - protein, 169 aa, Glycine max
  Coding DNA Sequence Number=SeqID_97893
MISQWNNRAEFRVEVYPRQEGLLSFNSDYMGEVPETLQYMVSPQGRNTWTVDDLVPYVEKITILSEKQERITEHTKGGHDTDMSTSEHSFGGVVETHPHFSWPTMTPSQQHDAPMATPSAPLAPQWNVPGAIPDMGDLLGVDLRHEFCAEAEQEGQRQRARRNPDRQAR

SEQ ID NO: 214672 - protein, 139 aa, Glycine max
  Coding DNA Sequence Number=SeqID_97894
SHTGDGGVYARIVDVENLLCTIARPPPSTTCDGVVPGDMSRGSGDLGDVRRAPGSQQIKGTKTTKQGGLWLKNEDRRLRWSLVIDYHGVLKKGNWEMVEASGNRLPACVIDYTEEWVTGNRLPGMCKSITQCIFAYFMF

SEQ ID NO: 214673 - protein, 61 aa, Glycine max
  Coding DNA Sequence Number=SeqID_97895
MLSQSIATTWAATGKLCTRWRNSCQDHFRITSEAIQSLLDLRARLEDTSHYQLIKQALQLL

SEQ ID NO: 214674 - protein, 195 aa, Glycine max
  Coding DNA Sequence Number=SeqID_97896
MDKALLKSGMTSEACESPELTENALSWKTNCYKGKKLLIEDDEDAPPTKYVKARLCPFFKHEHEALKQKTELTNLDWYVMKRFYTLKEHYSSLERIEKPHADAIHHENGEFYDVSDRTFLFMVFLPFSKFFFMQHVDPIIKKVESDVEVATASNSMVFQDRAHAKKQGHKWFMTWDYFYKKIIGWKPPHPPMAPQ

SEQ ID NO: 214675 - protein, 76 aa, Glycine max
  Coding DNA Sequence Number=SeqID_97897
MEIEGSDMWVHLLGSSDSEGGIMMLAVVQGLNSSSCEEREERKGVEKGKKKKLITRIHLRRRCTVVCHSYLTRYIA

SEQ ID NO: 214676 - protein, 72 aa, Glycine max
  Coding DNA Sequence Number=SeqID_97898
MHETQCGPLRVHRMNRKAWFEQNRGGGCRPARPGELSSPRRARLLPPEATAFWRNILEGPSGPGCYMHPHFY

SEQ ID NO: 214677 - protein, 412 aa, Glycine max
  Coding DNA Sequence Number=SeqID_97899
  Gene Ontology: Cellular component=cellulose and pectin-containing cell wall
  Homolog annotation: Hit_ID=Q41695; Match level="QueryCoverage=99%, HitCoverage=100%, E-value=1e-123, Identity=50%"; Hit description =Pectinacetylesterase precursor
  Pfam annotation: Domain name=PAE; Domain location=11-389; Score =594.3; E_value=1.1e-175; Accession=PF03283.4; Description =Pectinacetylesterase
MESARISQWLNLLVCVLLLLKAEGSLVPLILVENAESKGAVCLDGSPPAYHFDKGFGEGINSWIVHIEGGGWCNNIESCLDRKDTRLGSSKQMEDIYFSGILSNEQQFNPDFYNWNRVKVRYCDGSSFTGDVEEVDPAILSGCSAGGLTTILHCDSFKTFLPSRANVKCVPDAGYFVNVEDISGAHFIQQYYSEVVSTHGSAKNLPTSCTSKLSPTLLCNFFGVTDASELLCSAFFHNMWHHISVPQSSLLIQPMTRGRNYEKVWERFIVRSLTCAYAMRLFPDSKIRYIFVPGSADPSDSWNSCKVNMSNCSPDQLSKLQGFKSEFERALSEVGDSPSKGMFIDSCYAHCQTEPQETWFKTDSPKLANTTIAKAVADWFYGRSSFRHVDCNYPCNPSCQNRVFDLKDLPGI

SEQ ID NO: 214678 - protein, 142 aa, Glycine max
  Coding DNA Sequence Number=SeqID_97900
  Pfam annotation: Domain name=zf-CCHC; Domain location=70-87; Score =31.1; E_value=3.8e-06; Accession=PF00098.13; Description=Zinc knuckle
MELQCLNQNEETDKKKRSIALKASSSIQEENEEDFSLFVKKFQKFVKKRRIEKRQNFNNGRRSQEDSQILRCYKCNQLGHIKANCPSNEEWPEKSDKKRYEERRTKKAYIAWDDNDSSNGSEKEINLLTKNYESNENISQED

SEQ ID NO: 214679 - protein, 72 aa, Glycine max
  Coding DNA Sequence Number=SeqID_97901
MEMTNVDEDFIMVVSFDNRSESDLDVDCVDTKLPLEPYEGMNFSSIEDAMKYCTRVHSFFEYIGRKLKCKNN

SEQ ID NO: 214680 - protein, 82 aa, Glycine max
  Coding DNA Sequence Number=SeqID_97902
MSAVPTDSPADSPAVPAAEPLIAGDEAMIDANAQDTSAEADAHDTGANSAVDEAEGFLGGPRNPSVLTGYADHVATSVWSGE

SEQ ID NO: 214681 - protein, 281 aa, Glycine max
  Coding DNA Sequence Number=SeqID_97903
  Gene Ontology: Mol. function=transcription regulator activity; Cellular component=nucleus; Biological process=regulation of transcription, DNA-dependent
  Homolog annotation: Hit_ID=Q9CAA4; Match level="QueryCoverage=97%, HitCoverage=76%, E-value=2e-67, Identity=51%"; Hit description =Putative transcription factor BIM2
  Pfam annotation: Domain name=HLH; Domain location=45-115; Score=26.7; E_value=8.4e-05; Accession=PF00010.16; Description=Helix-loop-helix DNA-binding domain
MRAGKGSQEEDEYEEEEFGSSKKQGTSSAPNTNKDGKAIDKASAIRSKHSVTEQRRRSKINERELEILVHSVGVLMIGNPFSRFQILRDLIPHSDQKRDTASFLLEVIEYVQYLQEKVQKYEGSYQGWGQEPSKLMPWRNSHWRVQSFAGQPTAVKNGLGPVSPFPGKFDESNVSISPTMLNGSQNTIDPDQSRDIVNKTAERQPDLVSKGIPLPLAMHANMSVPVRSDGVLAHPLQGTVSNAQSTECPTTSEPQNQQDELSVEGGTISISSAYSQGWVIA

SEQ ID NO: 214682 - protein, 53 aa, Glycine max
  Coding DNA Sequence Number=SeqID_97904
MLVNLATPKFWEAFLIFGNLALTELNITGNAVADENFRCYRASIDYAYANRSG

SEQ ID NO: 214683 - protein, 383 aa, Glycine max
  Coding DNA Sequence Number=SeqID_97905
  Gene Ontology: Mol. function=nucleotide binding
  Homolog annotation: Hit_ID=Q93ZR8; Match level="QueryCoverage=98%, HitCoverage=73%, E-value=1e-155, Identity=67%"; Hit description =Putative auxin-independent growth promoter
  Pfam annotation: Domain name=DUF246; Domain location=1-338; Score =652.8; E_value=2.8e-193; Accession=PF03138.5; Description=Plant protein family
MRAGICDMVTIARYLNVTLIVPELDNTSFWNDHSQFKDIFDVDYFINSMRDEVRILKEFPPQQKKVETESIYSMPPISWSNMTYYYDVILPRIKSYGIVHFTKSDARLANNGIPEEVQRLRCRVNYHALRFVPPIEQLAKKIVKILKERGPFLSLHLRYEMDMIAFTGCNEGCNKEEIDQLTKMRYAYPWWKEKEIDSEKKRKDGSCPLTPEETALTLRALDIDRNIQVYIAAGDIYKPEKRMASLREAFPNLVKKETLLEPSELDPFRNHSNQMAALDYYVSIESDIFVPSYKGNMAKLVEGHRRYLGFKKTILLNRKILVKLIDQYKNGTINWNQFSTSVKVAHSDRVGNPSTRSVVPGKPKEEDYFYSNPQECLSPVDGP

SEQ ID NO: 214684 - protein, 488 aa, Glycine max
  Coding DNA Sequence Number=SeqID_97906
  Gene Ontology: Mol. function=serine-type peptidase activity; Cellular component=lysosome; Biological process=proteolysis
  Homolog annotation: Hit_ID=Q8LFB7; Match level="QueryCoverage=91%, HitCoverage=88%, E-value=1e-135, Identity=51%"; Hit description =Prolylcarboxypeptidase-like protein
  Pfam annotation: Domain name=Peptidase_S28; Domain location=30-446; Score=150.8; E_value=3.6e-42; Accession=PF05577.2; Description =Serine carboxypeptidase S28
MSPIPEWETSLHDHPVATDAEEVKTFYFKQVLDHFNYRPESYTTFQQRYLVNFKYWGGANSSAPIFAYFGAESPIDNSPNGIGFLTDNAASFNALLVYIEHRYYGKSVPFGSREEALKNASTIGYFNSAQALADYAAILEHIKKTLHAQNSPVIVIGGSYGGMLASWFRLKYPHLTVGALASAAPILYFDKITPQNGYYSVVTRDYRDASETCYETILKSWSEIHRVASQPNGLVTLSHRFNTCHTVNQSYELIDYLRSTYVYAAQYNQPPRYPVSEICGGIDGASLGSDILSKIYAGVVALWGNNTCKVNGPTNVSETSVGWRWQARNCIYKTCSEMAIPISIGNNTMFEQPIPFNLTRYAEGCKKQYGVSPRPHWVTTYYGGHNIKLVLRRFGSNIIFSNGLRDPYSIGGVLDYTSDSIVAVNTVNGMPPRKISLPGSSAGKMVGGTTKKEIRIIKSWITQYYAADLDALKDKPKIPEQMIGEKAS

SEQ ID NO: 214685 - protein, 304 aa, Glycine max
  Coding DNA Sequence Number=SeqID_97907
  Homolog annotation: Hit_ID=Q67YP2; Match level="QueryCoverage=68%, HitCoverage=67%, E-value=2e-40, Identity=44%"; Hit description=MRNA, complete cds, clone: RAFL24-17-M19
  Pfam annotation: Domain name=BSD; Domain location=146-212; Score =59.5; E_value=1.1e-14; Accession=PF03909.7; Description=BSD domain
MEDLWKRAKTFAEEAAKKSQSLTPSSSRIADLVSETAKKSKELAAEASKKADILKSAALRQADQIKSFSDTIAIPPQFAAIASAATTAATAATATAPPSATPQELEKFGVTDDLRSFVKGLTSTTFQNFPLSSVSSVGNVDESEVSDVTTVGSNVRKDLNEFQEKHATLVLTTVKEISRLRYELCPRAMKERHFWKIYFTLVNTHVAPYVLTKHDVAPYQAPLLLLSSELQGLCTMALGYNSVKPDVPPYQAPLPLLSEQLGALHHLDIESKIYSTSTHPVAHSLLYPSSLINVSALLTKQIDL

SEQ ID NO: 214686 - protein, 355 aa, Glycine max
  Coding DNA Sequence Number=SeqID_97908
  Gene Ontology: Mol. function=protein serine/threonine kinase activity; Cellular component=integral to membrane; Biological process=protein amino acid phosphorylation
  Homolog annotation: Hit_ID=O82432; Match level="QueryCoverage=62%, HitCoverage=31%, E-value=2e-36, Identity=37%"; Hit description =Leucine-rich receptor-like protein kinase
MSECAVISASRAHETYVLVLKVKAPLPPPPSRSSAAPSQRAPIDLVTVLDVGGNMIGRKFHMLKRVMRLVISSLGIADRLSIRVAHRIVDRLVIGQGSSEGDALRKATRVFEDRKERNPVASVMLLSNGQEEKHPQLFQFAMLTETPWNSTEEPVVENVGQVCNTRQQLASEVILIEVKTLERQTTQLIKNGPTQMVHGNINKPQRSEVGHFLGEASERTRDGTVEVVDGEVQDEVPEGVQDGAHKVAEGVRDEGREKRVEGEVKRFESSDVEEGRKNDVVEEVEDEGEFSKVREGGEKGRNGAKEVVAGGEKGCKERFREREGLVDGVVEEDDGSQAGEVVEKGGGEWAHHVEV

SEQ ID NO: 214687 - protein, 742 aa, Glycine max
  Coding DNA Sequence Number=SeqID_97909
  Gene Ontology: Mol. function=serine-type endopeptidase activity; Cellular component=periplasmic space; Biological process=proteolysis
  Homolog annotation: Hit_ID=Q9CAA3; Match level="QueryCoverage=77%, HitCoverage=77%, E-value=1e-170, Identity=48%"; Hit description =Putative protease
  Pfam annotation: Domain name=Peptidase_S9; Domain location=539-738; Score=11.9; E_value=2.7e-08; Accession=PF00326.11; Description =Prolyl oligopeptidase family
  Pfam annotation: Domain name=Peptidase_S9_N; Domain location=50-441; Score=116.2; E_value=9.5e-32; Accession=PF02897.5; Description =Prolyl oligopeptidase, N-terminal beta-propeller domain
  Pfam module annotation: Pfam domain module=Peptidase_S9::Peptidase_S9_ N; Domain location=539-738::50-441
  Subcellular localization annotation: CTP_CleavageSite=60; ConfidenceScore=5.76e-01
MALFRALAHSKNTTLTLTRSCRTIITFTPSSSFSSACRRRNPSPAPPQAPPSPKKVPFTVSVHGKKWQDPYHWMSNTDDPNLLDHLNRENSYADAFMADTVELRSVLSSEMKARLPPTVLTPPERWGPWLYYQYIPEGKEYPVLCRRLETKRTGWMKNVFLHYGMTRSKREEILLDWNELAEKYGYVNVGTCRVSPDHNYLAYTLDISGGERFTLQIKDLRSGLIDPKLEVYGAVSLAWAQDASYLFYTLSDENQRPYRQNLTIGFSFCHFSGRLGYDHEDDLAVFTENNSSFCVDITSTKDGKFITVYVIDSVNPSNGLQKICNRTSGVQYFVEHHSGLFYILTNAPIPDAEWSGQGYYLVRSRIEDVESAKFQSIILPDKDTSLCDMDIFNGYLVLFFTKKGLPLLCSLNLPMQIDFKMPDVIVDYDMSRHTYSIVHQEEVNCDSVGQSCIPTFVLNKNKSKIQEAHGDNKECATNFNSQRWKDFSHVYCCQREEVISDDGVRVPLTIVYSRESWKKGQSPGLLVSYGAYGEDLDKSWCSDHLSLLDRGWVVAFADVRGGGGGGPSWHKSGSGLNKLNSIFDFVSCGNYLVNEGYVQSDLLSAIGWSAGCLLVGAAMNMHPQLFRAVILKRLKLLRVKSESASTAGKSYPVISSDHLKSWTGAEARNPASGVTKFYEHEFGNNEKSIMSVPKMLTCDTFPGHVYCSPVVFGHVGVDVMAVALCSTLAFSGLHRDVPSRNP

SEQ ID NO: 214688 - protein, 233 aa, Glycine max
  Coding DNA Sequence Number=SeqID_97910
  Homolog annotation: Hit_ID=Q2HRX8; Match level="QueryCoverage=57%, HitCoverage=19%, E-value=4e-09, Identity=29%"; Hit description=IMP dehydrogenase/GMP reductase
  Pfam annotation: Domain name=DUF1723; Domain location=169-216; Score =10.3; E_value=0.031; Accession=PF08330.1; Description=Protein of unknown function (DUF1723)
IMVRTRGLGRDLGTGRGRDLSQDAHEPEVRRRHWPTASVHWQQVHVTEDVTQKPKDVPQLNEDVPHVSDATPEMTSAVDVADAEGVASDGSLGSPAVDEGFPGGPRDPSVLTGFAEHVAHSIWSGEERPNLKLVSHGRKVDKFGRLAPEIEDMIAATRLSPLIRCSIITTDPGLISAFVMRWHRETSTFHLPPLVTFDAVGLLTELLEVTPEEAIAETRQAGGPHVRLSWLQD

SEQ ID NO: 214689 - protein, 212 aa, Glycine max
  Coding DNA Sequence Number=SeqID_97911
  Gene Ontology: Mol. function=protein binding
  Homolog annotation: Hit_ID=Q9FKT0; Match level="QueryCoverage=92%, HitCoverage=34%, E-value=6e-33, Identity=45%"; Hit description =Similarity to actin
  Pfam annotation: Domain name=F-box; Domain location=43-90; Score =46.3; E_value=1e-10; Accession=PF00646.23; Description=F-box domain
  Subcellular localization annotation: CTP_CleavageSite=23; ConfidenceScore=5.07e-01
MSMLLRKVWERVLWRSDSSTSASASASSSSSSSPPEVACSDMGELELLPSDILMHILRLLGPKEAAKLSVVCKALRSLVSDNRLWIHFLQTHQAEPSGDSVFFAETTLSYGYPLPEFGGLRLKICVLMGGASFCCDGACSWIDCCLPFAGHWPQLSFKHIYGQRALVPGSIIIDGGSGYCKFGWSKYAYPSGRSATFLVMILIGTSTRAVFN

SEQ ID NO: 214690 - protein, 374 aa, Glycine max
  Coding DNA Sequence Number=SeqID_97912
  Gene Ontology: Mol. function=hydrolase activity, acting on ester bonds; Cellular component=cellular_component; Biological process =lipid metabolic process
  Homolog annotation: Hit_ID=O80470; Match level="QueryCoverage=91%, HitCoverage=88%, E-value=1e-142, Identity=70%"; Hit description =Putative GDSL-motif lipase/hydrolase
  Pfam annotation: Domain name=Lipase_GDSL; Domain location=35-355; Score=189.1; E_value=1.1e-53; Accession=PF00657.12; Description=GDSL- like LipaseAcylhydrolase
MALKYHNFFSLLLLLVNLSFHGNIAAQNAKLAASFIFGDSLVDAGNNNYLSTFSKADVPPNGIDFKASGGNPTGRFTNGRTISDIVGEELGQPSYAVPYLAPNTTGKTILNGVNYASGGGGILNATGSLFVNRLGMDIQINYFNITRKQIDKLLGKSEARDYIMKKSLFSIIVGSNDFLNNYLLPFVSSGVRVSQNPDAFVDDMINHFRIQLYRLYQLEARKFVISNVGPLGCIPYQRIINELNDEDCVDLANELATQYNSRLKDLVAELNENLPGATFVLANVYDLVSELIVNYHKYGFTTASRGCCGIGSGGQVAGIIPCVPTSSLCSDRHKHVFWDQYHPSEAANIILAKQLINGDKRYISPMNLRQLIDL

SEQ ID NO: 214691 - protein, 833 aa, Glycine max
  Coding DNA Sequence Number=SeqID_97913
  Gene Ontology: Mol. function=binding; Cellular component=nucleus; Biological process=metabolic process
  Homolog annotation: Hit_ID=Q2QNV4; Match level="QueryCoverage=80%, HitCoverage=67%, E-value=1e-108, Identity=30%"; Hit description =Pentatricopeptide, putative, expressed
  Pfam annotation: Domain name=PPR; Domain location=218-252; Score =39.4; E_value=1.2e-08; Accession=PF01535.11; Description=PPR repeat
  Pfam annotation: Domain name=PPR; Domain location=253-287; Score=7.4; E_value=0.99; Accession=PF01535.11; Description=PPR repeat
  Pfam annotation: Domain name=PPR; Domain location=319-353; Score =29.9; E_value=9.2e-06; Accession=PF01535.11; Description=PPR repeat
  Pfam annotation: Domain name=PPR; Domain location=421-455; Score =22.7; E_value=0.0014; Accession=PF01535.11; Description=PPR repeat
  Pfam annotation: Domain name=PPR; Domain location=522-556; Score =44.0; E_value=5.2e-10; Accession=PF01535.11; Description=PPR repeat
  Pfam annotation: Domain name=PPR; Domain location=557-591; Score =19.2; E_value=0.014; Accession=PF01535.11; Description=PPR repeat
  Pfam annotation: Domain name=PPR; Domain location=85-119; Score=13.1; E_value=0.21; Accession=PF01535.11; Description=PPR repeat
  Pfam module annotation: Pfam domain module=PPR::PPR::PPR::PPR::PPR::PP R::PPR; Domain location=218-252::253-287::319-353::421-455::522 -556::557-591::85-119
FIFTFSKKQSNIALHSLFIIAVSVCALGKIYVCNNYMNKACFCVAEGHALSLLQKCSTVTSLREARQLHALILTTTTAFTSQSPFVYNNILSMYARCGSLTDSHLVFDKMPRRTIVSYNALLAAYSRASPNHAISALELYTQMVTNGLRPSSTTFTSLLQASSLLEHWWFGSSLHAKGFKLGLNDICLQTSLLNMYSNCGDLSSAELVFWDMVDRDHVAWNSLIMGYLKNNKIEEGIWLFIKMMSVGFAPTQFTYCMVLNSCSRLKDYRSGRLIHAHVIVRNVSLDLHLQNALVDMYCNAGNMQTAYRIFSRMENPDLVSWNSMIAGYSENEDGEKAMNLFVQLQEMCFPKPDDYTYAGIISATGVFPSSSYGKSLHAEVIKTGFERSVFVGSTLVSMYFKNHESDAAWRVFCSISVKDVVLWTEMITGYSKMTDGICAIRCFFQMVHEGHEVDDYVLSGVVNACANLAVLRQGEIIHCYAVKLGYDVEMSVSGSLIDMYAKNGSLEAAYLVFSQVSEPDLKCWNSMLGGYSHHGMVEEALQVFEEILKQGLIPDQVTFLSLLSACSHSRLVEQGKFLWNYMNSIGLIPGLKHYSCMVTLFSRAALLEEAEEIINKSPYIEDNLELWRTLLSACVINKNFKVGIHAAEEVLRLKAEDGPTLVLLSNLYAAARKWDKVAEIRRNMRGLMLDKYPGLSWIEAKNDIHVFSSGDQSHPKADEGVDTGPGTGVVEPKSEVCGPGAGVGVANRDDNIEDDGAEDGVLKRDNPLPDDKDEVDAAVNAMLDELFLRQLLVLQFLADLPPKMDHSPPPGDADQLGMLISLIQCTDECSPPE

SEQ ID NO: 214692 - protein, 309 aa, Glycine max
  Coding DNA Sequence Number=SeqID_97914
  Gene Ontology: Mol. function=porin activity; Cellular component =integral to membrane
  Homolog annotation: Hit_ID=O23173; Match level="QueryCoverage=77%, HitCoverage=38%, E-value=1e-67, Identity=58%"; Hit description =Nucleoporin-like protein
  Subcellular localization annotation: CTP_CleavageSite=76; ConfidenceScore=5.53e-01
MSFSLFATPQQQQPQQQSPFQPQQTSLFLPQQQQQFQQQQQQQQQQQQQQQQQFQQQQQQQQPQQQLFLFTNDRTPASYSTNWADLHPDSQKILLQIEYALIIPRECSVLLWERILEFRDESQRLDQCSRLYDSSVSNDGFELDAGHIVQELGGINTAMERQKTLLHELMSTVKDMLRNTEVAVRSFMMLRPRFLHPSGGTSSATAPSQTPGATIAPSSSSQPTTASIVPVFDFYSGLPRKPSPFLQQTVLRFEKYLGECHQWIEELEQLLLLESERNASSNGSSLLQSLPKVMTNVHDFFVHVAAKVE

SEQ ID NO: 214693 - protein, 381 aa, Glycine max
  Coding DNA Sequence Number=SeqID_97915
  Gene Ontology: Mol. function=oxidoreductase activity; Cellular component=membrane; Biological process=electron transport
  Homolog annotation: Hit_ID=Q309D0; Match level="QueryCoverage=99%, HitCoverage=86%, E-value=3e-91, Identity=43%"; Hit description=P450 mono-oxygenase
  Pfam annotation: Domain name=p450; Domain location=1-376; Score=3.1; E_value=4.1e-11; Accession=PF00067.12; Description=Cytochrome P450
MADKHGPIFTIKLGSYKVLVLSSLEMAKECFTVHDKAFSTRPCVTASKLMTYNSAMFGFAPHGPYWREMRKFATIELLSNQRLELLKDTRTSELETATRKVYKLWSREGCPKGGVLVTPEGIRKLREFMRLFGVVAGEHKRKRAMSTNGKEEQDVMDVMLNVLQDLKVSDYDSDTIIKATCLNRILAAGDSIMVALTWAVSLLLNNEMELKKAQDELDTHVGKDRKVEKSDIKKLVYLQAIVRETMRLYPPSPIITLRAAMEECTFSCGYHIPAGTHLIVNTWKIQRDGCVWPDPHDFKPERFLASHKDVDAKGQNYELIPFGSSLALRVVHLARLLHLTLFQCCFSFKSSCGHDRVHWTHKFKSYSTSSSPNSTFRYKAL

SEQ ID NO: 214694 - protein, 46 aa, Glycine max
  Coding DNA Sequence Number=SeqID_97916
MGRAKRGCHCGMLNVSFGEIEGKGPQLLLPLKQIRMHTCVCITQEK

SEQ ID NO: 214695 - protein, 68 aa, Glycine max
  Coding DNA Sequence Number=SeqID_97917
MSEPMHLRPAVGATQIYNDKKNKDETGKGINDKRRTTLMEILGVRHTTDICKYLGYRPLTGRGKKVDF

SEQ ID NO: 214696 - protein, 335 aa, Glycine max
  Coding DNA Sequence Number=SeqID_97918
  Gene Ontology: Mol. function=zinc ion binding; Biological process =regulation of transcription
  Homolog annotation: Hit_ID=Q0GLD7; Match level="QueryCoverage=67%, HitCoverage=72%, E-value=2e-51, Identity=53%"; Hit description=Dof15
  Pfam annotation: Domain name=zf-Dof; Domain location=58-120; Score =136.3; E_value=8.4e-38; Accession=PF02701.6; Description=Dof domain, zinc finger
  Subcellular localization annotation: CTP_CleavageSite=67; ConfidenceScore=5.63e-01
MLGGASASHIPGERKISINNGGGGRALLLTPPTSSSSPSCTTSITTSTATATATSSNSENQNLRCPRCDSSNTKFCYYNNYNLTQPRHFCKTCRRYWTKGGALRNVPIGGGCRKSKSSGGMSNSVAKQTATKMKAVASELGRSPQGLFDQELPQTPILWGSPQNSQLMALLRATQNQNPNPNPSPMSISVKGEGNLMGSHSHMVSTESLLANGLLNPRTSLGFDDGRVGEALPSLGLCSSFWRNNQDQTQQQNNGFVVGEHQSSGVQELYHKLRSSSSVNYWGSDNSPVFLSNMASSSSSLSNILESSSVSGSEFGCWNPTLSWSDLPTTNGAYP

SEQ ID NO: 214697 - protein, 530 aa, Glycine max
  Coding DNA Sequence Number=SeqID_97919
  Gene Ontology: Mol. function=oxidoreductase activity; Cellular component=cellulose and pectin-containing cell wall; Biological process=lignin catabolic process
  Homolog annotation: Hit_ID=Q7XIF0; Match level="QueryCoverage=85%, HitCoverage=83%, E-value=1e-179, Identity=64%"; Hit description =Putative pollen-specific protein NTP303
  Pfam annotation: Domain name=Cu-oxidase; Domain location=150-286; Score=198.9; E_value=1.2e-56; Accession=PF00394.12; Description =Multicopper oxidase
  Pfam annotation: Domain name=Cu-oxidase_2; Domain location=368-508; Score=156.2; E_value=8.4e-44; Accession=PF07731.4; Description =Multicopper oxidase
  Pfam annotation: Domain name=Cu-oxidase_3; Domain location=56-140; Score=54.0; E_value=5e-13; Accession=PF07732.5; Description =Multicopper oxidase
  Pfam module annotation: Pfam domain module=Cu-oxidase::Cu-oxidase _2::Cu-oxidase_3; Domain location=150-286::368-508::56-140
MKKMQLLHTLASEKPPQEKREGVRKRESGTDPSGCKSVLGVSHSSCITQICRQYAKNWLVTFVMPCHCFSYSYQWNGIKQRKNSWQDGVLGTNCPIPPNSNYTYKFQAKDQIGTYTYFPSTQLHKAAGGFGALNVYHRSVIPIPYPNPDGDFTLLVGDWYKTNHKTLRQTLESGKPLAFPDGLLINGQAHSTFTGNPGKTYMFRISNVGFSTSINFRIQGHTLKLVEVEGSHTVQNLYDSLDVHVGQSVAVLVTLNQPPKDYYIVASTRFTETPLTTTAVLHYANSFSSALGPVPAPPVDKYDFDWSMKQARTYRWNLTANAARPNPQGSFHYGKITPTKVIKLANSAPLINGKLRYAVNSVSYVNPDTPLKLADYFNIPGIFSVNLLQNSPSNGPGYIGTSVLQTSLHDFIEVIFQNNENTMQSWHLDGYDFWVIGHGFGQWTDASRKTYNLVDALTRHTTQVYPKSWTTILVSLDNQGMWNLRSAIWERQYLGQQFYLRVWDAQKSLANEYDIPNNVLLCGKAVGHHP

SEQ ID NO: 214698 - protein, 508 aa, Glycine max
  Coding DNA Sequence Number=SeqID_97920
  Homolog annotation: Hit_ID=Q9ZTZ3; Match level="QueryCoverage=37%, HitCoverage=90%, E-value=1e-104, Identity=100%"; Hit description=24 kDa seed maturation protein
  Pfam annotation: Domain name=NB-ARC; Domain location=283-500; Score= -64.2; E_value=3.4e-06; Accession=PF00931.13; Description=NB-ARC domain
  Pfam annotation: Domain name=Reticulon; Domain location=6-189; Score =124.3; E_value=3.4e-34; Accession=PF02453.8; Description=Reticulon
  Pfam module annotation: Pfam domain module=NB-ARC::Reticulon; Domain location=283-500::6-189
VDNGIVKDVVLWRRKKINISVLVAATAAWVLMEVFEFNFLTLISWVAILGLASIFLYANMLRLLGKEPPNLLGLEVSEKTTTRIAHTVRAWIEEGIRWLFLVGAEKEWPVFVGAVAGLLSLSYLGSCMDLLTLVYMGTLVGMAVPLTYVKNEDKIKRFVEWLREKHKRYYQIIDEKTIQKIKSRIVKEKKTETRTSLGIGVNTLTILEPCMAYTKAQVNLVVIRKVCEFKATHERSRETFKSLSPECKVEANAVDLTRHTTTIEPVHIRRNIMEIQSDIRIMKEKENACGAIEEPECIGMDQHLKQLKIDLLKDGVSVLVLTGLGESGKTTLAKKICWNPQIKRKFGANIFFVTVSETPNLKSIVGTVFEGCGPPVPEFQSDDDATSRLRALLRKALVEKVKIDIPDYKILVTSRIEYPRFGTKILLGQLDHNQAVALFTHYAKLNENSLYRPEEDLLHVDELPTNGKVCFMDLGLFPQDQRIHVPALIDMWPELHNLNSDGSNAMAI

SEQ ID NO: 214699 - protein, 208 aa, Glycine max
  Coding DNA Sequence Number=SeqID_97921
  Gene Ontology: Mol. function=protein binding; Cellular component =intracellular; Biological process=defense response
  Homolog annotation: Hit_ID=Q1S328; Match level="QueryCoverage=98%, HitCoverage=24%, E-value=2e-13, Identity=27%"; Hit description =Disease resistance protein
MADLFSGGAVGAVMGELLKGAIATINKGRDFGPTLESNIETLNSLAPQVEEMKRYNKMLDRPIEEIARLESQMQAGEELVRKCSKFGRWRMLSFPYYQSKLKSNDANLKRHFSVNVPAENKRDLMEVVASVRQILEILSKKEDFRHSFHLRGLSGAPQEPECVGMDVPLSKLRIDLLKDGVSVLVLTGLGGSGKSTLAKKICWDPQVK

SEQ ID NO: 214700 - protein, 667 aa, Glycine max
  Coding DNA Sequence Number=SeqID_97922
  Gene Ontology: Mol. function=protein binding; Cellular component =intracellular; Biological process=defense response
  Homolog annotation: Hit_ID=Q1SVX0; Match level="QueryCoverage=99%, HitCoverage=78%, E-value=1e-175, Identity=51%"; Hit description =Disease resistance protein
  Pfam annotation: Domain name=LRR_1; Domain location=455-475; Score =1.2; E_value=1.7e+02; Accession=PF00560.23; Description=Leucine Rich Repeat
  Pfam annotation: Domain name=LRR_1; Domain location=502-524; Score =6.0; E_value=21; Accession=PF00560.23; Description=Leucine Rich Repeat
  Pfam annotation: Domain name=LRR_1; Domain location=526-548; Score =10.6; E_value=3; Accession=PF00560.23; Description=Leucine Rich Repeat
  Pfam annotation: Domain name=LRR_1; Domain location=550-572; Score =10.8; E_value=2.7; Accession=PF00560.23; Description=Leucine Rich Repeat
  Pfam annotation: Domain name=LRR_1; Domain location=574-596; Score =11.1; E_value=2.4; Accession=PF00560.23; Description=Leucine Rich Repeat
  Pfam annotation: Domain name=LRR_1; Domain location=598-620; Score =9.5; E_value=4.7; Accession=PF00560.23; Description=Leucine Rich Repeat
  Pfam annotation: Domain name=NB-ARC; Domain location=1-234; Score= -55.3; E_value=9.2e-07; Accession=PF00931.13; Description=NB-ARC domain
  Pfam module annotation: Pfam domain module=LRR_1::LRR_1::LRR_1::LRR _1::LRR_1::LRR_1::NB-ARC; Domain location=455-475::502-524::526 -548::550-572::574-596::598-620::1-234
KFEGNIFFVTVSKTPNLKYIVETLFEHCGCPVPKFQSDEDAINRLGVLLRLVGKNPILLVLDDVWPSSEALVEKFKIDIPDYKILVTSRVSFPRFGTPCQLDKLDHDHAVALFCHFAQLNGKSSYMPDEKLVDEIVRGCKGSPLALKVTAGSLCQQPYEVWQNMKDRLQSQSILLESSSSDLLFRLQQSLDILEDKFKINEKVCFMDLGLFPEDQRIPVAALIDMWAELHNLDENGRNAMTIIHDLTIRNLINVIVTRKVAKDADMYYNNHFVMLHDLLRELSICQSKEKPFEQRERLIIDLNGDNRPEWWIGQDEQGVIGRMSSFFLRMLYRQKQLRVAARILSISTGDTYFGGGIATVLKMYGLIRNTPAMCHTSSSIIDVKYVASADETFTSDWCDMLPDEAEVLVLNLNSSQYSLPEFTEKMSKLRVLLVTNYGFHRSELNKFELLGSLFNLKRIRLEKVSVPSLCILKNLQKLSLHMCNTRQAFENCSIQISDAMPNLVEMSIDYCNDLVKLPDGMSNITPLKKLSITNCHRLSTLPQDIAKLENLEVLRLCSCSGLVEMPDSVKGLYKLSCLDISDCVSLSRLPDDIGELKKLEKLYLKGCSKLSEFPYSVVNFGNLEHEIYVICDEEIAALWENFPTMPKLKIEISTMEINLNWLPGVHS

SEQ ID NO: 214701 - protein, 382 aa, Glycine max
  Coding DNA Sequence Number=SeqID_97923
  Gene Ontology: Mol. function=RNA polymerase I transcription factor activity; Cellular component=nucleus; Biological process =transcription from RNA polymerase I promoter
  Homolog annotation: Hit_ID=Q10EQ6; Match level="QueryCoverage=99%, HitCoverage=100%, E-value=8e-64, Identity=63%"; Hit description=SWIB complex BAF60b domain-containing protein, putative, expressed
  Pfam annotation: Domain name=DEK_C; Domain location=3-56; Score=78.6; E_value=1.9e-20; Accession=PF08766.1; Description=DEK C terminal domain
  Pfam annotation: Domain name=SWIB; Domain location=181-256; Score =147.5; E_value=3.5e-41; Accession=PF02201.9; Description=SWIBMDM2 domain
  Pfam annotation: Domain name=SWIB; Domain location=301-378; Score =138.1; E_value=2.4e-38; Accession=PF02201.9; Description=SWIBMDM2 domain
  Pfam module annotation: Pfam domain module=DEK_C::SWIB::SWIB; Domain location=3-56::181-256::301-378
MVSESELIGRLREFLRSSDLNTTTTATVRRQLEADFGIDLSDRKAFIREQVDLFLQTEHNQSQQEEEEKEEKHQNDHVEEQEEDAPNNPEQSQPSDSKEVTDEDEEEEDEEEEEDKPKHAKKAKKNKGRLTGTWFSVIFNNWGPLSDFAALLSIKICVFFKLLTRSNTLGDEVVKKRGGGFCKLCSLSPQLQEFMGAPEMARTEVVKQLWAYIREKNLQDPNNRRNIICDERLRSLFNVNSINMFQMNKALSKHIWPLDSDDVVQVKSTPKEKQKKQERDDDSDEPKKKEKRQKGGGKSGFLAPLQLSDALVNFLGTGESELARTDVIKRMWDYIKGNNLQDPSDKRKIICDEKLKELFDVDTFTGFTVTKLLAPHFIKTEQ

SEQ ID NO: 214702 - protein, 426 aa, Glycine max
  Coding DNA Sequence Number=SeqID_97924
  Gene Ontology: Mol. function=protein serine/threonine kinase activity; Cellular component=cytoplasm; Biological process=protein amino acid phosphorylation
  Homolog annotation: Hit_ID=Q3HVN8; Match level="QueryCoverage=100%, HitCoverage=74%, E-value=4e-67, Identity=80%"; Hit description =Serine/threonine protein kinase SAPK8-like protein
  Pfam annotation: Domain name=Pkinase; Domain location=21-426; Score =103.6; E_value=5.8e-28; Accession=PF00069.15; Description=Protein kinase domain
  Pfam annotation: Domain name=Pkinase_Tyr; Domain location=21-419; Score=-83.7; E_value=2.5e-07; Accession=PF07714.7; Description =Protein tyrosine kinase
  Pfam module annotation: Pfam domain module=Pkinase::Pkinase_Tyr; Domain location=21-426::21-419
MDRPATGPGVDMPIMHDSDRYDFVRDIGSGNFGVARLMRDKQTQELVAVKYIERGDKIDENVKREIINHRSLRHPNIIRFKEVILTPTHLAIVMEYASGGELFEKICNAGHFNEDEEVCHRDLKLENTLLDGSPALHLKICDFGYSKFVLDPFIRIGPIPSLSDRVLDQNVSLNSETLRIWKVYVYKKRKTSEKRIRRMISSLSWLRKSLNLLGVDALQAVNGSDSICGRLTDAPKDAMTSSKMLDPYSYDEQGSGSNRGVGVTLGSGGGTSFLVVETYFKVQITLDDVEVKLAKLSMDGATIYLFNLLKETKEDALCCIHEEGEFLSSVLHSQPKSTVGTPAYIAPEVLLKQEYDGKIADVWSCGVTLFVMLVGSYPFEDPNDPKDFRKTIQRVLSVQYSIPDNVQVSPECRHLISRIFVFDPAE

SEQ ID NO: 214703 - protein, 305 aa, Glycine max
  Coding DNA Sequence Number=SeqID_97925
  Homolog annotation: Hit_ID=UPI0000E47FAE; Match level="QueryCoverage =89%, HitCoverage=51%, E-value=2e-10, Identity=30%"; Hit description =PREDICTED: hypothetical protein, partial
TYQGNPCGVYPDLSSFTGSGVYPDLSSFIGSGVYPDLSSFTGSGVYPDLSSFIGSGVYPDLSSLTGSGVIQTFVTCIKRSTPYGSHHLVSELWLLIQTYQGNPCGVYPDLSSFIGSGVYPDLSSLTGSGVYPDLSSLTGSGVYPDLSSFTGSGVYHDLSSFTGSGVIQIFVTCIKRSAPTQAKYSLKAQVEKDEGPSGEGQSPRVEKDEGPSNPCGVYPDLSSFIGSGVYPDLSSLTGSGVYPDLSSFTGSGVYPDLSSFTGSGVYPDLSSFTGSGVIQTFVACIKRSAPVRFTSSGIRASALDT

SEQ ID NO: 214704 - protein, 75 aa, Glycine max
  Coding DNA Sequence Number=SeqID_97926
  Subcellular localization annotation: CTP_CleavageSite=63; ConfidenceScore=5.12e-01
MARDEMQRLDLLLIRKIGKSVVFTFSLSQSTGLVIKRTASAHLLSETSALSQNPLRRAKQSIRALSARARTRPPT

SEQ ID NO: 214705 - protein, 116 aa, Glycine max
  Coding DNA Sequence Number=SeqID_97927
  Gene Ontology: Mol. function=RNA-directed DNA polymerase activity; Biological process=RNA-dependent DNA replication
MNRLNLMIGHTHADHLVTTKPPQQMLIKEVIPNRKGINGSLNPAQMISHNIFCTTLVSDLNIKLLKKKHPPDQFGFSIRFLQQVSQGCMGNLAKILDESPVKICMSQKRAYFSHRL

SEQ ID NO: 214706 - protein, 464 aa, Glycine max
  Coding DNA Sequence Number=SeqID_97928
  Gene Ontology: Mol. function=signal transducer activity; Biological process=G-protein coupled receptor protein signaling pathway
  Homolog annotation: Hit_ID=O81225; Match level="QueryCoverage=97%, HitCoverage=48%, E-value=1e-138, Identity=58%"; Hit description =Extra-large G-protein
MSPAAPDAAEYSFAVEYDGPPLTCDLPRAVPISVDNIPVAAVVSQVPLSDSLSLPVVQPLLPPQQHHQPLRTEARVSKLASETTVSPTSVIAFEHRASQSNVGELSGELSSSGAFEFSTGNDGSGDLSDLGGSSRVLEETRSSSTIEFRDKSGRSSGALRVLEDGKESLDFNELNQQDWASTESVLSLEYPSTRVSSLKAEDIDAKRPPIVTFDVDSDDALVEEFDVEDTVSSNKPVKRAPLTKGKKGSCYRCFKGNRFTEKEVCLVCDAKYCGNCVLRAMGSMPEGRKCVTCIGFPIDEAKRGTLGKCSRMLKRLLNELEVRQIMKAERFCEANLLPPEYVCVNGHPLSYEELVTLQNCPNPPKKLKPGTYWYDKVSGLWGKEGQKPSQIISPHLNVGGPIQQDASNGNTQVFINGREITKVELRMLQLAGVQCAGNPHFWVNDDGSYQEEGQRNTRGYIWGK

SEQ ID NO: 214707 - protein, 79 aa, Glycine max
  Coding DNA Sequence Number=SeqID_97929
MRKLLMIPCRAKPPNVVGGSVERFGHVFYVCDYVGQFSCQTNGNLGLGKQVVTKIDDERELSGDDIQTANLRKCAILDV

SEQ ID NO: 214708 - protein, 458 aa, Glycine max
  Coding DNA Sequence Number=SeqID_97930
  Gene Ontology: Mol. function=ATP binding; Cellular component =intracellular; Biological process=electron transport
  Pfam annotation: Domain name=WD40; Domain location=129-165; Score =16.9; E_value=0.071; Accession=PF00400.22; Description=WD domain, G -beta repeat
  Pfam annotation: Domain name=WD40; Domain location=201-239; Score =25.0; E_value=0.00028; Accession=PF00400.22; Description=WD domain, G-beta repeat
  Pfam annotation: Domain name=WD40; Domain location=243-280; Score =33.0; E_value=1.1e-06; Accession=PF00400.22; Description=WD domain, G-beta repeat
  Pfam annotation: Domain name=WD40; Domain location=290-328; Score =14.5; E_value=0.4; Accession=PF00400.22; Description=WD domain, G -beta repeat
  Pfam annotation: Domain name=WD40; Domain location=333-369; Score =31.3; E_value=3.5e-06; Accession=PF00400.22; Description=WD domain, G-beta repeat
  Pfam annotation: Domain name=WD40; Domain location=376-422; Score =36.8; E_value=7.5e-08; Accession=PF00400.22; Description=WD domain, G-beta repeat
  Pfam annotation: Domain name=WD40; Domain location=91-127; Score =18.0; E_value=0.035; Accession=PF00400.22; Description=WD domain, G -beta repeat
  Pfam module annotation: Pfam domain module=WD40::WD40::WD40::WD40::WD4 0::WD40::WD40; Domain location=129-165::201-239::243-280::290 -328::333-369::376-422::91-127
MTGSSRKGRGYLDEGSVNGRMYGKLKKDEFDGYNSDNHQRKNNPITMDAPHLDPQMEADNAPYDASLSPLSKSPWSSHMNEDAFAGSNENDALVGSLVREEGHIYSLAATKDLLYTGSDSKNIRVWKNQEEFAGFKSNSGLVKAIVIAGEKILTGHQDGRIRVWKVSGKNDQQHKRVATLPTLRNYIKCSMKPSNYVEVRRRRNLIWIKHYDAISCLSLTEDHSLIYSASWDKTFKVWRTSNFKCLESVTAHDDAVNALVVGLDGMVFTGSADGTVKIWRREVQGKGTKHLFSQTLLKQECAVTALAINEEGNVLYAGSSDGLVNYWVRETNLEHKGVLRGHKLAVLCLATAGSLVFSGSADMAICVWKRSLNDDHTCVNILSGHTGPVKCLAAERDPEAMCNERRWILYSGSLDKSVKVWKVSENAASAHNNHQPPRPSLDQFPRVSSLRKMGSKRY

SEQ ID NO: 214709 - protein, 88 aa, Glycine max
  Coding DNA Sequence Number=SeqID_97931
MQSSSRPPGCARNCPPIGDQPRAQRSSLPASAKDHGPIKAPKHPLRKCLDSLTTLVPHEWAIRQGQCTSPPTNIHNIQRIEHGHHQVQ

SEQ ID NO: 214710 - protein, 225 aa, Glycine max
  Coding DNA Sequence Number=SeqID_97932
  Gene Ontology: Mol. function=signal transducer activity; Cellular component=heterotrimeric G-protein complex; Biological process=G -protein coupled receptor protein signaling pathway
  Homolog annotation: Hit_ID=O81225; Match level="QueryCoverage=88%, HitCoverage=25%, E-value=5e-71, Identity=62%"; Hit description=Extra- large G-protein
  Pfam annotation: Domain name=G-alpha; Domain location=1-219; Score= -178.0; E_value=3.3e-07; Accession=PF00503.10; Description=G-protein alpha subunit
MPDYLEHGIVQKLLLVGGSGSGTSTIFKQAKILYKSVPFSEDEHENIKLTIQSNVYAYLGMLLEGRTSPKLDEKTVYSIGPRLKAFSDWLLKTMVSGKLDAIFPAATREYAPLIEELWNDAAIKATYERRSELEMLPSVASYFLERAVKILRTDYEPSDLDILYAEGVTSSNGVACVEFSFPQSASDETVDTTDLHDSLVRLIAPVKLPRVVNASTSELQNTKRN

SEQ ID NO: 214711 - protein, 500 aa, Glycine max
  Coding DNA Sequence Number=SeqID_97933
  Gene Ontology: Mol. function=oxidoreductase activity; Cellular component=membrane; Biological process=electron transport
  Homolog annotation: Hit_ID=O49858; Match level="QueryCoverage=98%, HitCoverage=92%, E-value=1e-147, Identity=53%"; Hit description =Cytochrome P450 82A3
  Pfam annotation: Domain name=p450; Domain location=2-486; Score =268.8; E_value=1.1e-77; Accession=PF00067.12; Description=Cytochrome P450
APQAAGAWPIIGHLHLFNAHQLTHKTLGKMAEKHGPIFTIKLGSYKVLVLSSWEMAKECFTAHDKAFSTRPCVAASKLMGYNYAMFGFTPYGSYWRQVRKLTTIELLSNNRLEPLKDTRTVELDAAIRELYKVWTREGCPKGGVLVDMKQWFGDLTHNIALRMVGGKSYSGVGDDDHAEGEARRYRRVMRDWVCLFGVFVLSDSFPFLGWLDINGYEKDMKRTASELDALVEGWLEEHKRKRKRKRGLSVNGKEEQDDFMDVMLNVLQGTEISGYDSDTIIKATCLNLILAGTDPTMVTLTWALSLLLNHQMELKRARHELDTLIGKDRKVEESDIKKLVYLQAVVKETLRLYPPSPIITLRAAMEDCTFSCGYHIPAGTQLMVNAWKIHRDGRVWSEPNDFKPERFLTIHKDVDVKGQNYELVPFSSGRRACPGASLALRVVHLTLARLLHSFDVASPSNQVVDMTESFGLTNLKATPLEVLLTPRLDTKFYEDYIILS

SEQ ID NO: 214712 - protein, 129 aa, Glycine max
  Coding DNA Sequence Number=SeqID_97934
MAACPGKLMLIPEVTGSPRRAGYFTLKSFGGPGEPEANLGDLGFLKRPFCPSFFGIFCIPDRNTEWFLALHCNWCSTLGSKDKDTNFVRVILLFDRATAYKLRTMSPKKHKDKDIESYKRQKTLKSYKV

SEQ ID NO: 214713 - protein, 39 aa, Glycine max
  Coding DNA Sequence Number=SeqID_97935
MEPPTGFSASLLSFIRFLPFFIGLLLLGTTKVVGTSGGA

SEQ ID NO: 214714 - protein, 154 aa, Glycine max
  Coding DNA Sequence Number=SeqID_97936
  Gene Ontology: Mol. function=cysteine-type endopeptidase activity; Biological process=proteolysis
  Homolog annotation: Hit_ID=Q1SVJ9; Match level="QueryCoverage=77%, HitCoverage=23%, E-value=1e-30, Identity=56%"; Hit description =Peptidase C13, legumain
  Pfam annotation: Domain name=Peptidase_C13; Domain location=43-154; Score=-222.7; E_value=4e-05; Accession=PF01650.8; Description =Peptidase C13 family
MKFNSRNWVTLIASVWMSFTVSVMEGVRPLPNPLIEAHGHVKHATAKRWVVLVAGLSGYDNYRHQADVCHAYQILKNGGLKDENIIVFMYDDIAHHNLNPRLGTKINKPNDPHVYKGVPKFLPNNIFGIGMSPLDKYISDSSVSLLLHSPIQDR

SEQ ID NO: 214715 - protein, 304 aa, Glycine max
  Coding DNA Sequence Number=SeqID_97937
  Gene Ontology: Mol. function=cysteine-type endopeptidase activity; Cellular component=vacuole; Biological process=proteolysis
  Homolog annotation: Hit_ID=Q1SVJ9; Match level="QueryCoverage=100%, HitCoverage=66%, E-value=2e-96, Identity=57%"; Hit description =Peptidase C13, legumain
  Pfam annotation: Domain name=Peptidase_C13; Domain location=1-304; Score=387.1; E_value=2.7e-113; Accession=PF01650.8; Description =Peptidase C13 family
DYTGNATTSENFYAVISGNRSALSGGSGKVVDSGPNDTIFIYYADHGATGVIGMPVGDFVMANDFVDVLKKKHAAKSYKKMVIYMEACESGSMFEGILPNNIDVYATTAANTDEDSYGFYCPDLYPTPPPEYTTCLGDEYSISWLEDSDKNDMVNETLQQQYETVRRRTLVSHINATSHVMQYGDKELNNDSLAIYIGALAPSLSLNENAHSFEQSTTQTKLISQRDTRLLHLRLELQKAQDGSEKLKAQKELADEIAHRKHVDNVVHLIGDLLFGEENSSAMMFHVRPAGKPLVDDWDCFKTL

SEQ ID NO: 214716 - protein, 181 aa, Glycine max
  Coding DNA Sequence Number=SeqID_97938
  Subcellular localization annotation: CTP_CleavageSite=47; ConfidenceScore=5.62e-01
MSPSIQLQQPLPSSSLQPHSLPSSGYIATTWFSRTITNGSVSRSSHMAFAKVEMNPLVLSPYHSTYFSFTTTLFHYCASIAFSHTLSPNISPSLDSHPIFHTSSRPFVTINLENPQYHSLTQLTLDHITENLNRPCVQPFFFAQSLIFPSKNPNTMRLLPISTPHKTPRSHSPLLTCITNP

SEQ ID NO: 214717 - protein, 105 aa, Glycine max
  Coding DNA Sequence Number=SeqID_97939
MLKAIVVARMVVAATGDGFGERNTTKGVVDGENLLCMTMIMVAGTTATTNVVVAEVVAEGQNDRSHFRGQARHIQICLWNLLDNYNGCYGWWLMKWKGSKNAHIQ

SEQ ID NO: 214718 - protein, 86 aa, Glycine max
  Coding DNA Sequence Number=SeqID_97940
MAATLASSGSDASSYGANDEGCRSGGDNETILEPNEKLPPYGGQHEVGCHYEDSESYLFTIETPFNRVFPWKRDFVAEFDCNFSFM

SEQ ID NO: 214719 - protein, 230 aa, Glycine max
  Coding DNA Sequence Number=SeqID_97941
  Gene Ontology: Mol. function=protein binding; Biological process =protein modification process
  Homolog annotation: Hit_ID=Q6K5J0; Match level="QueryCoverage=60%, HitCoverage=88%, E-value=2e-34, Identity=56%"; Hit description =Ubiquitin-like protein
  Pfam annotation: Domain name=ubiquitin; Domain location=140-207; Score=25.3; E_value=0.00022; Accession=PF00240.13; Description =Ubiquitin family
MPHLSSMCSELIGFSRSLKSCFLATQGHNLIFYSWFSSSLCTLSSIIYLPQLLQLLLLHFQFFQEKEIQKAIKMIKLRSMRFSRSSSKLGNGGHKATTPTEKDCRSIGEIQWELRPGGMLVQKRESNQSAGEGMITIIVSTVSQSHEISIEATSTFGELKMILSLATSFEPREQRLLFKGKEREDDEYLHMVGVRDKDKVLLFEDPAIKEKKLLGLRNQPINNPSRTISV

SEQ ID NO: 214720 - protein, 83 aa, Glycine max
  Coding DNA Sequence Number=SeqID_97942
  Gene Ontology: Mol. function=hydrolase activity, acting on ester bonds; Biological process=lipid metabolic process
  Homolog annotation: Hit_ID=Q7Y055; Match level="QueryCoverage=98%, HitCoverage=20%, E-value=8e-07, Identity=34%"; Hit description=GDSL -lipase
MVVGNLTTVIKVYIRGYLKGIHKKGGRKFGVLNQSVLGCIPLVKAPVNGSEGSCVEEASALAKLHNSVLSVELEKLKKHLKGY

SEQ ID NO: 214721 - protein, 107 aa, Glycine max
  Coding DNA Sequence Number=SeqID_97943
  Gene Ontology: Mol. function=metal ion binding; Cellular component =intracellular; Biological process=regulation of transcription
  Homolog annotation: Hit_ID=Q1SVK0; Match level="QueryCoverage=70%, HitCoverage=22%, E-value=1e-24, Identity=71%"; Hit description=CCT
  Pfam annotation: Domain name=CCT; Domain location=52-90; Score=45.0; E_value=2.6e-10; Accession=PF06203.4; Description=CCT motif
MMRVVVVAWDGLGSGGVVGNAWNVPENCGANKTNVKEEMGWKLGQREASLQRYKEKRQSRLFYKKIRYEVRKLNAEKRPRMKDVNIHMNRWRLEIPVCVCIGYKFLM

SEQ ID NO: 214722 - protein, 170 aa, Glycine max
  Coding DNA Sequence Number=SeqID_97944
  Gene Ontology: Mol. function=iron-sulfur cluster binding; Biological process=electron transport
  Homolog annotation: Hit_ID=Q6D458; Match level="QueryCoverage=97%, HitCoverage=44%, E-value=7e-60, Identity=64%"; Hit description =Putative iron-sulfur binding protein
  Pfam annotation: Domain name=Fer2; Domain location=93-165; Score =62.6; E_value=1.3e-15; Accession=PF00111.17; Description=2Fe-2S iron- sulfur cluster binding domain
MPKPCSRCVFTTIGTESGRKHPQGEPLATLQRFRSAQDGSGDIDFGLNLIALNSGIVRVGDTVEVLERQTPRAYGAGEVVETLQAASSAPAAVTIGYQGQQFAGDNQQVLLEQLEMQGFRIPYSCRAGICGSCKITLVSGDVKALKQSAVRGDGTILSCSCIPNGDIELA

SEQ ID NO: 214723 - protein, 120 aa, Glycine max
  Coding DNA Sequence Number=SeqID_97945
  Subcellular localization annotation: CTP_CleavageSite=39; ConfidenceScore=5.33e-01
MSPPPLGPHNRSQTHLKLSGQLPLPALVSTDLHTTNSLKLSGTWTFLSLELSRHAEASRKGQTPLQNLILGLNRCFVCARALSAIMNRLVHISEFRLSTEGENQHFKTCLIILKLRENDY

SEQ ID NO: 214724 - protein, 94 aa, Glycine max
  Coding DNA Sequence Number=SeqID_97946
  Gene Ontology: Mol. function=nucleic acid binding
MGELEIMPTRMTLQLVDFSITRLYGVIEDVLVRVKHFTFPTDFVVMDIEEDANIPLILGRPFMLNASCVVDMGRRNPLAKHTSRAKRIFLPALS

SEQ ID NO: 214725 - protein, 80 aa, Glycine max
  Coding DNA Sequence Number=SeqID_97947
FIKKYCIPRQAQGETPQQPGDGQQRAIDAPPSPLEFTSAHPQKGHPLYPRTAGQTLTYIMTSRSTSLEPKSQLIINLDPG

SEQ ID NO: 214726 - protein, 222 aa, Glycine max
  Coding DNA Sequence Number=SeqID_97948
  Gene Ontology: Mol. function=DNA-dependent protein kinase activity; Cellular component=DNA-dependent protein kinase complex; Biological process=double-strand break repair via nonhomologous end joining
  Homolog annotation: Hit_ID=Q2QTN1; Match level="QueryCoverage=53%, HitCoverage=57%, E-value=4e-33, Identity=57%"; Hit description=Kub3 -prov protein, putative, expressed
MKTISLPPTLPHSAAAEHLEKAGCLVGDNFIKAVKCDNIAIAGGYTQGEGIVVCCNEMESQDDVDQLLKHELIHVFDDCRAGNLDWTKCAHHACSEIRAGHLSGDCHFKRELLKLASLKIRGHEQGSTATRKTYSKESLVSTFRRVVEAIGIQVEVKAGVHHNHEEIGIDGVTDSSHIAGKPNDSVTGHGSSWMLWWQHDWVGFDNQKLLKIIVWSAGGVDA

SEQ ID NO: 214727 - protein, 82 aa, Glycine max
  Coding DNA Sequence Number=SeqID_97949
MKVVVGFLRVILCLILLSQYQTFSVRQLHHSAKTFEWLAGSKGLHEHDQQQHMKGKNHVPGWWHVDYSLPHRRRPVHNKLEP

SEQ ID NO: 214728 - protein, 71 aa, Glycine max
  Coding DNA Sequence Number=SeqID_97950
  Gene Ontology: Mol. function=oxidoreductase activity, acting on the CH-OH group of donors, NAD or NADP as acceptor; Cellular component =glycerol-3-phosphate dehydrogenase complex; Biological process =glycerol-3-phosphate catabolic process
  Homolog annotation: Hit_ID=P52425; Match level="QueryCoverage=63%, HitCoverage=12%, E-value=2e-16, Identity=89%"; Hit description =Glycerol-3-phosphate dehydrogenase [NAD+]
MWVFEEKLPSGEKLTDVISKTNENVKYLPGIKLGKNVVAVPDLENAGMYNYKACFRCIYKDRMSAILRKFS

SEQ ID NO: 214729 - protein, 53 aa, Glycine max
  Coding DNA Sequence Number=SeqID_97951
MEGGKPGGGGSNKLCRYQERYISCTSKTETGDVELPNRFMCLINLRQAYRLLC

SEQ ID NO: 214730 - protein, 432 aa, Glycine max
  Coding DNA Sequence Number=SeqID_97952
  Gene Ontology: Mol. function=peptidase activity
  Homolog annotation: Hit_ID=Q2QTQ5; Match level="QueryCoverage=96%, HitCoverage=93%, E-value=2e-72, Identity=42%"; Hit description =Expressed protein
  Pfam annotation: Domain name=Abhydrolase_1; Domain location=90-320; Score=-9.0; E_value=0.039; Accession=PF00561.10; Description =alphabeta hydrolase fold
MAAKFAFFPPNPPSYKVVTDDMTGLLLLTPFPHRENVEIQKLPTRRGTEIVALYIRHPMATSTVLYSHGNAADLGQMYELFIQLSIHLRVNLMGYDYSGYGQSSGKPSEQNTYSDIEAAYKCLEESYGAKQEDIILYGQSVGSGPTLDLAARLPQLRAVVLHSPILSGLRVMYPVKRTYWFDIYKNIDKIPQVNCPVLIIHNVKGQNALIKAVIVYFYFCMDNALNYLVIDILPFHNSECKGRIPSYFSPSDHFIFVICLSAMFFNLNELAEGTSDEVVDCSHGKQLWELCKEKYEPLWLKGGNHCDLELFPEYIRHLKKFITTVEKSPSQRYSFRRSTDQFEQPRKSTDIFEVSRKSTDRREKPRKSTDKPEKLKNLSNNSDMLEKLRMTFDHKERSRRSVDCHEKSRKSIDHQLEKARKSVDRLDRIRSG

SEQ ID NO: 214731 - protein, 98 aa, Glycine max
  Coding DNA Sequence Number=SeqID_97953
MAHSGSFLAMQTVTAVAGCHQFFDPLTMMFACYFPADCEMLLADIVSHVLTLFMEFMYHLSQCSRSAAVRHCFTCPLSPCFGIWGTLVLDKGDNISWD

SEQ ID NO: 214732 - protein, 150 aa, Glycine max
  Coding DNA Sequence Number=SeqID_97954
  Homolog annotation: Hit_ID=Q1S7C5; Match level="QueryCoverage=61%, HitCoverage=7%, E-value=7e-11, Identity=37%"; Hit description =Integrase, catalytic region
IQTLVNSLTAVGETVTSTEHLDLVLDGLPLEYDSSISLISRCVANFTIDEVETMLLEHESRIDMAKKRSLVSVNLTEGNFRANDSFQPSNSNLQGTILVVGALDAVVVVEIILLMSNAKCVTNDENYVATIPMASTTSAASSAVSTVASP

SEQ ID NO: 214733 - protein, 107 aa, Glycine max
  Coding DNA Sequence Number=SeqID_97955
MDAMELSASSFIDSQENRQVEGYDYIFLHGGGGDDPEWVRRFLKEVHKAATTTGMNLRMLYVGKNNKKEQVQKIIDTIQGEELKIKYWKIPSLEHALFQASTQANRR

SEQ ID NO: 214734 - protein, 433 aa, Glycine max
  Coding DNA Sequence Number=SeqID_97956
MDAEAYQMLRELFSKPHTDNMKVLKALIYAQDDILPLYDGVTKKRVSLEPLRRKNVLLLFSGMEISTDELLILEQIYNESKAHAPRMESRYELVWIPIVDPNSEWIEPKQKQFEILQESMSWYSVYHPSLIGKPVIWFIQREWKYKNKPILVVLDPQGRVSCPNAIHMMWIWGSAAYPFTSSREEALWKEETWRLELLVDGIDQEILNWVKDGKYIFLFGGDDPEWVRRFVKEARRVATATQIPLEMVYVGKSNKREQVQKIIDTIIRDKLNTQYWSEQSMIWFFWTRLQSMLFSKLQLKQTDDDDHVMQEIKKLLSYDKQGGWIVLARGSHIVVNGHATTGLQTLVEYDAVWKELADRDGFEPAFKNHYDKVHSIVSPCCRFEFSHSMGRIPERLTCPECRRNMHVLTTFQCCHDEKIDEDFFVSTVTPPTI

SEQ ID NO: 214735 - protein, 255 aa, Glycine max
  Coding DNA Sequence Number=SeqID_97957
MNSIGKLGAMQKLIKGGRAMPAAAISDDSVLVKKIVAEHSPEGIEYDVRPLLHIVEDVLIYSTLSSDSATTAALTRADHVEDRSHRPGHTNMLEALSAKIDRISCEISYKTLNGVDAHSTTIAIFDMLTIYKWDVKIVLALAAFALTYGEFWLLAQIHDTNQLAKSMAILKLLPSIMEHGSSLKPRFDTLNDLVNNILEVTKCVIEFHDLPAQYITQDISAYTTAYNYIPVASYWATRSIVACAAQITSLTTLGY

SEQ ID NO: 214736 - protein, 85 aa, Glycine max
  Coding DNA Sequence Number=SeqID_97958
KTDLTPSCMLHSARGDIAQLVELRSCNWVVAITEDRNMPLKTLLRQRRAVKNVEEGFLIWDPGEEDQAGPCEQLDALSPFNPLSE

SEQ ID NO: 214737 - protein, 69 aa, Glycine max
  Coding DNA Sequence Number=SeqID_97959
  Homolog annotation: Hit_ID=Q1RTC8; Match level="QueryCoverage=97%, HitCoverage=14%, E-value=3e-27, Identity=79%"; Hit description =Remorin, C-terminal region
MKSSLEEKLMKRMSVVHRKAEEWRAEARQQHLEQIHKATEQAQKMIHKHNSQFSRPSSCGCFPCNNNHH

SEQ ID NO: 214738 - protein, 91 aa, Glycine max
  Coding DNA Sequence Number=SeqID_97960
MVPMDRPDATPITIDHCWYYYIPWGFMSHQQLEWFEDINFYLGMEVPHDAQEFEVTPVIEDRGDHTDMMPKEEEVYREFLQNLEPSSKEED

SEQ ID NO: 214739 - protein, 214 aa, Glycine max
  Coding DNA Sequence Number=SeqID_97961
  Subcellular localization annotation: CTP_CleavageSite=35; ConfidenceScore=5.06e-01
SQMDMNVGALISGQITSIAQSNSSRLGFPALIIALCKARGVNSDSLVFEHLSSVINLAYIRKNCWNPDDLTVSIRGARRARTRLAEPPSTSTAPVPARSIPSMEQFAELVAWPGTQSSLRKEDEGPTAQAEETQEAAATLERSLEAASELPAQGEDIPSPQLAADPSTPVLELSEDQTALVLTMNTSPPTTPVLHLTDEEDVQIQDTQDQSQEF

SEQ ID NO: 214740 - protein, 51 aa, Glycine max
  Coding DNA Sequence Number=SeqID_97962
MVLPKRGMFGHRHPKTTTSMPIGRLLTHSYHKYQHGHLLFEESLYRTRFRH

SEQ ID NO: 214741 - protein, 150 aa, Glycine max
  Coding DNA Sequence Number=SeqID_97963
  Homolog annotation: Hit_ID=Q0KIN0; Match level="QueryCoverage=51%, HitCoverage=7%, E-value=7e-09, Identity=29%"; Hit description =Integrase core domain containing protein
MVTEYANDLSGTLGYMEEQLELLLDTIMFKCSFLPRPSRKQIRSQVVDEIGLQPKTIGDEIGLASFMLAFDNWACFPTDKRSTSGYCIFIGDIFISWKSKKHVVKSSADAEHRAMASSTCEFIWLKELMFGDITNTFVNSNDQLADVFTT

SEQ ID NO: 214742 - protein, 263 aa, Glycine max
  Coding DNA Sequence Number=SeqID_97964
  Gene Ontology: Mol. function=methyltransferase activity; Biological process=metabolic process
  Homolog annotation: Hit_ID=Q01AF6; Match level="QueryCoverage=83%, HitCoverage=76%, E-value=6e-55, Identity=51%"; Hit description =Homology to unknown gene
MSPIMQTNLQPISAPHTRTSIKIVSTLNKSYHTNQPPLEGKIKRLVLTQEGRTKLNIYPDREFYAFPRFVKHVDDGFISTLTNLYRERLRPDMEILDLMSSWISHLPSDVKYKKVVGHGLNAQELAKNPRLDFFVVKDLNKDQEFEFESFSFDAVLCIVSVQYLQQPEKVRGFPGTIKSGGVFIVSFSNRMFYEKAISAWSEGTAYSRVQLVVQYFQSVEGFTEPQENMSPIGWIMRLFGLISELDPFYAVIAYRSFKHIHDA

SEQ ID NO: 214743 - protein, 384 aa, Glycine max
  Coding DNA Sequence Number=SeqID_97965
  Gene Ontology: Mol. function=RNA-directed DNA polymerase activity; Biological process=RNA-dependent DNA replication
MAQKRPGFMRLGPTSLSLKTMSEKMARCVATHQEQGHTPRRQKIYIFINKRSYSTRGTDDNHTKAAVLPASQTENQNPSQSPTTSLLGLLGCQSSGWIPKKVADKLVKVQRRFLWCGGELMQSRRRLPGLAGDQLAYQRRKGVWELGSCPNRGTWIRIEGTWQNLYGGGKMECGVWVKGEVLGGWVEGRRCSVDGQIPPRLYLISNQQNKLIQQMGTLSDAAWEWNLQRRRILQDLPIDPNHQDKWVWKGDASGRYTVGSAYKLLDSNSRDENQDGAFRELWKLKISAKASFFAWRLLRDRLPTKNNLCRRNIRKKRQLTCFQLSFDPAVMVEIDVLGKNGGSFPTEPTTALPLAFLLQEFGNSSAAMADLVDLPNLVHMVSQK

SEQ ID NO: 214744 - protein, 78 aa, Glycine max
  Coding DNA Sequence Number=SeqID_97966
MDLVRPLFAWEEDLLRDLMSKLHGVELLAELLKFWTRGTEKFIIPTYGTYLGSEDEKDGALLLACHMLVSLEYEKQYI

SEQ ID NO: 214745 - protein, 194 aa, Glycine max
  Coding DNA Sequence Number=SeqID_97967
MVSNPSRAQKKDKSSKRKQGECSQATLNRLDTWFTNENKNNDFKMIYAMKNQGFNFPNLLEAQGLSKLVQMKGTFYTELKWLLVLKFEESTDDYNKIQTYRGGLTAEDRMFVYHITYILNQGPTTTHRYSNELGTLDRRHHVEEPSITKRRLKKLVKRFFEHEWNMDGEPPATANIDQMEKEAKDEAQQELAHQ

SEQ ID NO: 214746 - protein, 341 aa, Glycine max
  Coding DNA Sequence Number=SeqID_97968
  Gene Ontology: Mol. function=oxidoreductase activity; Cellular component=integral to membrane; Biological process=brassinosteroid biosynthetic process
  Homolog annotation: Hit_ID=Q6F4F5; Match level="QueryCoverage=99%, HitCoverage=69%, E-value=3e-84, Identity=48%"; Hit description =Cytochrome P450 724B1
  Pfam annotation: Domain name=p450; Domain location=36-341; Score= -178.5; E_value=0.0076; Accession=PF00067.12; Description=Cytochrome P450
MVELLAVICTLFSALAFVYLLKYRNKNKQDSPHKLPPGSMGWPFSGETLGFLKPHRSNSLGSFLQERCSRYGKVFKSHLFGSPTIVSCDFEFNMYILQNEGTLFPVDYPKVMHNILGKFSLLLVKGDLHRKLRSTIISFVSATKHESNFLHCVEMLALSRINSWIPISKQVAFYEEAKRFTINVMMKHLLNINPDDPLAFKILGNFENYIKGFISLPIRIPGTAYFKALQARIRLSAIIKDIIIERRKCNNVRPMQGGDLLNVILSKKNLSDEEMVSIVLDLLFGGYETTAKLLSLIVYFLGGASNALESLKEEHQEIRKRKKEGELLNWEDYKQMNFTQM

SEQ ID NO: 214747 - protein, 231 aa, Glycine max
  Coding DNA Sequence Number=SeqID_97969
MTRSTGDVKRATQEFFVVHWLSMCGWFHTLFSKKVGPSIRYKVTARRKNQDSIFMRRMSKCSLDGTRGCINYNPVLAIRQLGYPMRGVPSDESITPFIARGFGDHNARDRELRGSSNGIIGGYHKWLKGLDWLPNLKTVREDEVKASEESDEVQALKAELGRARVVEEKFKSIAIKESSRVKGMISEEVKGFITGQRHDLEGRAKGNMWAIIDKCKEKLNLAATHEQRLED

SEQ ID NO: 214748 - protein, 77 aa, Glycine max
  Coding DNA Sequence Number=SeqID_97970
MKSEREGDGHSSFTRIRKWSSIKEEVEKTHLDLQELKPSTMEEEKKKKKKKKRTPSPSPWRTNTQPGGLLLFYRGKG

SEQ ID NO: 214749 - protein, 66 aa, Glycine max
  Coding DNA Sequence Number=SeqID_97971
GGMMKGKGGQEAGSGLEGFPLGEVMKRFKEGQVHFGDLFAGNYLFMHVNPTSLKCLERDLSLSKIA

SEQ ID NO: 214750 - protein, 185 aa, Glycine max
  Coding DNA Sequence Number=SeqID_97972
  Homolog annotation: Hit_ID=Q1T6D1; Match level="QueryCoverage=61%, HitCoverage=15%, E-value=8e-32, Identity=62%"; Hit description =Quinoprotein amine dehydrogenase, beta chain-like
MGLKAIHSSDQVHLIQLLMTENITFPILLSRQKTPKIEKGACYILFKIFRSPVIYHEKDAGLEILSKAVQELQEQPDGDSKSLNLVRCTSLKQDGIIKDECSFSPLQNLLLYYPEKLTGKFPENEPDKSSLCPLSFLFRYYILEYAFAWNSVGNVYITLLNQNSSCSIDFPSYWHLNLVPQESVS

SEQ ID NO: 214751 - protein, 95 aa, Glycine max
  Coding DNA Sequence Number=SeqID_97973
  Gene Ontology: Mol. function=metal ion binding
  Homolog annotation: Hit_ID=Q5N6Z8; Match level="QueryCoverage=100%, HitCoverage=24%, E-value=1e-18, Identity=48%"; Hit description =Copine III-like
FVNFTEIMSKNIPPSRKEASFALAALMEIPSQYKAAIELNLLGTRQVNALQRHALPPPTYNPHAARFEPSIPPQHGNSHLVATAPSAPSSTYDNQ

SEQ ID NO: 214752 - protein, 54 aa, Glycine max
  Coding DNA Sequence Number=SeqID_97974
MVRGVTLAENLEWLCGSVEEARAWKFRVSYRNSNLERSCSALTVTCGGFGTELT

SEQ ID NO: 214753 - protein, 312 aa, Glycine max
  Coding DNA Sequence Number=SeqID_97975
  Pfam annotation: Domain name=SURF2; Domain location=2-265; Score =100.7; E_value=4.5e-27; Accession=PF05477.2; Description=Surfeit locus protein 2 (SURF2)
KKEGNNLLGLPNFTELGNGRFKCLETGHEVLSKDIASYSHSKKCRLGLIDFALSNNKPPLNMFKQHPLCRSKLICKLTGDNVNKSEEHIWKHMSGKRFLNKLEQEEEEKLLCHGLEGEESLHESKSADGGKKDRMKKKKKKKNRVKEIDEEKLQVSKSADGAKKDRMKKENNKDKGIEEVISEVRKSSNENSDTEDEDFWMPPAGDRWDNDDGGDRWGSESEQGTEEGDVIDGDAAEDCKESDELSSRTKRMSIEIGPSSFATRKKKNIAGEIDEDRGDKIDTERMGPEGLTEEIGNRAEEDELLFQNNYQA

SEQ ID NO: 214754 - protein, 85 aa, Glycine max
  Coding DNA Sequence Number=SeqID_97976
  Gene Ontology: Mol. function=aspartyl esterase activity; Cellular component=cell wall; Biological process=cell wall modification
  Homolog annotation: Hit_ID=Q94B16; Match level="QueryCoverage=50%, HitCoverage=8%, E-value=2e-10, Identity=72%"; Hit description=Pectin methylesterase PME1
  Pfam annotation: Domain name=Pectinesterase; Domain location=28-85; Score=-229.8; E_value=0.00032; Accession=PF01095.10; Description =Pectinesterase
MIEPLQETLSESEGGLLASWSSGTSNADFTVAQDGSDVSGDGFWARDMTFENRAGPRGHQAVALRVSSDLSVFYKCSFKGRNIKE

SEQ ID NO: 214755 - protein, 115 aa, Glycine max
  Coding DNA Sequence Number=SeqID_97977
MKAQVEKDEGLEAEAQSRQLMLLKAQTNLKAQTYQGNPCGVYPDLSSFIGSGVYPDLSSLTGSGVYPDLSSFTGSGVYPDLSSFTGSGVIQIFVACIKRSAPTQVHIIWYQSFGS

SEQ ID NO: 214756 - protein, 85 aa, Glycine max
  Coding DNA Sequence Number=SeqID_97978
  Gene Ontology: Mol. function=pectinesterase activity; Cellular component=cell wall; Biological process=cell wall modification
  Homolog annotation: Hit_ID=Q7XAF8; Match level="QueryCoverage=94%, HitCoverage=14%, E-value=6e-24, Identity=58%"; Hit description =Papillar cell-specific pectin methylesterase-like protein
  Pfam annotation: Domain name=Pectinesterase; Domain location=1-85; Score=-165.1; E_value=3.9e-09; Accession=PF01095.10; Description =Pectinesterase
MEKIVKPAYDFDSSKDSITSYLGRPWKQYSRTLFLKTNLDGLIDPNGWGEWIKDFALSTLYYGEYMNTRSGASTQNRVTWSGFHV

SEQ ID NO: 214757 - protein, 80 aa, Glycine max
  Coding DNA Sequence Number=SeqID_97979
  Gene Ontology: Mol. function=ribonuclease H activity; Biological process=DNA integration
  Homolog annotation: Hit_ID=Q1SAS4; Match level="QueryCoverage=97%, HitCoverage=5%, E-value=3e-20, Identity=42%"; Hit description=RNase H, putative
MEVVLPFKVEIPSLRILAESGLGEAEWARHKDLQGKWAPNYEGPFLVKKAFSGGALILENMDGEELPLPVNSDVVKRYYA

SEQ ID NO: 214758 - protein, 70 aa, Glycine max
  Coding DNA Sequence Number=SeqID_97980
MVMDMADTLGEGFWKWASLYEDPIQLQCDILKEMGLSYKEEDSKVKGLLLDMENKDDLMATEKGIKSQQL

SEQ ID NO: 214759 - protein, 94 aa, Glycine max
  Coding DNA Sequence Number=SeqID_97981
MQSHGLALPPEPKVGPPAARVSTKLSYVDPLRNNLDMGDSDKYELYIDENPPRLVALGRIYEGSTIIHNFPSLELWDPRNLQIGRIMMSMIPYI

SEQ ID NO: 214760 - protein, 126 aa, Glycine max
  Coding DNA Sequence Number=SeqID_97982
MKRRGRGFIGKREVPGGPPLVDAPDRLPLVVAPGRPPLLVAPGRPPLLVAPAHGPENYPKAHENPEAFSCISGIIFLESSIQCPWGVGLHHILNHYMTRHDLQEAYLPATLLFVVAKYYDIDLNTL

SEQ ID NO: 214761 - protein, 196 aa, Glycine max
  Coding DNA Sequence Number=SeqID_97983
  Gene Ontology: Mol. function=DNA binding
  Homolog annotation: Hit_ID=Q10CY9; Match level="QueryCoverage=65%, HitCoverage=17%, E-value=4e-12, Identity=29%"; Hit description =Expressed protein
MESSNVKNKSSGKRKMSSEDTRSYFAWNLEMERVLADVLRDQRNLGNKGGGNWKAVAYSTATQILSKRFGVHLMADNVKNRFKLWRTWYGIVSVILSQSGFDWDSIKYMITVENEIAWSEYVKSHEEAKQFRFKVIPNWDDIVDLCAKDRAIGLGAENALDADDIMSKETNEEEAIHSVSFDLEGSSSATRKNIRP

SEQ ID NO: 214762 - protein, 104 aa, Glycine max
  Coding DNA Sequence Number=SeqID_97984
MHPPPKEFGAMLHDCLSVDPLVQSSILPFFSEPHECHCLALSMLPPPKEFGAMLHDCLSVDPLVQSSILPFFRSPTNVIAKRCSCILHPKSLELCFMIAKVWTL

SEQ ID NO: 214763 - protein, 170 aa, Glycine max
  Coding DNA Sequence Number=SeqID_97985
  Gene Ontology: Mol. function=serine carboxypeptidase activity; Biological process=proteolysis
  Homolog annotation: Hit_ID=Q6JJ33; Match level="QueryCoverage=50%, HitCoverage=19%, E-value=6e-19, Identity=52%"; Hit description =Putative serine carboxipeptidase
MGRIPLSVKNNYARNNHLKPDDGNVQVAIPRPNPLKLGIYGWGLFARRDIQEGEMEAATDLTTLLIELFNSDHILQKSSFFIVAESYGGKFAIHKGKLKLKLGGVVLGDSWISPEDFVFSWGPLLEYLSRLDDKEMQISNEYFNFPPYINTLMKSTETISKMDEREMHTS

SEQ ID NO: 214764 - protein, 146 aa, Glycine max
  Coding DNA Sequence Number=SeqID_97986
  Homolog annotation: Hit_ID=Q97TW5; Match level="QueryCoverage=65%, HitCoverage=31%, E-value=2e-48, Identity=97%"; Hit description =Transposase ISC1290
  Pfam annotation: Domain name=Transposase_33; Domain location=5-140; Score=-34.5; E_value=0.0018; Accession=PF05457.2; Description =Sulfolobus transposase
MKPWIEYYNGPVPYEHLSARHKTLVKMNYMLITSEVLSRLSDLFILRALIVMIVWTCSYRDVWSYYESDVVVRWFLGEYKSKSEIHRRAKKFRGEVVSNLPGEVEKGTILVSSVKKPLGSGWRKGLDKLAEGQYSLPSLLHVPGGL

SEQ ID NO: 214765 - protein, 56 aa, Glycine max
  Coding DNA Sequence Number=SeqID_97987
  Subcellular localization annotation: CTP_CleavageSite=25; ConfidenceScore=5.43e-01
MAPPLTFSPLSSAASPWARRSEAPSASAAPTPPTSAPSTSALPSPSAAPVHPGPST

SEQ ID NO: 214766 - protein, 86 aa, Glycine max
  Coding DNA Sequence Number=SeqID_97988
MFESLKTNTNWMKNEERMKNDVEVDYGRKPEASLDEPGVNKARWYSADFHPLAKKTFWLSKPSAEREEESGRRMSCACSLSEGPSR

SEQ ID NO: 214767 - protein, 347 aa, Glycine max
  Coding DNA Sequence Number=SeqID_97989
  Gene Ontology: Mol. function=chitin binding; Cellular component =extracellular region; Biological process=chitin metabolic process
  Homolog annotation: Hit_ID=UPI000044A8F0; Match level="QueryCoverage =99%, HitCoverage=99%, E-value=6e-33, Identity=28%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
VLTFRGLHVLAFRGLHVLAFRGLHVLAFRGLHVLAFRGLHALTFRGIHVLAFRGLHALTFRGLHVLTIRGLHALTFRGLHVLAFRGLHTLTFRGLHVLNFRRMHALTFRGLHVIAFRRLHALTFRGLHVLAFRGLHFLAFRGLHVLAIRGLHALTFRGQHVLAFRGLHTLTFRGLHVLLFGGLRVLTFRGLHVLNFRGLHRTTCPHHPRTTGPRLQRTTCPHLLKTKRSRLQSTTCPHLQRTTCPRLQRATRPRLQRTTCPRLQRTTRPRLQKASRPHLQRTIRPHLPRAECPHLQRTTRPCHHRAARPHHQRTTRPRLQRPAHPHLQRTTCPRLHRDACPHLQRTT

SEQ ID NO: 214768 - protein, 181 aa, Glycine max
  Coding DNA Sequence Number=SeqID_97990
  Gene Ontology: Mol. function=inorganic diphosphatase activity; Cellular component=cytoplasm; Biological process=phosphate metabolic process
  Homolog annotation: Hit_ID=Q2HTA8; Match level="QueryCoverage=92%, HitCoverage=79%, E-value=3e-87, Identity=90%"; Hit description =Inorganic pyrophosphatase
  Pfam annotation: Domain name=Pyrophosphatase; Domain location=50-177; Score=226.7; E_value=5e-65; Accession=PF00719.9; Description =Inorganic pyrophosphatase
MSDENNEEPCENRPVPRLNERILSSLSRRSVAAHPWHDLEIGPGAPMIFNCVVEITKGSKVKYELDKKTGLIKVDRVLYSSVVYPHNYGFIPRTLCEDNDPIDVLVLMQEPVLPGCFLRARAIGLMPMIDQGEKDDKIIAVCADDPEYKHYTDFKELPPHRLMEIRRFFEDCILKNLIPIT

SEQ ID NO: 214769 - protein, 181 aa, Glycine max
  Coding DNA Sequence Number=SeqID_97991
  Gene Ontology: Mol. function=O-methyltransferase activity; Biological process=lignin biosynthetic process
  Homolog annotation: Hit_ID=Q2HTB3; Match level="QueryCoverage=99%, HitCoverage=54%, E-value=9e-49, Identity=51%"; Hit description=O -methyltransferase, family 2
  Pfam annotation: Domain name=Methyltransf_2; Domain location=1-181; Score=134.5; E_value=3e-37; Accession=PF00891.8; Description=O -methyltransferase
MQFWKELGSPFNRIHGKQVFEDFHMNSSFNQLFMAAMTNRATLITKKIVESYKGFENINKLVDVGGGVGATLNIITSKYPHIKGINFDLPHVWSMWEEIYMFESVPQGDAILMMCVLHDWSDEWCLKVLKNCYVAIPNDGKVIVEEVLPFEPLTTGAVKSISQFDVLMMTTNPGARREREK

SEQ ID NO: 214770 - protein, 136 aa, Glycine max
  Coding DNA Sequence Number=SeqID_97992
  Gene Ontology: Mol. function=voltage-gated potassium channel activity; Cellular component=integral to membrane; Biological process=potassium ion transport
  Homolog annotation: Hit_ID=Q9LEQ3; Match level="QueryCoverage=52%, HitCoverage=10%, E-value=8e-18, Identity=57%"; Hit description =Putative cyclic nucleotide-gated ion channel 18
  Subcellular localization annotation: CTP_CleavageSite=61; ConfidenceScore=5.59e-01
MTRTFVSIFLVSSASSGDSGLDRRQRQRERRSTLSRSYGITKSWTPTATSWPIGTGCSLLRASSPSSSTLSTSSSPTLAAPPASRLIPNSARRGSGDSGGGRKEEVEREEGLEDLVRRVWRGGLGYCKCGVIRTYS

SEQ ID NO: 214771 - protein, 99 aa, Glycine max
  Coding DNA Sequence Number=SeqID_97993
  Homolog annotation: Hit_ID=Q9LEQ3; Match level="QueryCoverage=53%, HitCoverage=7%, E-value=9e-17, Identity=68%"; Hit description =Putative cyclic nucleotide-gated ion channel 18
  Subcellular localization annotation: CTP_CleavageSite=52; ConfidenceScore=5.56e-01
TPVLPSKPSSPSPPIPPLAPLLPSFLHRCRRFLRRRRPIRVHLPLLAEFGISLEAGGAANVGEEEVERVDEEGEEARNKEHPVPIGHDVAVGVQDLVMP

SEQ ID NO: 214772 - protein, 129 aa, Glycine max
  Coding DNA Sequence Number=SeqID_97994
  Gene Ontology: Mol. function=O-methyltransferase activity; Biological process=lignin biosynthetic process
  Homolog annotation: Hit_ID=Q2HTB3; Match level="QueryCoverage=88%, HitCoverage=35%, E-value=3e-23, Identity=49%"; Hit description=O -methyltransferase, family 2
  Pfam annotation: Domain name=Dimerisation; Domain location=20-56; Score=26.9; E_value=7.1e-05; Accession=PF08100.2; Description =Dimerisation domain
MEEESFTYAMQLVNSNVLSMAMYSAIELGIFDIIAKAGEAAKLSAKDIAAQLPLLACHSIIDCTVVADQHALPIHLQRLYGMNAVAKYFASIDDGAGSLGPFMMLAQDKAALQTWSVFPFLYSTLLSGE

SEQ ID NO: 214773 - protein, 96 aa, Glycine max
  Coding DNA Sequence Number=SeqID_97995
  Subcellular localization annotation: CTP_CleavageSite=47; ConfidenceScore=5.34e-01
MPYPTRWGRLHGSTSAMMFYQRVMNCNPRQQSTHAFGSGTQQFLRAQRSHIKGRPLKYQVSPLVDVTSPTVNTWVCMWYTATLKGTRTIKIFGRYF

SEQ ID NO: 214774 - protein, 91 aa, Glycine max
  Coding DNA Sequence Number=SeqID_97996
  Gene Ontology: Cellular component=chloroplast
  Homolog annotation: Hit_ID=Q2HTB6; Match level="QueryCoverage=76%, HitCoverage=45%, E-value=3e-14, Identity=53%"; Hit description =Thylakoid membrane phosphoprotein 14 kDa, chloroplast
  Subcellular localization annotation: CTP_CleavageSite=61; ConfidenceScore=5.68e-01
MASTSSALTISSSSTLLDGKAPRQSPAASPQCVSLPPPPLHSQNRSWKTTAYCRKVARKVMAMATGEAPAEATSTEVPEIVKTLQETVRVS

SEQ ID NO: 214775 - protein, 50 aa, Glycine max
  Coding DNA Sequence Number=SeqID_97997
MWLKFLSFFLVSELLDNLEMSVEMLFPGLEMQQNHSFLFFWIVCADMAAR

SEQ ID NO: 214776 - protein, 387 aa, Glycine max
  Coding DNA Sequence Number=SeqID_97998
  Gene Ontology: Mol. function=transcription regulator activity; Cellular component=nucleus; Biological process=regulation of transcription
  Homolog annotation: Hit_ID=Q2HTN6; Match level="QueryCoverage=53%, HitCoverage=60%, E-value=5e-44, Identity=48%"; Hit description=Helix- loop-helix DNA-binding
  Pfam annotation: Domain name=ACT; Domain location=316-384; Score =14.9; E_value=0.047; Accession=PF01842.15; Description=ACT domain
  Pfam annotation: Domain name=HLH; Domain location=186-237; Score =61.2; E_value=3.4e-15; Accession=PF00010.16; Description=Helix-loop -helix DNA-binding domain
  Pfam module annotation: Pfam domain module=ACT::HLH; Domain location =316-384::186-237
MEPYIPSFELKLGCMKFFGDPLEVNCLDQVLVDEESLRLEEEEQFLISSLEDNMPFLQMLQSVESPQFFPLKEPNFQTLLRLQHMKKPWEGIAYIPRMEAQVQAALELESCVTHDMLEMQSPVKSESNELQHPLSISCFEKVNYECNQEPQKVSQTCPKSQPAATRERRKRKRTRPSKNKEDVENQRMTHIAVERNRRRQMNDHLSVLRSLMPPSYIQRGDQASIIGGAIDFVKELEQLLQSLEAQKRMRKNEEGGGGSSSSTMLCKPPPPSSLSSPHGYGMRSSTSDEVNCGDEVKAENKSEAADIKVTLIQTHVNLKIECQRRPGQLLKVIVALEDLRLTILHLNITSSETSVLYSLNLKIEEDCKLCSASDIAEAVHQIFSFIN

SEQ ID NO: 214777 - protein, 120 aa, Glycine max
  Coding DNA Sequence Number=SeqID_97999
MASSCAAASEVFESLALSKGKTVGIPHSEASEGTACCPLSLISETALPLLVSGFLHPPELGPNNSLPKGLQRTARERIYHKELKIMKWGWRKRKRKKKEKAVDGKELRGPWSLSMMKAEQ

SEQ ID NO: 214778 - protein, 235 aa, Glycine max
  Coding DNA Sequence Number=SeqID_98000
  Gene Ontology: Mol. function=cation transporter activity; Cellular component=membrane; Biological process=cation transport
  Homolog annotation: Hit_ID=Q6S356; Match level="QueryCoverage=98%, HitCoverage=67%, E-value=9e-78, Identity=64%"; Hit description=Heavy metal transporter MTP2
  Pfam annotation: Domain name=Cation_efflux; Domain location=4-235; Score=31.8; E_value=1.8e-10; Accession=PF01545.11; Description =Cation efflux family
MDFPNRDLGALVSIQMIWLLAGILVYEAIDRIIAGPKNVDDQHHHTHHHDENHPKDAHHHTDEDHLHHHAHKEVTELLLGESKGGTKKKKQWNINVQGAYLHVLGDSIQSIGVMIGGAVIWYNPRWQIVDLICTLIFSVIVMGTTINMLRNILEVLMESTPREIDATKLERGLLDMEDVVAVHELHIWAITVGKVLLACHVKIRREADADLVLDKVIDYIKRVYNISHVTIQIER

SEQ ID NO: 214779 - protein, 246 aa, Glycine max
  Coding DNA Sequence Number=SeqID_98001
  Gene Ontology: Cellular component=cellulose and pectin-containing cell wall
  Homolog annotation: Hit_ID=Q2HTB8; Match level="QueryCoverage=82%, HitCoverage=92%, E-value=1e-61, Identity=57%"; Hit description =Harpin-induced 1
  Pfam annotation: Domain name=Hin1; Domain location=88-226; Score =153.2; E_value=6.9e-43; Accession=PF07320.4; Description=Harpin -induced protein 1 (Hin1)
MAEMQIQHQEDHNHNPNHILRPNPNPNPNPTQYTHYRFPGKVPHHQHQVHNMDKGAASRFKPNAPKREHCICITVFLLLLGIILLVLWLAYHPTKPRFTVASAAVYGLNATSPPLMSIAMQFNMVIRNPNRRVSISFDRLSAYVSYRNQPVTPHVMLPPLFIEKHSAVSLSPEIGGVPVPVSEDVSNGLAMDENYGVVGVKLVLFGRLRWRAGDINSAHYGLYVKCDVLMGLRKGFVGQVPLLGAP

SEQ ID NO: 214780 - protein, 97 aa, Glycine max
  Coding DNA Sequence Number=SeqID_98002
MRPSESIEAKKLASGSKEGGRRVGFGVIEGERERLVIGSGGGGSERERRREVEPKKWVLLYRREVAERSIFGFVRTIFILDNSGAAVNDIIVDEFKD

SEQ ID NO: 214781 - protein, 449 aa, Glycine max
  Coding DNA Sequence Number=SeqID_98003
MELDLRSFLHSPTSTSSSDADADDGAPPRTIDDILNDCDTSSSSPSPPSSPSHSLSNNSRPQNPTLQQKPLQPAPDSFSRVKPAEFSDRARVSRPFSSLLHGVRSNAKPGAALAAAAAASRSVPTPHAAAIISRRKSAAANIVESSSIAATGDVSSKGELGEPSEKFDPVPPKIETPSSESASAIGERFEIDAEIVTDLKAGSDDIQVHTDNNNNNADDDDDNDNDSSIVSEEKRDLDEVDRDHEKDMNSAPFDDDDDRGFDGKGDDERITATGVAVETEEEVVVSNDISSMEDVKNEVSVGGDDEGSSLGDVAELVEERLEELENRRAAKRAEKKRESSMKPLELAEELEKKRASTGLHLEEGAAAQPMRLEGVRRGSTTLGYFDVDAGNAFTRAISSQTFRREQGSTRALAVHANYIAVGMSKGLIVVFPSKYSIHHADNSDGKVGA

SEQ ID NO: 214782 - protein, 244 aa, Glycine max
  Coding DNA Sequence Number=SeqID_98004
  Pfam annotation: Domain name=WD40; Domain location=2-39; Score=19.6; E_value=0.011; Accession=PF00400.22; Description=WD domain, G-beta repeat
MMLAIQGDRLHAPVTSMSFNQQGDLLLAGYGDGHLTLWDVQKGVVAKVISGEHTAPVVHTLFLGQDPQNTRQFKAVTGDCKGLVLFHIISVVPLFSRFSIKTQCLLDGQSTGLVLSASPLLFDDFSGSASPYTQGNTSAPASSISSMMGGVVGGDAGWKLFNEAPSLVEEGVVVFVTHQTALVVRLSPTLQVYAQLSRPDGVREGSMPYTAWKYMTQICSSTDKTVQVVLNKGNTKHLWCCLPK

SEQ ID NO: 214783 - protein, 1206 aa, Glycine max
  Coding DNA Sequence Number=SeqID_98005
  Gene Ontology: Mol. function=metal ion binding; Cellular component =nucleus
  Homolog annotation: Hit_ID=Q6Z706; Match level="QueryCoverage=36%, HitCoverage=89%, E-value=1e-104, Identity=47%"; Hit description=VacA protein-like
  Pfam annotation: Domain name=zf-C3HC4; Domain location=1058-1106; Score=15.2; E_value=0.0042; Accession=PF00097.15; Description=Zinc finger, C3HC4 type (RING finger)
MSAEAVERVSLLAIAWERKVLVAKLVKSELKVYGRWSLDGAALGLAWLDDQMLVVLTSSGQLYLFSKDGTVIHQTSFSVDGIGGDDLVSYHTHFINIFGNPEKAYHNSVAVRGASIYILGPTHLLVSRLLPWKERISVLRKAGDWMGALNMGMTLYDGHAHGVVDLPRTLDAVHEAIMPFLMELLTSYVDEVFSYISVAFCNQIGKLDQSNDSNSRSNSVHSEIKEQYARVGGVAVEFCCHIKRTDILFDEIFNKFVDVQQRETFLELLEPYILKDMLGSLPPEIMQELVEYYSTKGWLQRVEQCVLHMDISSLDFNQVVRLCREHGLYSALVYVFNKGLDDFRAPLEELFAVLQNSQKESATALGYRMLVYLKYCFTGLPFPPGRGSIPPSRLPSLRRELVEFLLKDTCTPKSQTVSDFVYRRPHLNLYLLLKLDTEATLDVLRCAFMEDGISNASSSSPDSANKPITEAKKENDNVNKTQNALVQNTVDALIQIIDMNIVPTDKTSSSGDDGLIKDCPSKDIGYLFEFIAYYVALQRAKISKGVLCQILEYLTSDSQFSTNVSVQGSSPKNREKQVLALLEILPESDWDASFVLDLCERAKYHQVCGLIHSIRHEYVAALDSYMKDADEPVHAFSFINRAFSQLTDNDHAAFRSAVIFRIPELVELSREGAFHMVISHFSNESSRIITDLHCHPRSLFLYLKTLIELHLFGTLDLSNLRKDGTMNPLNGRQVKDHPQGVRDYLENISNFPKYMRENPIRVPDDLIELYLELLCKYEGGSVLKFLEMFDSYRVEHCLRLCQEYGIIDASAFLLERVGDVGSALSLTLSDLYDKFVELDTAVEAVVLNHRRVGSSHMEVFNSVLKTKEVSDIHNLLRACIGLCQRNTPRLNPEESEAHWFKLLDSFCDPLMDSNVEERAYESKSYFGMLAGSADSQQDKDTHKSSWKISKSWTGHILKKLLSQFIKEIVEGMIGFVHLPTIMSKLLSDNGSQEFGDFKLTILGMLGTYGFERRILESKYCSNLGPDAAKSLIEDDSFYTMSLLKKGASHGYAPRSLVCCVCNCPLTKNSVSSGIRIFNCGHAIHLQCEVSEIEGSSKTSSSGCPVCPVCMPNQKSQQSRNKSIIAANGLVNKFSSRPQYPHGSSIHPHDSDLSDNMYGQQQISRFEILSSLQKNRRFMQIENLPPLKLAPPAVYHEKARRRPISGD

SEQ ID NO: 214784 - protein, 384 aa, Glycine max
  Coding DNA Sequence Number=SeqID_98006
  Gene Ontology: Mol. function=protein dimerization activity; Cellular component=nucleus; Biological process=regulation of transcription, DNA-dependent
  Homolog annotation: Hit_ID=Q2R4E7; Match level="QueryCoverage=99%, HitCoverage=43%, E-value=1e-106, Identity=50%"; Hit description=HAT family dimerisation domain containing protein
MNQNQHIEVVISKQSEQVRDLYRRRLTVSIDCICFLLKQGLAFCGHDESTNSANQGNFLELLRFPAEHNESINHDVLENAPENHQLIAPKIQKDIVNAIALETTNAIITDLRDELFAIIVDEARDISNKEQMAIALRYVNKKGSIVERFFGMVHVKDITALSLKMAIDELFCKHGLNISRIRGQGYDSASNMQGEFSGLKSLILKENSSAFYVHCFVHQLQLTLVAVAKNHIQVASLFNLVSTLLNVVGGSCKRHDMLREKQINYVRKALGKGEIPSGQGLNQETSLKRAVDTRWGSHYATLINLILMYSSIVDVLEIIKEDGSNADQRAEANGLLHLLEDFDFAFTLHLMKNVLGISNELSQALQRKDQDIINAMNLVNITKL

SEQ ID NO: 214785 - protein, 285 aa, Glycine max
  Coding DNA Sequence Number=SeqID_98007
  Gene Ontology: Mol. function=nucleic acid binding; Cellular component= nucleus; Biological process=nuclear mRNA splicing, via spliceosome
  Homolog annotation: Hit_ID=O81034; Match level="QueryCoverage=56%, HitCoverage=55%, E-value=2e-47, Identity=60%"; Hit description =Putative RNA-binding protein
  Pfam annotation: Domain name=RRM_1; Domain location=20-90; Score =74.5; E_value=3.3e-19; Accession=PF00076.12; Description=RNA recognition motif. (a.k.a. RRM, R
MVGDNINSRQYNIDINSTKIFVGGLAWETQRDTMRRYFEQFGEILEAVVITDKNTLKSKGYGFVTFKDPEAAMKACQNPSPIIDGRRANCNIASIGANKNRTRAPQHQHGRSRAAPGVLASPAYHGTSSTFVHQNSGQYTFPNSSFGYTGYSQGTIYPLSCYGVFGGQQISTYYPSNGASGQVGLVHNIYPFSAQYSYNSHSHGFGVQYPQMMQFPILPRHYGSAGILALPSSMPMPNISAVTTTATTTTAEAIRTSVGTSQTAGTTSEQNSSAESLHRQTHDAL

SEQ ID NO: 214786 - protein, 42 aa, Glycine max
  Coding DNA Sequence Number=SeqID_98008
MYRGPWRLRSHVDLGDGVWIIWLAMVLVEACRQRRCFRLDYK

SEQ ID NO: 214787 - protein, 541 aa, Glycine max
  Coding DNA Sequence Number=SeqID_98009
  Gene Ontology: Mol. function=protein serine/threonine kinase activity; Cellular component=cytosol; Biological process=protein amino acid phosphorylation
  Homolog annotation: Hit_ID=Q9M269; Match level="QueryCoverage=95%, HitCoverage=73%, E-value=1e-112, Identity=47%"; Hit description =Serine/threonine-protein kinase-like protein
  Pfam annotation: Domain name=Pkinase; Domain location=16-296; Score =315.7; E_value=8.2e-92; Accession=PF00069.15; Description=Protein kinase domain
  Pfam annotation: Domain name=Pkinase_Tyr; Domain location=16-296; Score=110.8; E_value=4.1e-30; Accession=PF07714.7; Description =Protein tyrosine kinase
  Pfam module annotation: Pfam domain module=Pkinase::Pkinase_Tyr; Domain location=16-296::16-296
MTMMMELGGPRVIGDYIVGPRIGSGSFAVVWRARNRSSGLEYAVKEIDKRHLSPKVRENLLKEISILSTIHHPNIIRLFEAIQVSCLISDSVLDSIVSKGGCLWETKKRIYLVLEYCAGGDLAAYIHRHGKVSEPVAHHFMRQLAAGLQVLQEKNLIHRDLKPQNLLLATTAATPVMKIGDFGFARSLTPQGLADTLCGSPYYMAPEIIENQKYDAKADLWSVGAILYQLVIGRPPFDGNSQLQLFQNILASTELHFPPDALKVLHSDCLDLCRNLLRRNPDERLTFKAFFNHNFLREPRPTVNVEQFQLHQSERLTDHQLGVSASEKISQSHSKYHVVDNPVVVSSAADETMLLQRKDGKITAGTKSAKGSTPTIASDKLGKAVDAGAHLSNQPLGLIVSGYCVAFSHLMESIEKDYVFVNSHFASFEAFSDYFEASVQNISSHRISLFSSKRTNMEVGHAKQTKDLPFSSTEVLENLKSNKQEACVASCEFAALRKENGISSLLPSNRLQLLHQYVRILAELSQEKVRLCHSVNLRSLC

SEQ ID NO: 214788 - protein, 386 aa, Glycine max
  Coding DNA Sequence Number=SeqID_98010
  Gene Ontology: Mol. function=identical protein binding; Cellular component=cytoplasm; Biological process=negative regulation of enzyme activity
  Homolog annotation: Hit_ID=Q1SHG8; Match level="QueryCoverage=95%, HitCoverage=49%, E-value=1e-132, Identity=65%"; Hit description =Protease-associated PA; Proteinase inhibitor I9, subtilisin propeptide
  Pfam annotation: Domain name=PA; Domain location=35-146; Score=13.2; E_value=0.014; Accession=PF02225.12; Description=PA domain
  Pfam annotation: Domain name=Peptidase_S8; Domain location=25-289; Score=-69.1; E_value=0.0045; Accession=PF00082.12; Description =Subtilase family
  Pfam module annotation: Pfam domain module=PA::Peptidase_S8; Domain location=35-146::25-289
MERGIFVSTSAGNEGPFLAVLHNGIPWVITVAAGTLDREFQGTLTLGNGVQVTGMSLYHGNFSSSNVPIVFMGLCNKMKELAKAKNKIVVCEDKNGTIIDAQVAKLYDVVAAVFISNSSESSFFFENSFASIIVSPINGETVKGYIKSTNSGAKGTMSFKRTVLGTRPAPSVDDYSSRGPSSSCPFVLKPDITAPGTSILAAWPQNVPVEVFGSHNIFSNFNLLSGTSMACPHVAGVAALLRGAHPEWSVAAIRSAIMTTSDMFDNTMGLIKDIGDGYKQASPLALGAGHVNPNRGLDPGLVYDVRVQDYVNLLCALGYTQKNITIITGTSSNDCSKPSLDLNYPSFIAFINSNGSSAAQEFQRTVTNVGEGKQSMMPAYTRQRYH

SEQ ID NO: 214789 - protein, 492 aa, Glycine max
  Coding DNA Sequence Number=SeqID_98011
  Gene Ontology: Mol. function=RNA-directed DNA polymerase activity; Cellular component=chromatin; Biological process=DNA integration
MILLGYHAIGGYKLFNPVTKEVLVSRDMVVDESKDWNWDKEMVEKPTKVVIEAPIDEPSDYFAVVIDDSDQGRVRKSQRARQVSSRLQDYELIHDSAIGEEGELVHLALFAESESLKAIEKNNTWQLVPLPAKKKPIVVKWVYKVKKNLKEEISKYKARLVAKGFLQKAGTDFNEVFALVARMETVRIITAIASQKGWHMHHMDVKSAFLNGPLEEEVYMSQPPGFEIKGSEEKVYRLNKALYGLKQTPRAWNRRIDGFLMKLGFLKCTTEHGVYIKGSNTTNLTIVCLYIDDLLVTRNNETEIANFEEEMMREFEMTDLNLISYFLGIEFKRIDEGVIMHQGRYMENPKLSHFRAAKRIMSDSDWCGDKSDRKNTTAYVFFYGDAPISWSSKKEQVVASSLLIELKMKEKGAITLMVDNKFSINLAKHPVAHGRSKHIKTQFHFLIEQVTKGKLSVEYCPTTVQVADIFTKPLKNDQFKELSSRLGVIEVE

SEQ ID NO: 214790 - protein, 270 aa, Glycine max
  Coding DNA Sequence Number=SeqID_98012
  Gene Ontology: Mol. function=nucleic acid binding; Cellular component= chromatin; Biological process=DNA integration
  Homolog annotation: Hit_ID=Q1T010; Match level="QueryCoverage=99%, HitCoverage=25%, E-value=1e-83, Identity=46%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
NPKGEISKYKARLVAKGFLQKAGIDFKEVFAPIARMETVRIITAIASQKGWHMHHMDVKSAFLNGPLDEEVYVSQPPGRIDGFLMKLGFLKCTTEHGVYIKGSNTTNLTVVCLYVDDLLVTGNNETKIANFKGEMMREFEMTDLDLISYFLGIEFKRADEGVIMHQGRYARDVLKKFIMVDCNSADTSTATGVNLVKDPNEEEVDVTLYRQMVGSLRYMENPKLSHFRAAKRIMSDSDWCGDKSDRKSTEGYVFFYGDAPISWSSKKEQV

SEQ ID NO: 214791 - protein, 156 aa, Glycine max
  Coding DNA Sequence Number=SeqID_98013
  Gene Ontology: Mol. function=protein serine/threonine kinase activity; Biological process=protein amino acid phosphorylation
  Homolog annotation: Hit_ID=Q10SI6; Match level="QueryCoverage=47%, HitCoverage=11%, E-value=5e-18, Identity=58%"; Hit description =Protein kinase domain containing protein, expressed
MASITKSELPGSSSANESISARDINLPQSTEQKINFSDPSSISLIYLNYVLQKPIAEATEMPDAMEIIFQKALLIGTSGAVDEYMEIRDRAAASYSKAMLLLSFIVAEAENLPLNPPFSLVATNKERISQYIHSLQSRKESSSESSSKKVLILLSK

SEQ ID NO: 214792 - protein, 65 aa, Glycine max
  Coding DNA Sequence Number=SeqID_98014
  Gene Ontology: Mol. function=DNA binding; Cellular component=nucleus; Biological process=regulation of transcription, DNA-dependent
  Homolog annotation: Hit_ID=Q8L5P7; Match level="QueryCoverage=84%, HitCoverage=6%, E-value=4e-18, Identity=82%"; Hit description=LHY protein
MDAYSSGEEVVVKVRLIVVTRKPYTITKQRERWTEEEHNRFLEALKLHGRAWQRIEGDSVFIIST

SEQ ID NO: 214793 - protein, 54 aa, Glycine max
  Coding DNA Sequence Number=SeqID_98015
MRSIPMNQELEIFEQGIKLSKLAHPMVRWAKLNQALKIEALKVVGPNTTGPIFA

SEQ ID NO: 214794 - protein, 69 aa, Glycine max
  Coding DNA Sequence Number=SeqID_98016
MVGPSGDVARSTACTRSPGCARRGPFGPSGGDIRPAWPLTFGHCHVAARWGFIGRCSIRACGGHVHVFG

SEQ ID NO: 214795 - protein, 111 aa, Glycine max
  Coding DNA Sequence Number=SeqID_98017
  Gene Ontology: Mol. function=protein kinase activity; Biological process=protein amino acid phosphorylation
  Homolog annotation: Hit_ID=Q1SAG3; Match level="QueryCoverage=88%, HitCoverage=17%, E-value=2e-13, Identity=47%"; Hit description =Protein kinase; Integrase, catalytic region
MTIPLPPLKYVPITFPPSKSSFALKTLATSEGNDSPLKRIIMYPPTLPQELDFPTALRKGDALSYLGWQQAMIDEMCALQSSGTWDLVLLPLGKSIVDRRCIFTVKLGFDS

SEQ ID NO: 214796 - protein, 183 aa, Glycine max
  Coding DNA Sequence Number=SeqID_98018
  Gene Ontology: Mol. function=carboxyl- and carbamoyltransferase activity; Cellular component=ornithine carbamoyltransferase complex; Biological process=amino acid biosynthetic process
  Homolog annotation: Hit_ID=Q8RCA4; Match level="QueryCoverage=62%, HitCoverage=36%, E-value=2e-37, Identity=65%"; Hit description =Ornithine carbamoyltransferase
  Pfam annotation: Domain name=OTCace; Domain location=1-126; Score =112.0; E_value=1.7e-30; Accession=PF00185.14; Description =Aspartateornithine carbamoyltransferase, AspOrn binding domain
MVGAAKMGMHYVICSPESLRPEKWLVDECMKFAAESGAKIEFTDNPEEAVKGADVIYTDVWASMGEEDKAAERRKLLQPYQVNEELMKKTGKPETIFMHCLPAVKGEEVTFEVIEAYIFVALASPVPFIYSALLSASAFIIAAFLSASDLIFCASFSPSALINAAMLCLSDFILSNTAFLFSA

SEQ ID NO: 214797 - protein, 101 aa, Glycine max
  Coding DNA Sequence Number=SeqID_98019
  Pfam annotation: Domain name=zf-CCHC; Domain location=23-40; Score =29.9; E_value=8.7e-06; Accession=PF00098.13; Description=Zinc knuckle
MRGSQRRQNFKPKRRTEESSQIPKCFECNQPGHMRADCPIFKRKIEKSEKKTIGDKKAKKAYITWDDNDLESFDDSEKEMVNLCPMGKNYESNEEQICRRN

SEQ ID NO: 214798 - protein, 232 aa, Glycine max
  Coding DNA Sequence Number=SeqID_98020
  Homolog annotation: Hit_ID=Q9AVH2; Match level="QueryCoverage=20%, HitCoverage=16%, E-value=9e-20, Identity=97%"; Hit description =Putative senescence-associated protein
MTEGCGEGFCLANLPGDAFSLWGNFFEAKKQMMADAKFAGLLGLGKPLVEILPPGQLRGFCPLLAWLGSAVLGYGPVLSFGLVGPLLPPVISFVARILPTLACAPLAKSGRIKATRAESQWIVAARPLCHLQYPVAYLSRLQRILPAARWELRFKASRRANPPHEGHQRHVPLGGRGPLLLVGKRTAGARVASSPDSDLEAFSHNPTHGSFAPLAFQPSAMTNCANQRFLSY

SEQ ID NO: 214799 - protein, 106 aa, Glycine max
  Coding DNA Sequence Number=SeqID_98021
STKAGLLLLRTLHRRGNQTYAVLFKGESSDSFYLEGDHFKALDLKNDPFTWRENGLNDRLKLVKNGRKETKIERNKNESQETRNELKVSDLETYPLKNEERMKNGE

SEQ ID NO: 214800 - protein, 107 aa, Glycine max
  Coding DNA Sequence Number=SeqID_98022
MPRTHDTILYYNGKWNMPPQNKFVGCAFTGKNPKKFQIPSTCTIDELKNLIKQVAPKGIPPLGIHESQTVLIQSNYWKKYGPIEILVVFTKYVVKIEYEVTGTSLNN

SEQ ID NO: 214801 - protein, 80 aa, Glycine max
  Coding DNA Sequence Number=SeqID_98023
  Subcellular localization annotation: CTP_CleavageSite=45; ConfidenceScore=5.17e-01
MNLLPSAVHVSSTIESGAPRIDCLAMFANSPFSNLIQRPTNSLPSAVHVSSTIESGAPRIDWLALFAYPPASNLVRRPMN

SEQ ID NO: 214802 - protein, 148 aa, Glycine max
  Coding DNA Sequence Number=SeqID_98024
  Gene Ontology: Mol. function=serine carboxypeptidase activity; Biological process=proteolysis
  Homolog annotation: Hit_ID=Q1EP77; Match level="QueryCoverage=38%, HitCoverage=11%, E-value=1e-10, Identity=66%"; Hit description =Serine carboxypeptidase (Carboxypeptidase D), putative
MALCSVFLNLHLWLFVCLTIEALGVPKPSVASYLSQELLAEQEVDRVHGLLAQPPVKLNNMLVISLSMKLKEEICSIGFSRPPINRNKNPFSYGSMEVYDYLVDTAAFVQTRESINEFLTSVKQHDLAKAKVLSILNIGPAADFELYP

SEQ ID NO: 214803 - protein, 205 aa, Glycine max
  Coding DNA Sequence Number=SeqID_98025
MGVKIEVVFGEEPKDDAQELVEDLIYIITSFAGKIYGMRSHKKTLLVQALKEVEKEYREVLEEAINYGLSNKTTSFTRIKAGVYKTEREKHKDLPSHYIYTACEDASERLDSFEKLKKRGRSYTEKPSVRRVTIHLDDHLWKFNLDRISISTKRSRVFISPTFPKIFWRYYNKGWRIASEARFRLMKGNVVEFYVIFKRDEPKPY

SEQ ID NO: 214804 - protein, 143 aa, Glycine max
  Coding DNA Sequence Number=SeqID_98026
MGEVEEVQEQVKADTEALKEQMATMMEAMMSIKEIMEVNAVAIAATSTIAECKNKHAFPPYDLPPNYTPPNVAYTPSEDVNNSAPILFESRQPQTDHAHVSQTMGETHEIPHHNLADFEPCLGYATEGQAVGGIPLQNTLESP

SEQ ID NO: 214805 - protein, 191 aa, Glycine max
  Coding DNA Sequence Number=SeqID_98027
  Gene Ontology: Mol. function=protein serine/threonine kinase activity; Cellular component=nucleus; Biological process=protein amino acid phosphorylation
  Homolog annotation: Hit_ID=Q84VT0; Match level="QueryCoverage=94%, HitCoverage=59%, E-value=2e-41, Identity=49%"; Hit description =Putative cyclin dependent kinase A
  Pfam annotation: Domain name=Pkinase; Domain location=2-189; Score =54.3; E_value=4e-13; Accession=PF00069.15; Description=Protein kinase domain
  Pfam annotation: Domain name=Pkinase_Tyr; Domain location=2-190; Score=-98.0; E_value=1.9e-06; Accession=PF07714.7; Description =Protein tyrosine kinase
  Pfam module annotation: Pfam domain module=Pkinase::Pkinase_Tyr; Domain location=2-189::2-190
MVSILNEENQANNGVPYWIIREISILKELDHINIVRLIDVMTDGPDLFLVFEYLDNEFQADFLKNPKMFMYPQMKKEFLYQILNTVAYLHARKILLRDLRPENILVNVRTQVLKIALFGAARTFEAPLEAYSSSVGCLSYRSPEVLFQSGCEKYSTPNDVWAVGCIFGEMLLHRPLFSGPSDVELLDEIFT

SEQ ID NO: 214806 - protein, 125 aa, Glycine max
  Coding DNA Sequence Number=SeqID_98028
DCKVIFTEREEEEKKTEEDVCDEEGEKKKETKRNEEKAQQWEKYSQVEIQQESILQVNTPPHQLIVKEERHGKHEKALSVILSLIATTSLAIMWKVLPEYTSFMASLTKRRKCKEDVFYVTFMPP

SEQ ID NO: 214807 - protein, 457 aa, Glycine max
  Coding DNA Sequence Number=SeqID_98029
  Gene Ontology: Mol. function=protein binding; Cellular component =integral to membrane; Biological process=defense response to fungus
  Homolog annotation: Hit_ID=Q1SWI7; Match level="QueryCoverage=90%, HitCoverage=88%, E-value=1e-128, Identity=36%"; Hit description =Leucine-rich repeat
  Pfam annotation: Domain name=LRR_1; Domain location=118-141; Score =7.3; E_value=12; Accession=PF00560.23; Description=Leucine Rich Repeat
  Pfam annotation: Domain name=LRR_1; Domain location=16-38; Score =20.9; E_value=0.0047; Accession=PF00560.23; Description=Leucine Rich Repeat
  Pfam annotation: Domain name=LRR_1; Domain location=166-188; Score =5.5; E_value=27; Accession=PF00560.23; Description=Leucine Rich Repeat
  Pfam annotation: Domain name=LRR_1; Domain location=191-213; Score =6.7; E_value=16; Accession=PF00560.23; Description=Leucine Rich Repeat
  Pfam annotation: Domain name=LRR_1; Domain location=215-240; Score =4.6; E_value=40; Accession=PF00560.23; Description=Leucine Rich Repeat
  Pfam annotation: Domain name=LRR_1; Domain location=264-283; Score =11.8; E_value=1.8; Accession=PF00560.23; Description=Leucine Rich Repeat
  Pfam annotation: Domain name=LRR_1; Domain location=288-310; Score =8.1; E_value=8.6; Accession=PF00560.23; Description=Leucine Rich Repeat
  Pfam annotation: Domain name=LRR_1; Domain location=312-334; Score =9.5; E_value=4.8; Accession=PF00560.23; Description=Leucine Rich Repeat
  Pfam annotation: Domain name=LRR_1; Domain location=336-359; Score =11.5; E_value=2; Accession=PF00560.23; Description=Leucine Rich Repeat
  Pfam annotation: Domain name=LRR_1; Domain location=361-383; Score =11.2; E_value=2.2; Accession=PF00560.23; Description=Leucine Rich Repeat
  Pfam annotation: Domain name=LRR_1; Domain location=385-407; Score =12.8; E_value=1.2; Accession=PF00560.23; Description=Leucine Rich Repeat
  Pfam annotation: Domain name=LRR_1; Domain location=40-62; Score =19.9; E_value=0.0093; Accession=PF00560.23; Description=Leucine Rich Repeat
  Pfam annotation: Domain name=LRR_1; Domain location=69-91; Score=5.7; E_value=25; Accession=PF00560.23; Description=Leucine Rich Repeat
  Pfam annotation: Domain name=LRR_1; Domain location=93-116; Score =7.7; E_value=10; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1; Domain location=118-141::16-38::166-188::191-213::215 -240::264-283::288-310::...
  Pfam module annotation: Domain location=312-334::336-359::361 -383::385-407::40-62::69-91::93-116
NQLEGTIPTSLGNLTSLVELDLSGNQLEGNIPTSLGNLTSLVELDLSHNQLEGTIPTFLGNLRNSREIDLTFLYLSMNKFSGNPFESLGSLSKLSSLLINDNNFHGVVNEDDLANLTSLKAFDASGNNFTLKVGPNWLPNFQLFFLDVTSWHIGPNFPSWIQSQNKLQYVGLSNTGILDSIPTWFWEAHSQVSYLNLSHNHIHGELVTTIKNPISIQTVDLSTNHLCGKLPYLSSDVYGLDLSTNSFSESMQDFLCNNQDKPMQLEILNLASNNLSGEIPDCWINWPFLVEVNLQSNHFVGNFPPSMGSLAELQSLQIRNNLLSGIFPTSLKKTGQLISLDLGENNLSGCIPTWVGEKLSNMKILRLRSNSFSGHIPNEICQMSLLQVLDLAKNNLSGNIPSCFRNLSAMTLVNRSTYPRIYSQAPNDTAYSSVLSIVSVLLWLKGRGDEYGNILGL

SEQ ID NO: 214808 - protein, 245 aa, Glycine max
  Coding DNA Sequence Number=SeqID_98030
  Gene Ontology: Mol. function=nucleoside-triphosphatase activity; Cellular component=membrane; Biological process=DNA replication
  Homolog annotation: Hit_ID=Q97WM8; Match level="QueryCoverage=99%, HitCoverage=62%, E-value=1e-120, Identity=91%"; Hit description=Cell division control protein 6 homolog 3
  Pfam annotation: Domain name=AAA; Domain location=57-243; Score= -25.2; E_value=0.017; Accession=PF00004.19; Description=ATPase family associated with various cellular activities (AAA)
MNVIRETLKGGKGEVIKNPKVFIDPLSVFKEIPFREDILRDAAIAIRYFVKNEVKFSNLFLGLTGTGKTFVSKYIYNEIEEVKNEDEEYKDVKQAYVNCREVGGTPQAVLSSLAGKLTGFSVPKHGINLGEYIDKIKNGTRNIKAIIYLDEVDTLVKRRGGDIVLYQLLRSDANISVIMISNDINVRDYMEPRVLSSLGPSVIFKPYDAEQLKFILSKYAEYGLIKGTYDGDILGYIAAISAKEH

SEQ ID NO: 214809 - protein, 118 aa, Glycine max
  Coding DNA Sequence Number=SeqID_98031
  Gene Ontology: Mol. function=sequence-specific DNA binding
  Homolog annotation: Hit_ID=UPI00005F9DEB; Match level="QueryCoverage =99%, HitCoverage=100%, E-value=3e-35, Identity=62%"; Hit description= COG5606: Uncharacterized conserved small protein
  Pfam annotation: Domain name=HTH_3; Domain location=61-116; Score =19.1; E_value=0.016; Accession=PF01381.12; Description=Helix-turn -helix
MSGVKVMTKPIDTGSRHVTPAGGNVFADLGFSADEARQLQAQSNAEIAQLIALKKQLMGEISAWIEEEGYRQEEAARYLHTSRPRVSDVVNQKTEKFTLDALVNMMANIGKSVKLIVE

SEQ ID NO: 214810 - protein, 265 aa, Glycine max
  Coding DNA Sequence Number=SeqID_98032
  Gene Ontology: Mol. function=nucleoside-triphosphatase activity; Cellular component=membrane; Biological process=cobalt ion transport
  Homolog annotation: Hit_ID=UPI00006B87A7; Match level="QueryCoverage =96%, HitCoverage=96%, E-value=1e-103, Identity=75%"; Hit description= ABC transporter (ATP-binding protein)
  Pfam annotation: Domain name=ABC_tran; Domain location=38-219; Score =180.4; E_value=4.4e-51; Accession=PF00005.17; Description=ABC transporter
  Pfam annotation: Domain name=SMC_N; Domain location=24-224; Score= -130.9; E_value=0.05; Accession=PF02463.9; Description=RecFRecNSMC N terminal domain
  Pfam module annotation: Pfam domain module=ABC_tran::SMC_N; Domain location=38-219::24-224
STATEGAGVEVRNVSKTFGVDGAKVTVLDDVSLTIGRGEFVSVIGPSGYGKSTLLKVVAGLLDADSGTVTIDGESVRAASRDKKIGLVPQSPALLPWKTVRENVELPVRINRGANGGRTLRDPAELLSTFGLGHALKKYPGQLSGGMQQRAAIARAFVFDPSIMLMDEPFSALDEMNRDLQRIALLDFWQSNRKAVMFVTHSVPEAIMLSDRIVVMAAHPGRIAEVIDVNLPRPRTEEAYATDEFRDLEAVVRGALRAQTEKAHV

SEQ ID NO: 214811 - protein, 193 aa, Glycine max
  Coding DNA Sequence Number=SeqID_98033
  Homolog annotation: Hit_ID=Q2PMM5; Match level="QueryCoverage=97%, HitCoverage=8%, E-value=1e-107, Identity=99%"; Hit description =Protein ycf2
MVERKNPYLTRLLTIPMNSIGPKNDTLEESSESSNINRLIVPLLYLPKGKKISESYFLDPKESTRVLPITKKYIMPESNWGSRWWRNWIGKKSDSSCKISNETIAGIEISFKEKDIKYLEFLFVYYMDDPIRKDHDWEFFDRLSPRKRRNIINLNSGQLFEILVKDWIYYLMFAFREKIPKEVEGFFQPPRDW

SEQ ID NO: 214812 - protein, 88 aa, Glycine max
  Coding DNA Sequence Number=SeqID_98034
MTSKKHKSSDSRPQDQNDNKRFQSEEAWNRYIDNILNRRILPQRNVELYHSEFDEFKIELERQNLHKHLANLQEGSIDDAILPPKGIG

SEQ ID NO: 214813 - protein, 361 aa, Glycine max
  Coding DNA Sequence Number=SeqID_98035
  Gene Ontology: Mol. function=beta-lactamase activity; Cellular component=integral to membrane; Biological process=beta-lactam antibiotic catabolic process
  Homolog annotation: Hit_ID=UPI000068D720; Match level="QueryCoverage =75%, HitCoverage=74%, E-value=1e-89, Identity=59%"; Hit description =beta-lactamase family protein
  Pfam annotation: Domain name=Beta-lactamase; Domain location=104-361; Score=122.8; E_value=9.6e-34; Accession=PF00144.14; Description=Beta -lactamase
MTPVEATLVYDMSKHCLRIKNSETNWSDCLLDKTQLTQMSAGKAQVAIGTNKPEGILHLQNSDKEMGLVIPRVTSAESTTGLTSLIPVKATLVLIFAQTLEKRIDDVILKEFSDAKGPGGVFQVTQKGKVLYQKAFGKANLELNANLHADYVFEIGSMTKQFTAIATLMLEQQGKLSVNDPISKYIKDYPNGDKITIHHLLTHTSGIKDFTKMKSITTIAQKEMKPEMMVDFFKNEPVDFAPGEKFDYNNSGYVVLGHLIELISGDSYENFIQKNIFDKAGMNHSYYASDRKIVLKRASGYHKKESGYVNKTLISFSVSFSSGSLMSTLEDMLKWQNALHKNILLNSQETEKAFQKYRPYN

SEQ ID NO: 214814 - protein, 222 aa, Glycine max
  Coding DNA Sequence Number=SeqID_98036
  Gene Ontology: Mol. function=DNA-directed RNA polymerase activity; Cellular component=chloroplast; Biological process=transcription, DNA-dependent
  Homolog annotation: Hit_ID=Q8HVY4; Match level="QueryCoverage=99%, HitCoverage=45%, E-value=2e-88, Identity=61%"; Hit description=DNA -directed RNA polymerase beta' chain
  Pfam annotation: Domain name=RNA_pol_Rpb1_2; Domain location=37-151; Score=105.8; E_value=1.3e-28; Accession=PF00623.11; Description=RNA polymerase Rpb1, domain 2
MCQEKLVQEAVDTLLDNGIRGQPMRDGHNKMWIAPRNSNRTFPDISNSWSNSKTFCFEHRIAKSKIREKEPIVWEILQEVMQGHPVLVNRAPTLHRLGIQAFQPILVEGRAICLHPLVCKGFNADFDGDQMAVHVPLSLEAQAEARLLMWSHTNLLSPAIGDPISVPTQDMLIGLYILTSGNRRAYQQKRINFDSPLWLRWRLDQRIISSREVPIEVHYESL

SEQ ID NO: 214815 - protein, 143 aa, Glycine max
  Coding DNA Sequence Number=SeqID_98037
  Homolog annotation: Hit_ID=Q5XM22; Match level="QueryCoverage=42%, HitCoverage=44%, E-value=2e-08, Identity=43%"; Hit description =Resistance-like protein HAAS-2
ALHSFELLHVDDAVDMLVELLEVSAAKARAEMIQCHGSYVRLSWLRDREHICCICSLFANKSVTHVHAVFLDVLRDLTQSGGYAWGAAALVHIWGPLTVIHRPKRVVQQFGYIQTILPHLATSSLSIEEIDDGWMQFGEYIAP

SEQ ID NO: 214816 - protein, 92 aa, Glycine max
  Coding DNA Sequence Number=SeqID_98038
MRGLQALNFRRLQVLAFRGLHILAFRGLHALAFRGLHMLAFRGLHTLAFIGLQTLAFRGLHRATCPRLRRTKLPRLQRATRPRLQRATRPPL

SEQ ID NO: 214817 - protein, 293 aa, Glycine max
  Coding DNA Sequence Number=SeqID_98039
  Gene Ontology: Mol. function=oxidoreductase activity, acting on the CH-OH group of donors, NAD or NADP as acceptor; Cellular component =cytosol; Biological process=metabolic process
  Homolog annotation: Hit_ID=Q2DDU4; Match level="QueryCoverage=94%, HitCoverage=78%, E-value=8e-41, Identity=38%"; Hit description =Putative phosphoglycerate dehydrogenase
  Pfam annotation: Domain name=2-Hacid_dh; Domain location=9-241; Score= 27.9; E_value=1.3e-05; Accession=PF00389.20; Description=D-isomer specific 2-hydroxyacid dehydr
  Pfam annotation: Domain name=2-Hacid_dh_C; Domain location=102-284; Score=201.8; E_value=1.6e-57; Accession=PF02826.9; Description=D -isomer specific 2-hydroxyacid dehyd
  Pfam module annotation: Pfam domain module=2-Hacid_dh::2-Hacid_dh_C; Domain location=9-241::102-284
RSGGSRRRGDDDDHGAHVGRLGDPRVRGRPAEVARLGRGYDIIAFHAAPFTADVLAALPDLRLVGCARGGPVNVDLAAAKERGVRVTTTPGKNADAVADLTIGFLISLMRNVPASLRDVDERVADGRPLAESTFEGARWFGREVKGLRLGLIGYGNVARLVAARARALGAAITAYDPFVDPATVPDATIVSDLDALLRSSDVVSVHARATGENRHMIGAAQIARMPQGSFLINTARESLVDEQALLDGLRSGHLAGVALDVNEPDGPWRDLVGEPNLILTPHLAGATRETLAR

SEQ ID NO: 214818 - protein, 183 aa, Glycine max
  Coding DNA Sequence Number=SeqID_98040
MVRRQAKKARSEDEDQCYACQRCVAHHVRELHTPSKKVNQGHLETEGEKISATLVKDASRVIWLRTRKHDDLWKGHRKSLNMLLERDEARWFGQWIVGQPNRDKLRPNKFIRGEGAQQGGCRRMGLAKTTSCAKKGIAHEHDVLKCGGRKGCSQRRWVCQGEALLIRGNAAAKRGKIAEERNS

SEQ ID NO: 214819 - protein, 63 aa, Glycine max
  Coding DNA Sequence Number=SeqID_98041
MNVSVGSNNYNDSSNCGEDNNSNGCDGKNVNVDSSDDNVSDCDGGNVNDNGGGDSDDNNDDCE

SEQ ID NO: 214820 - protein, 294 aa, Glycine max
  Coding DNA Sequence Number=SeqID_98042
  Gene Ontology: Mol. function=4 iron, 4 sulfur cluster binding; Cellular component=integral to membrane; Biological process=protein -chromophore linkage
  Homolog annotation: Hit_ID=P56766; Match level="QueryCoverage=99%, HitCoverage=39%, E-value=1e-155, Identity=88%"; Hit description =Photosystem I P700 chlorophyll a apoprotein A1
  Pfam annotation: Domain name=PsaA_PsaB; Domain location=1-294; Score =99.8; E_value=8e-27; Accession=PF00223.9; Description=Photosystem I psaApsaB protein
MYFHGARFSNYEAWLSDPTHIMPSAQVVWPIVGQEILNGDVGGGFRGIQITSGFFQIWRASGITSELQLYCTAIGALVFAALMLFAGWFHYHKAAPKLAWFQDVESMLNHHLTGLLGLGSLSWAGHQIHVSLPINQFLNAAVDPKEIPLPHEFILNRDLLAQLYPSFAEGATPFFTLNWSKYAEFLTFRGGLDPVTGGLWLTDIIHHHLAIAILFLIAGHMYRTNWGIGHSIKDILEAHKGPFTGHGHKGLYEILTTSWHAQLSINLAMLGSLTIVVAHHMYSMPPYPYLATDY

SEQ ID NO: 214821 - protein, 77 aa, Glycine max
  Coding DNA Sequence Number=SeqID_98043
GKEGRAKCSALLVFEDSLEISEKNCFHEKQPSRGVSVTLPRHFRERFREASSPFFIVLRSFFIVLRSSTESNRSFTL

SEQ ID NO: 214822 - protein, 386 aa, Glycine max
  Coding DNA Sequence Number=SeqID_98044
  Gene Ontology: Mol. function=nucleoside-triphosphatase activity; Cellular component=membrane; Biological process=defense response
  Homolog annotation: Hit_ID=Q2L3S2; Match level="QueryCoverage=96%, HitCoverage=38%, E-value=3e-55, Identity=33%"; Hit description =Putative ATPase
EAMSLMLGSGKDYPVAEVDALRTIEEKLGRLTLGLAIVSGILSEIPITPSRLLDTINRMPLKDMSWSGKEARSFRQNTFLLQLFDVCFSIFDHADGPRSLATRMVLVSGWFAPCAIPVSLLALAAQKIPEKQKGTCFWRKLLQSITCGFTSSNTKKSELEASSLLLRFNIARSSTKQGRIHFNEIIKQYARKREVTGSAQAMVQAVISQGSISESIEHLWAACFLLFAFGHNPPAVELEVSELLYLVKKVVLPLAIHTFITYSRCTAAIELLHLCTNALEAADQAFVTPVDKWFDKSLCWRSIQTNAQLNPCLWQELALCRATVLETRGKLMLRGAQFDIGDDLIRKAVYIRTSICGEDHPDTISARETLSKLARLIANVQIRASI

SEQ ID NO: 214823 - protein, 57 aa, Glycine max
  Coding DNA Sequence Number=SeqID_98045
MVSDSDTHLRKRRKGDKVKGKAASFINKCCVFIVPAKFRKWGEEGCNGSDLGMVESQ

SEQ ID NO: 214824 - protein, 372 aa, Glycine max
  Coding DNA Sequence Number=SeqID_98046
  Gene Ontology: Mol. function=nucleoside-triphosphatase activity; Cellular component=membrane; Biological process=defense response
  Homolog annotation: Hit_ID=Q2L3S2; Match level="QueryCoverage=57%, HitCoverage=19%, E-value=6e-39, Identity=40%"; Hit description =Putative ATPase
  Pfam annotation: Domain name=TIR; Domain location=164-296; Score= -31.1; E_value=0.052; Accession=PF01582.10; Description=TIR domain
  Subcellular localization annotation: CTP_CleavageSite=44; ConfidenceScore=5.78e-01
MDIQEESSTTLGPLTAMSSRNMSSSSSAFFSANQSPFFSPRSSSCQLSESLRPDAPSDRIHSDATAPSTSSGIPEPKSLVNVGCTFSEVVASPAGCNAGDLQNLDRISSSVGISSSTVSGYCHPYDDGYSGQKEKRSKKGRNKRTSSTPGSTSLSSYRLKSCDVFIGLHGRKPPLIRFANWLRVELEIQGISCFISDRAGCRNSCKLGIAEKAMDVASFGIVIITRKSFKNPYTIEELQFFSGKKNLVPIYFDLSPADCLVRDIIEKRGEMWEKHGGELWILYGGLEQEWKDAVHGLSRVEEWKLEAHDGNWRDCILRAVTLLAMKLGRRSVAEHLTKWREKVKEELPFTRNENFIGRKKELSQLEFMLFGD

SEQ ID NO: 214825 - protein, 144 aa, Glycine max
  Coding DNA Sequence Number=SeqID_98047
  Homolog annotation: Hit_ID=Q9CAE1; Match level="QueryCoverage=48%, HitCoverage=7%, E-value=3e-21, Identity=70%"; Hit description =Putative aminopeptidase; 4537-10989
MLYTHTSMHISNESERNKYRSLDFIINHSHLKANCSVSYFQNTARGSIRFKHFLASEVTFRKKYCPLYSSLPRVKQVSRRLICSVATEDLPKEVEKSNMETPREIFLKDYKMPDYYFDTVDLKFSLGEEKTIVNSKIAVYPRIE

SEQ ID NO: 214826 - protein, 441 aa, Glycine max
  Coding DNA Sequence Number=SeqID_98048
  Homolog annotation: Hit_ID=Q6K6Z8; Match level="QueryCoverage=95%, HitCoverage=91%, E-value=1e-54, Identity=35%"; Hit description =Hydroxyproline-rich glycoprotein-like
MYDLYVIHWKKGCSRCKNYCKKRWGSWLGKIGCFGYKKTRKRIGHAVLVPEPTTNGADPAAAASSIQAPSITLPFVAPPSSPASFFQSEPPSTAQSPIGKVSHTCVSASIYSPGGPASIFAIGPYAHETQLVSPPVFSASSTAPFTPPPESVHMTTPSSPEVPFAQLLDPNNKNSETFQRFQISHYDFQSYQFHPGSPVGQLISPRSAISVSGTSSPLPDSEFNATFAHILDFQRADPPKLLNLDNKLSSCENQKSNHGSGSLTPDAARSTTQSGFLSNHWVSEIKMSPHPSNNRLNEISINHRVSFELSAQKVLKSLENKPAASAWTNVLPKLKNDAPTTDKEEKSEESALDDKQVVSEAHNDQPLETTLGGDKATTVHEKDQSLTLSSAKEFNFDNADGGDSLAPNIVADWWANEKVAGKEREASKDWSFFPMIQPGVS

SEQ ID NO: 214827 - protein, 175 aa, Glycine max
  Coding DNA Sequence Number=SeqID_98049
  Gene Ontology: Mol. function=peptidase activity; Biological process =DNA integration
MEGTSLVDLWLVKDFTMLKEISRTAGCLGTECRHGPLDPTSGIRAGFLRKVSQFQDSWPPQILCFLKETPSIGHLSLMVRVTTIGKPECKSLLKSDLNIWEAIEIGPYVPTIVDASTSTTTEKPRDKWTEEDRRRIKYNLKAKNIITSALGIDEYFRVSKLFKCKGDVGYSPTNT

SEQ ID NO: 214828 - protein, 88 aa, Glycine max
  Coding DNA Sequence Number=SeqID_98050
  Subcellular localization annotation: CTP_CleavageSite=25; ConfidenceScore=5.09e-01
MARSPQEQVQEMAQGSVGVSSSSPSAAGSSRAGSWAAEAPPPPEEEGWAPSQATCTSNSFVLIMDGKPKPCKLYMMMDYPMCMLWSME

SEQ ID NO: 214829 - protein, 138 aa, Glycine max
  Coding DNA Sequence Number=SeqID_98051
  Gene Ontology: Mol. function=protein serine/threonine phosphatase activity; Cellular component=protein serine/threonine phosphatase complex; Biological process=protein amino acid dephosphorylation
  Homolog annotation: Hit_ID=Q1T009; Match level="QueryCoverage=73%, HitCoverage=41%, E-value=1e-38, Identity=72%"; Hit description =Protein phosphatase 2C
MGLQIATRPTWAFQDVPPEGGCFWRKQPSSPGRAGWQGSKGSACPLSVEPELQEINLTEDDEFLIMGCDGLWDVMSNQCVVTMARKELMIHNDPQRCSRELAREALKHLPPRIETPPSRVKGSISAEGLNLLKDVLDC

SEQ ID NO: 214830 - protein, 247 aa, Glycine max
  Coding DNA Sequence Number=SeqID_98052
  Gene Ontology: Mol. function=RNA-directed DNA polymerase activity; Biological process=RNA-dependent DNA replication
MNSNGAYTGQAITQHDMLDIYSNLKDVPQSISGRDELNKDELHNVVAVTEAQGSLQQRRTQAEGEKRRTIRFKRAGCAISGMNWMSWDRLCALKEDGGMGFQNGSQSQIFSKGEFHGGVFKVVLKEGFQWRLGDRVSIDVWKQPWLRSTNVAYIQTPMYPRMEDLKVSDLIDYHSGHWNNPLIDNLFEAGDDYSSKVHTNYNTVSMHGDWKLVWDLEIVMRVKVFMWRLPSIHFSHVLATKVVGKEC

SEQ ID NO: 214831 - protein, 75 aa, Glycine max
  Coding DNA Sequence Number=SeqID_98053
MGAKYLEVVKRGSHPNNGWSPDEIRTQQQVPAGRCKSAQASKRMVQTCLQDAWRNKPMQDSPKALAKKATVLSPI

SEQ ID NO: 214832 - protein, 66 aa, Glycine max
  Coding DNA Sequence Number=SeqID_98054
  Subcellular localization annotation: CTP_CleavageSite=6; ConfidenceScore=5.03e-01
MHHHARKTYVSSSLKLPLRFVFGFALASGVPTRDYRDLGFRHSLGSWLMGSRVPELVGSGAGEFVV

SEQ ID NO: 214833 - protein, 130 aa, Glycine max
  Coding DNA Sequence Number=SeqID_98055
  Gene Ontology: Mol. function=nucleoside-triphosphatase activity; Cellular component=integral to membrane; Biological process=protein catabolic process
  Homolog annotation: Hit_ID=Q6H6R9; Match level="QueryCoverage=74%, HitCoverage=13%, E-value=4e-25, Identity=56%"; Hit description =Putative cell division protein FtsH3
MVDKQFSLPIKVVQTDRGEVYTFYFLLQQSGIIHRTIGPVSISTLSNGGIDEFGGSAPWRRDQGHLVDLVQREVKALLQPWCSNSAYSSEKEKVEGEELHKWLRLVVAPTELAIFIDGKQWSLLPLQTGS

SEQ ID NO: 214834 - protein, 543 aa, Glycine max
  Coding DNA Sequence Number=SeqID_98056
  Homolog annotation: Hit_ID=Q6DW76; Match level="QueryCoverage=31%, HitCoverage=22%, E-value=9e-91, Identity=91%"; Hit description =Digalactosyldiacylglycerol synthase 1, chloroplast precursor
MTGRAVNPLFRGAYLSEFAKQKVTLLVPWLCKSDQELVCPNNLTFTSPEEQEAYMRSWLEERIGFKADFKISFYPGKFSEARRSIIPAGDTSQFIPSRDADIAILKEPEHLNWYHHGKRWTNKFNHVVGIVHTNYIEYIKREKNGALQVFLVKHINNWVTRAYCHKVFRLLDATLGIRITVSNLLDHHSARVQDRAKTLFDGWKGVGNGDTESHEVEFAKVDNASDKIVSKESQPSTLNEDGNDNDPASGLIGCEKSLLRSSNDLLVHSSDNVPQLSTTVECIDIKEGSANHVASVPSSAQEVAPTHEGLPICTTGEATSAGTCKFFVTNQSSFEGQSDVVQLSNLAKMEKQEQNVNDPSEKLGAPEIYFVSSNKPEPQPISMVACEAKAPESMKEPALEKNVEHNEDGVCHKLTTSASMRTPASDRSGEDDATSITQVFKATENDNDCCSNALQGTSVSDSNLGKTEVLDMSVSGTEYVIASKENKGHEEDTSSGSDCSKPGIDFRGSNIIHKSGSDNELDKNLIGSLRFNKAHIRVIFKGN

SEQ ID NO: 214835 - protein, 826 aa, Glycine max
  Coding DNA Sequence Number=SeqID_98057
  Gene Ontology: Mol. function=ATP-dependent DNA helicase activity; Cellular component=nucleus; Biological process=regulation of transcription, DNA-dependent
  Homolog annotation: Hit_ID=Q38861; Match level="QueryCoverage=88%, HitCoverage=99%, E-value=0.0, Identity=77%"; Hit description=DNA repair helicase XPB1
  Pfam annotation: Domain name=DEAD; Domain location=281-415; Score= -49.7; E_value=0.088; Accession=PF00270.19; Description=DEADDEAH box helicase
  Pfam annotation: Domain name=Helicase_C; Domain location=514-587; Score=51.3; E_value=3.3e-12; Accession=PF00271.21; Description =Helicase conserved C-terminal domain
  Pfam annotation: Domain name=ResIII; Domain location=277-410; Score= -6.3; E_value=0.00016; Accession=PF04851.6; Description=Type III restriction enzyme, res subunit
  Pfam module annotation: Pfam domain module=DEAD::Helicase_C::ResIII; Domain location=281-415::514-587::277-410
MGYGEKGGRPPFKKLKASTKFEDPQKGIAYDDDGYGGEDAYDDDDGKTKDFSKLELKPDHPNRPLWACGNGRIFLETFSPLYKHAYDFLIAIAEPVCRPESMHEYNLTPHSLYAAVSVGLETETVISVLNKLSKTKLPKEMVKFIHDSTANYGKVKLVLKKNRYFIESPFPEVLKTLLRDETISRSRIISENVNGDGFTISKAAGEIEGTHDELLNEAEVAAVAEEKEAHSFEIDPSQVENVKQRCLPNALNYPMLEEYDFRNDTVNPDLDMELKPQAQPRPYQEKSLSKMFGNGRARSGIIVLPCGADQWAFQFKLWSTIREEQICRFTSDSKERFRGNAGVVVTTYNMVAFGGKRSEESEKIIEEIRNREWGLLLMDEVHVVPAHMFRKVISITKSHCKLGLTATLVREDERITDLNFLIGPKLYEANWLDLVKGGFIANVQCAEVWCPMTKEFFAEYLKKENSKKRQALYVMNPNKFRACEFLINFHERTRGDKIIVFADNLFALTEYAMKLRKPMIYGATSHVERTKILQAFKTSKDINTIFLSKVGDNSIDIPEANVIIQISSHAGSRRQEAQRLGRILRAKGKLEDRMAGGKEEYNAFFYSLVSIDTQEMYYSTKRQQFLIDQGYSFKVITSLPPPDEGPNLSYHRLEDQLALLGKVLSAGDDQVGLEQLDEDADEIALQSARRSQGSMSAMSGAKGMVYMEYSTGRNKGQGQIKSKPKDPAKRHFLGTHRATPASQGSNRHYLSCGRSARRRGGPVSCLALLTKYCGRGGDTKESAIDNNRELKVRKRKVKVLVGKGGRKGGGKVRRRKKRGGGNDEGK

SEQ ID NO: 214836 - protein, 71 aa, Glycine max
  Coding DNA Sequence Number=SeqID_98058
LSECYENSRIAQQHFHLIFGTLRNSTNCVTMPHFDFRHVSKLHVLCNKGCQVPRSGQPKVACRQTIVPGRN

SEQ ID NO: 214837 - protein, 264 aa, Glycine max
  Coding DNA Sequence Number=SeqID_98059
  Gene Ontology: Mol. function=protein serine/threonine kinase activity; Cellular component=integral to membrane; Biological process=protein amino acid phosphorylation
  Homolog annotation: Hit_ID=P43298; Match level="QueryCoverage=66%, HitCoverage=18%, E-value=1e-60, Identity=66%"; Hit description =Putative receptor protein kinase TMK1 precursor
MVSLAVTGRVTTKVDVYSYGVILMEMITGRKAIDNSQPEENVHLVTWFRRMLLNKDSFTKLIDPIMDVDEETLPSFRTVAELAGHCCAREPYQRPDMSHVVNVLAPLVEIWKPSEADDDDIYAIDLDMTLPQALSKWQAIEGKNTFDVSCTSSMLTSGDTTQSSILTRPSGFADSFTSNDGSIMSIGSPGAAVKLCLGDLLVMGSNPEIASLHMQGNIGQKFQRQCTLQRLHRNISIMIVGSLQEFHPWEEQGISSQSSMTAQG

SEQ ID NO: 214838 - protein, 228 aa, Glycine max
  Coding DNA Sequence Number=SeqID_98060
MNTSSSNVSVANVIEVPFAYHRQWSSNYPSYVLFDYEGDKHFIKLHKYGNRFFFGDGLKELRRTHGIHKSVLMHFVGRDKNTTFSVDIVGPLHQRAATTIRHHVFTIDVSEDMIQHNYQLVLPPEASIYLTASKKYMIVDRGSGRHHKWMITMNNGLSCVADAWIHYLGDCHLKPGDEVIFFYNIDQHLWEVLYRKCRNLPFRGRATRDSRDACSTKGIRAESPPTFI

SEQ ID NO: 214839 - protein, 805 aa, Glycine max
  Coding DNA Sequence Number=SeqID_98061
  Gene Ontology: Mol. function=protein serine/threonine kinase activity; Cellular component=cell surface; Biological process =protein amino acid phosphorylation
  Homolog annotation: Hit_ID=Q7G6W1; Match level="QueryCoverage=96%, HitCoverage=97%, E-value=0.0, Identity=47%"; Hit description =Putative receptor-like protein kinase
  Pfam annotation: Domain name=Adeno_GP19K; Domain location=343-469; Score=-57.6; E_value=0.025; Accession=PF04881.4; Description =Adenovirus GP19K
  Pfam annotation: Domain name=B_lectin; Domain location=84-193; Score=- 7.4; E_value=0.011; Accession=PF01453.15; Description=D-mannose binding lectin
  Pfam annotation: Domain name=Pkinase; Domain location=486-785; Score =147.3; E_value=4.1e-41; Accession=PF00069.15; Description=Protein kinase domain
  Pfam annotation: Domain name=Pkinase_Tyr; Domain location=487-785; Score=104.7; E_value=2.8e-28; Accession=PF07714.7; Description =Protein tyrosine kinase
  Pfam annotation: Domain name=S_locus_glycop; Domain location=181-298; Score=-31.1; E_value=0.007; Accession=PF00954.11; Description=S-locus glycoprotein family
  Pfam module annotation: Pfam domain module=Adeno_GP19K::B _lectin::Pkinase::Pkinase_Tyr::S_locus_glycop; Domain location=343 -469::84-193::486-785::487-785::181-298
  Subcellular localization annotation: CTP_CleavageSite=26; ConfidenceScore=5.68e-01
MALCTSSFFFTFFFTFFLFLFNLQPSVSQQQFTSFNISHSPWLPAQNKTLLSPNKNFTAGFFPLPNSSNVFTFSIWYSKVPPSANPFVWNATVQVNTSGSLEITPKGELLLNGSPFQSAENATTNSTSNSTQLLLQNDGNLVFGEWSSFKNPTSTVLPNQNFSTGFELHSNNGKFRFIKSQNLVLSSTSDQYYNTPSQLLNMDDNGKMSMQGNSFLTSDYGDPRFRKLVLDDDGNLRIYSFYPEQKNQWVEVWKGIWEMCRIKGKCGPNAICVPKEDLSTSTYCVCPSGFTPAIQNDPEKGCRRKIPLSQNTQFLRLDYVNCSSDGHLNEIKADNFAMCEANCSREKTCLGFGFKYDGSGYCMLVNGTNLQYGFWSPGTEAALFVKVDKSESSVSNFIGMTEVMQTTCPVNISLPLPPKDSNATARNIAIICTLFAAELIAGVAFFWSFLKRYIKYRDMATTLGLELLPAGGPKRFTYSEIKAATKDFSNLIGKGGFGDVYKGELPDHRVVAVKCLKNVTGGDAEFWAEVTIIARMHHLNLVRLWGFCAEKGQRILVYEHIPGGSLDKYLFRVNKSHNNNHLKEQSSSLNPNTPQQERHVLDWSMRYRIALGMARAIAYLHEECLEWVLHCDIKPENILLGDDFCPKISDFGLAKLRKKEDMVTMSRRRGTPGYMAPEWITADPITSKADVYSFGMVLLELVSGIRNFEIQGSVVRSEEWYFPGWAFDKMFKEMRVEEILDGQIRDAYDSRAHFEMVNRMVKTAMWCLQDRPELRPTMGKVAKMLEGTVEITEPKKPTVFFLGEE

SEQ ID NO: 214840 - protein, 109 aa, Glycine max
  Coding DNA Sequence Number=SeqID_98062
MSDHQAPEVKDLPCLMGSPFKGTHSRFSRKSSLVIDYSTGVIDYTVIFIQNSNVQHSKALGLKEKFFFDPTKSVKCFYHIWQDLLHVWWWSVDNNNNSDNKNNDNDYNN

SEQ ID NO: 214841 - protein, 84 aa, Glycine max
  Coding DNA Sequence Number=SeqID_98063
MRSLQKAKSGVDATYCSLFKEKDASHLGPWNGGFNPFSFSLTFGNPNRATGGGALESTKNATIDKRECLSDYIEIRDELFTIGD

SEQ ID NO: 214842 - protein, 88 aa, Glycine max
  Coding DNA Sequence Number=SeqID_98064
  Gene Ontology: Mol. function=RNA-directed DNA polymerase activity; Cellular component=intracellular; Biological process=RNA-dependent DNA replication
MGISPSYCMHRVLMEEDYKLVAQPQRRLNPTMKEVLTKEVVKLLEAGMIYPIFDSQWVGECVLITGSSTKPPEKIIFHYDLWIKCWRD

SEQ ID NO: 214843 - protein, 69 aa, Glycine max
  Coding DNA Sequence Number=SeqID_98065
MEFQIEIARRHWTQLAEPMTKYDLEIVMEFYANVWPIEEGVMDKRSKVQGQWIPYDTDAINQFLGNSLI

SEQ ID NO: 214844 - protein, 117 aa, Glycine max
  Coding DNA Sequence Number=SeqID_98066
  Homolog annotation: Hit_ID=Q9FLH0; Match level="QueryCoverage=84%, HitCoverage=9%, E-value=2e-18, Identity=48%"; Hit description =Putative nuclear matrix constituent protein 1-like protein
MSKKKSRIDSRLNDTRLSTSAHRVDILRHEAFKSETNDLSVLEVKLNEQIDVVRSQKLEIVAEADKLRAEKAKFEAQWELLHENKEKLREEAEYITEENKVVSKIQVQFAYLIHFMY

SEQ ID NO: 214845 - protein, 202 aa, Glycine max
  Coding DNA Sequence Number=SeqID_98067
  Homolog annotation: Hit_ID=Q6ZI83; Match level="QueryCoverage=49%, HitCoverage=25%, E-value=2e-21, Identity=47%"; Hit description =RanBPM-like
  Pfam annotation: Domain name=SPRY; Domain location=70-166; Score=7.1; E_value=0.0067; Accession=PF00622.18; Description=SPRY domain
MTSYSLTPFSRDGVEGVVVGPTPNAKYGKAATGEEEGVDAKVGGCVSEAGGEEAEGGRGFLASKPAPTQCLMYYFEIHVKDVDVKGQIAIGFTYETFKIQRQPGWETNSCGYHSDDGLLYCGYCMGEHSLYANKNGQVVGSVYKDMKGPIFQPLLFTVKMKSMSLVLLLHSYLSAHNHVFIVSESFLLLATLLVATYLTTGR

SEQ ID NO: 214846 - protein, 303 aa, Glycine max
  Coding DNA Sequence Number=SeqID_98068
  Gene Ontology: Mol. function=diaminobutyrate-2-oxoglutarate transaminase activity; Cellular component=mitochondrion; Biological process=biosynthetic process
  Homolog annotation: Hit_ID=Q6D4Z7; Match level="QueryCoverage=100%, HitCoverage=65%, E-value=1e-156, Identity=90%"; Hit description =Diaminobutyrate--2-oxoglutarate aminotransferase
  Pfam annotation: Domain name=Aminotran_3; Domain location=43-303; Score=255.4; E_value=1.2e-73; Accession=PF00202.11; Description =Aminotransferase class-III
MTDKVRIDTLVANSLNGNNETYLARQAEFESNVRSYPRKLPLAIAKAQGVWITDVENNQYLDCLAGAGTLALGHNHPDVLQSIQNVITSGLPLHTLDLTTPLKDRFSDYLLSLLPGEGKEYCLQFCGPSGADAVEAALKLAKKHTGRSGVISFSGGYHGMTHGALSVTGNLSPKAAINGMMPEVQFMPYPHEYRCPLGIGGEAGVKALTYYFDNLINDVESGVRKPAAVILEAVQGEGGVNPAPAEWLQRIRKVTQEHGILLIIDEVQAGFARTGKLFAFEHAGIEPDIIVMSKAVGGGLPLA

SEQ ID NO: 214847 - protein, 102 aa, Glycine max
  Coding DNA Sequence Number=SeqID_98069
  Subcellular localization annotation: CTP_CleavageSite=68; ConfidenceScore=5.82e-01
MKDWRNTSSGDVSSTFRTSQSLTNSSQVLRTTSSSSLVLCSALIGMTLHSANMHNSSFFQILPCAQPRSVALSGWLAKPEDWLSGRVKISTSQTCLINLKLR

SEQ ID NO: 214848 - protein, 88 aa, Glycine max
  Coding DNA Sequence Number=SeqID_98070
MWGSHDNKKYSHCPRPQEYLSTIPCGGIKVSITGRNTHLLVTLSSSHRTNFSNGSPCGGIFLQLSISIYPSRDFAENQRKNKALNAES

SEQ ID NO: 214849 - protein, 621 aa, Glycine max
  Coding DNA Sequence Number=SeqID_98071
  Gene Ontology: Mol. function=pyridoxal phosphate binding; Cellular component=cellular_component; Biological process=carboxylic acid metabolic process
  Homolog annotation: Hit_ID=Q6D4Z6; Match level="QueryCoverage=68%, HitCoverage=90%, E-value=0.0, Identity=82%"; Hit description=L-2,4 -diaminobutyrate decarboxylase
  Pfam annotation: Domain name=Beta_elim_lyase; Domain location=149 -472; Score=-126.0; E_value=0.032; Accession=PF01212.11; Description =Beta-eliminating lyase
  Pfam annotation: Domain name=HTH_1; Domain location=549-608; Score =66.7; E_value=7.5e-17; Accession=PF00126.17; Description=Bacterial regulatory helix-turn-helix protein, lysR family
  Pfam annotation: Domain name=Pyridoxal_deC; Domain location=91-438; Score=33.6; E_value=1.8e-16; Accession=PF00282.9; Description =Pyridoxal-dependent decarboxylase con
  Pfam module annotation: Pfam domain module=Beta_elim_lyase::HTH _1::Pyridoxal_deC; Domain location=149-472::549-608::91-438
MAESPAERDGDSRGGVLVTFAAWGFPADGELSALLQKKCFEAGLILERGGRHGAAIAQSSAAVVQWLQQPEMYQGKTVAELRERITLDFNPNGLGNQAAIERAIEYFLKDSLAVHHPQCVAHLHCPSLVVSQAAEVLINATNQSMDSWDQSPSATIIEIKLIEWLRAQVGYPAGDAGVFTSGGTQSNLMGLMLARDAFYARQGHSVQQHGITGDLRKIKVLCSENAHFSVQKNMALLGHGYQSVVQVKSDQFARMDVNDLKAKLAQAEANGEQILAIVATAGTTDAGAIDPLREIAAIAAEHNIWVHVDAAWGGALLLSEKYRHYLDGLELVDSVTLDFHKQYFQTISCGARAEPGVQVAANHPPLRCVEAVDGAGGAGAEAIRRDHRSWRDAGATGGALHRRSGIAGTGDAAAAGQRAVPLPSGAAGGERRRGRRLVQPAHRRRPAGIGPRQRRRDRVRWRNLPEDDVAEPDRDAGRHQAVAGAGRENRAAAAGVTSRSLPLKPITCVIGFFIAHQIAGGAAFTLIYCIKRLLSCQPTGYARMTDPDFNLLIALDALLTAGSVVGAARRLGLSASAMSRTLSRLRAATGDPLLVRAGRHMVLTPYAETLRERTRNTAFEA

SEQ ID NO: 214850 - protein, 220 aa, Glycine max
  Coding DNA Sequence Number=SeqID_98072
  Homolog annotation: Hit_ID=Q8H6Q8; Match level="QueryCoverage=74%, HitCoverage=6%, E-value=1e-20, Identity=33%"; Hit description=CTV.20
MQPRHYGSNLNQPKKFYAPFDPAGYSYWDYIDAWTNVFWHQNSKFKHSWLIYFKNNTVYNFPNWFLQWWNYFRPIPQIFPQEVQQGFQQFSKLFNSKESRISADLKHAFVKWWSQFDTSKAAPEQVKNWFQSNPEFLKPADPETSLFLNQKSQLAAFLASSKSKESLAQNLKEVLQLLQQEEEEEPPKKEAESSENNDDQEDDPFYQNEDDCFGISLDDD

SEQ ID NO: 214851 - protein, 341 aa, Glycine max
  Coding DNA Sequence Number=SeqID_98073
  Gene Ontology: Mol. function=transferase activity, transferring nitrogenous groups; Cellular component=intracellular; Biological process=regulation of transcription, DNA-dependent
  Homolog annotation: Hit_ID=Q6F766; Match level="QueryCoverage=100%, HitCoverage=68%, E-value=1e-130, Identity=66%"; Hit description =Putative transcriptional regulator
  Pfam annotation: Domain name=GntR; Domain location=3-56; Score=31.0; E_value=4e-06; Accession=PF00392.11; Description=Bacterial regulatory proteins, gntR f
MQAAIVEGIFPRGSRLPATRDLARELAVSRNTVLNVYENLVAQGYVSARTGSGTWIAENLPEGCLNSAPALPLSEPLMSKPAAISKRGATLLGHANASPYQWGAFVPGAPDVREFPHKLFSQIQSRLNREPDIERLIYSSNGGCPQLRQALAEYLSVARSVRADADQIIITEGIHQAVDLVTRVLCDAGDPVWIEEPGYWGTRNLLRINGLKIQAKAVDEQGIIPELAPRSKAPKMIFVTPSHQYPLGVHLSLERRRQLLDLARKHKSWLVEDDYDSEFRFAGQPFPSLQGFEPDAPVIYMGTFSKTLYPALRLGYLVVPKALAQPLRVAAAELYRGGHLL

SEQ ID NO: 214852 - protein, 126 aa, Glycine max
  Coding DNA Sequence Number=SeqID_98074
  Homolog annotation: Hit_ID=Q9LJR0; Match level="QueryCoverage=46%, HitCoverage=40%, E-value=5e-13, Identity=62%"; Hit description =Arabidopsis thaliana genomic DNA, chromosome 3, TAC clone: K7L4
MGLSGIVCKQSNELIREKEKELKKNQKVDSTTSFILSLKKNNTHIMKKDPRNGQCYVPNSMPRPLMCKIPKLPLKEESPECNGNVKHHTPLGKETLKLYVLNKSNHQEKESYCEQQQAREGIRGVN

SEQ ID NO: 214853 - protein, 76 aa, Glycine max
  Coding DNA Sequence Number=SeqID_98075
MCLIVRQWHYIENCQVVVRRTYIIPQEDPEVAKFRGQGLKFLPEMEFLFKGIIATGLAAYAPSEDSRQYEGFNTRT

SEQ ID NO: 214854 - protein, 59 aa, Glycine max
  Coding DNA Sequence Number=SeqID_98076
MVDYNDPIKINFVRVNPNTHLCGLIIQVVAVVCQTGMTRPSHLRKTKALRNSVFLMVST

SEQ ID NO: 214855 - protein, 111 aa, Glycine max
  Coding DNA Sequence Number=SeqID_98077
  Homolog annotation: Hit_ID=Q9LS23; Match level="QueryCoverage=41%, HitCoverage=8%, E-value=5e-16, Identity=80%"; Hit description =Arabidopsis thaliana genomic DNA, chromosome 5, BAC clone:F10E10
MAETNTSIKSSRQLRYVYSFADKVKSFPGLARRATWKVGKEDPRRVVHALKVGMALTLVSLLYLMEPLFKGIGKNAMWAVMTVVVVMEFTVDQSFNFLDQKFRAFMHITEK

SEQ ID NO: 214856 - protein, 46 aa, Glycine max
  Coding DNA Sequence Number=SeqID_98078
MKEGHIPFELGAMFGHNTSNVVDEGSRQDGPTPRGESSLDSNFLAT

SEQ ID NO: 214857 - protein, 47 aa, Glycine max
  Coding DNA Sequence Number=SeqID_98079
MAVGIKQKDLVNKMVQKFLASNFVVMLFHYDGIVIREIGNLLSRIMN

SEQ ID NO: 214858 - protein, 42 aa, Glycine max
  Coding DNA Sequence Number=SeqID_98080
MYICVEMAPRKLSSKRSRKDAAAAGTSATPKFDIHRFRSAEH

SEQ ID NO: 214859 - protein, 125 aa, Glycine max
  Coding DNA Sequence Number=SeqID_98081
MSVDEFLAQVAWLGVQPSPFGRGEASTAQEPVPVEEPVPDVEDEPIPPEPFIFETDSVAQEEAAAQEPTSPGASTAKRNFSTLSVTRSWKLACEASMEAGSLIFNEELRHQECVLDKKLGEDALR

SEQ ID NO: 214860 - protein, 75 aa, Glycine max
  Coding DNA Sequence Number=SeqID_98082
  Subcellular localization annotation: CTP_CleavageSite=33; ConfidenceScore=5.06e-01
MRVQDLFTHREGSIKGVALAPTYPQMMNEERCRSRLGSQFGSASASFFSSSFFFSLISLNDGPWNPFLSHLHAYL

SEQ ID NO: 214861 - protein, 109 aa, Glycine max
  Coding DNA Sequence Number=SeqID_98083
  Subcellular localization annotation: CTP_CleavageSite=31; ConfidenceScore=5.43e-01
MNVGALISGQITSMAQSNSSRIGFLALITTLCRSRGVAFDSLVFERLSPLVAPPDSISTVEQFNEWLAWPGTQPPLHREDEDPATQVPHQPKDESSESSTPEPLIKKRR

SEQ ID NO: 214862 - protein, 43 aa, Glycine max
  Coding DNA Sequence Number=SeqID_98084
MAKLRDTILFESKRQEGGLRNIGRVEWVYSRVEGNAARFLDLA

SEQ ID NO: 214863 - protein, 83 aa, Glycine max
  Coding DNA Sequence Number=SeqID_98085
  Subcellular localization annotation: CTP_CleavageSite=59; ConfidenceScore=5.54e-01
MRKIPKKGDKRVFSLVFLDPSSPRLASGSPGLPNNFMVKKPTRLGELIPSALSFSLPGRAATTQSDPLPINRRRRGVLRGSES

SEQ ID NO: 214864 - protein, 61 aa, Glycine max
  Coding DNA Sequence Number=SeqID_98086
MHSQGVRDIWNSLPTPIYRKRGDEVAAQLAQASWVASSRSNPTSKIFWKGFRNFTEALRKP

SEQ ID NO: 214865 - protein, 429 aa, Glycine max
  Coding DNA Sequence Number=SeqID_98087
  Gene Ontology: Cellular component=integral to membrane
  Homolog annotation: Hit_ID=Q82VI9; Match level="QueryCoverage=51%, HitCoverage=65%, E-value=1e-43, Identity=41%"; Hit description =Putative transmembrane sensor
  Pfam annotation: Domain name=FecR; Domain location=62-155; Score =134.3; E_value=3.3e-37; Accession=PF04773.4; Description=FecR protein
  Pfam annotation: Domain name=STN; Domain location=324-374; Score =28.8; E_value=1.9e-05; Accession=PF07660.4; Description=Secretin and TonB N terminus short do
  Pfam module annotation: Pfam domain module=FecR::STN; Domain location= 62-155::324-374
MQDLRGAASQAAAPARAGFEAAFAHAGKRRASRMLFAIGAALIVAAAGWMTLQAYPAAYLTADVHSVTGEWRVQLLEDGSRVTLAGDSAVNLRFNRQRRELELVQGQVLIEVAKDALRPFVVRTREARLTALGTRFAVDRHDGVTKLAMIESRVRVEAAGAAPAQALVVQAGQRVAVSARGAGPIVAVDPGQVEDAWKFHQLAARDQPLADVLKELNRHRPGRIFYDGAALAGIRMTVVLPLDDTDRALRLLAESVPGLTLRFASSYFVWRAPHTLSPAARLVLAGLGASVALIAQAQHVDRQYDIPAGSLADVLSRYAQQSDIALSLIAEQVAGRESPGLHGRYAVEEGFAALLRGTGLQARRGASGYVLVVSPGAVTLAPVEIEGDEVAGKEVYAAPRSSVHLSSQDLDRFGRVSVGDLLAGIPGVQ

SEQ ID NO: 214866 - protein, 52 aa, Glycine max
  Coding DNA Sequence Number=SeqID_98088
MAFFLSYLDYKAQNAQVSNALGNGNVAHTPEIFTKIPTIYIRVLQSLQDIRL

SEQ ID NO: 214867 - protein, 82 aa, Glycine max
  Coding DNA Sequence Number=SeqID_98089
  Subcellular localization annotation: CTP_CleavageSite=31; ConfidenceScore=5.41e-01
FFDVSVKNVENTQKGGPKGHLKFFLTPGSPRLSSSSPGPPNNLGVEAIARLGELLINQVPLFPINRRERAEGRVQTFNIERI

SEQ ID NO: 214868 - protein, 129 aa, Glycine max
  Coding DNA Sequence Number=SeqID_98090
MKEMIESFFLYRILEVHYEDSAPIKTFLSMWWSSGKQRQLMVAIGGLRHFTLSACPLALSSTFRAEHNSSRVGIALSALLAISKMSKCFTLKIPMVKPWGCGLQTYSLNLKAIQWLMSLGSLFYQNGFR

SEQ ID NO: 214869 - protein, 418 aa, Glycine max
  Coding DNA Sequence Number=SeqID_98091
  Gene Ontology: Mol. function=protein kinase activity; Cellular component=integral to membrane; Biological process=protein amino acid phosphorylation
  Homolog annotation: Hit_ID=Q6R2J8; Match level="QueryCoverage=95%, HitCoverage=52%, E-value=1e-162, Identity=73%"; Hit description =Strubbelig receptor family 8
  Pfam annotation: Domain name=Pkinase; Domain location=81-384; Score =106.8; E_value=6.2e-29; Accession=PF00069.15; Description=Protein kinase domain
  Pfam annotation: Domain name=Pkinase_Tyr; Domain location=81-384; Score=81.3; E_value=3e-21; Accession=PF07714.7; Description=Protein tyrosine kinase
  Pfam module annotation: Pfam domain module=Pkinase::Pkinase_Tyr; Domain location=81-384::81-384
  Subcellular localization annotation: CTP_CleavageSite=71; ConfidenceScore=5.21e-01
MAYMHPNQFTFSIGFVLAVTPQMQEQRVKSAAVVTDLKPRPAENVTVERVAVKSGSVKQMKSPITSTLYTVASLQSATNSFSQEFIIGEGSLGRVYKADFPNGKVMAIKKIDNSALSLQEEDNFLEAVSNMSRLRHPSIVTLAGYCAEHGQRLLVYEYIANGNLHDMLHFAEDSSKALSWNARVRIALGTARALEYLHEVCLPSVVHRNFKSANILLDEELNPHLSDCGLAALTPNTERQVSTQMVGSFGYSAPEFALSGVYTVKSDVYSFGVVMLELLTGRKPLDSLRVRSEQSLVRWATPQLHDIDALAKMVDPTLNGMYPAKSLSRFADIIALCVQKNVLGCMGTCGVEVSLRRLDQMEEVLLLEPEPEFRPPMSEVVQALVRLVQRASVVKRRPSEESGFGHKTPDHEAMDMPF

SEQ ID NO: 214870 - protein, 255 aa, Glycine max
  Coding DNA Sequence Number=SeqID_98092
  Gene Ontology: Mol. function=structural constituent of ribosome; Cellular component=intracellular; Biological process=translation
  Homolog annotation: Hit_ID=Q8LE97; Match level="QueryCoverage=94%, HitCoverage=75%, E-value=2e-70, Identity=61%"; Hit description=50S ribosomal protein L4
  Pfam annotation: Domain name=Ribosomal_L4; Domain location=120-255; Score=41.5; E_value=2.9e-09; Accession=PF00573.12; Description =Ribosomal protein L4L1 family
  Subcellular localization annotation: CTP_CleavageSite=59; ConfidenceScore=5.06e-01
MAALISKRILRCSSWSLHSLGRCYFDSPSAGFASIYKPRDVCSSLSGERMLPADRSLVRSMVRQFSTSILTPGADDSAFPSDLLSKKTLATSERTIGNLDGGLCQDLLIPVTNFHNEDKGYMVFPGDVFDLPIRKDIIHRVVRWQLAKRQQGTHSTKTISEVSGTGRKPWNQKGTGRARHGSLRGPQFRGGATMHGPKPRSHAFKVNKKVRRLGLKIALSARAAEGKASLLPHLCPHSPSKNKKWHLIYIILSVA

SEQ ID NO: 214871 - protein, 73 aa, Glycine max
  Coding DNA Sequence Number=SeqID_98093
  Gene Ontology: Mol. function=sequence-specific DNA binding; Cellular component=nucleus; Biological process=regulation of transcription, DNA-dependent
  Homolog annotation: Hit_ID=P46608; Match level="QueryCoverage=86%, HitCoverage=16%, E-value=3e-33, Identity=100%"; Hit description =Homeobox protein SBH1
MRTAFIIYMKLALAESTGLDQKQINNWFINQRKRHWKPSEDMQFVVMDPSHPHYYMDNVLGNPFPMDLSHPML

SEQ ID NO: 214872 - protein, 74 aa, Glycine max
  Coding DNA Sequence Number=SeqID_98094
  Subcellular localization annotation: CTP_CleavageSite=41; ConfidenceScore=5.51e-01
MAESSKKRKGSSSFTTTAGHRRHDASGDSLTPPNPSLSSPCSFTLFSTDVQRQRYYFSFSNRVILDPKFLNFEF

SEQ ID NO: 214873 - protein, 52 aa, Glycine max
  Coding DNA Sequence Number=SeqID_98095
MANEEHRTKNDVEVDDGCNSVRPLPQPPSRLFIGNEGIWDYGSSARRADASS

SEQ ID NO: 214874 - protein, 84 aa, Glycine max
  Coding DNA Sequence Number=SeqID_98096
  Gene Ontology: Mol. function=sequence-specific DNA binding; Cellular component=nucleus; Biological process=regulation of transcription, DNA-dependent
  Homolog annotation: Hit_ID=P46608; Match level="QueryCoverage=90%, HitCoverage=20%, E-value=2e-30, Identity=85%"; Hit description =Homeobox protein SBH1
  Pfam annotation: Domain name=ELK; Domain location=45-66; Score=38.2; E_value=2.8e-08; Accession=PF03789.4; Description=ELK domain
MFYIGARLFILCTNSTCNEGAERNGSSEEDVDLHNMIDPQAEDRELKGQLLRKYSGYLGSLKQEFMKKRKKGKLPKEARQQLLE

SEQ ID NO: 214875 - protein, 140 aa, Glycine max
  Coding DNA Sequence Number=SeqID_98097
MHQSNILFWRFNDISQVVPILTYLDNIDADVLAWKFKYGPSLHYDDREVITYHSQDIDEWCFFDVVGLLKGDVFDGSMKLWWKAEHASFEGNLEPFLDNNDAMELTTYAIQNKCEMAIYVEHPVTTLDYTHEMCFEDGQR

SEQ ID NO: 214876 - protein, 246 aa, Glycine max
  Coding DNA Sequence Number=SeqID_98098
  Gene Ontology: Mol. function=sequence-specific DNA binding; Cellular component=nucleus; Biological process=regulation of transcription, DNA-dependent
  Homolog annotation: Hit_ID=P46608; Match level="QueryCoverage=92%, HitCoverage=60%, E-value=8e-75, Identity=67%"; Hit description =Homeobox protein SBH1
  Pfam annotation: Domain name=KNOX1; Domain location=117-161; Score =92.5; E_value=1.3e-24; Accession=PF03790.4; Description=KNOX1 domain
  Pfam annotation: Domain name=KNOX2; Domain location=171-222; Score =109.7; E_value=8.2e-30; Accession=PF03791.4; Description=KNOX2 domain
  Pfam module annotation: Pfam domain module=KNOX1::KNOX2; Domain location=117-161::171-222
  Subcellular localization annotation: CTP_CleavageSite=60; ConfidenceScore=5.00e-01
MEGSSCSNDTSYLLAFGENSGGLCPMTMMPLVTSHHATNPSNPSNNTNNNENTNCLFIPNCSNSSGTPSIMLHNNNNTDDDNNKTSTNTGLGYYFMESDHHHRNNNNNGSSSSSSSSAVKAKIMAHPHYHRLLAAYVNCQKVGAPPEVVARLEEACASAATMAGDAAAAAGSSCIGEDPALDQFMEAYCEMLTKYEQELSKPLKEAMLFLQRIECQFKNLTISSTDFGDDPLPLSIFSKYSAYLKI

SEQ ID NO: 214877 - protein, 47 aa, Glycine max
  Coding DNA Sequence Number=SeqID_98099
MDGSVEGSLLVNLGLVNNLGIRVSSAVVPRSDEKVGRKELKFFGDKC

SEQ ID NO: 214878 - protein, 447 aa, Glycine max
  Coding DNA Sequence Number=SeqID_98100
  Gene Ontology: Mol. function=ribulose-bisphosphate carboxylase activity; Cellular component=chloroplast ribulose bisphosphate carboxylase complex; Biological process=carbon utilization by fixation of carbon dioxide
  Homolog annotation: Hit_ID=P27066; Match level="QueryCoverage=99%, HitCoverage=100%, E-value=0.0, Identity=90%"; Hit description =Ribulose bisphosphate carboxylase large chain precursor
  Pfam annotation: Domain name=RuBisCO_large; Domain location=126-434; Score=803.8; E_value=9.7e-239; Accession=PF00016.10; Description =Ribulose bisphosphate carboxylase large chain, catalytic domain
  Pfam annotation: Domain name=RuBisCO_large_N; Domain location=21-118; Score=164.2; E_value=3.2e-46; Accession=PF02788.6; Description =Ribulose bisphosphate carboxylase large chain, N-terminal domain
  Pfam module annotation: Pfam domain module=RuBisCO_large::RuBisCO _large_N; Domain location=126-434::21-118
MSPQTETKASVGFKAGVKDYKLTYYTPDYETKDTDILAAFRVTPQPGVPPEEAGAAVAAESSTGTWTTVWTDGLTSLDRYKGRCYGLEPVAGEENQYIAYALRALRLEDLRIPTAYIKTFQGPPHGIQVERDKLNKYGRPLLGCTIKPKLGLSAKNYGRAVYECLRGGLDFTKDDENVNSQPFMRWRDRFLFCAEAIFKSQAETGEIKGHYLNATAGTCEEMMKRAVFARELGVPIVMHDYLTGGFTANTSLAHYCRDNGLLLHIHRAMHAVIDRQKNHGMHFRVLAKALRLSGGDHVHAGTVVGKLEGEREITLGFVDLLRDDFVEKDRSRGIYVTQDWFSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 214879 - protein, 357 aa, Glycine max
  Coding DNA Sequence Number=SeqID_98101
  Gene Ontology: Mol. function=nucleoside-triphosphatase activity; Cellular component=membrane
  Homolog annotation: Hit_ID=Q6Z7T4; Match level="QueryCoverage=67%, HitCoverage=40%, E-value=2e-64, Identity=53%"; Hit description =Putative AAA family ATPase
  Subcellular localization annotation: CTP_CleavageSite=74; ConfidenceScore=5.80e-01
MERLARSARTWRWHWRSFSSFQTLASRSSPPSSFPKFASSWSTSSSVSSSRVLREDYSLLPVVLAGIFGTGFVEAAYADNGAVDVQESAKKERERIEELLRSRGIRYGSYPRFTVSVKGQKVSIKFQIPPNCEVSQLIANLTAHLGTKAEGHGGGSDMLLRAWDSTVAWQLTLTHPSKLKHIQGNNLSSTDIIADDRDLCILIFHSLIGSDKAEIEFIKQGDLSPEELDAFVSVLQLAGNKLGQRNTLERKPREETEKVPSVDKSISDLEGMGVRIYGLDEPVGISNDGEISWDNIAGYEHQKRVVEDTILLALHSPEVYDDIARGTRHKFESNRPRAVLFEGPPGVSFRLFYTFCV

SEQ ID NO: 214880 - protein, 81 aa, Glycine max
  Coding DNA Sequence Number=SeqID_98102
MLRIPSLLKVNLVFRVESSQLITEISAKPCLRCCSSFDGGRRRYTYKDTPNKGAKVKVLFQASSNDVKGTQTPNYPTYAIP

SEQ ID NO: 214881 - protein, 917 aa, Glycine max
  Coding DNA Sequence Number=SeqID_98103
  Gene Ontology: Mol. function=RNA-directed DNA polymerase activity; Cellular component=chromatin; Biological process=chromatin assembly or disassembly
  Pfam annotation: Domain name=rve; Domain location=613-745; Score= -10.6; E_value=0.046; Accession=PF00665.16; Description=Integrase core domain
  Pfam annotation: Domain name=zf-H2C2; Domain location=554-595; Score =14.6; E_value=0.0042; Accession=PF09337.1; Description=His(2)-Cys(2) zinc finger
  Pfam module annotation: Pfam domain module=RVT_1::rve::zf-H2C2; Domain location=221-422::613-745::554-595
MVAYLLEFEELANRIIGLPAPFLLSCFISGLTPEIRQEVQAHQPLTLAQAVGLARLQEEKRFDHPRSQRPRLPPITPPPRPIPLPPLLPSPPRPPPPIVKCLMLEEITLRQECGFCFTCDERYHRGHRCASRVFLLVADEEEPNWLHMEPVDPPQPASLVSNPNPAHPAQISLNSLLGTLAQETLRLTGSLAGHHGENDTTLGILTQHQLRRLSQKHDDVSYFHITMFPKDPPTPLPADTPAAIHTLLTKFAALFQYPQTLPPARSTDLHIHLVPDSPPVNHEPLLIAGIAGSEAGWNVAGYHQIRMHYADIPKIAFRTHHVHYEFNVLLFGLCNAPSSFQATMNLLFRSYLRHFIIVFFDDILIYSSSFEAHLSHLETAFQHALSSTPILALPNFSLPFTVETDAFVIVKKWRQYLLGWRFIIITDHRSLKELLTQTIQTPEQHMYLTCLIGYDYQIQYRADNHNQAADALSRLPAQESSMSMILSVPSLTFLEELRRQLNTYPEYTQQRQQILEDPTNQPQFSLSNDLVLHASHIWLSRDIPIISTLLTEYHATPTGGHADVAKTLAKISANFYWPGLRDDVKHFVANCVDCQVTKYEAQKVVGLLCPLPVPCRPWEDLSLDFIVGLPVYQGHTTILMVVDRFSKGIHLGTLPAAHTAHMVAIPFINIVVKIHGILRSLVSDRDPLFISSDGQTEVLNRIIEQYLRAFVHRRSSLWGLGWNVVEEMMTDRDDTFQLIRKKLLKAQEAMKRQADSHRREVNYKEGDWVLPKLRPRRQTTAKGSQAITGKLAKRFYGPFLILQCIGPVTYKLQLPAASKIYHVFHSSMLKPFCGSPEQMTGLELPGLSPDETSWEDWTQLCSTYQLEDKVVLQGPKDDRNSETTIIGTRVEIANQGVQGEAKPKRKVVKPSYLKDYV

SEQ ID NO: 214882 - protein, 109 aa, Glycine max
  Coding DNA Sequence Number=SeqID_98104
MGHTGFVVLAGMLARRDKGGVVRNWWRLVRGRRGHGSYAGEELIHFEGHGLHGITKLSKDILEVAGGVFMLPSNIMIQKIFAITKLGSACPPKADHIKQGYSLWCEVLY

SEQ ID NO: 214883 - protein, 372 aa, Glycine max
  Coding DNA Sequence Number=SeqID_98105
MLESSMQCLKCSKEEATKWNTALNNNEACNKFNMLHGMKHVEEKQIVGDCYFGVTNLLELLRAQRSINELKATQKSSKKTVEQFLQNLEDKRVSQKCRECLKIGTMLDNIKDKLAREKRSRERMELFNTKLVHELAKTKISAKQYMTNYKKEKRERKLIEEVCNELAMQVREDTAKLEVLLSDSVKICKEVEEEREMMEMAELWREERVQMKLADVQFLLEDKYNQMVQLIAFLQVFLRSRGAELDTTELEDAELIKQVVESVNIKRILELSYDFSKSDDTVSTFEELRKENTEEGKIKPCYSHTTLTSPMSTIYIENLDEELNESSILHHNSPSSDYNFGLEPTNYSLETIGYIEDRKFSSMPQRGDTYFC

SEQ ID NO: 214884 - protein, 326 aa, Glycine max
  Coding DNA Sequence Number=SeqID_98106
  Gene Ontology: Mol. function=structural molecule activity; Cellular component=chloroplast; Biological process=response to stress
  Homolog annotation: Hit_ID=Q2HTH4; Match level="QueryCoverage=84%, HitCoverage=80%, E-value=7e-89, Identity=67%"; Hit description=PAP fibrillin
  Pfam annotation: Domain name=PAP_fibrillin; Domain location=80-317; Score=352.6; E_value=6.5e-103; Accession=PF04755.3; Description=PAP _fibrillin
  Subcellular localization annotation: CTP_CleavageSite=44; ConfidenceScore=5.44e-01
MASLSHLNKLLCMPPLNSSPSISPPRSSVGIWTKPVGRPRLLVRVRAVTSDDEWGPEKEEAYGGGVAVEEKPTKSETETEKLKKALVDSFYGTDRGLKATSETRAEIVELITQLEAKNPNPVPTDALTLLNGKWILAFYITVDIKTSDVNITGINKVEIVKFLTESYQLMGGFEVPQVEEISQIIDSLNFTVQNSVQFAGPLATTSISTNAKFDVRSPKRVQIKFEEGIIGTPQLTDSLEIPENVEFLGQKIDLTLFKGILTSVQDTATSVVKTISSRPPLKIPISNSNAQSWLLTTYLDEELRISRGDGGSVFVLIKEGSSLLTR

SEQ ID NO: 214885 - protein, 297 aa, Glycine max
  Coding DNA Sequence Number=SeqID_98107
  Homolog annotation: Hit_ID=Q47522; Match level="QueryCoverage=19%, HitCoverage=77%, E-value=5e-19, Identity=74%"; Hit description=LacZ protein
LELLRADQRLISPKVGPGLPGINRDTRIYVFCEVLQWLLFLSAVPPVQLLTGWCVTAKAPPDISAGKCSGHAARRVPFAIQAAQLLGRAIGAGLFAITPAGERGMCCKAIKLGNARVFPEFDAAVDEKVLDVQENIPYGALPTDNVEHRSAAIVGKVEADFDGLVEKDPYCVIPKLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPEDT

SEQ ID NO: 214886 - protein, 109 aa, Glycine max
  Coding DNA Sequence Number=SeqID_98108
MDKASNIREKKQSNISFNNKYADLNKLQQHTQYSMGTRITALWSQEFPFELSILSRGFIEDATEQTWTIFQSHTPSISNWTSLIDLYITSVIELCPRDPSLASPLAQAL

SEQ ID NO: 214887 - protein, 405 aa, Glycine max
  Coding DNA Sequence Number=SeqID_98109
  Gene Ontology: Mol. function=N-acetyltransferase activity; Biological process=metabolic process
  Homolog annotation: Hit_ID=Q42381; Match level="QueryCoverage=97%, HitCoverage=99%, E-value=1e-158, Identity=67%"; Hit description =Putative N-acetyltransferase hookless1
  Pfam annotation: Domain name=Acetyltransf_1; Domain location=61-165; Score=58.7; E_value=1.9e-14; Accession=PF00583.14; Description =Acetyltransferase (GNAT) family
MGEELSPTLVVREFDLNKDRERVETVERSCEVGPSGKLSLFTDMLGDPICRVRHSPAFLMLVAEIGEEIVGMIRGCIKTVTCGKRLSRNGKYNNTNVKHVPVYTRVAYILGLRVAPNQRRMGIGLKLVHRMESWFRDNDAEYSYMATERDNLASIKLFTDKCGYSKFRNPSILVNPVFAHRARVSPRVTIVSLSPSDAEFVYRRHFATTEYFPRDIDSILNNKLNLGTFLALPNGSYSAETWPGPDLFLSDPPHSWAMVSVWNTKEVFTLEVRGASRLKRTLAKTSRLVDRALPWLRLPSMPDLFRPFGFQFMYGLGGEGPEGVKMVKALCGFVHNLAMEKGCSVVATEVSSNEPLRFGIPHWKMLSCEDLWCMKRLGEDYSDGSVGDWTKSQPGMSIFVDPREV

SEQ ID NO: 214888 - protein, 94 aa, Glycine max
  Coding DNA Sequence Number=SeqID_98110
MVMNPQVNVFWKLMKVRIGKAKKDAPKEKPAKKKNIEKETAGKWHTDDDESSSLGGQGDVSAEEAAIMRLQIHLFWANMLFQQSLVECKLGMSD

SEQ ID NO: 214889 - protein, 119 aa, Glycine max
  Coding DNA Sequence Number=SeqID_98111
  Gene Ontology: Mol. function=oxidoreductase activity; Cellular component=mitochondrial respiratory chain; Biological process =carotenoid biosynthetic process
  Homolog annotation: Hit_ID=Q2HTI6; Match level="QueryCoverage=99%, HitCoverage=40%, E-value=2e-55, Identity=78%"; Hit description =Alternative oxidase
MAYHFSECVESHAFETYDKFIKVQGDELKKMPAPEVAVNYYTGDDLYLFENLYDVFVNIRDDEAEHCKTMKACQTHGNLRSPHSYAEDDDSSVCALEADCEGIVDCIKKSVASNPAKVK

SEQ ID NO: 214890 - protein, 117 aa, Glycine max
  Coding DNA Sequence Number=SeqID_98112
  Homolog annotation: Hit_ID=Q1RWR6; Match level="QueryCoverage=30%, HitCoverage=8%, E-value=8e-11, Identity=89%"; Hit description =Pentaxin
MGPDPLSLPPAGPEFGPDLTDPDDGRDGFGSTPGISNIFPSSPDFLGSPPVYGTERDVIVGGRSFTCSGVGGASGRRTKLEVREVKVKVQWNCRNGVERRQPTETKLRQPSNVVVLY

SEQ ID NO: 214891 - protein, 320 aa, Glycine max
  Coding DNA Sequence Number=SeqID_98113
  Gene Ontology: Mol. function=ubiquitin thiolesterase activity; Cellular component=intracellular; Biological process=ubiquitin -dependent protein catabolic process
  Homolog annotation: Hit_ID=Q1RWR6; Match level="QueryCoverage=99%, HitCoverage=67%, E-value=1e-117, Identity=68%"; Hit description =Pentaxin
MVYGSAVTSLSEEVRVGFRVSRAVVWVFMVVVAMSLLVGVFLMVAVKKAVILVALGAVIVPVVVLIAWNCVWGRRGLLGFVKRYPDAELRGAIDGQYVKVTGNKEEGTGIVAFLQKWMSYCYTLSFFLIMILEQVVTCGSIPLESSYQRVPRCVYVSTELYEYKGLGGKSANSKHRCFTWGSRYSEKYVADFYVSDFQSGLRALVKAGYGAKVAPFVEPTTVVDITKDNRELSPNFLGWLADRKLSSDDRIMRLKEGYIKEGSTVSVMGVVQRHDNVLMIVPAAEPVSTGCQWIRCLLPTYVEGLILTCDDSQNADVIPV

SEQ ID NO: 214892 - protein, 286 aa, Glycine max
  Coding DNA Sequence Number=SeqID_98114
  Gene Ontology: Mol. function=transferase activity; Biological process= metabolic process
  Homolog annotation: Hit_ID=Q1XNN4; Match level="QueryCoverage=99%, HitCoverage=82%, E-value=3e-74, Identity=45%"; Hit description=ADP -heptose:LPS heptosyltransferase-like
  Pfam annotation: Domain name=Glyco_transf_9; Domain location=47-285; Score=-55.1; E_value=0.0011; Accession=PF01075.8; Description =Glycosyltransferase family 9 (heptosyltransferase)
EVNDTFPDARIDLFVKGSISPIIFKNYKNIDQIIQLPKKPFSNLLKYIRSWSLLRWKKYDLVINTSHSSSSGKISTQLANGDYKFFNEWSDELHSEYPDYPHAAKNPIYNLRKFLTHLGFERNTGKVPFLNIKLSPEEIETGKRKLEGITKNDKKTICLFTNATGDKCYSNTWWASFYESLKITFPDYNIVELLPVENISRLDFKIPSFYSTDIREMGAFIANTSVFIAADNGVMHLASAVGTPTIGLFMVTDENAYKPYNDKSFSINTNNVKESEIPDLIKMVLQ

SEQ ID NO: 214893 - protein, 277 aa, Glycine max
  Coding DNA Sequence Number=SeqID_98115
  Gene Ontology: Mol. function=sugar binding; Biological process =protein amino acid phosphorylation
  Homolog annotation: Hit_ID=Q8W408; Match level="QueryCoverage=46%, HitCoverage=38%, E-value=2e-19, Identity=35%"; Hit description=S receptor kinase 32
MNDTGDLQAVSTTRPKRKPHIYEFTTPRHASTSFVCDLNVGISSARTIPEAKILTLPWVHAPVHKHIGCLRLNTPTHVQTDEALVVTQPIRTTRSVAITLILRRVLKRGPSFATWHPTNEDSVVEVEPFCGIDSSIKEEGVVVAAAGELLADLGNGDLATIRGRVGVAVSKEGNDHNGKRSRQGMDGGGGTGGGVGVGSGVGKGDWLCCIGTGHGGAVSLEGGGDGGDCTEDDGKFGHGGLEAILASGRKFGIRHSRCVPKWKGRWLLMEGSVERKQ

SEQ ID NO: 214894 - protein, 339 aa, Glycine max
  Coding DNA Sequence Number=SeqID_98116
  Gene Ontology: Mol. function=metallopeptidase activity; Cellular component=cytoplasm; Biological process=amino acid metabolic process
  Homolog annotation: Hit_ID=Q9C6Y8; Match level="QueryCoverage=81%, HitCoverage=69%, E-value=1e-96, Identity=62%"; Hit description =Aminoacylase, putative
  Pfam annotation: Domain name=Peptidase_M20; Domain location=93-271; Score=41.5; E_value=2.8e-09; Accession=PF01546.18; Description =Peptidase family M20M25M40
  Subcellular localization annotation: CTP_CleavageSite=33; ConfidenceScore=5.74e-01
MTFPIFLSSLSHSHSPSSPLRNRNNLTTQTPPRSTRRHSHHALPALPPYQHGPPFPRRLLRGLLPQSPGPKPGPQNPNPRVRPTRSGSNPFLLLNSHLDSVPAEPEKWLHPPFSVHRTSSGAIFARGSQDDKCITIQYLEAIRNLKSQSFTLHRTIHISLVPDEEIGGFDSAAKFVESEEFDGLNVGFALGEGQASPGDEFRVFYSDRVPWNVKIRARGLPEHGSRMYDGSAMENLMESVEVVNRFMESQFDVVKAGNALNAEVVSGFVMNVQPLGAEAGFDLRLTPTTDAEEMRRRIAKEWAPAVRNMSYEAFIQYVVIGCIFCSSRILDSPCLGATD

SEQ ID NO: 214895 - protein, 64 aa, Glycine max
  Coding DNA Sequence Number=SeqID_98117
MSQRVRDENGFEVGPISSAFALDGFGAECKEAFKAFVDDAYAGDIKREGSMEVEVVEVIVMMGF

SEQ ID NO: 214896 - protein, 68 aa, Glycine max
  Coding DNA Sequence Number=SeqID_98118
MERCLSLDLLEQTEETCEQDIFRFGIHWNKQVMKADISMRGLAKNVAATMVEAMPCYSAMALGKNSTM

SEQ ID NO: 214897 - protein, 167 aa, Glycine max
  Coding DNA Sequence Number=SeqID_98119
MARTKKTRQMTSKAAKEIADKIASQDFFVTHGCQDVLTAAIGRLEHPSRVRGARPGVMIKKYFGPASRTSRTSSSMASKDLEKLTQKIRDQLEELALPPEFEGSTTIHNIPLLLDQVKVGVEEVRDADAPIPVPIEKVMWDATVFGVFNENFPLYIKHEDLSKIAPV

SEQ ID NO: 214898 - protein, 37 aa, Glycine max
  Coding DNA Sequence Number=SeqID_98120
MAYIPKCPTFMLEKSGIRLICKFVKDQVDPQVAHGST

SEQ ID NO: 214899 - protein, 116 aa, Glycine max
  Coding DNA Sequence Number=SeqID_98121
  Gene Ontology: Mol. function=amino acid transporter activity; Cellular component=integral to membrane; Biological process=amino acid transport
  Homolog annotation: Hit_ID=O64759; Match level="QueryCoverage=97%, HitCoverage=20%, E-value=7e-36, Identity=64%"; Hit description =Putative amino acid transporter
MERSWGSYGIALRETPWKFKNRVMTRSKDETEVVEMKGRSSNEMKKTLNSWDLIWFGIGAVIGSGIFVITGLEARDAAGPAVVLSYVVSGISALLSVFCYTEFAVEIPVAGFSPNY

SEQ ID NO: 214900 - protein, 76 aa, Glycine max
  Coding DNA Sequence Number=SeqID_98122
MLLSSNVIHICVRVVMLVRMIHTHLFVAVQVKSCQVVLAQLAFFQDQGMAQDLIKGNYWPLNRERKSRLSIKGRRP

SEQ ID NO: 214901 - protein, 81 aa, Glycine max
  Coding DNA Sequence Number=SeqID_98123
  Subcellular localization annotation: CTP_CleavageSite=50; ConfidenceScore=5.39e-01
MMKKKMTQENVGPPKMVTPSWSKDSVFESEQSKKRSSSSPRPSKDGNSIKSKSKSPTWSKGSESKSLLSMGEDEQMAELAS

SEQ ID NO: 214902 - protein, 97 aa, Glycine max
  Coding DNA Sequence Number=SeqID_98124
MTCGDNPGSLNHNINFMTVFQGRLFYIGCLATTDVEWVGFYRDSKAETDVEWVGFYIGYQSTDVENERYGSVATSVINQPMQKMKGFYIVYRPTDVV

SEQ ID NO: 214903 - protein, 86 aa, Glycine max
  Coding DNA Sequence Number=SeqID_98125
MNSKSKNKKEENYTLLIRGNSWTWKGMMGYNLVFNNQLFNPEKVMDEALFHTWSLRVGTTDEVGPLSPGPSRTEKDHSCTGQHVDE

SEQ ID NO: 214904 - protein, 48 aa, Glycine max
  Coding DNA Sequence Number=SeqID_98126
  Homolog annotation: Hit_ID=Q9FUM1; Match level="QueryCoverage=75%, HitCoverage=8%, E-value=1e-08, Identity=75%"; Hit description =Elongation factor 1-gamma
MALILHATKANKNSFKTLIAAEYSGVQVELDPNFEMGGVQVELASKWN

SEQ ID NO: 214905 - protein, 455 aa, Glycine max
  Coding DNA Sequence Number=SeqID_98127
  Gene Ontology: Mol. function=kinase activity
  Homolog annotation: Hit_ID=Q8LAR3; Match level="QueryCoverage=84%, HitCoverage=83%, E-value=1e-107, Identity=51%"; Hit description =Phosphatidylinositol-4-phosphate 5-kinase, putative
  Pfam annotation: Domain name=MORN; Domain location=215-237; Score =24.0; E_value=0.00054; Accession=PF02493.10; Description=MORN repeat
  Pfam annotation: Domain name=MORN; Domain location=238-260; Score =32.8; E_value=1.2e-06; Accession=PF02493.10; Description=MORN repeat
  Pfam annotation: Domain name=MORN; Domain location=261-283; Score =29.1; E_value=1.5e-05; Accession=PF02493.10; Description=MORN repeat
  Pfam annotation: Domain name=MORN; Domain location=284-306; Score =28.0; E_value=3.5e-05; Accession=PF02493.10; Description=MORN repeat
  Pfam annotation: Domain name=MORN; Domain location=307-329; Score =35.1; E_value=2.4e-07; Accession=PF02493.10; Description=MORN repeat
  Pfam annotation: Domain name=MORN; Domain location=330-352; Score =30.6; E_value=5.5e-06; Accession=PF02493.10; Description=MORN repeat
  Pfam annotation: Domain name=MORN; Domain location=353-375; Score =28.2; E_value=3e-05; Accession=PF02493.10; Description=MORN repeat
  Pfam module annotation: Pfam domain module=MORN::MORN::MORN::MORN::MOR N::MORN::MORN; Domain location=215-237::238-260::261-283::284 -306::307-329::330-352::353-375
  Subcellular localization annotation: CTP_CleavageSite=22; ConfidenceScore=5.47e-01
MEAQKKTQTQTKLTRTQSSLLRCSSPTTTTRSSVHSLSSVNEDFFPEEEKSSSDTSSKRKKKNNKPIRLRPGSIRFSLAGPVLGFFTACTFFSYFLYLGSRAAAATSENVLAVLVFLAATLYFLNRNKSLIQRTFSVLKHAWDGNLKRLGFSTKGSEKPVQWFIGDDATMSSREEGMNKHKKNKNKINNDVVVDVDVGEGDVIEGVEFYSNGDFYEGEFHGGRCSGSGVYHYFESGRYEGEWVDGKYDGYGIESWARGSKYKGCYKQGLRHGFGVYKFYTGDSYAGEWCNGQSHGVGVQACSDGSCYVGEFKFGVKHGLGCYHFRNGDRYAGEYFGDKIHGFGVYHFANGHYYEGSWHEGRRQGYGMYMFRNGDGRCGEWDAGNLKLSLPPQNDAIIRTVQAARKTAENAINLPRKDDHVNKAVIAANRAATAARVAAVKAVQNQMGGKFCDIDV

SEQ ID NO: 214906 - protein, 235 aa, Glycine max
  Coding DNA Sequence Number=SeqID_98128
  Gene Ontology: Mol. function=unfolded protein binding; Cellular component=cytoplasm; Biological process=protein folding
  Homolog annotation: Hit_ID=Q00NU9; Match level="QueryCoverage=91%, HitCoverage=37%, E-value=7e-25, Identity=35%"; Hit description=Heat shock protein 90
RQWLGYHDLVYKLIKLKVEISCLYDQVEQKEKLRNELELMNKSLEESEAQLQSRTVESNELVSQIALLKKEAKRSLDELNRMKNLKYEKELAGRVLQSELEALRTQYNDLKSYLLGDEAEKENVRKQVFQLKGELKKKDDALMNIEKKMMRGNQQTLLYSGHEREVPPKDINIHFEEDYNKFYEGFSKNLKLGIHEDSQNKTKLAELLRYDSSKSADEMTSLKDYVTRMKEGQNE

SEQ ID NO: 214907 - protein, 550 aa, Glycine max
  Coding DNA Sequence Number=SeqID_98129
  Gene Ontology: Mol. function=nucleic acid binding; Cellular component= chromatin; Biological process=DNA integration
  Homolog annotation: Hit_ID=Q1T010; Match level="QueryCoverage=98%, HitCoverage=50%, E-value=1e-108, Identity=44%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
  Pfam annotation: Domain name=rve; Domain location=389-550; Score =157.5; E_value=3.4e-44; Accession=PF00665.16; Description=Integrase core domain
MASTNGNGVFLAHMPILDGKNYNKWCIQMKTIFEMQDALDVVQSGIQDLEKSASDAPEKTFKELKKRDCKALFLIHQGVDAVNFEKIASAATTKQAWEILAKAYAGSDKLKKIRLQNLRRQYEMLQMNDKETVGEYLGHVQIMTNQMSGWGHFAKECKNPKRPRVQNDEAKLVQEENSEYDHVILMVTTALEGGNREENAWYLDTRCSNHMTGRKDWLVDLDLSKKGKVRFADDNTIRTEGMGTMQIQKKDGGISCIYEVLYVPIMNNNLLSLGQLLQNGYRMLLEDNALKIFDKKNRFILKAPMLKNKTFKVEIQANQEVNCLSITEEGESWLWHKRYDHLNFKSLNRLHDQSMVSGLPKLVAPGRECVGCCISKQPRKSYRNLITSRTKSALEVVYLDGCGPMEVETLSGNKIFVTFIDDFTRKVWIYLLKRKSQVFEVFRKYKTMVEKQSKLSIQTLRTDGGGEFTSQDFEMLCEQEGIVHEVTPPYTPQQNGTAERLNRSILNITRNMLKCYEVPKKLWGEAVATTTYLLNRSPSKKLDGITPEEA

SEQ ID NO: 214908 - protein, 199 aa, Glycine max
  Coding DNA Sequence Number=SeqID_98130
MTKVYLTTFVKELVEEHHREEVLPNSKNFPFNHYIIVAMNDGDTNTVNQGKRPRKQEFTMLGMLAMGASEKGNPTNFPFSDNLCKKPLATLEELRARVVSFIQMEKMVRFKEKVYGESSKKLMEDSLRIKNLHGSKKGSVIKVDSVVGLEKQYNRNHDETSPPETQIQGVINMIAGGFTSGGSSKSASKCYVRSLKFVN

SEQ ID NO: 214909 - protein, 59 aa, Glycine max
  Coding DNA Sequence Number=SeqID_98131
PKQFGGPGKPEASLGELGSRKLPEKTLLPIPLGIFRILDQNIERSFILRSNWCRTTQFG

SEQ ID NO: 214910 - protein, 65 aa, Glycine max
  Coding DNA Sequence Number=SeqID_98132
MHDATTTDASNKSCHVERDALVAAAAWPSAYVEWDAQASTTALADQEQLLQQEQGGSANDVGILG

SEQ ID NO: 214911 - protein, 90 aa, Glycine max
  Coding DNA Sequence Number=SeqID_98133
MGAKYLEVVKRGSHPNKRMVLGRNLGMTLTNLGIKHQVTSVEHPQSNGQIDAANKVMPEEEKSESEKEKEIELRSFRPSYGLIIALRSRQ

SEQ ID NO: 214912 - protein, 195 aa, Glycine max
  Coding DNA Sequence Number=SeqID_98134
MARSSALTNLVLKDDKAEKKKAEKAKDDKGKKHDEVEEKWVPPPSFIKPSAAKRAHPSHSHQQDVAATRQRVELVPIATPSSIKNCEMLREADQQASMDSIANFQVRTWRIVDFWANEFEKTVTKSNKAQTELDKTKLKEVEAQEEALKTKLTITEASTKVLKKEIERLNKEFSLFKVNAENLKSDLSKVEYEIL

SEQ ID NO: 214913 - protein, 71 aa, Glycine max
  Coding DNA Sequence Number=SeqID_98135
MVPESKLITFVLGLIPLNFFMDGGSDASNRDDTIDGNTRLLVIGDIRATVMVKYLAKEKILVGLGYNQTDE

SEQ ID NO: 214914 - protein, 192 aa, Glycine max
  Coding DNA Sequence Number=SeqID_98136
  Gene Ontology: Mol. function=transcription factor activity; Biological process=regulation of transcription, DNA-dependent
  Homolog annotation: Hit_ID=Q6KAY3; Match level="QueryCoverage=98%, HitCoverage=86%, E-value=2e-93, Identity=95%"; Hit description =Transcriptional repressor
  Subcellular localization annotation: CTP_CleavageSite=35; ConfidenceScore=5.07e-01
MPSRLRSISSGSTIATVQHAQYGGVQHARGDLRVRSFAQLAQVPGPAKRTLHPVQRIAESGLLHFGQHLGVGGGIAAQHDLHGLEQALILGQLDERVDHHRAQVVYRSVALLGGGAFQFLHEGQVHALDDGGQHLALVLEVPVDRATGIAGAGADHLQRGTGHAVFMETGFGGVKDAFPGCLGVLIGLAGHG

SEQ ID NO: 214915 - protein, 132 aa, Glycine max
  Coding DNA Sequence Number=SeqID_98137
  Gene Ontology: Mol. function=transferase activity, transferring nitrogenous groups; Biological process=biosynthetic process
  Homolog annotation: Hit_ID=Q67UZ0; Match level="QueryCoverage=84%, HitCoverage=28%, E-value=1e-26, Identity=52%"; Hit description =Putative cysteine conjugate beta-lyase
MLFHSYHDSVCLDKGEGTVTVRLLPSFFILTFASSTPMQCAASAALRAPDSYFVEKEGLYSKEGYLGSRFEGCWIRAFCEYLIKEAGVAAIPTSVFYLNPEEGKNPVRFTFCKDDETLKAAVERMKEKLKRK

SEQ ID NO: 214916 - protein, 415 aa, Glycine max
  Coding DNA Sequence Number=SeqID_98138
  Gene Ontology: Mol. function=transporter activity; Cellular component= membrane; Biological process=transport
  Homolog annotation: Hit_ID=Q6KAY9; Match level="QueryCoverage=69%, HitCoverage=62%, E-value=1e-107, Identity=81%"; Hit description =Outer membrane protein
  Pfam annotation: Domain name=OEP; Domain location=117-290; Score =59.7; E_value=9.5e-15; Accession=PF02321.8; Description=Outer membrane efflux protein
NRRNAQLSLVAEPATAWLTYDADAQQLKIAEVHVEDLGGFAAPGRGPPRTWWQFGAGADPDPYPGRDRTYGCCTPAWPAGPGPQCAGAAGRWPAGSGTAAGQHRTAAACTGPAAGRPAQRRAAAAPGHHGRRTPAAGRKRQHRCGTRSVLPEHLADRQHRQCGTRVWSFLPKITLPIFQGGKLRANLAIANADRDIALAQYEKSIQVGFRETADALALNVSLDEQVSSQQRLVDAAEQANRLSQARYDAGLDSFVTLLDARRTAYNAQQTQLQAQLAQQANRITLYKLSSNSIPVAPGHARRPFVPACLTSGRTALRARRAWPGATAWANGTMQTDIHRDAGSILLGWGCPGCTTHGASRLPRCVPRDRNSSAATKASVCRTAAPATGCCGISPFPSCAPVIRRAAASANADGQA

SEQ ID NO: 214917 - protein, 101 aa, Glycine max
  Coding DNA Sequence Number=SeqID_98139
MGGGAKRRTKNSRAVNNGPIGGYRKWLKAHVQGRKFEAPEEDEKVQALRAELEQAQTVKERFKSAALKIRKENAKLRDINIAYHQGLGTRDQEGSQGRAWP

SEQ ID NO: 214918 - protein, 209 aa, Glycine max
  Coding DNA Sequence Number=SeqID_98140
  Gene Ontology: Mol. function=protein transporter activity; Cellular component=membrane; Biological process=ciliary or flagellar motility
  Homolog annotation: Hit_ID=Q0A6X0; Match level="QueryCoverage=71%, HitCoverage=54%, E-value=8e-37, Identity=52%"; Hit description =MotA/TolQ/ExbB proton channel precursor
VDSRGSHGHHAEHLRFGHFAGLEPRHAPLQQFDDLVFGGVVDDQLHAGAQERIADLLEFLFDLVDVGVHPQLRHVDQFLDVALLVVLVAAEHRDHQLEHPHHFGQRVGDEQRGAGAAQHDGQARQVEVHAGVGGGQRDDDDQGEQADNGADDGRRIHGSCLIASASGSRNAGWWQILATGGSRQSVGKRGERGGKRRLEPASGRGAPGE

SEQ ID NO: 214919 - protein, 135 aa, Glycine max
  Coding DNA Sequence Number=SeqID_98141
  Subcellular localization annotation: CTP_CleavageSite=62; ConfidenceScore=5.74e-01
MTLSSWQNKLNRKMVTPPNSPPPPTGAASQSRSTLKQTRKAIWLRSLATRPVGAERPLVHVDTMTGKADSPHRKKLRTYLGIIARDKAEFDIPEALDPRTKKKILQTMGERWRQFKSDLTSKWALAADKESVEDT

SEQ ID NO: 214920 - protein, 44 aa, Glycine max
  Coding DNA Sequence Number=SeqID_98142
MVAHNLQAPSTHISPPYRSRGISICRPLASAKSEEIVTKRTNTS

SEQ ID NO: 214921 - protein, 74 aa, Glycine max
  Coding DNA Sequence Number=SeqID_98143
MPLSVGLQTWNSGQKRIRDQPLIIRMKIMDRRRKLHSNVMRKLKRVSNGRVKTSIILPKVDIRARSNEPTSIIL

SEQ ID NO: 214922 - protein, 70 aa, Glycine max
  Coding DNA Sequence Number=SeqID_98144
MTYYKREERDWGRAYGAGDGEMAERARRRGQRRGRTTPVTMRGGDIGDSDDERLGLHRLLQDVWILRCEE

SEQ ID NO: 214923 - protein, 101 aa, Glycine max
  Coding DNA Sequence Number=SeqID_98145
MAPSIRFGLLKHIWRIVGRGEKDDGNRGGGGEKEKEMEEVEPTKEVETEESEDGAGGREKEETWRREKKSEVGGTFVVETQGYGIEDPRVEVGAKEDPASG

SEQ ID NO: 214924 - protein, 336 aa, Glycine max
  Coding DNA Sequence Number=SeqID_98146
MSLFLSDSTIDMGGSDSGGSFEQPIMDREVISIGGSLSEDTYRGASDSKSSSSERGTTFCCYWGASLGHCYPPPSASGGVRRGSGGEDVKASSCVRRSKSVRSLSSTPTVTGYEWVRNYILKYKSSLTSMASVAVLQCQVNLANPEDFCKLAVQACGSDDFLFLRVSGVILPLTASECALLEHLNVASSQVHLNHWETGRFFKVLATGVVADGMPLMDDKVILEKLLTSLDTLAILSPPLTIDPLAALDGKMPNLALICILGRPLVKQVKPASGTVPSSTAAPAVGEEGQPAGEVGPIVVVAVVTPNAPPSVLVKRKRDDGVGPSGRKKSKAPMSL

SEQ ID NO: 214925 - protein, 36 aa, Glycine max
  Coding DNA Sequence Number=SeqID_98147
CQALSRLAGKRDCPMLKEIVSCRGSLSDVRGSSLDK

SEQ ID NO: 214926 - protein, 136 aa, Glycine max
  Coding DNA Sequence Number=SeqID_98148
  Gene Ontology: Mol. function=receptor activity
  Homolog annotation: Hit_ID=Q5S1T9; Match level="QueryCoverage=59%, HitCoverage=45%, E-value=1e-17, Identity=53%"; Hit description =Prenylated Rab acceptor protein 1
  Subcellular localization annotation: CTP_CleavageSite=54; ConfidenceScore=5.10e-01
MTKLLHYLTFNSTIISWHKTKSRTNLRRIHQTDRPSRSRRLHARDYCCGGRSSDAAEEREESGAVRLLIVEKEILGNAKSPVRAHDRQSNHEGRDQQGSNTGEQNDKGVSEEDDRLIRRAKEIKERPRREETEEDK

SEQ ID NO: 214927 - protein, 127 aa, Glycine max
  Coding DNA Sequence Number=SeqID_98149
MALGQMQPIHHQWANISPTAAILAKITQKHDQDQTAETKYYERTSSHYRSNAKRRIHEPKDSFVLPDPYSLCIDGVFSELRSGFSDPKLRAPHPIYRVCPSQSSTNLLSEHGLEDRYVICYRRWLQR

SEQ ID NO: 214928 - protein, 69 aa, Glycine max
  Coding DNA Sequence Number=SeqID_98150
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=P26205; Match level="QueryCoverage=97%, HitCoverage=16%, E-value=7e-25, Identity=75%"; Hit description =Cyanogenic beta-glucosidase precursor
MDNSNKDVIIGAYHHCKEDVGMMKDMNLDSYRFSIYWSRILPKGKLSGGINREGINYYNNLINELVANG

SEQ ID NO: 214929 - protein, 627 aa, Glycine max
  Coding DNA Sequence Number=SeqID_98151
  Gene Ontology: Mol. function=protein serine/threonine kinase activity; Cellular component=membrane; Biological process=protein amino acid phosphorylation
  Homolog annotation: Hit_ID=Q1S7H1; Match level="QueryCoverage=99%, HitCoverage=72%, E-value=0.0, Identity=51%"; Hit description=Protein kinase; EGF-like, subtype 2; S-locus glycoprotein; Curculin- like (Mannose-binding) ...
  Homolog annotation: Hit description=lectin; N/apple PAN; Type I EGF
  Pfam annotation: Domain name=B_lectin; Domain location=33-143; Score =144.5; E_value=2.8e-40; Accession=PF01453.15; Description=D-mannose binding lectin
  Pfam annotation: Domain name=PAN_2; Domain location=300-368; Score =116.2; E_value=9.3e-32; Accession=PF08276.2; Description=PAN-like domain
  Pfam annotation: Domain name=Pkinase; Domain location=462-625; Score =0.5; E_value=1.4e-08; Accession=PF00069.15; Description=Protein kinase domain
  Pfam annotation: Domain name=Pkinase_Tyr; Domain location=462-625; Score=-5.2; E_value=3.8e-12; Accession=PF07714.7; Description =Protein tyrosine kinase
  Pfam annotation: Domain name=S_locus_glycop; Domain location=157-283; Score=158.6; E_value=1.7e-44; Accession=PF00954.11; Description=S -locus glycoprotein family
  Pfam module annotation: Pfam domain module=B_lectin::PAN _2::Pkinase::Pkinase_Tyr::S_locus_glycop; Domain location=33-143::300- 368::462-625::462-625::157-283
MTLVSRGETFELGFFSPENSNKRYLGIWYKNIPQTVVWVSNRAINDSSGILTVNSTGNLVLRQHDKVVWYTTSEKQAQNPVAQLLDSGNLVVRDESEADSEGYLWQSFDYPSDTILPGMKLGLNLRTGIEWRMTSWKNPNDPSPGDFYWGLLLYNYPEFYLMMGTEKFVRVGPWNGLHFSGIPDQKPNPIYAFNYISNKDEKYYTYSLQNAAVISRLVMNQTSSMSIRYVWMENEQYWKVYKSLPKDNCDYYGTCGAYGTCLITGSQICQCLAGFSPKSPQAWNSSDWTQGCTRNQPLNCTNKLNDGFMKVEGVKVPDTTHTWLDETIGLGECRMKCLNNCSCMAYTNSDIRGEGSGCVMWFGDLIDIRQFENDGQDLYIRMDSSELGEQEEHKKVVIIIVSTTIATILVILCIGCYRIYIVRHSITEYSDIVRDQNRGGSEENIDLPLLDLSTIVIATDNFSINNKIGEGGFGPVYKGRLVSGQEIAVKRLSRGSGQGMTEFKNEVKLIAKLQHRNLVKLLGCCVQEQDRMLVYEYMTNRSLDWLIFDDTKSKLLDWPKRFNIICGIARGLLYLHQDSRLRIIHRDLKASNVLLDDQMIPKISDFGIARIFGGEQTEGNTNRVVGT

SEQ ID NO: 214930 - protein, 67 aa, Glycine max
  Coding DNA Sequence Number=SeqID_98152
LSLAHQWAKRASIAKRNFSMLSATEESGRASISRPHAKREISALSTAIVFSQAQSTTGAKLEATYMH

SEQ ID NO: 214931 - protein, 111 aa, Glycine max
  Coding DNA Sequence Number=SeqID_98153
MTSRFGHSAPLYHPEAAGPMIRRDTLRLFAPFCHPEAAGPMIRGDTLRLFAPICHPEAAGPMTSRDQVWSFCTLVSSRGGGPDDTRKYPSGYPYKHSFAICKTERLIACRG

SEQ ID NO: 214932 - protein, 62 aa, Glycine max
  Coding DNA Sequence Number=SeqID_98154
MVRAEEETREKVGEKEREIEEMRQRIEDVEKVRVVEMKEKGESGWFHLSSKGLQCPIDVLPM

SEQ ID NO: 214933 - protein, 130 aa, Glycine max
  Coding DNA Sequence Number=SeqID_98155
  Gene Ontology: Mol. function=drug transporter activity; Cellular component=membrane; Biological process=multidrug transport
  Homolog annotation: Hit_ID=Q6ZJI2; Match level="QueryCoverage=67%, HitCoverage=25%, E-value=1e-20, Identity=39%"; Hit description =Putative ripening regulated protein DDTFR18
MWTSLRSGASAHVGSVHAALVAVRVRGELPGAKVPAGAEQDHGDGVDRGGGTGAAHFVQLVAHSGVLVGSRQRRRGAERVVVVHRHWTAAHFFFNLIEDDTSSPSELEDERAKSVSSLSRAHYDGNEESG

SEQ ID NO: 214934 - protein, 409 aa, Glycine max
  Coding DNA Sequence Number=SeqID_98156
  Homolog annotation: Hit_ID=O22197; Match level="QueryCoverage=35%, HitCoverage=41%, E-value=2e-11, Identity=31%"; Hit description =Expressed protein
  Pfam annotation: Domain name=Extensin_2; Domain location=31-370; Score=-96.6; E_value=0.0014; Accession=PF04554.4; Description =Extensin-like region
  Pfam annotation: Domain name=zf-C3HC4; Domain location=226-267; Score= 47.9; E_value=3.5e-11; Accession=PF00097.15; Description=Zinc finger, C3HC4 type (RING finger)
  Pfam module annotation: Pfam domain module=Extensin_2::zf-C3HC4; Domain location=31-370::226-267
MPVNRGQGQTTRWYQLCFIPTSSDNSDDSDIESVVLTPSNLTQTSSTWQELSPPIPPESEPEIDWSLPPPPPPPPPPSPPPPLPNFLPLQRVVLTLGTPTSSTWQELFPPSSPLSSPPRPTRISSTWQELSPPSSPLSSRPPTNLEPEIDMSLSLLSPPPLLPDFLQSRPLQRASARTFNIEVQQDRHQPPSPSHVFEGDQSDCSMNVKNGITRVRVSEIDKLFHCPICMDEFKVGGDKACQLPCTHTYCSECILRWLDNNKTCPVCRLQLNGCSFDSINCNNGLDSQPQIPSLPSRSPIVHNDSPQRWENFSQSPPYLLQGIENSINDNNGLDSQPEILLPPPPPPPSAHNDLHRPWEYYFESPYLIVQDIENSEGGNSDEADYDSACDELGDPHEDGASQSVPAPLT

SEQ ID NO: 214935 - protein, 92 aa, Glycine max
  Coding DNA Sequence Number=SeqID_98157
MVNGNGNYLGVGSGSLGKWELQFRDSLATVLENAICLQHVEDKWIWLEDGSGEYTTSSANKALNVQRWASQMDDVMEYGASTGGNLMPFLEL

SEQ ID NO: 214936 - protein, 138 aa, Glycine max
  Coding DNA Sequence Number=SeqID_98158
MTAVNRRNLLLDVLPRWRALSKNPGVPRRMLRLPDWQADWNAGMALLARHARNGGELAEEPLQGYAALEHAYGWEAVAQTGSNMMMKGIDRGFAPTALQQMQADVTELWLEHARLLALARDSLQQQGQDIALAASLQP

SEQ ID NO: 214937 - protein, 51 aa, Glycine max
  Coding DNA Sequence Number=SeqID_98159
MNPSGDSGSSWPWQRWFKLALAEASSEKEYFGVIIYLNLKSTYQDPIIDGS

SEQ ID NO: 214938 - protein, 122 aa, Glycine max
  Coding DNA Sequence Number=SeqID_98160
MRNLEYLPRKLWWVATKALQRRPKLRVLIRKSKENQKRGREEMKRGGEGEKWKGEKEVRNLREREGEGLGFSNEEGKKHIQISKPSLASCNNLPMAKVESVHDFLKGKTILVTGATGFVGKG

SEQ ID NO: 214939 - protein, 60 aa, Glycine max
  Coding DNA Sequence Number=SeqID_98161
MFVFNNALNGLDDTYQSKSKPAARWIVVKYFTDARPLEPERLKALRIQWAKYYLKVKNET

SEQ ID NO: 214940 - protein, 110 aa, Glycine max
  Coding DNA Sequence Number=SeqID_98162
  Gene Ontology: Mol. function=transition metal ion binding; Biological process=proteolysis
MKLDELENEAAIILCELKMYFLPAFFNIMVHFIIHLAKEIKCCGPIYLRWMYPVERYMKILKGYTKNLHRSKASIVERKKLMDQKRKKKLEEAAQSKSTNTVIDPPSPIK

SEQ ID NO: 214941 - protein, 85 aa, Glycine max
  Coding DNA Sequence Number=SeqID_98163
  Homolog annotation: Hit_ID=Q1SAV3; Match level="QueryCoverage=56%, HitCoverage=8%, E-value=6e-08, Identity=52%"; Hit description=Cyclin- like F-box; F-box protein interaction domain; Galactose oxidase, central
  Pfam annotation: Domain name=F-box; Domain location=7-54; Score=39.9; E_value=8.9e-09; Accession=PF00646.23; Description=F-box domain
MRSEKKPWSPLLCEELIEEILSRLPVKPLIQFKCVCKGWNSLMSDPYFIKLHLSKSAAKDDLEHLQLMKNVCLGSIPEIHMESCD

SEQ ID NO: 214942 - protein, 57 aa, Glycine max
  Coding DNA Sequence Number=SeqID_98164
MATLGLEILVESASSVISKMILSFDLAFALIPLLKISSSKMTSSTSIEELGIHYINC

SEQ ID NO: 214943 - protein, 130 aa, Glycine max
  Coding DNA Sequence Number=SeqID_98165
  Gene Ontology: Mol. function=tetracycline:hydrogen antiporter activity; Cellular component=integral to membrane; Biological process=tetracycline transport
  Homolog annotation: Hit_ID=Q2NX31; Match level="QueryCoverage=96%, HitCoverage=31%, E-value=1e-52, Identity=76%"; Hit description =Putative transport protein
MLRSIESWKINLISVWFGCFFTGLAISQIIPFLPLYVEELGIRGGNALSIWSGLTFSVTFIVSAAVAPLWGSLADRKGRKLMLLRASFGMGAVILLQAFVTQAWQLLLLRALMGLTSGYIPNAMALVAAQ

SEQ ID NO: 214944 - protein, 897 aa, Glycine max
  Coding DNA Sequence Number=SeqID_98166
  Homolog annotation: Hit_ID=Q7MZI4; Match level="QueryCoverage=36%, HitCoverage=96%, E-value=1e-137, Identity=74%"; Hit description =Similar to putative membrane protein
  Pfam annotation: Domain name=DUF969; Domain location=1-135; Score =49.0; E_value=5.2e-16; Accession=PF06149.2; Description=Protein of unknown function (DUF969)
  Pfam annotation: Domain name=DUF979; Domain location=134-467; Score =448.7; E_value=7.5e-132; Accession=PF06166.2; Description=Protein of unknown function (DUF979)
  Pfam annotation: Domain name=Fapy_DNA_glyco; Domain location=657-761; Score=32.4; E_value=1.3e-07; Accession=PF01149.14; Description =Formamidopyrimidine-DNA glycosylase
  Pfam annotation: Domain name=MFS_1; Domain location=33-381; Score= -53.4; E_value=0.087; Accession=PF07690.6; Description=Major Facilitator Superfamily
  Pfam annotation: Domain name=Peptidase_C15; Domain location=460-667; Score=368.6; E_value=1e-107; Accession=PF01470.8; Description =Pyroglutamyl peptidase
  Pfam annotation: Domain name=SNARE_assoc; Domain location=250-342; Score=-27.2; E_value=0.034; Accession=PF09335.1; Description=SNARE associated Golgi protein
  Pfam module annotation: Pfam domain module=DUF969::DUF979::Fapy_DNA _glyco::MFS_1::Peptidase_C15::SNARE_assoc; Domain location=1-135::134- 467::657-761::33-381::460-667::250-342
RHGLKERAQTWIARIKTATAGRLLIVYLFVRELTAALGLTSLGGHPQMVRPLLAPMAEGATENRYGSVSPEIRQRLRAMSAATDNVGLFFGVGGHQHRTVAHRAVGHSDGAVCVPDSCCATGAARKRRRVMFQQQYLMWLAGAILLIVALLSWRDSANPRRFTTGLFWALYGLIFQIGDGAYQLMGQWAGDAELGRRWLHIAVGAAVVVMALIAGFGGVRLGRYHQRSDEQKQQSAQRLGNKLFLPALAIPLVTVIGVLAFNHIPGLQEKVFGPGNHSTLVTLFSMMIGCVLGWLIALKFTHEKPLQSMQETRRLLDAVGWAFILPQILATLGLLFTSAGVGTAISHLTEHYLAVDNRLIAVAVYALGMALLTMVMGNAFAAFPIVTAGIGIPILVLQHGGNPAVMAAIGMFCGYCGTLMTPMAANFNIVPARLLELPDRNAVIKAQVPTGVLLLLVAMKTVLMTAFEPFGGERINPSWEAVRSFDGREFGGARIVVRQLPVVFARCGQVLTAALEELQPHRVLCVGQAGGRSDISVERVAINVNDARIPDNDQQQPVDQPIVAGGPAAYFSTLPIKAMVAALREVGIPASVSQTAGTFTCNNVMYHLLHWLQTTGSAARGGFVHIPYMPQQAAQHPGAPSMSTASVIQALETSLQGPEIRRAADQLAAAMVGKPLTEVWFAFPALKTYEPALMGETIDAFETRGKALLTHFSNGLTLYSHNQLYGVWRVVPSGTEPNTSRQLRVRLAAERRYARRASVFATRRTGRAGRYADGGRGARATAVAAFSSPPVQRFAAGSGISRRARQLSARRDFVARRFAGAASCTGFERPAAGCVEPRHAGGAAFVLSDAWQHEEVSRRGGVSFRGVSPAGQKVPALRRGAGQAIIVFRQIAPELMH

SEQ ID NO: 214945 - protein, 48 aa, Glycine max
  Coding DNA Sequence Number=SeqID_98167
SPAWLSPVSGVLAPLTRYLHTLRQSDGPPSTGHPVPAPAFTRIHAVSS

SEQ ID NO: 214946 - protein, 163 aa, Glycine max
  Coding DNA Sequence Number=SeqID_98168
  Gene Ontology: Mol. function=isomerase activity; Biological process =cellular metabolic process
  Homolog annotation: Hit_ID=Q0LXG0; Match level="QueryCoverage=99%, HitCoverage=54%, E-value=1e-38, Identity=51%"; Hit description=NAD -dependent epimerase/dehydratase:3-beta hydroxysteroid dehydrogenase/i somerase:Male sterility-like
  Pfam annotation: Domain name=adh_short; Domain location=1-126; Score=- 49.4; E_value=0.0099; Accession=PF00106.15; Description=short chain dehydrogenase
MNVFITGASGFIGMAIAAELVQAGHHVTGLARSEQTVQRLNRIGADAHRGELKNLLSLTVGARAADAVIHCAYDHAFAHPQDTAMQEMQAIAALGKGLLDSTRPLLITSVAAMGSRAPGQLASEDFYDPSMQNPRKSTEIAAAQVADSGVNVSIIRLPQVHNE

SEQ ID NO: 214947 - protein, 163 aa, Glycine max
  Coding DNA Sequence Number=SeqID_98169
  Gene Ontology: Mol. function=sequence-specific DNA binding; Cellular component=intracellular; Biological process=regulation of transcription, DNA-dependent
  Homolog annotation: Hit_ID=Q13XK1; Match level="QueryCoverage=53%, HitCoverage=28%, E-value=4e-15, Identity=45%"; Hit description =Transcriptional Regulator, AraC family
MDPLSEVLTLLRLQGAISGGFPVEAQTALVFAPHQGIKCYCVVEGSCWVAVDGIQQPLLLETGDCVFLTSGKSFSLATHPAAKRQPFVPPDSETGALTQVTPDQGSARDHSRQAGHGNQHYAQCDGMPERGDTNFAARRRFTLAATGADYAGAGAQGISSAGR

SEQ ID NO: 214948 - protein, 192 aa, Glycine max
  Coding DNA Sequence Number=SeqID_98170
  Gene Ontology: Mol. function=transcription factor activity; Cellular component=nucleus; Biological process=regulation of transcription, DNA-dependent
  Homolog annotation: Hit_ID=Q414P7; Match level="QueryCoverage=75%, HitCoverage=71%, E-value=2e-13, Identity=30%"; Hit description =Similar to Uncharacterized protein conserved in bacteria
MSERALERYPGFRNNNIHFYKINKLVIDRDTLRDIDFAMRRTKKPSMTWSESVDQALCYGWIDGVRKSVDDEKYTIRFTPRKPTSIWSAINIKKVEDLTQAGLMKTAGLKAFALRKQDKTAIYSHENALAELSPAFKKQFKSNKKAWDFFSNQAPSYKKVMLHWIMSAKQEKTRISRLEKTIRESEQQKRVL

SEQ ID NO: 214949 - protein, 267 aa, Glycine max
  Coding DNA Sequence Number=SeqID_98171
  Gene Ontology: Mol. function=hydrolase activity; Cellular component =integral to membrane; Biological process=conjugation
  Homolog annotation: Hit_ID=UPI00005F12C3; Match level="QueryCoverage =100%, HitCoverage=27%, E-value=2e-52, Identity=41%"; Hit description= COG1196: Chromosome segregation ATPases
  Pfam annotation: Domain name=TraG_N; Domain location=1-239; Score= -162.1; E_value=0.0014; Accession=PF07916.2; Description=TraG-like protein, N-terminal region
MDESYNLYYAGGLSASQIMRNNITNAAIRDGWKGFAARSSDTANLMNLATESSLTKQRLSWASFGTIMGRMLPMFQSLLMLILIALFPMVIALALVNHTIFGLNTLKLYAGGFLYFQMWPVMYGILNSLANFYLQSKTGTTALVLSNQDQVALQHSDAANIAGYLSASIPILSFYLTKGAGAIASQVAGSVISSAAFTTGGQASTTADGNWSFNNMSMDNVSANKFDTNMLRRSGSQSIQTGNNAMMTQTADGHTVVDTSQAISNLP

SEQ ID NO: 214950 - protein, 34 aa, Glycine max
  Coding DNA Sequence Number=SeqID_98172
MGFEDLLFKGVVPQQRQQKPKVPGTNVVFNLGTM

SEQ ID NO: 214951 - protein, 305 aa, Glycine max
  Coding DNA Sequence Number=SeqID_98173
  Homolog annotation: Hit_ID=Q47522; Match level="QueryCoverage=18%, HitCoverage=75%, E-value=1e-14, Identity=67%"; Hit description=LacZ protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGIRWAAGDGPGRPLLARLAAGRARGRPAGRRGVRDRDGGTRHRPGRAADQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 214952 - protein, 101 aa, Glycine max
  Coding DNA Sequence Number=SeqID_98174
MTPKKLPAKRSKKDSTREGSSAAPQADMEFDRHRFWSAEHQQRFEAIKDWQWAQLVSPMAKFNPEIVMEFYANAWPTEEGVCNDPPRHYDITTLNRENFNF

SEQ ID NO: 214953 - protein, 219 aa, Glycine max
  Coding DNA Sequence Number=SeqID_98175
MIMRSQDIYSSQYEATTSPSSSESEEAKGEESSEEIYPQEEGKPLMVKEECKEVNVSSKRLAKKERHFEINTNIKEISLLRQPPHFLLCKKTLVSIATPLGLEFILLVKELLDEGLVRKSLNPCALLVPKIGIIRHRIPKIGGMMNVFSGATLFCEINRAPNNFMICVHRDSLGGNNQHKNKEKGMFYSITFLNFLNSDQGLPMDPKRIKVIPEWPTPP

SEQ ID NO: 214954 - protein, 187 aa, Glycine max
  Coding DNA Sequence Number=SeqID_98176
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q6L597; Match level="QueryCoverage=84%, HitCoverage=30%, E-value=4e-38, Identity=50%"; Hit description =Putative beta-glucosidase
  Pfam annotation: Domain name=Glyco_hydro_1; Domain location=1-162; Score=-266.4; E_value=2.5e-05; Accession=PF00232.9; Description =Glycosyl hydrolase family 1
MNPFTFGDYPDIMKKNAGSRLPSFTQKESNLVRGSIDFIGINFYYSFYVKNSPGSLQKEDRDYIADLSVEIESQQTPHNSSLDDWPRVNYLHEYIGSLVDALRSGLNVKGYFVWSFLDAFELLLGYESSYGLYYVDMNDPSLRRIPKLSAEWYSNFLKRKPMDPKITKEIEKNATLLSHNLSLHNAT

SEQ ID NO: 214955 - protein, 164 aa, Glycine max
  Coding DNA Sequence Number=SeqID_98177
  Homolog annotation: Hit_ID=Q1T344; Match level="QueryCoverage=68%, HitCoverage=40%, E-value=1e-14, Identity=37%"; Hit description=RNA polymerase, RBP11-like
MPKLPLPLLLLHSVLSMNSVAMNSSVKVKVKALWWSVAAYEVHSVGCLTAKRMFCDGLDPLLMKMDLWRSGEYRCRNKEFVIRDTRTRKCRCPFKLRGKPVVEGQGWVKLICGIHNHELAKSLVGHPYVWRLSKAEKTLIGDMTKSMVKPRNILLTLKEHNVNS

SEQ ID NO: 214956 - protein, 268 aa, Glycine max
  Coding DNA Sequence Number=SeqID_98178
  Gene Ontology: Mol. function=protein binding
  Homolog annotation: Hit_ID=Q9FKT0; Match level="QueryCoverage=75%, HitCoverage=43%, E-value=1e-59, Identity=57%"; Hit description =Similarity to actin
  Pfam annotation: Domain name=F-box; Domain location=39-86; Score =41.6; E_value=2.7e-09; Accession=PF00646.23; Description=F-box domain
MATLLRKLCESATMKRSGSHSHPHPLPSSEQARPSSPLGAFDPLPADILMQIVRLLGPKHAARLCLVSKSWRSLVSDNALWAHFLQTHHPHSPLFAETALSSGYPLPTLPAQNSPRVSFQHAYALRERVPPSVVIDGGSGYCKFGWSKGASPSGRFATFLEFGNVETPMYTRLRHFFSTIYNRMQVKPSSQPVVVSIPICHYDDTESAKASRQQLKEAIYVVLFDMNVPAVCALNQYNENKITRKAARWVVGDILEGHTPEGCMRVLQ

SEQ ID NO: 214957 - protein, 101 aa, Glycine max
  Coding DNA Sequence Number=SeqID_98179
  Gene Ontology: Mol. function=protein binding
  Homolog annotation: Hit_ID=Q9FKT0; Match level="QueryCoverage=71%, HitCoverage=15%, E-value=1e-26, Identity=80%"; Hit description =Similarity to actin
  Subcellular localization annotation: CTP_CleavageSite=55; ConfidenceScore=5.11e-01
MGTLALYAANQTSGIAVNIGFQVTSIVPILNGKVMRKVGVEVVGLGALKLTGFLREQMQQNNISFESLYTVRTLKEGCDLCKLSTLNSYDTDVGHSELVYM

SEQ ID NO: 214958 - protein, 761 aa, Glycine max
  Coding DNA Sequence Number=SeqID_98180
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=95%, HitCoverage=53%, E-value=0.0, Identity=57%"; Hit description=Chromo
  Pfam module annotation: Pfam domain module=RVT_1::Retrotrans_gag; Domain location=460-629::71-161
  Subcellular localization annotation: CTP_CleavageSite=27; ConfidenceScore=5.15e-01
MNLLLQNASQPPGSSPNNGSPMVQLINASLSVKEISLGFPHFDGTTRVMEWIFKAEKFFTYHNTPDASRVDIAVMHFDKDVVAWFQMSQKLSLVSTWSELTGALESKFSPSPFDCPMAELFKLQQTGSVSDYYLKFMSLANRSLGLSNEALLNCFISGLNPDIRRDVVAMCPPTLLRAVALAKLFEEKYGPGTQEDEIVESEDHHLSFNALKGGRGVGTNRFIAYIEKLPVTVLIDGGSSDNFLQPRVAKFLKLPREPTTQFRVMVGNGNYMSAEGLVKQLKVQAQGNTFQLPIFLLSISGADLILGASWLKTIGSHIADYDALQLKFLWKGKFTTLQGDCELVPEQAQLHCIRRMVATNSIVEVYSLQLMEPDVVPKSMLDLLVTMKPELALLLHTYSVVFDTPSSLPPQRSHDHSILLLSGSQPVKVKPYRYPHSQKEEIERLVSGMLDEGIIQPSKSPFSSPIILFKKKDGPWRVCTDYRALNAITIKDNFPIPTVDELIDELFGASFFSKLDLRSGYHQILINPDDRHKKAFRTHHGHYEWLVMPFGLTNAPATFQSLMNDIFVGILRKFVLVFFDDILVYSANWKYHLYHLEVVLSILKQHQLFARFSKCCFRVQQIDYLGHTLSGSGVAMEGTKLEAIQKWPEPINLKQLRAFLGVTGYYRRFVKSYASIAAPLTDLLKKDSFKRSVAASEAFQQLKIAMTSTLVLAIPNFKEIFVLETDASGSRISVVLSQNKHPIAYFSKKLSLRMQKQFAYI

SEQ ID NO: 214959 - protein, 140 aa, Glycine max
  Coding DNA Sequence Number=SeqID_98181
MSQLLIQWEVTEAKDATWEDLRDICESYPQFNLEDKVVFYDQEGNCIKNCIYGTKVVYNANFEAAKVLTKRMLHNLDSLCVSLSQLSDGVVSADVGFLEVTLKKKIARRIVLLLFYVLSNILLMMKNGGTQPILVVPNQG

SEQ ID NO: 214960 - protein, 185 aa, Glycine max
  Coding DNA Sequence Number=SeqID_98182
  Homolog annotation: Hit_ID=Q1STT2; Match level="QueryCoverage=55%, HitCoverage=22%, E-value=2e-07, Identity=33%"; Hit description =Lipocalin
MEVRQWTQLWLWKKDKSYVSFLPPLGLEFMTVNSLIDHENNSWRMDIAAQILNEDDMNDLQMVPLTNTHDSDRPCWKYSAHGKYTVRSAYHHLMDNMICNENLKVKGCNLKERSPLHESSLAANKLETCGKKQESRTSNSLYIAPNESAQDLEWCKLVAGFLKVYIDAGIFEEPNLFGAGIVRGV

SEQ ID NO: 214961 - protein, 229 aa, Glycine max
  Coding DNA Sequence Number=SeqID_98183
  Gene Ontology: Mol. function=protein serine/threonine kinase activity; Cellular component=membrane; Biological process=two -component signal transduction system (phosphorelay)
  Homolog annotation: Hit_ID=Q5DW42; Match level="QueryCoverage=81%, HitCoverage=46%, E-value=1e-103, Identity=72%"; Hit description =Phototropin
  Pfam annotation: Domain name=PAS; Domain location=4-106; Score=10.4; E_value=0.042; Accession=PF00989.14; Description=PAS domain
  Pfam annotation: Domain name=PAS_3; Domain location=17-109; Score =22.9; E_value=0.0006; Accession=PF08447.1; Description=PAS fold
  Pfam module annotation: Pfam domain module=PAS::PAS_3; Domain location=4-106::17-109
MQPTRICLVVGGGGGGLIFASDSFLELTEYTREEILGRNCRFLQGPETDQATVSRIRDAIREQREITVQLINYTKSGKKFWNLFHLQPMRDQKGELQYFIGVQLDGSDHVEPLKNRLSETTEQQSAKLVKATAENVDEAVRELPDANLRPEDLWAIHSQPVFPRPHKKENPSWIAIQKVAARGEKIGLQHFVPIRPLGCGDTGSFPITGQNRIPISEPSLIKLPHEDDS

SEQ ID NO: 214962 - protein, 238 aa, Glycine max
  Coding DNA Sequence Number=SeqID_98184
  Gene Ontology: Cellular component=nucleus; Biological process =regulation of progression through cell cycle
  Homolog annotation: Hit_ID=Q8RYC7; Match level="QueryCoverage=94%, HitCoverage=34%, E-value=1e-24, Identity=36%"; Hit description =Cyclin-like protein
  Pfam annotation: Domain name=Cyclin_N; Domain location=141-233; Score= -29.3; E_value=0.054; Accession=PF00134.13; Description=Cyclin, N -terminal domain
MTKHESDVYNVVTDLACSEDLCFSYCDDDGDESKYCSSQGTVFSEFHFEIFGECSQAELSDYSPSLFVDSESQFLEGSVGETPSPTHLLFLRYRKEFAALVSAPPVKNASNIEDAANLLNVSIFIVCGFWFVRFKDWDDEDSYQMLRKRERKQGFVSNYGDRYFSTTEFGDIVIEQRALMVQWIVEQSCRRQLRQETVFLGVSLLDRFLSKLRILQSQQKPSNCWNSLGKNVSSLVLS

SEQ ID NO: 214963 - protein, 135 aa, Glycine max
  Coding DNA Sequence Number=SeqID_98185
  Gene Ontology: Mol. function=protein serine/threonine kinase activity; Cellular component=cytoplasm; Biological process=two -component signal transduction system (phosphorelay)
  Homolog annotation: Hit_ID=Q5DW42; Match level="QueryCoverage=88%, HitCoverage=7%, E-value=1e-26, Identity=58%"; Hit description =Phototropin
MGILSFLLLPLVGLCIIYRDLKPENILLQKDGHVVLADFDLSYMTSCKPQLCFVREKVMEKRLQVVHVPTIDQYADILTKSLSPSNFTVFRDKVVKQAIPGKRRSRSEPPPTFVAEPVTQSNSFVGTEEYIAPVW

SEQ ID NO: 214964 - protein, 122 aa, Glycine max
  Coding DNA Sequence Number=SeqID_98186
  Gene Ontology: Cellular component=nucleus; Biological process =regulation of progression through cell cycle
  Homolog annotation: Hit_ID=Q1PFW3; Match level="QueryCoverage=60%, HitCoverage=18%, E-value=7e-17, Identity=56%"; Hit description=Cyclin
  Pfam annotation: Domain name=Cyclin_C; Domain location=9-106; Score =2.3; E_value=0.025; Accession=PF02984.9; Description=Cyclin, C -terminal domain
MCTVDARWYYLKAANADAEVQKRVKYLAELALSGHEQLCYRPSTVAAALVILACLEVNQISYHKVIGIHVRSKDENLYECIEDSILVGMEALLMQFSLVTMVPNHQKTNGFLMPGWFFINTK

SEQ ID NO: 214965 - protein, 38 aa, Glycine max
  Coding DNA Sequence Number=SeqID_98187
MQSIMFLLEVGHLWHTGRARAAATGFEKGKYGRDWKKQ

SEQ ID NO: 214966 - protein, 102 aa, Glycine max
  Coding DNA Sequence Number=SeqID_98188
  Gene Ontology: Mol. function=oxidoreductase activity
  Homolog annotation: Hit_ID=Q8W319; Match level="QueryCoverage=87%, HitCoverage=31%, E-value=3e-26, Identity=67%"; Hit description =Putative splicing regulatory protein
  Pfam annotation: Domain name=RRM_1; Domain location=18-85; Score =32.4; E_value=1.6e-06; Accession=PF00076.12; Description=RNA recognition motif. (a.k.a. RRM, R
MEKLPRSIRFDLLQIRTVKVSNISLVTSKKDIEEFFSFSGDIRYIEMQRESGHTQVAYVTFKDTQGADTAVLLTGSKIGDLYVTITPVEKYQLPPEALPSSP

SEQ ID NO: 214967 - protein, 101 aa, Glycine max
  Coding DNA Sequence Number=SeqID_98189
  Homolog annotation: Hit_ID=Q1HBJ0; Match level="QueryCoverage=49%, HitCoverage=8%, E-value=7e-07, Identity=53%"; Hit description =Polyphenol oxidase
MAAPHNTVHTWVGAVDKPHHEDMGVINIEPDQTEFVGTFVNLFHGQGHNINTSFKVGISKVLECLEAEEDDVVLVTLVPKVGKGDVIIGGIKVEFIPKYKD

SEQ ID NO: 214968 - protein, 107 aa, Glycine max
  Coding DNA Sequence Number=SeqID_98190
MDQVIRKHVTDQVDPEHAYGSLDPGLRIKLSLVFGAYLDGGRSRSSLHGGYGVALHESLLNVPLRRPHITSHNDLYIGVMLQIGKESLLYVMWYHVREKSHVPPRST

SEQ ID NO: 214969 - protein, 48 aa, Glycine max
  Coding DNA Sequence Number=SeqID_98191
MHTRHRQDRWLTTLVVGLDARKLAQSGGGWKSVKKGQCQDRQRKSYSS

SEQ ID NO: 214970 - protein, 149 aa, Glycine max
  Coding DNA Sequence Number=SeqID_98192
  Gene Ontology: Mol. function=protein serine/threonine kinase activity; Cellular component=membrane; Biological process=two -component signal transduction system (phosphorelay)
  Homolog annotation: Hit_ID=Q5DW42; Match level="QueryCoverage=82%, HitCoverage=12%, E-value=1e-63, Identity=95%"; Hit description =Phototropin
MGSNIKLTKYLNRIHRIRTFDQLHLPGILLYEMLYGRTPFRGKNRQKTFSNILHKDLTFPSSIPASLAARQLINALLQRDPTSRIGSTTGANEIKQHPFFRGINWPLIRNMTPPPLDVPLKLIGNDPVAKDIKWEDDGVLVSSIDMDIF

SEQ ID NO: 214971 - protein, 133 aa, Glycine max
  Coding DNA Sequence Number=SeqID_98193
  Gene Ontology: Mol. function=RNA-directed DNA polymerase activity; Cellular component=chromatin; Biological process=RNA-dependent DNA replication
MVHWPIPSNVKSLRGFLGLTEYYRKFVRNYGKIALPFTHQLKKDSFNWGSEAQMAFEHLNQAMTTMSVLAVPNFEKTFIVEADASGKELGAVLMQEGQPIAYMSKTLGEKAQNKSIYEHELMTIILAIHKWQD

SEQ ID NO: 214972 - protein, 93 aa, Glycine max
  Coding DNA Sequence Number=SeqID_98194
MAVLFTELYASETRKLVERLINYVIYKIPLGVILAILDLALIALSKSAPALIAGNSFVLKPPTQIHILCHFIMPPTSIRTVATRMIMPNNMLC

SEQ ID NO: 214973 - protein, 901 aa, Glycine max
  Coding DNA Sequence Number=SeqID_98195
  Gene Ontology: Mol. function=protein kinase activity; Cellular component=cell surface; Biological process=protein amino acid phosphorylation
  Homolog annotation: Hit_ID=Q9LT35; Match level="QueryCoverage=18%, HitCoverage=30%, E-value=5e-45, Identity=56%"; Hit description =Kinase-like protein
  Pfam annotation: Domain name=Pkinase; Domain location=2-206; Score= -74.1; E_value=0.00038; Accession=PF00069.15; Description=Protein kinase domain
  Pfam annotation: Domain name=Pkinase_Tyr; Domain location=1-206; Score=-175.4; E_value=0.1; Accession=PF07714.7; Description=Protein tyrosine kinase
  Pfam module annotation: Pfam domain module=Pkinase::Pkinase_Tyr; Domain location=2-206::1-206
MTLGSIITCYLKSESWNTTFFWSRAANIKKARGSYFSEECLFGWGTMEGKGGEGEFGLAKLLNTEDLTSPVVGTLNYMCPEAFAGMPYGYKSDMWSLGCCMFEIVAHQPAFRAPDRAGLINKINRSSISPLPIVYSSTLLNLPNAYSDGFGEIWALSLGHSSHQCHISTLLNRTESRQKKQLIKSMLRKNPEHRPTASELLKNPHLQPYVLRCRNASSIFLPVHLINSNSKDKTKTKSSSGSKDHWEREAALAGLVNRLDRLYPLEGNGDVQSRNWHNDGKLAVSTSAEDNLETKMVDLTSYTVEFSTSISGSKDGSTTSESTVCSVCKEGDSKNRLTRDTADSEITSKSTMDSGLEEQGLDCHKSYAIDINTVINKVEDTFSNEDFNTDEALSEGVKPEDSSKSIMSSEDSNGNDKDELIDEITSKSTLDSVHEKQGFTAEHFQKSDVIDTSAVSTKIEDNFFSEDRTEAERENAKPEDSRKSIVSSENSDVKDNEGSINEITSTSMLDSVHEEQGFTAEHFPKSDGIDTNAVAIKVEDNFSNEGFDQTETERENAKPDDSRKSIVSSENSDGNDIVAVDETTLKSMLNYVHEERGFTAELVQKSDVEINAAASKVEDKFSNEGFDKAEAQREDAKLESSSKSIISCENRNDNDDYGSGYEITSNSMLDSVGEEKRLPAELFQKSDAIDINAVTTEDEDKLSKEGFDRAETQEKDDKPEDSSNSLSSEDSNSNDKEGSIDEERSSPIAHAVKVEHDTDTGNSLKENENPKVLTEDSCMDSLASESNEMRPGKDEGQADTHTISCSTHKEVDNAVMADKPPNGVSLRTRISRGGDNTCHQRADALESLLELCAQLLQQGKLEELAAVLRPFGEDAVSVSSRETAIWLTKSLVASQNLNPEI

SEQ ID NO: 214974 - protein, 66 aa, Glycine max
  Coding DNA Sequence Number=SeqID_98196
  Subcellular localization annotation: CTP_CleavageSite=38; ConfidenceScore=5.02e-01
MDIRKVTCAVLIAAASMSAALATTEVSAPAPGPSSGASAATVGSLGYGERMLKEHAAQGRRLHIFT

SEQ ID NO: 214975 - protein, 152 aa, Glycine max
  Coding DNA Sequence Number=SeqID_98197
MELRRTHGIHESVLMRFVGRDKNTTFSVDVVGPLHQRAATTIRHHVFTIDVSKDMIQHNYQLVLPLEASIYLTTSKKYMIVDRGSGRHHKWMITTNNGLSCVVDAWIHYLGDCHLKPGDEVIFFYNIDQHVWEVLYRKQVKWDDEEDEAESP

SEQ ID NO: 214976 - protein, 190 aa, Glycine max
  Coding DNA Sequence Number=SeqID_98198
  Gene Ontology: Mol. function=nucleic acid binding; Biological process= DNA integration
MVVSTITDMMDRENNVQDLLHFFSKECEIVPQYTMSGKPIMNESLWREALKTIAYILNKVSNDYTIFLQDHEDDISLTEDDPIKFCQAMCSSNSQNWVDAMKDEMKSMQGNDIWNLVELPKDVKPIGQERTTTNVASATTAAVVALESGPGWHRRGRRLPKHIVYDNENAGKAMRVIQLTMVHARAVRNA

SEQ ID NO: 214977 - protein, 107 aa, Glycine max
  Coding DNA Sequence Number=SeqID_98199
MDEAPEGAHVDVDQPRHAVSTTRQLTGYITLLQCWIYKNFPFVGFVIAAEDYDERKPCACRWKFGKALLAYQMGSIYCHTPTGEDNVAQHPVVATTMDEAPEGQMLM

SEQ ID NO: 214978 - protein, 179 aa, Glycine max
  Coding DNA Sequence Number=SeqID_98200
  Pfam annotation: Domain name=SinI; Domain location=116-144; Score =13.3; E_value=0.047; Accession=PF08671.1; Description=Anti-repressor SinI
  Subcellular localization annotation: CTP_CleavageSite=58; ConfidenceScore=5.24e-01
MKISTSGAYSSSSNPETPVEANTPSPIIRPMGQKATKRKSKGKGVGTSTKPVDLSGVEEAMRERNVVNAKLEALRVKELENEYNDILVKDTFIMSETQLKDHEVFCKIIRSQNNDFDQAWKQIIYETLEDNSDEQIMSYLRAMQQQGDNNSQQRRPRKFINRNREDGHLRLMNDTSQKI

SEQ ID NO: 214979 - protein, 107 aa, Glycine max
  Coding DNA Sequence Number=SeqID_98201
MDGWSSAIFSNYMKVLQGKVGKDPVYGILSLINTQVLQGKVEKDQEPNQPMVFKQKKMSVEQIICSRYTASFYRLLKTIKVLQGGIKDLQQSLCQILIVSKWQNLWP

SEQ ID NO: 214980 - protein, 119 aa, Glycine max
  Coding DNA Sequence Number=SeqID_98202
MSISYIIKEKYRKIIDLSSGDEVMVGKHGYEAEIEAIGALKDNQLQKMRNCTKEFSWIGLPWTCKKLVLMLSLAFVRCVPLFPWICSDLVCYDNQLQKMRNCTKEFSWIGLPWTYKKWF

SEQ ID NO: 214981 - protein, 185 aa, Glycine max
  Coding DNA Sequence Number=SeqID_98203
  Gene Ontology: Mol. function=catalytic activity; Biological process =nucleoside metabolic process
  Homolog annotation: Hit_ID=Q9LWK9; Match level="QueryCoverage=66%, HitCoverage=37%, E-value=9e-28, Identity=48%"; Hit description =Putative bark storage protein
MHGATQRRKRCNEGFHEFTAETISEEGMVKQTMKRTVKKRRSEEGENNVKCTIINGVYFYITTINDLELESCINSKTCLTTTPKLELVNRGISQSIYLDNAAYRSFIYNEFDVSPVDMESASVALICYQQRVPFIAIRALPDLAGGGSAESNEADTFLSIAATNSVTVVIEFVKLLSLHSKWWSM

SEQ ID NO: 214982 - protein, 132 aa, Glycine max
  Coding DNA Sequence Number=SeqID_98204
MKNLRQNLEVRATIPVKLGKKSTWEVLFPRRLWLPMWTFDQRKEGKLKLKRVWVWRFGRGLFSVFCHSPAALAESLTVAFPVSRAPEGHCFAKMLQPCGIGTGLKEHSNRVTPKAYTPKSPSGPLSPDSGPT

SEQ ID NO: 214983 - protein, 70 aa, Glycine max
  Coding DNA Sequence Number=SeqID_98205
MAPFGRFTAEILMAVMFVGLFCVTNIVAQDSEIAPTGQLEAGTGFALPVSKLYDELQLQVCKISTQLLLV

SEQ ID NO: 214984 - protein, 224 aa, Glycine max
  Coding DNA Sequence Number=SeqID_98206
  Gene Ontology: Mol. function=actin binding; Cellular component =cytoplasm; Biological process=cytoskeleton organization and biogenesis
  Homolog annotation: Hit_ID=Q94HU9; Match level="QueryCoverage=58%, HitCoverage=22%, E-value=1e-25, Identity=44%"; Hit description =Putative transposable element
  Pfam annotation: Domain name=Transposase_21; Domain location=79-211; Score=-83.9; E_value=1.9e-07; Accession=PF02992.5; Description =Transposase family tnp2
MVSHTKHVDVDIRDHIEDMICDLGQKSFQQAHAPLMLPKDNMLSKNHYEVKKILCPMGMEYRKIRAWPNDCILYINEFAEMRKCPTCGVSWYKAKDDDCSNDESTNKDRPTKRKYIMLFMMITDPRQPGNEIGVYLSPLIKDLRRLWVDGVNVFDGNRQQTFKLCAMYMEQVKPVGLPQTRHDERRGVQNNRVSLDADSLHFSSASDNNLIRASMPYFGVIEEI

SEQ ID NO: 214985 - protein, 347 aa, Glycine max
  Coding DNA Sequence Number=SeqID_98207
  Gene Ontology: Mol. function=transporter activity; Cellular component= membrane; Biological process=oligopeptide transport
  Homolog annotation: Hit_ID=Q2HU45; Match level="QueryCoverage=88%, HitCoverage=48%, E-value=1e-67, Identity=44%"; Hit description=TGF -beta receptor, type I/II extracellular region
  Pfam annotation: Domain name=PTR2; Domain location=131-347; Score= -110.1; E_value=0.075; Accession=PF00854.12; Description=POT family
MCRTCRESCLILQIWYTLLCALQFTPAQPPPVVSLAMEGLSEMESVIEEPLLSKQNSNAKGGFRTLPFIIANEAFERLASLGLMPNMILYLTREYGMQTAGATNFLLLWSAASNFTPFVGAVLSDSYVGRYSMIAFGSIASLLGMVLLWLTTLIPLSKPLCNQFTNSCNNSPTTIHLLILHSSFALMSIGAGGIRSSSLAFGVDQLSKRDKNAGIKESYFSWYYAIVAMSSLIGLTVVVYIQDNMGWAVGFGIPVILMFVATASFFLASPFYVMVEVKRNMLSGLAQVLVASYKNRLLQLPQETENGIYHLEKDSDLLMPTEKLRLHLSIITETHHLDNRTTSTVVN

SEQ ID NO: 214986 - protein, 300 aa, Glycine max
  Coding DNA Sequence Number=SeqID_98208
MGFTLVDLDKGRSSGVSHQNGDSTLDIYETPSFTKCMPSIIEEHEVDNLMATPLSSHLQSSASSESTSRRPRQSTRLKILIARHLDKPKVVVHVNPATRKASGPQKEKFCSYLGMETFDIPEVSNTKKKVISSMAILWRQFKSSLATKYVYAGKEGQDYQNPCNKYGLDPKTWEESIASHKTLSWKGIKKKAQTIQKQNDCSHLLSRGGLLTRSDDKRKLCTHGCQDILTTAIRQPEHSSRLLVVEFGVIISQYFGHASYGSIRQLEHSSLVRVVEFGVIISQYFGHASYGSNSSTSITP

SEQ ID NO: 214987 - protein, 45 aa, Glycine max
  Coding DNA Sequence Number=SeqID_98209
MDISTKNLAILYDVMEIRLSSVMLSCPSDQACTSCKHSDSTTNEG

SEQ ID NO: 214988 - protein, 87 aa, Glycine max
  Coding DNA Sequence Number=SeqID_98210
MATNKAFEKRMLGFHFEVTRHIDYAMQLDVGATSVHVIRVCSAVTIFKLVFDDFLARSCAVWCRWLHCHPFVHVYVNSENKIHKNLS

SEQ ID NO: 214989 - protein, 446 aa, Glycine max
  Coding DNA Sequence Number=SeqID_98211
  Homolog annotation: Hit_ID=Q1T1Y0; Match level="QueryCoverage=36%, HitCoverage=58%, E-value=5e-11, Identity=26%"; Hit description =Ankyrin
  Pfam annotation: Domain name=DUF1723; Domain location=142-191; Score =48.5; E_value=2.3e-11; Accession=PF08330.1; Description=Protein of unknown function (DUF1723)
MVRTRGLGRALGMVIGRALGKEDHHHSNDVLQRRRPTTFARRQRKVAPIAGDAPDVTEDVHAHAKKVVDDAKRFLGGSRNPLVLTDYGDHVAVIVWNGEERLELKLSSHGRKVQKFERSAPEIERLVVATGLSPLIACSVDTGDRGLISAFVERWHKKTSSFHLLVGELTITLDDVSPERKLELRQHNVKGHTYIYRGYDIFIRVNSGSYAWKASAIVHMYDHLNDACKSDNRQLAGYIILLQCWIYEYFPSVAESLSDLDYDEMSPRACRWIATKASSKLLPASTYQKRLDGLTIVDTTSSMLAFEDIDDRWMHFSDYLAVVGHICVMPGQCASDYMQWFFMISHPFMTPAQSTDSARHPPVTQDDTYVEPNILEVLVAPTTAPAHAPSNVEQPRHVVEACQTIAERLERLLNLRIVTAGTEIHEVMEDCLRIARDVTTEGNVYV

SEQ ID NO: 214990 - protein, 184 aa, Glycine max
  Coding DNA Sequence Number=SeqID_98212
  Gene Ontology: Mol. function=protein serine/threonine kinase activity; Cellular component=cytoplasm; Biological process=protein amino acid phosphorylation
  Homolog annotation: Hit_ID=Q5NB70; Match level="QueryCoverage=84%, HitCoverage=33%, E-value=7e-60, Identity=73%"; Hit description =Putative dual specificity kinase 1
  Pfam annotation: Domain name=Pkinase; Domain location=9-182; Score= -74.5; E_value=0.0004; Accession=PF00069.15; Description=Protein kinase domain
MERVIGGKFKIGRKIGSASNMDTSEIVAIKMILGNKKCQNNVNGNESKKTKHPQLLYEAKLYSILQGESGIPSMKWCGTDGDNNVLVIDLLGRSLEDFFVYCGRKFSLKTVLMLADQMLTRIECMHSKGFLHRDIKPDNFLMGLGRKSNQVYIIDFGLAKRYRDPNTNKHIPYSFSLTSKDLMA

SEQ ID NO: 214991 - protein, 134 aa, Glycine max
  Coding DNA Sequence Number=SeqID_98213
MDYSDQCEAATRVKIRDYDMSPVLSPSWVEKKLQASEECNKYLLQIECRLAINGRLRDSNLDLCNVQRKDKKEEAEKPYSDEEEEVGYMDISNILMARSTEEPFYDSPVEEEPLISTSSSSKPNAGPWFTLDDT

SEQ ID NO: 214992 - protein, 433 aa, Glycine max
  Coding DNA Sequence Number=SeqID_98214
  Homolog annotation: Hit_ID=UPI00005DC266; Match level="QueryCoverage =47%, HitCoverage=82%, E-value=2e-23, Identity=36%"; Hit description =ice binding
  Pfam annotation: Domain name=DUF828; Domain location=122-340; Score =137.4; E_value=3.9e-38; Accession=PF05703.2; Description=Plant protein of unknown function (DUF828)
  Pfam annotation: Domain name=PH_2; Domain location=359-432; Score =36.3; E_value=1.1e-07; Accession=PF08458.1; Description=Plant pleckstrin homology-like region
  Pfam module annotation: Pfam domain module=DUF828::PH_2; Domain location=122-340::359-432
  Subcellular localization annotation: CTP_CleavageSite=86; ConfidenceScore=5.22e-01
MLANLERPSAPRVQPKPSNVQNLDAKNHIEKHGVNNSPSTSSATPKSSTVNASKPERPAGTSNLGRVFGSNARVSSSWIPSLRRISSAKYPSASNSICSVHQLENIDENAPADWPASSCPPPDTPTESMEFLARSWSLSAMELSKALHSTNVTISTGIEMPLSCPSGHQFDTKSSTASKAVRTLAVFNLRVICIRSLLRGRTMGRWLKDQKERKKQEIRTHNAHLHAAVSVAGVAAAIAAVAASTASPEMPYANQKNPPPASSAIASAAALVASHCIEIAEDMGAEHDQILTVVNSAINAKTNGDIMTLTAGAATGAATLKARLQKGPGATSIPLVEEKCDERKEANILTALDYVFRGGELLKRTRKDIVTGVCNDIPAWPGREKEDISEKRAYFGIKTTDRTIEFECGSKGDKQFWLEGIQYMLNCRVKVTL

SEQ ID NO: 214993 - protein, 192 aa, Glycine max
  Coding DNA Sequence Number=SeqID_98215
  Subcellular localization annotation: CTP_CleavageSite=34; ConfidenceScore=5.13e-01
MAFLGETSSQTVVNSTLGFIFPNGSIVHNDSGVSFQAFTPVPIRVPNGCDFQTLKTRIHNTLKLIDKQFLDEIYYRQPFTYAGKNPKNFDIPTGCTMDELKDLIKQVASRGIPPYGVDEIQMVTRLFFRKPSHHEYSEKVIKFEIIELKTNEDVMKVPIESNYWKKIGPIEILVVFNKPLPQMEDELSLSQN

SEQ ID NO: 214994 - protein, 68 aa, Glycine max
  Coding DNA Sequence Number=SeqID_98216
MVRGAHMRGALVRGAHMSGALVRGATSLVRRAAAVIALEIGVRRRCRQTKPVAVLACAPCLLLHAKFG

SEQ ID NO: 214995 - protein, 150 aa, Glycine max
  Coding DNA Sequence Number=SeqID_98217
MNYDIDSYRTDVECENTMSSGNVNGFSLTPYFHLLFNLFLLLALSLSVRASITMEIPTKPVKIQRHRCSLLMRLTWILHRQKLSCFWFEHGIYILLIRGLNRNHFSFGFSSVDLPLLTTLHLQSFILECRDTIELPGGSLNLKFSCVSYL

SEQ ID NO: 214996 - protein, 80 aa, Glycine max
  Coding DNA Sequence Number=SeqID_98218
  Gene Ontology: Mol. function=structural molecule activity; Cellular component=chloroplast envelope
KLKALDGEWIQVIFEAPELKVGSWQVQYGGQSEVKLRITYVDEKIRSLKRPLYSLAAEFVSKWTTEIWSGDEECGMVSNL

SEQ ID NO: 214997 - protein, 144 aa, Glycine max
  Coding DNA Sequence Number=SeqID_98219
  Gene Ontology: Mol. function=glutamyl-tRNA reductase activity; Biological process=tetrapyrrole biosynthetic process
  Homolog annotation: Hit_ID=Q9LVD1; Match level="QueryCoverage=84%, HitCoverage=28%, E-value=4e-38, Identity=57%"; Hit description =Arabidopsis thaliana genomic DNA, chromosome 5, P1 clone:MJB24
  Pfam annotation: Domain name=DUF266; Domain location=14-140; Score =239.0; E_value=1e-68; Accession=PF03267.4; Description=Arabidopsis protein of unknown function, DUF266
MQGHEGKFSVYVHSSKEKPTHVSSFFVGREIHSEPVGWGKISMVEAERRLLAHALLDPDNQHFVLLSESCIPVRRFEFVYNYLLLTNVSFIDSYVDPGPHGNGRYIEHMLPEVEKKDFRKGSQIVETMETSMVSVIKYFFFFII

SEQ ID NO: 214998 - protein, 194 aa, Glycine max
  Coding DNA Sequence Number=SeqID_98220
  Gene Ontology: Mol. function=structural molecule activity; Cellular component=chloroplast envelope
  Subcellular localization annotation: CTP_CleavageSite=47; ConfidenceScore=5.82e-01
MAATASASAASLSLRSSPFKLNPPKLNSVTLRFPHLNRRYNSAFRVVAASVSVSNPNVQTGPDDLVASILSKVVQTDGGVLLKEEEHKEVAEVAQELQKYCVSEPVKCPLIFGEWDVAYCSRPTSPGGGYRSAIGRLFFNTKQMVQVVEAPDIVRNKGSTLSISFLDVEVSPQADIIFRKAIDSKTEISQFCYQ

SEQ ID NO: 214999 - protein, 80 aa, Glycine max
  Coding DNA Sequence Number=SeqID_98221
MAKEGGFPLRDRLRLWIALRLSLTFHADFALCAPLGFAVGFLHTKPRVHAKPRLARYTRVHTNPGLARYTRVCAKPRLGC

SEQ ID NO: 215000 - protein, 56 aa, Glycine max
  Coding DNA Sequence Number=SeqID_98222
MAKEGGFPLRDRLRLWIALRLGLTFHANFALSVPLGFAVGFLCAKPGVRSKPGLAR

SEQ ID NO: 215001 - protein, 175 aa, Glycine max
  Coding DNA Sequence Number=SeqID_98223
MTSRQPLQEPESRIKDMVEEPMEHFIDQNYWQVLANGGKKKSKTMSNSPMKNSKSAAVVLSDNCKWNYMLTWMKNEDVEAEKLWNIAIQLGVVFKGTEEEFMHKMIKWRGLRKLISKEEPHLVCLQEIKMENIQVEVSGAIRCDLNVEWHHATVNHGGVEKRMLWVELLNLKALE

SEQ ID NO: 215002 - protein, 129 aa, Glycine max
  Coding DNA Sequence Number=SeqID_98224
MRNDNLEMSVKDQKATFNLFEVMKHPSDHKACFKVEAIEKEVDLTVQHLAIHSPLEKALINDVDCLNNEEEEDLRDWEQTFEELKKDNPTKKPKVELKALPIHLKYVFLEDNGTKPIMINNNLSSDEEA

SEQ ID NO: 215003 - protein, 82 aa, Glycine max
  Coding DNA Sequence Number=SeqID_98225
  Gene Ontology: Mol. function=DNA binding; Cellular component=nucleus; Biological process=regulation of transcription
  Homolog annotation: Hit_ID=Q6YXH5; Match level="QueryCoverage=93%, HitCoverage=28%, E-value=2e-24, Identity=63%"; Hit description =Putative ZF-HD homeobox protein
MEAVSDPTSGAIPHGGSSKKRFKTRFTQEQKEKMMAFAEKLGWRILKHDESVMQEFCSQASIQPHMLKVWVHNNKHTLGKKP

SEQ ID NO: 215004 - protein, 95 aa, Glycine max
  Coding DNA Sequence Number=SeqID_98226
  Homolog annotation: Hit_ID=Q1SRI1; Match level="QueryCoverage=50%, HitCoverage=7%, E-value=1e-07, Identity=58%"; Hit description=RNA -directed DNA polymerase
MVDARQSAFLGDKNILDGIFVANEVIYEMREKKKYCLIFKANFEKAYDLGLSGLVREAEAKELFYEVNVGASNLKVFLLQFADDTIFFLRRWQSP

SEQ ID NO: 215005 - protein, 224 aa, Glycine max
  Coding DNA Sequence Number=SeqID_98227
  Gene Ontology: Mol. function=protein kinase activity; Cellular component=cytoplasm; Biological process=regulation of progression through cell cycle
  Homolog annotation: Hit_ID=Q9ZSW3; Match level="QueryCoverage=83%, HitCoverage=53%, E-value=6e-63, Identity=63%"; Hit description=CAK associated cyclinH homolog
MYKGCLHLVSHQFSSFYLLVSFSVCQIELFHRLTCVYAACKIEENHVSAEELGKGISQDHQMILNNEMISLEFDLIVYAPYRSVEGFINDVEVCLVGPDAAEFCNAGDDQLEMLKTLQETARFEVDKMMLTDAPLLFPPGQLALAALSNSNALHRVIDFDSYLRGIFSHENSMHTMSELSESLNAIDSWVRKYKSPSEKELKHINRKLKSCWGHSSHDEYFLYP

SEQ ID NO: 215006 - protein, 116 aa, Glycine max
  Coding DNA Sequence Number=SeqID_98228
MVNLHPSLVIVKDVEKDTIGSSDVWSEAKIQLCSVREKLDTRTKETHDDEAKMEVNDNEIEMTTQTTSSTEGSGQRKRRRKGDKRIGAIYKLSSQLDQVLEKYDGESLDDPTSINA

SEQ ID NO: 215007 - protein, 131 aa, Glycine max
  Coding DNA Sequence Number=SeqID_98229
  Gene Ontology: Mol. function=peptidase activity; Cellular component =nucleus; Biological process=spore germination
  Homolog annotation: Hit_ID=Q01CP2; Match level="QueryCoverage=63%, HitCoverage=87%, E-value=4e-19, Identity=53%"; Hit description =Homology to unknown gene
  Pfam annotation: Domain name=DUF163; Domain location=7-131; Score =119.1; E_value=1.2e-32; Accession=PF02590.8; Description =Uncharacterized ACR, COG1576
MFCNRALPIRILSVGKKRSRGLQLMVDEYADKLSDQRAQVDAEDEAVMNLIRSDDWVVMLDERGQDIESEQMAELVGDAGNTGASRLSFCIGGPYGHGRKMRQRANLSIKLSSLVLNHQIALLVLMEQLYR

SEQ ID NO: 215008 - protein, 74 aa, Glycine max
  Coding DNA Sequence Number=SeqID_98230
  Gene Ontology: Mol. function=catalytic activity; Biological process =metabolic process
  Homolog annotation: Hit_ID=Q1SI48; Match level="QueryCoverage=80%, HitCoverage=14%, E-value=1e-19, Identity=81%"; Hit description=AMP -dependent synthetase and ligase
MLKSESEPWSWYKMWYLWCQFCRMDYEHAGVGAIEFIICHSEVSIALAEEKKIPELFKTFPNATKYLKRSNSEL

SEQ ID NO: 215009 - protein, 343 aa, Glycine max
  Coding DNA Sequence Number=SeqID_98231
  Gene Ontology: Mol. function=nucleic acid binding; Cellular component= intracellular; Biological process=DNA integration
  Homolog annotation: Hit_ID=Q1S1X7; Match level="QueryCoverage=43%, HitCoverage=15%, E-value=1e-32, Identity=37%"; Hit description =Integrase, catalytic region; Zinc finger, CCHC-type; Peptidase aspartic, catalytic
MELRDIDVKIEDEDLAIISLASLPPSYDNLLRLQASGNYDEASVFGLSVTDSTKGREKKGKGSKRSMNDSSSENDLVMVVGEQIQQQHFEQRVLDSIWSYHMCPHNSWFITYENKSHGNVLMGNNASLQDRRYRLYTNQTANEIVRTLTDVELCKSEGKGKFVVMQALSQLFYKMGSHASNGSSNGIYHFIYGKQHSVKFPKVVHTTKAILDYVHSYCWWPLRVLSLGGARYILSIIDDYSRMTWVEAVNIAWYLMNRSSTTAIDFKTLIEAWSNKPAKYSILKVFGCPTYYHISEGKLEPRAMKGVFMSSEDEVKGFKIWSPSERKVILSRDVIFVELYIAF

SEQ ID NO: 215010 - protein, 143 aa, Glycine max
  Coding DNA Sequence Number=SeqID_98232
  Gene Ontology: Mol. function=carboxypeptidase activity; Cellular component=membrane; Biological process=auxin mediated signaling pathway
  Homolog annotation: Hit_ID=Q33A72; Match level="QueryCoverage=83%, HitCoverage=32%, E-value=2e-27, Identity=51%"; Hit description =Nodulin MtN21 family protein, putative, expressed
DIIIQGLTILSPVDSPNTDGIDPGMFTNARPYLLLVAVQFGSAGMFIFAMDSIKKGMSHYVFIVYRNAIASVSLAPFAFVLERKVRPKMTFRVFSEIMALAFFEIMLDQCIALLGMKFASASFLSVVMNSAHSVTFVMSVILR

SEQ ID NO: 215011 - protein, 56 aa, Glycine max
  Coding DNA Sequence Number=SeqID_98233
MEARSEQALIPKRARRESLSVWVQMLLMRECLPSLHKPWSTSIQEPPDCLKELEVS

SEQ ID NO: 215012 - protein, 129 aa, Glycine max
  Coding DNA Sequence Number=SeqID_98234
MELQRLNQNEEIDKKKRSIALKASSSISFKNSSRREESRGVRTSIMEENLKKTPKFLYATNGTNLVTSKQIVPQMRNGLRRVTRKRYEERRTKKAYIAWDDNDSSDGPEKEINLLTKDYESGENIAQED

SEQ ID NO: 215013 - protein, 112 aa, Glycine max
  Coding DNA Sequence Number=SeqID_98235
MNLRHRVLMKVYWGLGLWFNDYREKWKGTTVRCHKLLVVVVLQDVMVVVFGRVLQQIVGYAQWWKKVSRHNRWGCRSCQQTRTTSTMSSQATHMEVKQESGIEGGRSRGEGA

SEQ ID NO: 215014 - protein, 516 aa, Glycine max
  Coding DNA Sequence Number=SeqID_98236
  Gene Ontology: Mol. function=binding; Cellular component =intracellular; Biological process=metabolic process
  Homolog annotation: Hit_ID=Q8S263; Match level="QueryCoverage=83%, HitCoverage=78%, E-value=7e-69, Identity=29%"; Hit description =Putative pentatricopeptide (PPR) repeat-containing protein
  Pfam annotation: Domain name=PPR; Domain location=146-180; Score =34.9; E_value=2.7e-07; Accession=PF01535.11; Description=PPR repeat
  Pfam annotation: Domain name=PPR; Domain location=243-277; Score =20.5; E_value=0.0059; Accession=PF01535.11; Description=PPR repeat
  Pfam annotation: Domain name=PPR; Domain location=344-378; Score =28.3; E_value=2.7e-05; Accession=PF01535.11; Description=PPR repeat
  Pfam annotation: Domain name=PPR; Domain location=380-414; Score =13.8; E_value=0.17; Accession=PF01535.11; Description=PPR repeat
  Pfam annotation: Domain name=PPR; Domain location=416-450; Score=1.5; E_value=4.9; Accession=PF01535.11; Description=PPR repeat
  Pfam annotation: Domain name=PPR; Domain location=48-82; Score=36.1; E_value=1.2e-07; Accession=PF01535.11; Description=PPR repeat
  Pfam module annotation: Pfam domain module=PPR::PPR::PPR::PPR::PPR::PP R; Domain location=146-180::243-277::344-378::380-414::416-450::48-82
MGVKADKYTFAMMLSLCSLELFYYGRHMHSVVIKMFEEAEEGGSCDYDTYNAMIDGFASAERSEDAFLMFRDMQKGSFGPTEVTFVSVMSSCLSLRAGCQARAQAIKMGFVGCVAVNNAMMTMYSGFGEVNEVQNIFEGMEERDVVSWNIMVSTFLQENLEEEAMLSYLKMRREGIEPDEFTYGSLLLASDSLQVVEMIHSLLCKGGLVKIEVLNALVSAYCRHGNIKRAFQIFFGVPSKNLISWNIIMSGFLMNGHPLQGLEQFSALLSIQVKPNSYSLSLVLSICSSMSAVSHGKQVHGYILRHGFPSEVSLGNALVTMYAKCGSLDKALRVFDAMVERDTISWNAMISAYAQHGQGEEAVHCFEVMQTSPGIKPDQATFTSVLSACSHAGLVDDGIHILDTMVKVYGFVPSVDHFSCIVDLLGQSGYLDEAERVIKTHGNLRLGRTVARLILERDHNNPSVYVLLSNICAAADGVSGIGVEGVKDVEGLGEVVLVCMDGDDGVRWLNVDGLAC

SEQ ID NO: 215015 - protein, 45 aa, Glycine max
  Coding DNA Sequence Number=SeqID_98237
MVIFSHGIAAKDKEEEPSTWEASLRSKEGSFLEKLEGGYSHPSDS

SEQ ID NO: 215016 - protein, 67 aa, Glycine max
  Coding DNA Sequence Number=SeqID_98238
MAAVVVGKRGKRNDDVVEILAEHPCPRHPRRWHFPFSTMTLLNPSVAAFPPQVSSYVPKSQLTTQYL

SEQ ID NO: 215017 - protein, 108 aa, Glycine max
  Coding DNA Sequence Number=SeqID_98239
MRIDMHSEEGTDEQGTPGDSSNGLKELGGMLSGDNLTKAIFLSDVKHDVDSLVFIDAIKTWKQHDDVLHVDHFYGFLCCCSVLVDAPEYRPCIVDLSLSTISNYYDLF

SEQ ID NO: 215018 - protein, 359 aa, Glycine max
  Coding DNA Sequence Number=SeqID_98240
  Gene Ontology: Mol. function=nucleic acid binding; Cellular component= intracellular; Biological process=regulation of transcription
  Homolog annotation: Hit_ID=Q1SHX5; Match level="QueryCoverage=81%, HitCoverage=81%, E-value=1e-104, Identity=64%"; Hit description=Zinc finger, C2H2-type
  Pfam annotation: Domain name=zf-C2H2; Domain location=213-235; Score =15.5; E_value=0.19; Accession=PF00096.16; Description=Zinc finger, C2H2 type
  Pfam annotation: Domain name=zf-C2H2; Domain location=285-307; Score =23.3; E_value=0.00089; Accession=PF00096.16; Description=Zinc finger, C2H2 type
  Pfam annotation: Domain name=zf-C2H2; Domain location=311-336; Score =1.6; E_value=7.1; Accession=PF00096.16; Description=Zinc finger, C2H2 type
  Pfam module annotation: Pfam domain module=zf-C2H2::zf-C2H2::zf-C2H2; Domain location=213-235::285-307::311-336
  Subcellular localization annotation: CTP_CleavageSite=80; ConfidenceScore=5.19e-01
MADPYSNFFSPGSFFHHYPSPNPSPHHHPYAHNFLNQNGSNINNHNTFFHFHHFQTTICSSSPPSPPLREALPLLTLSPRNEEEQEEDDQDQDQEILQENICTAMDVEENYNNRTLHLHPKGEEQDQEDTDESVTVALHIGLPSPSAAEIASVLSSAACSTDKEQQGGHGVGNNNSNNGSEDFSSSGFLSNRLNKGQYWIPTPSQILIGPTQFSCPVCCKTFNRYNNMQMHMWGHGSQYRKGPESLRGTQPTGCRNNIDHPRAKPLKDFRTLQTHYKRKHGIKPFMCRKCGKAFAVRGDWRTHEKNCGKLWYCICGSDFKHKRSLKDHIKAFGSGHAAYGIDGFEEEEEPASEVEQDND

SEQ ID NO: 215019 - protein, 189 aa, Glycine max
  Coding DNA Sequence Number=SeqID_98241
  Gene Ontology: Cellular component=endoplasmic reticulum; Biological process=lipid biosynthetic process
  Homolog annotation: Hit_ID=Q9LJK3; Match level="QueryCoverage=50%, HitCoverage=32%, E-value=5e-18, Identity=44%"; Hit description=LAG1 longevity assurance homolog 2
  Subcellular localization annotation: CTP_CleavageSite=43; ConfidenceScore=5.40e-01
MYSDEQHIATWAFYSICVFFRCNCNLPLHTFPPPSSSSARIFRCSNSKAASSASSKSVLATADSVQALFLKLLQVLQSGMDFLWSENATTPRASHFSVAICFAFASFAARFFLDRFVFRSLAIRMLTKGRAPSRITKEMQVKIGKCSESMWKLTYYAAVEAFVLKITYHEPWFTNTKLYFNDWPNHELK

SEQ ID NO: 215020 - protein, 113 aa, Glycine max
  Coding DNA Sequence Number=SeqID_98242
MKEHSNRKGRFVKHFSVLLEIPSIYRDSDLRRKSIKYLGLEVSSYIQIDGKEWNGAQWNEFHSIQSLFSPPSSWGLWDKINLFLSIHCILYHPIPLQSTVDIQTLPQEIILAL

SEQ ID NO: 215021 - protein, 121 aa, Glycine max
  Coding DNA Sequence Number=SeqID_98243
  Gene Ontology: Mol. function=sequence-specific DNA binding; Cellular component=endoplasmic reticulum; Biological process=lipid biosynthetic process
  Homolog annotation: Hit_ID=Q9LJK3; Match level="QueryCoverage=84%, HitCoverage=34%, E-value=1e-38, Identity=70%"; Hit description=LAG1 longevity assurance homolog 2
  Pfam annotation: Domain name=LAG1; Domain location=1-106; Score= -38.8; E_value=4.5e-05; Accession=PF03798.6; Description=Longevity -assurance protein (LAG1)
MEAAKVFKYSGREFGASVCFGFFAVSWLILRLIFFPFWVIKATSIDLQQVLSLSEGFHMFLYYVFNTMLIMLLIFHIYWWKLICAMILRQLKNRGKVGEDIRSGTTAVRICSTEFIHTILH

SEQ ID NO: 215022 - protein, 100 aa, Glycine max; identical to SEQ ID NO: 149392
  Coding DNA Sequence Number=SeqID_98244

SEQ ID NO: 215023 - protein, 178 aa, Glycine max
  Coding DNA Sequence Number=SeqID_98245
  Gene Ontology: Mol. function=DNA-directed RNA polymerase activity; Cellular component=nucleus; Biological process=transcription
  Homolog annotation: Hit_ID=Q1S319; Match level="QueryCoverage=98%, HitCoverage=12%, E-value=5e-63, Identity=64%"; Hit description=RNA polymerase Rpb1, domain 5
MQIVQRTAKKFCLQNFGKVGECKAITCKESGVIYYGKDDRKGDEISAFEKEEIPALQTSGVHFKTFWELEDDLDVSQGDHHQGSTECFHISVNIRHLKLNADFMTHSGGYCLMNRTGSIADSTSLFIKMCFETAAKFIVEAAYHGQVDNLETPSARICIGLPVKMGTGCHDLIQKLEI

SEQ ID NO: 215024 - protein, 81 aa, Glycine max
  Coding DNA Sequence Number=SeqID_98246
MKPKEECKVIFIRRKEKEKKTEEDVCDEEGEKKEERERNEEKTQQWEKCSQVFPGYMSFIESPTKRRKCKEVVFYVTFMPS

SEQ ID NO: 215025 - protein, 262 aa, Glycine max
  Coding DNA Sequence Number=SeqID_98247
  Gene Ontology: Mol. function=DNA-directed RNA polymerase activity; Cellular component=nucleus; Biological process=transcription
  Homolog annotation: Hit_ID=Q1S319; Match level="QueryCoverage=95%, HitCoverage=15%, E-value=7e-93, Identity=67%"; Hit description=RNA polymerase Rpb1, domain 5
  Pfam annotation: Domain name=RNA_pol_Rpb1_2; Domain location=1-121; Score=58.3; E_value=2.6e-14; Accession=PF00623.11; Description=RNA polymerase Rpb1, domain 2
  Pfam annotation: Domain name=RNA_pol_Rpb1_3; Domain location=124-259; Score=-22.1; E_value=0.001; Accession=PF04983.8; Description=RNA polymerase Rpb1, domain 3
  Pfam module annotation: Pfam domain module=RNA_pol_Rpb1_2::RNA_pol _Rpb1_3; Domain location=1-121::124-259
MVLNPIPVLLIMLIKEISDHEFEGKVVYRHLKDGDVVLANRQPTLHKPSIMAHIVRVLKGEKTVRMHYANCRVTTVNNFFVLFFPLRDLCTYNADFDGDEINVHFPQDEISRAEAYNIVNANNQYVKPTSGDPIRALIQDHIVSAALLTKKDTFLSYEEFNQLLYSSGVSMAGLGSFYGKHGQKVISALLYYITRGSPSFTVEKNAKIPSNFFKTRIRKGKRYTQDTSKKKEKPDEDKLLIYKNDLVRGIVDKAQFGDWYDT

SEQ ID NO: 215026 - protein, 113 aa, Glycine max
  Coding DNA Sequence Number=SeqID_98248
  Gene Ontology: Mol. function=DNA-directed RNA polymerase activity; Cellular component=nucleus; Biological process=transcription
  Homolog annotation: Hit_ID=Q1S319; Match level="QueryCoverage=90%, HitCoverage=6%, E-value=3e-47, Identity=89%"; Hit description=RNA polymerase Rpb1, domain 5
  Pfam annotation: Domain name=RNA_pol_Rpb1_4; Domain location=5-88; Score=82.1; E_value=1.8e-21; Accession=PF05000.7; Description=RNA polymerase Rpb1, domain 4
MTNKLNSTTSSGILKELLSEGILQPSGKNCISLMTTSGAKGSMVNFQQISSHLGQQELEGKRVPRMVSGKTLPCFPPWDCSPRAGGFIIDRFLTALHPQEYYFCDTLYPSHIY

SEQ ID NO: 215027 - protein, 143 aa, Glycine max
  Coding DNA Sequence Number=SeqID_98249
MLQPYEISIGLKEHSNPVTPKAYTPKSPSGPLPPDSGWVPQVFGLSAYQLVSELVVDISIKAAYKAAEMSALKGGAMIGTWELWVLGSPPLTTSFEGWVPKCLGAYQLMLGPMGSAMMGTWVLWGAYVSHRVVWDARWSIKCL

SEQ ID NO: 215028 - protein, 212 aa, Glycine max
  Coding DNA Sequence Number=SeqID_98250
  Homolog annotation: Hit_ID=Q1S319; Match level="QueryCoverage=11%, HitCoverage=1%, E-value=7e-07, Identity=95%"; Hit description=RNA polymerase Rpb1, domain 5
MKNLMLEDTGTQRSDRMVKGSKKPINNEPSCSRGTIPGRKAGAHLEDMFDSEHSNQMPMLPNYIDLKMQAPVFSQPAQQLLSASASGTKTGATASGTKTGTRAAGTKTGGQCIWDEDRDQCIWDEDGPVHWDNESSNGDETPRIGAVSRGDHYAGSAAKTAARHALSCAGKASGTGVFSSLKRRVGRAHHEFFQDAVNGVDASLIDFTKQQV

SEQ ID NO: 215029 - protein, 235 aa, Glycine max
  Coding DNA Sequence Number=SeqID_98251
  Homolog annotation: Hit_ID=Q9M3V1; Match level="QueryCoverage=42%, HitCoverage=25%, E-value=3e-18, Identity=50%"; Hit description =Protein phpsphatase 2C
MECCQQIFHIIFYYLNYLKNPIRPPPLLLPRLPPLLPLLKIPSSTTNPLVFLQNYFQTLRASGGGNLQLVIKSSNPGRAFHFLGVTHNDYFFRSGLEELIQHLTENYRNRYGTPLASKFDVEGLGLRKVVSFSFPQVATMCKERLHEIVNEEMDHAHENLEWKLTMKNEFARMDDKVHCLSQSNQTFTCRCDFKLLTVMPSSPSSHQTNSLSPTATAPTSYSTIMAPPSLSPPIT

SEQ ID NO: 215030 - protein, 75 aa, Glycine max
  Coding DNA Sequence Number=SeqID_98252
MHNDVVRTLIEVLHIQKLKKTLVSVDTMDSKGHMSGKGLNIMSKRGLLGNHKVTLFSFVSTTYMGNNIEQSFQRL

SEQ ID NO: 215031 - protein, 178 aa, Glycine max
  Coding DNA Sequence Number=SeqID_98253
  Gene Ontology: Mol. function=nucleic acid binding; Cellular component= proton-transporting two-sector ATPase complex; Biological process=DNA integration
MSYVPYASVAGSLMYAMVWTKLDLAQAVNVVSRYIGNPGKEHWQVLKHILEYLKGTTNIRLVYHGDTSCALPNYSNSDYATDWDARRSGTGYTFTIGNCLEKAIILCDGLNAICLAKDQVHHERTNHMDIKYNFICVEKRVEVHKVDTRDNPTDMFTKAISRRKIMHCLDLLNVDFWK

SEQ ID NO: 215032 - protein, 199 aa, Glycine max
  Coding DNA Sequence Number=SeqID_98254
  Gene Ontology: Mol. function=acyltransferase activity; Cellular component=endoplasmic reticulum; Biological process=metabolic process
  Homolog annotation: Hit_ID=Q1SHX4; Match level="QueryCoverage=90%, HitCoverage=46%, E-value=1e-69, Identity=72%"; Hit description =Phospholipid/glycerol acyltransferase
MVKISLSLSLEFTDEIMGFVSAVNHMRSFVPAIYDVTVAIPKSSPAPTMLRLFRGKSSLVHVHIKRHAMKDLPEEDEAVAQWCRDVFVAKDALLDKHIAEDTFSDQELQDTGRPVKSLVVVILWACVVVTGVVKFLQWSSLLSSWKGVAFSAFGLGVVTLLMHILIMFSQSERSTPSKVAPTKKSKNSEQLEARDNKQD

SEQ ID NO: 215033 - protein, 84 aa, Glycine max
  Coding DNA Sequence Number=SeqID_98255
  Homolog annotation: Hit_ID=Q1SQN7; Match level="QueryCoverage=63%, HitCoverage=9%, E-value=3e-08, Identity=42%"; Hit description=RNA -directed DNA polymerase
MNIPFTYLGISVGADTKKSSTWKLIIDKMHAKLAPWRRRHLSFGGRISSKVLNILNRIQRNFLGCAKDEEKKDSLEEVDLEIVE

SEQ ID NO: 215034 - protein, 46 aa, Glycine max
  Coding DNA Sequence Number=SeqID_98256
  Homolog annotation: Hit_ID=Q2Z1Y8; Match level="QueryCoverage=76%, HitCoverage=9%, E-value=1e-11, Identity=86%"; Hit description=1-acyl- sn-glycerol-3-phosphate acyltransferase
MARISDYETHGSKYSQILKPFIQWVKSMLLSYPITEVTLIGLLDGF

SEQ ID NO: 215035 - protein, 204 aa, Glycine max
  Coding DNA Sequence Number=SeqID_98257
  Gene Ontology: Mol. function=RNA-directed DNA polymerase activity; Biological process=RNA-dependent DNA replication
MVQQNVSGISVLRKLNEHSKGNQQEGGKGDKLSIKVLTFKVRGLGSCLKWNAIMKLIAKEEPNLIFLQETKLQSVDDKIYGAMWGDAFEEWRQVPAVGALGGIQCFWELGSLQVIDWMGGKKFLYIQGRWCGGSEVILMLLERMRKGKEDVRVNFGARGGAMNKLDRVLVSTKWLQLWPNSTQSALDRSTSDHRPILVNQKHVD

SEQ ID NO: 215036 - protein, 71 aa, Glycine max
  Coding DNA Sequence Number=SeqID_98258
MRGSIGMLKKIRNREWGDLNEVNDEAGSEEEKAQWDDHTAVIASGFPKLLSVDDIDVAGYVMSISAMLWLP

SEQ ID NO: 215037 - protein, 270 aa, Glycine max
  Coding DNA Sequence Number=SeqID_98259
MAHLNSYEEFHGTFPSPAKDFFSNSCDSKDNDFIFSLLMPLPRDIASSSTWFLFLDLRSISLPPFSRSDMVASSSSSLCTDSPSLTLCPHCIKDVDVTNPRRRAIVATGFGGILKVSATVLPEKLCCFLVPTFKEIVHEEIACSFGNPATYIRDFLVEGIKNYRRKITMEYSGCIYLLLILYAEHVLYGSIPRWTSLEELPTHYWNNKLLNKLAETIEREGGLGVMTVKVLAQTKYNEHSLMPNCVQDLSKRVNMLEGTATSQSWLLQYY

SEQ ID NO: 215038 - protein, 72 aa, Glycine max
  Coding DNA Sequence Number=SeqID_98260
MAHNGGRIYWGVVRLGGMLQGRGGSKRLSFISEQKPSKVWEVGGWHRDIWVWELKRRRKRSFIFAVMGSHSL

SEQ ID NO: 215039 - protein, 607 aa, Glycine max
  Coding DNA Sequence Number=SeqID_98261
  Gene Ontology: Mol. function=tRNA methyltransferase activity; Cellular component=nuclear envelope; Biological process=tRNA processing
  Homolog annotation: Hit_ID=Q1S312; Match level="QueryCoverage=99%, HitCoverage=99%, E-value=0.0, Identity=77%"; Hit description =Quinoprotein amine dehydrogenase, beta chain-like
  Pfam annotation: Domain name=VID27; Domain location=1-585; Score= -397.0; E_value=1.1e-09; Accession=PF08553.1; Description=VID27 cytoplasmic protein
MGTSQSREGLEVTDSDSDYENEEETEHYEDAKTTHSTELDDVDAKLKALKLKYQTPSSSAKPLPQNAVKLYLHIGGNTPNAKWILSDKHTSYAFHKDTDENENDDVWLLTVGSKVRARVSSEMQLKMFGDQRRVDFVADGVWALKFPSDDTYRRFVTEFQSCMFENVYGIECTEENKVKIYGKEFIGWVKPEAADDSVWEDAVSGEPSPSPSPSRRRNDLMEEFEEAANGGVQTLTLGALDNSFMVNDTGVHVYRNFDRGIHGKGVAVKFAGDGSTPNKALLMRAETNMMLMSPLNDGKPHASKLHQLDIETGKIVTEWKFGKDGADLTMRDITNDTKGSQLDPSESTFLGLDDNRLCQWDMRDRKGIVQNIATASSSPVLHWSQGHQFSRGTNFQCFATTGDGSIVVGSLDGKIRLYSKTSMRMAKTAFPGLGSPITSVDVTYDGKWVLGTTDTYLVLICTLFTDKDGRTKTGFSGRMGNRIPAPRLLKLTPLDSHLAGANNKFHGGHFSWVTENGKQERHLVATVGKFSVIWDFQQVKNSAHECYRNQEGLKSCYCYKIILKDESIVESRFMHDKFAVSDSPEAPLVVATPMKVSSISMSGKRHG

SEQ ID NO: 215040 - protein, 35 aa, Glycine max
  Coding DNA Sequence Number=SeqID_98262
MAEINELRFQQWRVLGTHIQQEKMTNRRKRSTSFI

SEQ ID NO: 215041 - protein, 86 aa, Glycine max
  Coding DNA Sequence Number=SeqID_98263
MGWVEQECSSSARKWSSEEEKANWVGAKRDWETLAVMRIRNWNVGWDGRRRYMWGVYLDGGVGSESWTRGRLRIKWGGIVDWIRWI

SEQ ID NO: 215042 - protein, 338 aa, Glycine max
  Coding DNA Sequence Number=SeqID_98264
  Gene Ontology: Mol. function=nucleic acid binding; Cellular component= mitochondrion; Biological process=DNA integration
  Homolog annotation: Hit_ID=Q1T1E6; Match level="QueryCoverage=74%, HitCoverage=46%, E-value=3e-49, Identity=42%"; Hit description=Zinc finger, CCHC-type; Peptidase aspartic, catalytic
MGIPHQAWMALLLVTWPVLGHCLSIAAAQCWLTFLYMLMTSSQLVPTPDGLFLTQHHYIRDLLHKHNMHDAKPVCTPMSASVNLATPSGDVHEYRQIVGSLQYLALTRPNVAYCVSKVSQFMHAPTTIHMQATKGLLRYLKSIGLWSPSPPLIGSSPNGLLTRCHFLVLQKAENHCQIICGGRYRTIGSITAEILWLKELFKDLRLTLPGKPHIYSATIGATYLCANPVFHTRMKHLAIDYHFVRDPVTNLQISSQSSLFNKTQVADIQDWGCFLHLHLVGAWGVSAKVIGGELGKGLLRVKREMKVALGMKRTPSLCFSSIVCAMLEIRLFMFRKSV

SEQ ID NO: 215043 - protein, 163 aa, Glycine max
  Coding DNA Sequence Number=SeqID_98265
MFPLDVPPCVEGCVWCIRCQTVVECNVFSQVWLHDCVKRFGLSTVLHSDLIRHYQQFKGLVRVLLLTWMGALGLHELSIREVAGSILVFRECFLVRDPVRDNVVGLTVPSLARKGVEEGGLEDGESRSDLEELGDIVVVKVVQHDLAKVKDSERNFTLTAIYR

SEQ ID NO: 215044 - protein, 131 aa, Glycine max
  Coding DNA Sequence Number=SeqID_98266
  Subcellular localization annotation: CTP_CleavageSite=74; ConfidenceScore=5.38e-01
MDLGGSPLYQVNATPLRDMGKTQHRIALSMVYRFVWVRKKSRCSSGLVVPSYRSRLSGFQPRGMSSSMMRLTKRCRQVVNLVGRWTWQRLGSSRVLNVRHRRIGSFKRGLAFEATSSANHRCEREIDNERP

SEQ ID NO: 215045 - protein, 176 aa, Glycine max
  Coding DNA Sequence Number=SeqID_98267
  Gene Ontology: Mol. function=nucleic acid binding; Cellular component= nucleus; Biological process=DNA integration
  Homolog annotation: Hit_ID=Q1S1X7; Match level="QueryCoverage=80%, HitCoverage=13%, E-value=1e-19, Identity=37%"; Hit description =Integrase, catalytic region; Zinc finger, CCHC-type; Peptidase aspartic, catalytic
MGFVQIRMHDGVVKTLIEVHHVPELKENLVSVGVMDSKGFYCLVEGGVMHIRGKKKFVGSIETGSISIVSQLGSHASNGSSDNSLWHLHLSHMSKKRWNLFSFVSTASMGNNIRRSFQRLCTQQRPCWTIGDLRQFHNWKGKGLNRSFWVEVVNPTCYLVNESPPTVIDLKAPIEV

SEQ ID NO: 215046 - protein, 178 aa, Glycine max
  Coding DNA Sequence Number=SeqID_98268
  Gene Ontology: Mol. function=nucleic acid binding; Cellular component= signal recognition particle, endoplasmic reticulum targeting; Biological process=SRP-dependent cotranslational protein targeting to membrane
MDEEKCWNMVVLMLDSKPMSYFSEKLSGITLNYPTYDKELYVLFLKTQGKLGKRHAKSLEFTKMFPYLIKYKNGKENVVVVTHCLEDPLVPHYFFAFRYHNKIPTGSSKEISSLHSWPSFTPQLQNRKLLLYKWLLLNSTYLVTSLTLPKSSSYLECNIKSSSKTTSLLKMTFLSDGD

SEQ ID NO: 215047 - protein, 67 aa, Glycine max
  Coding DNA Sequence Number=SeqID_98269
MFISIAIKRYRSDDESCEASQAKDGEDEDAGFSPKLERMVAQEDRETKPHQEETKIMNLGVGKEGKR

SEQ ID NO: 215048 - protein, 418 aa, Glycine max
  Coding DNA Sequence Number=SeqID_98270
  Homolog annotation: Hit_ID=Q1SRN1; Match level="QueryCoverage=21%, HitCoverage=5%, E-value=2e-25, Identity=57%"; Hit description =Integrase, catalytic region
  Subcellular localization annotation: CTP_CleavageSite=18; ConfidenceScore=5.10e-01
MASATNNSNPSNPPPPINSGRRGGRGDGGCNGGRNNYGRGDGRGRGRFANIQCQVCHKFGHEASFCYCHYEENHDPTQPMIYANTETTPPTQQASTQQSVIQQPSTQQAVTQKVPSVQQYMPVMAPFPYYYSQMPYVQTYFNFTSQSLLLIPLCSNSSSESVNSSSNNTTVGNSAFLPLVMLCHLPLGMLDWVILVCPHQFEQFKAMVNTRFNFPIKAVQSDWGGDQNFPTQPYFLQKTSTPIPSQPTPTPLTVLPIIPATVVPQPSPLSTASIQQPHSPYQPSPEPSFSSHDTSISVPQQQSPPPEPITSSLPVNTSPPLPNLLRIVKPRLNPTLLLTHAEPKYVKSAISNPTWYAAMKSEYDALISNGTWTLVELPSQQVAISSKWVCRIKQNPDGSINKYKARLIAKRVSSKAWT

SEQ ID NO: 215049 - protein, 878 aa, Glycine max
  Coding DNA Sequence Number=SeqID_98271
  Gene Ontology: Cellular component=membrane
  Homolog annotation: Hit_ID=Q10R19; Match level="QueryCoverage=62%, HitCoverage=90%, E-value=0.0, Identity=60%"; Hit description =Exostosin family protein, putative, expressed
  Pfam annotation: Domain name=EGF_2; Domain location=397-423; Score =25.0; E_value=0.00026; Accession=PF07974.3; Description=EGF-like domain
  Pfam annotation: Domain name=Exostosin; Domain location=470-851; Score=115.9; E_value=1.2e-31; Accession=PF03016.6; Description =Exostosin family
  Pfam module annotation: Pfam domain module=EGF_2::Exostosin; Domain location=397-423::470-851
MGFCVLEIQIRERWDMALVIVRNSDSDFTVAISGYDVKIAWCSWSLAATIASVVALVSVVHLFLFPLTPTFNYFKIAQDSCFPTNASAEFPSNRDQEWPAVDFKRQFPADLHGAFVYQGAPWKAEIGQWLAGCDSVIKEVNITESSMSFRVAGCTTLLVGTTQPLLVSGCPSCGVLSLVNRFAILSSTWYEYGCVYQSYSRGKCNCCNVYLIDKFNLVQQPQLSELEYSLEKSIGSPESSVILLQNSDDCLYSSDYLPIDLRKEKGDGCTEKLQLQCNFLGSPDQPFGRWVVSICPANCDKTRAMCFCGEGTKYPNRPLAETCGFQFNPPSEPDGPRIVNWTKIDQDVFTTNRSIPGWCNVDPAEAYAGKAKIKEECDCKYDGLAGRLCEVPVESVCINQCSGHGHCRGGFCQCDNGWYGVDCSMPSVISSIKEWPSWLRPARIDIADDTHANEKMINLNAVVAKKRPLVYVYDLPPEFNSLLLEGRHFKLECVNRIYDGNNITVWTDQLYGAQIALYESLLASPHRTLNGEEADFFFVPVLDSCIITRADDAPHLSMQQMLRLCYVTPGGESTPWLWVPKLLRKALGVGEQIRKGENRIWRERHIFTLLNNILIGIAHQEGTTSGQSFSWDEGACYAPKEIWNSMMLVHWGNTNTKHNHSTTAYWADNWDKISSDKRGTHPCFDPDKDLVLPAWKVPDANVLTSKLWAWSHEKRKTLFYFNGNLGPAYPHGRPEDTMGIRQKLAEEFGSSPNKDGKLGKQHAKDVIVTPERSENYHLDLASSVFCGVFPGDGWSGRMEDSILQGCIPVVIQNVFITFSLTKNKSSSICLVLECSTGLWARATVLILSQKTMGVVCLTCNSDSKDTRLGPKKIAASEA

SEQ ID NO: 215050 - protein, 159 aa, Glycine max
  Coding DNA Sequence Number=SeqID_98272
MHARARVMSEIEEVQEQMKANMEAMKEQMAPMMEAMMSMKKMMEANAATIVATSTATEMDPPHPSGLNQVNPPVSDIVRQGGEALGSMGDPHLMQDQNKPSFPPYGLPPNYTPPNVAHIPDENADNSAPIPTKSQQPQSNHAHVSQPMEGHMKHPETIL

SEQ ID NO: 215051 - protein, 309 aa, Glycine max
  Coding DNA Sequence Number=SeqID_98273
  Gene Ontology: Mol. function=transcription factor activity; Cellular component=nucleus; Biological process=regulation of transcription, DNA-dependent
  Homolog annotation: Hit_ID=Q1SHW5; Match level="QueryCoverage=99%, HitCoverage=100%, E-value=5e-82, Identity=57%"; Hit description =Pathogenesis-related transcriptional factor and ERF
  Pfam annotation: Domain name=AP2; Domain location=27-91; Score=126.3; E_value=8.8e-35; Accession=PF00847.10; Description=AP2 domain
MEGCKMFPPKPWKKGPTRGKGGPQNSSCEYRGVRQRTWGKWVAEIREPKKRTRLWLGSFATAEEAALAYDEAARRLYGPDAYLNLPHMMMQPTIFTNSTATKSHKYFKWFPSKNFISMFPSRGGLLNLNAQPSVHVIHQKLQELKQNGVVATSQTQSSPHTSSLSTHPKVVDLENFDIQNHAEILPPLQEGNSRVSSQKTIVGDFEEKPQIDLLEFLQQMGILKEEREEEKTNSSGSSTTVSEAASRDESSEQAGVFSDMSSVNWEELIEMHEHDHGVADSFYRASEEIQFEAYDINEDLTFSPSIWNY

SEQ ID NO: 215052 - protein, 106 aa, Glycine max
  Coding DNA Sequence Number=SeqID_98274
  Homolog annotation: Hit_ID=Q1SYR3; Match level="QueryCoverage=50%, HitCoverage=2%, E-value=2e-07, Identity=50%"; Hit description=RNase H, putative
MVEREKLDHIEERLRAIEGGGDYAFANMAELCLVPDVVIHPKFKVSDFDKYNGTTCPQESPEDGSGSSSSTSNDGEGDDNNEGRHPGANGENKEEGGTHVVTGIPT

SEQ ID NO: 215053 - protein, 227 aa, Glycine max
  Coding DNA Sequence Number=SeqID_98275
MALRKLPTKRSRRTPPERAPTLPCKLTWTSTSTERQVQLRDDEFIDFQGKIARRHWAPLVTPMAKFDPRIIMEFYANAWPTKEGWIPLDADALSQFLGHPLILAEDQQCEYSQRRRQVSGFDEEAIAQLLCIPGQDFARTATGRRLISDAIYQFESIAPTRHLMDPEKSNRALGFPALITGLCQSYEVPITPSKVIQPPINRAFMEKYCIHKQAAVAGGGPTASYRG

SEQ ID NO: 215054 - protein, 82 aa, Glycine max
  Coding DNA Sequence Number=SeqID_98276
  Gene Ontology: Mol. function=DNA binding; Biological process=DNA integration
  Homolog annotation: Hit_ID=Q0ZCD2; Match level="QueryCoverage=78%, HitCoverage=13%, E-value=4e-13, Identity=43%"; Hit description =Integrase
MQEWPLLTGMRCPTTHFLLEGIDFMGLFHVSFGYSYILLVVDYVSKFGVPKAIINDQGRHFCNKTMPDLLQKYGVIHRFATT

SEQ ID NO: 215055 - protein, 200 aa, Glycine max
  Coding DNA Sequence Number=SeqID_98277
  Homolog annotation: Hit_ID=Q64EX4; Match level="QueryCoverage=98%, HitCoverage=56%, E-value=3e-45, Identity=45%"; Hit description=MtN19- like protein
  Pfam annotation: Domain name=SURNod19; Domain location=2-200; Score= -83.0; E_value=6.8e-09; Accession=PF07712.3; Description=Stress up -regulated Nod 19
MDIRRNGCSTSWSLIHVVHKIRKLALNDNLQCKQIEGFQGSKRMVSLRYKISWVDWNIYQIPVKVYTPDSTDRVRSNGSKIIHDCQAKYTIPATAGGGDSPHVQKANIPMEKGGFISFMALFICIQDGRTLCTSTPKYGTGKEVGNEKGYVIGMFVCYPQPGSIKIHDGEILTLESKYKNEFHTGAMRHFYIYLAEELPQ

SEQ ID NO: 215056 - protein, 37 aa, Glycine max
  Coding DNA Sequence Number=SeqID_98278
MVEVIIGYQGWGCLKGNSMIYLNGKKNASEAGWGVLQ

SEQ ID NO: 215057 - protein, 56 aa, Glycine max
  Coding DNA Sequence Number=SeqID_98279
MSQVLKVYQKLWEGGNLTSSPSRRVVSESEIETNTDNESESETENEECKCRGSESE

SEQ ID NO: 215058 - protein, 37 aa, Glycine max
  Coding DNA Sequence Number=SeqID_98280
MGSEESSERSAARGMAEARIEVNWESSGMVERRMLLM

SEQ ID NO: 215059 - protein, 263 aa, Glycine max
  Coding DNA Sequence Number=SeqID_98281
  Gene Ontology: Mol. function=drug transporter activity; Cellular component=membrane; Biological process=multidrug transport
  Homolog annotation: Hit_ID=Q8S6Q1; Match level="QueryCoverage=66%, HitCoverage=33%, E-value=6e-29, Identity=44%"; Hit description =Putative membrane protein
MVLTSTGVSDQQRWAEEQIPLREVAVLRNDAPFDVIFWHKVPFIACTAVVIDIEFIIIEGIISSYAFRNAFSSDELGLEILNIALPTTLALAADPIASLIDTAFIGHIGPVELAAVGVSIAIFNQISKITIIPLVSVTTSLVAEEDAADEQNQQSEKEMLMKVSNEDVKLDVHDHIEKAGNPSSANVGRVAKLKHDKSYIPSASSGVVIGGVLGVLQALFLIFTAKPMLSYMGVDSVSTFLANHEMNVNFKYEISSMIHITWA

SEQ ID NO: 215060 - protein, 187 aa, Glycine max
  Coding DNA Sequence Number=SeqID_98282
  Gene Ontology: Mol. function=drug transporter activity; Cellular component=membrane; Biological process=multidrug transport
  Homolog annotation: Hit_ID=Q1SCN3; Match level="QueryCoverage=99%, HitCoverage=80%, E-value=2e-45, Identity=55%"; Hit description=MatE, putative
  Pfam annotation: Domain name=MatE; Domain location=1-134; Score=28.8; E_value=1.9e-05; Accession=PF01554.9; Description=MatE
MAAFQICLQIWMATSLLADGLAVAGQAIIASAFARNDYKRVIASASRVLQLGLILGLVLSVLLLSLLPFASRLFTNDNNVLQLISIGIPYVAATQPINALAFVFDGVNYGASDFTYSAYSMFISPSWHMYFLLLPDYGSIGEHIEFIYAVLKPWLYRYLDCVVDLHDSKDICRLLEDWYWIRALELP

SEQ ID NO: 215061 - protein, 46 aa, Glycine max
  Coding DNA Sequence Number=SeqID_98283
NHDFTLEKSLERKTYRQSESDNGTYTVSESETSSDDIVKDTTVISP

SEQ ID NO: 215062 - protein, 200 aa, Glycine max
  Coding DNA Sequence Number=SeqID_98284
  Subcellular localization annotation: CTP_CleavageSite=38; ConfidenceScore=5.63e-01
MSPFTRDQPANKLSATSPSLPPATSQYGVPPRSDSTITSESFTNVPLIVKSTLGLPIIQLWFNILPSRHAMTIGTKHGSDYMEDPHLYHSIVGALQYGTLTRPEPAPADQPLSSSILVMLTRVVSMIIGNLLLDHGDLYFKNLRSPLTPIIIFCNNNSSLLLSHNSILHTKTKHMELDLFLVREKVLSRNPHVYHIPAQD

SEQ ID NO: 215063 - protein, 57 aa, Glycine max
  Coding DNA Sequence Number=SeqID_98285
MWAFSSLKYMSLKVNESYSNRLLREERLQRITRYRSRLRLLLPPAIEQCRNDTAAGN

SEQ ID NO: 215064 - protein, 194 aa, Glycine max
  Coding DNA Sequence Number=SeqID_98286
MPLDPAAAATTTTSRPISPLPQPQMQQHHHHYPSQQQTLPIRAPNPHFVYPFAPKGVRAADQGPFPPPSMMHGGVPLDYFSHALHVARPPTHVPFSHAAAAAPAASPPVKKSAARSAVAHVNGGKDTNTREKSREDTYIVVRDRKSSFTLGHMRKKGFVRGGFIKIMNKGEVLLSSKPQKCCSGPSGRAIGLLY

SEQ ID NO: 215065 - protein, 34 aa, Glycine max
  Coding DNA Sequence Number=SeqID_98287
MDEMNEGMLHLLFVIGKVMGSKVSMRALAECCID

SEQ ID NO: 215066 - protein, 384 aa, Glycine max
  Coding DNA Sequence Number=SeqID_98288
  Homolog annotation: Hit_ID=Q7XIR7; Match level="QueryCoverage=62%, HitCoverage=75%, E-value=1e-41, Identity=42%"; Hit description =Myosin-like protein
  Pfam annotation: Domain name=DUF827; Domain location=179-316; Score= -116.1; E_value=0.087; Accession=PF05701.2; Description=Plant protein of unknown function (DUF827)
  Pfam annotation: Domain name=Linker_histone; Domain location=2-69; Score=21.8; E_value=6e-05; Accession=PF00538.9; Description=linker histone H1 and H5 family
  Pfam module annotation: Pfam domain module=DUF827::Linker_histone; Domain location=179-316::2-69
EAHGVREVAEAIASLEEIIGSSQYAKTKFIKGKHKELPPTYTKLVLIRLNKTVAASKLIKVKNSFKLAPIKPAPKPRTTPSSAARGGNIAAAPRSAVRPAGPPPPPSSSSSSGPRPAPPPPPSRRLPRLAARAGPNARRRLAAQHQDIQGLLGDNQRLAATHVALKQELEAARHELQRVAHFRESLRADTEARMRELYDKAAQLEAELRGAEAARTELLQVRSDVKELTAVRQDLSGQVQAMTQDLARMTADAKRVPALRADVEAMKQELQCARAAIEYEKKGFAENYEHGQVMEKKLVAMAREMEKLRAEIANAEKRARAAAAAGNPGQGYNANYGTADVGYAGNPYPGIYGMNPPGVENFPQYGPGPAAWGAYDMQRVQGHR

SEQ ID NO: 215067 - protein, 338 aa, Glycine max
  Coding DNA Sequence Number=SeqID_98289
  Gene Ontology: Mol. function=transcription factor activity; Cellular component=nucleus; Biological process=regulation of transcription, DNA-dependent
  Homolog annotation: Hit_ID=Q9CA27; Match level="QueryCoverage=46%, HitCoverage=46%, E-value=6e-24, Identity=41%"; Hit description =Putative AP2 domain transcription factor; 68130-67156
  Pfam annotation: Domain name=AP2; Domain location=98-153; Score=56.7; E_value=7.9e-14; Accession=PF00847.10; Description=AP2 domain
MAESQKQPASRPKQKLHSMQEPKAMRKLHIICNDPDATDSSEDELERIQNPRRVKRSACEIPLPHTFTTPEMRVSTKDQPQSKKRALTHTPSARRNTSRKYRGVRQRKWGKWAAEIYNPFQSTRIWIGTFSTAEEASQAYEARRLEFEAMAKAQAYKTGSRSAAEPLATTSEKSNCRNSSSAAAAVDVSVSEKVSTTSDDSDKSVLSHNSPLSVLELDTPASKFIEMGNVSTDEAIEANNLVDELAELEIPDLNLLNLPPPPSAAVPSEIEPNFGLDFDWLSFDDYGQGFDDFGGLEDIHICGFDDNEPSELPDFDFGDFGADEFSGWTEDPLNIHYA

SEQ ID NO: 215068 - protein, 420 aa, Glycine max
  Coding DNA Sequence Number=SeqID_98290
  Gene Ontology: Mol. function=hydrolase activity, acting on glycosyl bonds; Cellular component=cellular_component; Biological process =carbohydrate metabolic process
  Homolog annotation: Hit_ID=UPI0000048272; Match level="QueryCoverage =89%, HitCoverage=92%, E-value=1e-94, Identity=46%"; Hit description =polygalacturonase
  Pfam annotation: Domain name=Glyco_hydro_28; Domain location=67-410; Score=361.6; E_value=1.2e-105; Accession=PF00295.8; Description =Glycosyl hydrolases family 28
MCVRIILLSSEKEDNLLSQNKKEDNLQKENRKKDAHIKLFNVAEYGAIADGKEDNSVAFLKAWSDACKWNGSATVLIPKGTYMLKSVIFKGPCNDSITFQIKGVLKAPIDPSLLTDQKWINFRYIDQLNVNGGGTLDGQGSATRRKCKNNANCEILFTTMDFDFITNGHVQNLHSIDSKGGHFIVFGCENMTFTDLTLKSPEHNRNTDGIKIAQTNGINITSVKIGTGDDCVAMISGTKNAWISNVVCGPGHGISVGSLGKNDGETDVEDIVVKNCTFVGTSNGLRIKTWAAPLKKTLNASNFVYEDIVMNSVQNPIVIDQQYCPLHQCDLKEISHVQISNVTYRNIRGSSETDIAVNFNCSKDKPCQKITLDNINLWRYGVRGKGRPLLRNNCFKVEGASYGKQTPPSCIAHRATPLST

SEQ ID NO: 215069 - protein, 474 aa, Glycine max
  Coding DNA Sequence Number=SeqID_98291
  Homolog annotation: Hit_ID=Q1T493; Match level="QueryCoverage=97%, HitCoverage=95%, E-value=9e-41, Identity=25%"; Hit description =Nucleic acid-binding, OB-fold, subgroup
  Pfam annotation: Domain name=DUF223; Domain location=30-129; Score= -8.7; E_value=0.019; Accession=PF02721.5; Description=Domain of unknown function DUF223
  Pfam annotation: Domain name=Rep_fac-A_C; Domain location=254-383; Score=-48.9; E_value=0.0026; Accession=PF08646.1; Description =Replication factor-A C terminal domain
  Pfam module annotation: Pfam domain module=DUF223::Rep_fac-A_C; Domain location=30-129::254-383
MARIPNKIKSIDGSRETLKLAVRITDLWFVGTPNKSEHAEMGDQIHVVCKANQLKSWKAYLKENSTYVMHNFKVVKNDGQFRVCEHQYKLVFIGVTVVRKADLHELPFKEFRFVEFGNVVGGNFVAGLLVDIIGVIDQFLAYLNERGNDGPIIIILTHARIKDAQGSNPASVSNSFKASKLLINEPVLEIQEFRERLLDLGVEVNPVLPPGDQGSSQLSGASQLSLKDAFLSKAEAKTISEINGISEYVVSVMVGTISKIVMDNHSWCYPACVQCHRKIDIEIGPFTWGCGKDNDQPVLRYKVEVMVSQNNDSSKFLLWDRECVELIGQIADEVNRVKIEDGDIDLNASPQALDRLLGYVLAFKVRIQSKFRNVVVLRYSNELDLINVVLDMLADTEACSKIDTSNVDCNNATHPECQSLSVTADHDPVAGFPLTPKKRLSSDEVDDELGSSQISPAQLSSNKLTRHSYKSEFS

SEQ ID NO: 215070 - protein, 1169 aa, Glycine max
  Coding DNA Sequence Number=SeqID_98292
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=92%, HitCoverage=90%, E-value=0.0, Identity=31%"; Hit description=Chromo
  Pfam annotation: Domain name=Chromo; Domain location=1076-1126; Score= 25.8; E_value=0.00015; Accession=PF00385.14; Description='chromo' (CHRromatin Organisation MOdifier
  Pfam annotation: Domain name=rve; Domain location=847-1018; Score =36.4; E_value=9.7e-08; Accession=PF00665.16; Description=Integrase core domain
  Pfam module annotation: Pfam domain module=Chromo::RVT_1::Retrotrans _gag::rve; Domain location=1076-1126::459-644::95-185::847-1018
MVEHGTRRTTTDRLEEAIAALFGRHSNLTNKVEAMCERLSHITAPNPPSTQPSYPPRPPVKLDVPRFDDHDPLGWIFKISQFFDYQGTPEEERITVASIYLDGPALSWFQWMFKNGFITSWSALLQAIEGRFAPSFYDDPCRTLFKLVQRSSVTEYLTEFEKLANRITGLSPSVLLSYFISGLSPEIRREVQAFQPISLPQATSLARLQEDKINDRKKHYPKPSPSFLPSHSSFSLPNNTQPPKPKTPFIQRTQEDMAYRREKGLCYNCDEKWSSSHRTYPSRTPIRNTPDPHPIPLEPDPTFDPTPLQPHISLHAMAGVPAIDTFRLYRFINNTRITILIDNESTHNFIQPHVAKFLNLPVEDIVPLRVMFSYLDKSIDLHADVQTDSSPASANQVKCMISTSSTSGLFHLSLLPMASTETPSHPLHTIPAINELLLKYQSLFHQPLSLPPPRQHDHHINILPAANPVNKDGTWRMCVDYRVLNVITVRERFPLPTIEELLDELGKALWFSKLDLWQGFHQILMAEEDIQKIAFRTHHGHYKYRVMPFGLCNVPSTFQAAMNALLSPFLRKFATVFFDDILIYNATLNDHLPHLECVFSSLLQARHIVSGSGVRPDHAKIQAIVDWATPQSPKDLRAFLGLTGFDRKFMKGYAAIVAPLTKILCKDSFQWAVMTAALVLSVPDFTIPFALETDASSMTMGVVLHQKGHPIMYFSKLFCQRLQHASTYVRELHVIIAAVIQTPEQQFYLAKLLGYDYDIQYKEGTSNIVADSLSPIRSQPEAYPDFSISDDFIIFKGAIWVDSQNPFIPSLLHEYHATPVGGHFGVKKTLHRLQSNFQWPNMLKDFKTFVLSEDLSMDFVTHLPNFRGFTTVLVMVDRFSKGIHFGALPTQFTTFKVASLFMDTVCKLHGFPRSIISDQDPIFINSFWKELFKMSGTMLRMSTAYHPQTDAKWSYNTLQHTCTGLTPYEVIYGKPLPSFPNYLRGSSRNDTVDMVLVTREEIHATLKRKLLKVQEAMKHFADKMRRDVEYKVDQLLPEGSKIHPVFHCSMLRPHHGPLDLQQAPLPPDALNNHPILEPLAILDSRVDSSTQPPTQLVLVQWTGLASKDSTWEKWVDVCSAHHLEDKVIFPVADNVSANSRGRNEDPLPATREERPRRNITRPRHLENYV

SEQ ID NO: 215071 - protein, 104 aa, Glycine max
  Coding DNA Sequence Number=SeqID_98293
  Gene Ontology: Mol. function=hydrolase activity
  Homolog annotation: Hit_ID=O64876; Match level="QueryCoverage=84%, HitCoverage=32%, E-value=2e-12, Identity=47%"; Hit description =Expressed protein
MEKSEGMDVSILCALGKDILLDLLENPILVSASNSLKANSERKFSVSDESSPERSKWVYIFQREYATVDPALVDDVSCPYGFTKNCRNGPLPNVIITRRQQFGD

SEQ ID NO: 215072 - protein, 200 aa, Glycine max
  Coding DNA Sequence Number=SeqID_98294
  Homolog annotation: Hit_ID=Q1S049; Match level="QueryCoverage=91%, HitCoverage=69%, E-value=3e-40, Identity=46%"; Hit description=Zinc finger, LRP1-type
  Pfam annotation: Domain name=DUF702; Domain location=8-127; Score =181.9; E_value=1.6e-51; Accession=PF05142.3; Description=Domain of unknown function (DUF702)
MQRATQQGISSSRGSKCHDCGNQAKKECSYSRCRTCCKNKGFHCQTHIKSTWTPVDNIRRRHIPQNHNPYSGLELKFPGATNSMAIFRCVKVRSMDDAVYEIAYQTSVNIGGHVFNGLLYDQGPDQSYNNNCKGESSTSLVDQQQNNLGFVNINNGSIQSRDSSGASASATMASVGPEETLLTPSPYPFSLASFRSGMPY

SEQ ID NO: 215073 - protein, 255 aa, Glycine max
  Coding DNA Sequence Number=SeqID_98295
  Gene Ontology: Mol. function=zinc ion binding; Cellular component =intracellular; Biological process=regulation of transcription, DNA -dependent
  Homolog annotation: Hit_ID=Q1S9J1; Match level="QueryCoverage=80%, HitCoverage=87%, E-value=2e-55, Identity=52%"; Hit description=Zinc finger, B-box
  Pfam annotation: Domain name=zf-B_box; Domain location=1-47; Score =39.3; E_value=1.3e-08; Accession=PF00643.14; Description=B-box zinc finger
  Pfam annotation: Domain name=zf-B_box; Domain location=53-100; Score =54.7; E_value=3.1e-13; Accession=PF00643.14; Description=B-box zinc finger
  Pfam module annotation: Pfam domain module=zf-B_box::zf-B_box; Domain location=1-47::53-100
MKIQCAVCDKVEASVFCSADEAALCHSCDRTIHHANKLATKHPRFSLHYPTSQDFPLCDICQERRAYLFCQEDRALLCRECDVPIHRANEHTQKHNRFLLTGVKLSGTSLDPAASSTNCTHGSEGRNNARSRMNRPRSSVSNEENASNSSCKVEDNVASDTGSVSTSSISEYLIETIPGYCFEDLLDASFAPNGFCKNQNYDRHRRFRTKIFKLLGRVWIFQAVMFALSPWRILRERLHISFKPKQGVGARAIFL

SEQ ID NO: 215074 - protein, 158 aa, Glycine max
  Coding DNA Sequence Number=SeqID_98296
MTLLSNFCPDDNTNTNTIANNNDNDNMKVDSGDSNTIVTSFPSNQVRTKGKSKGEKKEEREKEKGHRKSFSTIVYGGSGEENVHAGWGAVNHPGHRLSCIAIIYPVSLPNNTYVLHHYCATLRMPSHLVAKPKSRHQPQQQPGQWSWGWCCLDVGKEK

SEQ ID NO: 215075 - protein, 208 aa, Glycine max
  Coding DNA Sequence Number=SeqID_98297
  Gene Ontology: Mol. function=heat shock protein binding; Cellular component=integral to membrane; Biological process=protein folding
  Homolog annotation: Hit_ID=Q1SHY3; Match level="QueryCoverage=92%, HitCoverage=64%, E-value=4e-75, Identity=75%"; Hit description=Heat shock protein DnaJ
  Pfam annotation: Domain name=DnaJ; Domain location=28-101; Score =113.3; E_value=7.2e-31; Accession=PF00226.21; Description=DnaJ domain
MGKKKRSRVSEDEEIESDTNPFDQNEHTLYQVLGVEKTASQQEIKKAYYKLALRLHPDKNPGDEMFAVVIDHLLQEAKAKFQQLQNVIAILGDEEKRAVYDQTGCVDDAELAGDVVQNLKEYFRAMYKKVTEADIEEFEANYRGSDSEKNDLIDLYKKCKGNMNRLFCSMLCSDPKLDSHRFKDIIDEVIAAGKNITISSCPKFHADI

SEQ ID NO: 215076 - protein, 98 aa, Glycine max
  Coding DNA Sequence Number=SeqID_98298
MSCHCRHHRDPMAASSHQALLLLALGAAPPRWRCDEDMTKSKGNDPLEGLGRPMTRARARKAKEILQQVLSILFEYKPKFQGEKSKVVSCTMTQMEED

SEQ ID NO: 215077 - protein, 116 aa, Glycine max
  Coding DNA Sequence Number=SeqID_98299
TLSYTLEGTSFVVQVEGTSTWVVVTENKRGYISCGSVLVEGTSTSVVQREQGRVHPLWMFACKRIFTRLKRNLKDRRPLDPTRVRGHFIKFDENALNTFLKTPVIIEEGESLSAYS

SEQ ID NO: 215078 - protein, 73 aa, Glycine max
  Coding DNA Sequence Number=SeqID_98300
MTRSRSRQSVDTLQQMVADILNMAQIYQGNPCGVYPDLSSLTGSGVIQNFVTYIKRFVPSKDHIKSAQGSYSI

SEQ ID NO: 215079 - protein, 105 aa, Glycine max
  Coding DNA Sequence Number=SeqID_98301
MESSNVKNKSSGKRKMFGEDTRSYFAWNLKMEHVLADICLEIKEIWTIKDRATGLRAENALDADDIMSKETNEEEAIHSVSFDLEGSSSATRKAFAQVRVERKKG

SEQ ID NO: 215080 - protein, 65 aa, Glycine max
  Coding DNA Sequence Number=SeqID_98302
RGARRVLWLRTEETRGGAHAGAQRGEGNEPGASTSPGDASRQAGCVPARTHAALRARCPCWTGSR

SEQ ID NO: 215081 - protein, 436 aa, Glycine max
  Coding DNA Sequence Number=SeqID_98303
  Gene Ontology: Mol. function=transporter activity; Cellular component= integral to membrane; Biological process=transport
  Homolog annotation: Hit_ID=Q48I48; Match level="QueryCoverage=55%, HitCoverage=85%, E-value=1e-88, Identity=65%"; Hit description=ABC transporter, permease protein
  Pfam annotation: Domain name=BPD_transp_1; Domain location=234-436; Score=156.4; E_value=7.7e-44; Accession=PF00528.12; Description =Binding-protein-dependent transport s
LAVWRSRHVLQRHRPPVVAGSGVGAVVDGGHYSVAAGGDAGRVQQGIRDAGAFQGGRAPAHSAAPCVSQRAGHADHRTVSLLRQPAGGRGIDRNGVRLARRRALPDLGAVCRRYAGDPRCHAADRHLFRAVECAGRRLDLFSGSANPMSQYLSEHEPQSEPAVGYRRGRRLTTLTLGTALVAILIVTALLAPWLAPFDPNLQHIELRLLPPSAVHWLGTDGFGRDLLSRVIYGARPTLILVSLILVLTIPIGLLVGIGAGYLGGWVERILMRLTDIFLSLPSLVIALAFVAVMGPGLMNGALALALTSWPAFARQARAETLALRRSDYLAAARMQGINGLRLMVGHILPLCLPSAVVRAALSLGGIILSAAGLGFLGMGVAPPTAEWGSMVAEGSKVIFDQWWVAAAPGGAILFASLAFNLLGDGLRDKMDPRHGH

SEQ ID NO: 215082 - protein, 254 aa, Glycine max
  Coding DNA Sequence Number=SeqID_98304
MTSRKRKSTASRPQAQYDTRRFQSLEAWNRYTDNILDQRILPKRNVKIYHTKFDEFKAELERLNLHKRLANLQEGSIDVAEVKEFYANLYSLEDQSPKQVRVRGHLIRIDADSLNTFLETPVVLEEGETLPTYSRFTRMRIDPQEFVAPLCIPGRGFVLNAEGHPWKLLRKDLTTLAHTWSVLSYYNLTHTSHTSDLSMDRAKLVYSLVTGMDMNIRALISGQISIIAQSNSSRLGFPALVTALCRASGVTSAV

SEQ ID NO: 215083 - protein, 85 aa, Glycine max
  Coding DNA Sequence Number=SeqID_98305
MWYHVSEKPPWGRLGVHNKTHHTMGLSVRVTMFCKNAPTIWDQHRLKGALKPEDPQRPTLQKSPSRSLPPDSGPTPKIILAHRHC

SEQ ID NO: 215084 - protein, 235 aa, Glycine max
  Coding DNA Sequence Number=SeqID_98306
  Homolog annotation: Hit_ID=Q2PYY5; Match level="QueryCoverage=24%, HitCoverage=17%, E-value=2e-12, Identity=62%"; Hit description =Vernalization independence 3-like protein
MMRPNHDSDLFFRHMATKYNTFLVKVLIIVLCIILSTYTPSFTVTSITVSKFNVNTHVELAVKLSNWNMRLRLSYPMKTPTTSFWSPPTPATTSTSSHLPPTPLSTSPPPPPSIASSVSSLSIQTPPSPPSRLLPLKSGKCTLIPRYACILGHQFRQDIDVDISVKQFTEEYVKTRISPEELISGICKTTLKCFIFKELSLVNRGVWVDKNLASQRSLSRKLLKESTRKLLEEAS

SEQ ID NO: 215085 - protein, 166 aa, Glycine max
  Coding DNA Sequence Number=SeqID_98307
  Gene Ontology: Mol. function=chitin binding; Cellular component =extracellular region; Biological process=chitin metabolic process
  Homolog annotation: Hit_ID=UPI0000612705; Match level="QueryCoverage =71%, HitCoverage=91%, E-value=2e-15, Identity=29%"; Hit description =UPI0000612705 related cluster
  Subcellular localization annotation: CTP_CleavageSite=60; ConfidenceScore=5.49e-01
STLEDPTCSPLKARTYSPLKVRACSPLMARTCSPLKARTCSPLKARTCRPLKVRVRGTLMARMCGPLKVWVCDPLMATTCSPLKVSTCCPRMARTCSPLKARASSPLKTRTCSRLKASACRPLKVWVLDNSGIRQLSGESLYEYWERFKKLCASCPHHQISEQLLL

SEQ ID NO: 215086 - protein, 150 aa, Glycine max
  Coding DNA Sequence Number=SeqID_98308
  Gene Ontology: Mol. function=protein dimerization activity; Biological process=electron transport
  Homolog annotation: Hit_ID=Q1S735; Match level="QueryCoverage=83%, HitCoverage=27%, E-value=2e-37, Identity=58%"; Hit description =Probable transposase [imported]-Arabidopsis thaliana-related
  Pfam annotation: Domain name=DUF659; Domain location=1-115; Score= -11.8; E_value=2.1e-06; Accession=PF04937.6; Description=Protein of unknown function (DUF 659)
MKKIIGLQAPIELTSVNLAYYQSMIDAISSMSPGDCFLKLFKEMMLYVGAENVHIVIDNAANYVAAGRLLEKEFPELYWPPCVAYYINLMLQDFGKFEEYVYNLMRQHIGGRDILRPAPTQFATNFIVLQSILVQKDALKAMVTSKDWTS

SEQ ID NO: 215087 - protein, 107 aa, Glycine max
  Coding DNA Sequence Number=SeqID_98309
MATLGFVHTKLQDQDLDASNFVQLRKALMQYFRPSSFVREHTKNKPEEHVSSSLVHGSQMDSNMIKFYDKNPRAQHESYVSALWKLRDQVLSLHKQMPHKHYCAGFV

SEQ ID NO: 215088 - protein, 121 aa, Glycine max
  Coding DNA Sequence Number=SeqID_98310
MPQSDSTHRVPIVDPIIILVVQKFIALKGSYNYLSPSFATCHHRLLLTIVAVELLRELGFLIAVRLSIHWSPTSTQDALMFVMQSYSARALDRRLQEDWAGDAREGPRVFMSLRVDFGPMG

SEQ ID NO: 215089 - protein, 106 aa, Glycine max
  Coding DNA Sequence Number=SeqID_98311
  Gene Ontology: Mol. function=DNA binding; Biological process=DNA integration
  Homolog annotation: Hit_ID=Q1SKC8; Match level="QueryCoverage=98%, HitCoverage=35%, E-value=2e-28, Identity=62%"; Hit description =Integrase, catalytic region
  Subcellular localization annotation: CTP_CleavageSite=55; ConfidenceScore=5.07e-01
MSLASGVGAQSKIKAYHDKKLQKQNFQPGQQVLLFNSRLRLFPDKLKSKWSGPFVIKEVRPHGAIELEDPTGSNLEKKLIVNGQRLKIYKGGQLERLTSIVYLNDP

SEQ ID NO: 215090 - protein, 68 aa, Glycine max
  Coding DNA Sequence Number=SeqID_98312
MGKDTLKRIFQGKVFKCESRDFLPVLYSGGGRDGLNRRIKGTYVGKHVLGLPRKKNPRNLFLLINPNV

SEQ ID NO: 215091 - protein, 216 aa, Glycine max
  Coding DNA Sequence Number=SeqID_98313
  Gene Ontology: Mol. function=nucleic acid binding; Cellular component= cytoplasm; Biological process=positive regulation of cell division
  Homolog annotation: Hit_ID=Q1PFN7; Match level="QueryCoverage=59%, HitCoverage=62%, E-value=5e-22, Identity=45%"; Hit description=RNA -binding protein
  Pfam annotation: Domain name=RRM_2; Domain location=99-212; Score =56.0; E_value=1.2e-13; Accession=PF04059.3; Description=RNA recognition motif 2
MLSQYPLNPNAQSYYSTPNNQVFYDPRFIHHYVPPSNLGVYPPSPFPFPCDQNVKPVQVWARVRGRKLLAENNARAKPLGNRAVPFPNTVQEAKTSSITTVMIRNIPNQFKFEDLQLILDEHCFKQNKSAEDPKAWSKFDFVYLPMDYGKHAIEKKKSNLGYAFVNFTTPAAAFKFYSEFQGFEWDVAKNKKICEINVAQYQNAIFYSNICKRGSS

SEQ ID NO: 215092 - protein, 469 aa, Glycine max
  Coding DNA Sequence Number=SeqID_98314
  Gene Ontology: Mol. function=RNA-directed DNA polymerase activity; Biological process=RNA-dependent DNA replication
AREDRYVSLCPSCSHNPKGEEDEDELEIPSLITNKRLGERLCLWTPSQDRDGWFRDLVKAEGANEKWIRWIQEQEAKECEAMEFGRFFRCVRGGGTLMWYCPIESDEVVALRWNEGSRQSSKSLLTRWDLWMWQLWGRGSLGLVLTWVGKRDIYDHCPIALEVQVVGWKSFVFKEKLKLLKAKIRVWQQEVYGGLFVEISTLVDVMDKSDLRKMQAKKRMLAPKSQVRWTREGDANSGYFHTSLRERSWRNSLVGLQPMEEMPMLDGVVFIQLSFVDCTCLVAPFSPEEIKEDVWNCVGDKSPRPDGYLDQLSHLAFQLFCLDGVVVVNELVDLVKRSKKGCFMFKIDFEMAFRVGADVVIPYSYPYPSFGYRGKPEPKLIPGFDDTWRKWVKAVVCSSRMFVLVNGNPTMMFQDERGLTQGGLVGTISFLDGSGGCADDSIIIGEPCYGNLWDVKSILPGFELVSNLR

SEQ ID NO: 215093 - protein, 123 aa, Glycine max
  Coding DNA Sequence Number=SeqID_98315
MAAFPTIPTCEKMLEYDRKQPLGARWKPLRGIDMADSTKEALDRLYMFGVVWSLYASRRDLRPFEDKHVTICTREGFKVVPHGAPWAYTIDYLPWYYEHSHSYLIPPQEGEAPRSLVCISPQP

SEQ ID NO: 215094 - protein, 88 aa, Glycine max
  Coding DNA Sequence Number=SeqID_98316
MWGTIGFIVRWFVELFMDGTPPSRRTLGLESHKVSMGDVSRGQRSWGDMELEMTKSSIWARGGGGTTDRGLTFSGPIEFDDKGYMVVD

SEQ ID NO: 215095 - protein, 62 aa, Glycine max
  Coding DNA Sequence Number=SeqID_98317
MPLVLWGVVRLVVSSLANVRVLTIGSCVAYLPNGIRVASQTHSIQASLLGTLEDFKSPTREP

SEQ ID NO: 215096 - protein, 83 aa, Glycine max
  Coding DNA Sequence Number=SeqID_98318
MRLHELEQGACATARSGPFSPLPVWAKAFKYGAQFDMRLFISNSITHGLNEFGVQKAHSRRSTCTLKQAFQNEYLASKKAYPE

SEQ ID NO: 215097 - protein, 48 aa, Glycine max
  Coding DNA Sequence Number=SeqID_98319
MAMGPSTHTDVTSEPEDITLKCFKREQGQNTTEPDDAVVFTASAKCFI

SEQ ID NO: 215098 - protein, 339 aa, Glycine max
  Coding DNA Sequence Number=SeqID_98320
  Gene Ontology: Mol. function=phosphatidylinositol phosphate kinase activity; Cellular component=plasma membrane; Biological process =phosphatidylinositol metabolic process
  Homolog annotation: Hit_ID=Q9LLS0; Match level="QueryCoverage=99%, HitCoverage=42%, E-value=1e-165, Identity=82%"; Hit description =Putative phosphatidylinositol 4-phosphate 5-kinase
  Pfam annotation: Domain name=PIP5K; Domain location=122-329; Score =295.8; E_value=8.2e-86; Accession=PF01504.9; Description =Phosphatidylinositol-4-phosphate 5-Kinase
MFYRDGTTSDCEEKEMKRNPCCFSSEVKRPGETVSKGHKNYELMLNLQLGIRYTVGKEASILRELKQGDFDPKEKFWTRFPTEGSKLTPPHQSAEFRWKDYCPVVFRHLRKLFQVDPADYMLAICGNDALRELSSPGKSGSIFYLTQDDRFMIKTVKKSEVKVLIRMLRSYYQHVSRYENSLVTKFYGVHCVKPIGGQKIRFIVMGNLFCSEYPIHRRFDLKGSSHGRTTDKPEEDIDETTTLKDLDLNFVFRVQRNWFHELIKQIERDCEFLEAEKIMDYSLLVGIHFRDDNTCDKMGLSPFLLRTGNRDTYQNEKLMRGYRFLEAELQDRDRVKSGR

SEQ ID NO: 215099 - protein, 117 aa, Glycine max
  Coding DNA Sequence Number=SeqID_98321
MVCLSNLSMQWYIFAMASATWKISIVSQNEKYHPQASKLRFIAPQQRDGNVNLPKYRVHRRKSPKSGPVKSLSQVGKFLDIEAIGEFDQPLTRGTSLTSATDDLSSTGLASLTDELS

SEQ ID NO: 215100 - protein, 68 aa, Glycine max
  Coding DNA Sequence Number=SeqID_98322
MKAIKGGNTVYDDERIDVRPWRGCWGQGRRFQGLFVGDNAIAEAVVLVVNVAVMTRSKEQQSQEPENA

SEQ ID NO: 215101 - protein, 232 aa, Glycine max
  Coding DNA Sequence Number=SeqID_98323
MADSTRSKSNWDRLEEAIAKLASNHIHVTKKLDDLLHRVTTLENTSNPAVSPSSSSSIPAPTTHLINPPKMKLDVPRFDGFDPSGWVFKITQFFEYHSTPESNRLTIAFFYMEGPALVWFQWMMRNHQLTTWASFLQAIKACFVHSQYKDPIGILFKLTQKSAALQPLTLVHADGKLQFCDLMLNQTQFQAKDEKVKAADVALGREAADLAAEARGELGCIKAVDGSDAGFA

SEQ ID NO: 215102 - protein, 68 aa, Glycine max
  Coding DNA Sequence Number=SeqID_98324
  Gene Ontology: Mol. function=nucleoside-triphosphatase activity
  Homolog annotation: Hit_ID=Q1SHI2; Match level="QueryCoverage=97%, HitCoverage=14%, E-value=1e-16, Identity=64%"; Hit description=AAA ATPase
MADEIDWQGKRDLDLFMNTTDDFQHWRFVLFTHPSTFNTITMELDLTSKVKCDLESFLRVKQYYYHLD

SEQ ID NO: 215103 - protein, 62 aa, Glycine max
  Coding DNA Sequence Number=SeqID_98325
MGGVWNCKFYAEFGNRTGSSESLSQAWGSICSHLVKQVKPDVLLGLSAVGGLFSKEVSRLML

SEQ ID NO: 215104 - protein, 60 aa, Glycine max
  Coding DNA Sequence Number=SeqID_98326
MSDSGASYIKMLEIKHQSARQIQTVRTFDSDVRFRCPIQVHNISRCSKLNMKAHSKFKLP

SEQ ID NO: 215105 - protein, 116 aa, Glycine max
  Coding DNA Sequence Number=SeqID_98327
MKKSITIHKYFSFQFFTGEGDDQCIHSTSNEVGALSFAYVNQSTSTLSISFLGGGCEDVVTNIEQEKKCVLLIVYFDNVWDMSNEEMVDEDDVTGDEEVDGEVLTNVEYSWANERA

SEQ ID NO: 215106 - protein, 353 aa, Glycine max
  Coding DNA Sequence Number=SeqID_98328
  Gene Ontology: Mol. function=transferase activity, transferring phosphorus-containing groups; Cellular component=membrane; Biological process=peptidyl-histidine phosphorylation
  Homolog annotation: Hit_ID=Q7CKJ5; Match level="QueryCoverage=98%, HitCoverage=98%, E-value=1e-90, Identity=52%"; Hit description =Sensor protein for basR
  Pfam annotation: Domain name=HAMP; Domain location=63-132; Score =36.0; E_value=1.3e-07; Accession=PF00672.15; Description=HAMP domain
  Pfam annotation: Domain name=HATPase_c; Domain location=242-350; Score=105.5; E_value=1.6e-28; Accession=PF02518.16; Description =Histidine kinase-, DNA gyrase B-, and HSP90-like ATPase
  Pfam annotation: Domain name=HisKA; Domain location=136-196; Score =48.6; E_value=2e-11; Accession=PF00512.15; Description=His Kinase A (phosphoacceptor) domain
  Pfam module annotation: Pfam domain module=HAMP::HATPase_c::HisKA; Domain location=63-132::242-350::136-196
MNSMRQRLLIMLALILLTCQVMSAIWLWHESREQISFLVNETLSAQARNDRVENEIREAIASLLLPSLVMVSLTLLLSFWAINWIIRPFRSLQDSLAHRSADNLTPLPIYSEMDEIVAVTSSINQLFSRLDHTLQQERLFTADAAHELRTPLAGLRLHLELLHQQQVPQSAMLIERIDQLMHTVEQLLMLSRAGQALAGGHYQQLQWQRDIMQPIMPEMAELYAQRQQTLHWPDGDDVPQQGEAVLLRLMLRNLLENASRYSPEGSSVQVKLRQVQQQVWVEVWDQGPGIDADAAEELTQAFRRRDQRYGGSGLGLNIVLRIVQMHRGRLELVNREDSSGLVARCCLPTQLIG

SEQ ID NO: 215107 - protein, 208 aa, Glycine max
  Coding DNA Sequence Number=SeqID_98329
  Gene Ontology: Mol. function=DNA binding; Cellular component=beta -galactosidase complex; Biological process=DNA integration
  Homolog annotation: Hit_ID=Q1SDN3; Match level="QueryCoverage=97%, HitCoverage=19%, E-value=9e-60, Identity=49%"; Hit description =Polynucleotidyl transferase, Ribonuclease H fold
MLGSKPVSTPIDYAVRLHQQSGTPLDDTTASSYRRLIGRLIYLTKTRPDITYAVQHLTYRILRYLKAALGSGIFFPASSTLQLKAFNDSDWVGCVDTRRSITGYSVDLGNSLISWKSKKQATVSRSSSEAEYRALASATCELQWLTHLLNDFGIVYTQPALLLCDNRSALHIVVNPIVHEHIYTKALPPGAFHFLQCKLGMSDIHSPA

SEQ ID NO: 215108 - protein, 80 aa, Glycine max
  Coding DNA Sequence Number=SeqID_98330
  Gene Ontology: Mol. function=protein dimerization activity
  Homolog annotation: Hit_ID=Q1SR56; Match level="QueryCoverage=74%, HitCoverage=27%, E-value=1e-20, Identity=81%"; Hit description=HAT dimerisation
  Pfam annotation: Domain name=hATC; Domain location=1-48; Score=3.7; E_ value=0.013; Accession=PF05699.5; Description=hAT family dimerisation domain
MAADILATPISTMASESTFSARGRVIDEFRSKLNEESVEALICDGDWFRQKYNVKKKSKIFYVPVLLEWNEDTWMMLPQV

SEQ ID NO: 215109 - protein, 364 aa, Glycine max
  Coding DNA Sequence Number=SeqID_98331
  Gene Ontology: Mol. function=nucleic acid binding; Cellular component= membrane; Biological process=DNA integration
  Homolog annotation: Hit_ID=Q1ST43; Match level="QueryCoverage=95%, HitCoverage=25%, E-value=7e-45, Identity=29%"; Hit description =Integrase, catalytic region; Peptidase aspartic, catalytic
  Pfam annotation: Domain name=zf-CCHC; Domain location=217-234; Score =5.0; E_value=0.15; Accession=PF00098.13; Description=Zinc knuckle
  Pfam annotation: Domain name=zf-CCHC; Domain location=268-285; Score =8.6; E_value=0.037; Accession=PF00098.13; Description=Zinc knuckle
  Pfam module annotation: Pfam domain module=zf-CCHC::zf-CCHC; Domain location=217-234::268-285
MNQEQDESLSVHSPYYLHPSENLAIALVLPLLDPTNYNSWSKPVLTALSAKNKVEFVDGSLPRLASNHRLYAAWKRANNMVVSWLVHSVATSIRQSILWMDNAGDMNITDYFTKLRTIWDELESYRPDLVCTCASKCSCDALVEAKKRKDQDRIMEFMHGLNDQYNHVRSNILMMDPLPSINKVFSYMAQQERQLASSNALGNLSLVNVATNTRSSNSCSYCGRDNHTVETCYKKNGFRPNFFFNRGGRGGGRGFGRGGTGGKNTNGKVCTHCGIINHTVDECYKKHGYSPGHKFYKPQGASINNTVKEEEKVSRSETSYHGQDIKITQQQYQALMSLLAANNNSSHGSQVNQIGTNSAHTSTI

SEQ ID NO: 215110 - protein, 91 aa, Glycine max
  Coding DNA Sequence Number=SeqID_98332
MAIGTISDHASPEEENSRRGTMLHCYQVRILVPPHKYHNTPMVGNLGLKFTLARLATSFSWPVYGRAPPTAYDYIPGFNDLPSLDMSMHQR

SEQ ID NO: 215111 - protein, 206 aa, Glycine max
  Coding DNA Sequence Number=SeqID_98333
  Gene Ontology: Mol. function=RNA-directed DNA polymerase activity; Biological process=RNA-dependent DNA replication
MKPGRIKLGATGTRSLLNGLSKVYKIGLTLGLPQRGIDDLKGLKLPPPPIITSCTPLHCRKLNPKCKNAYDSYVGVIQIAVRSMHACKYGGSLKRIYVAKGIKTRRSTCSFPFHYCGRGIKWLDGEVISRNLYRGFKVGTKEVEVNLLQYADDTIFVGKFNVDNVVILKSMMKCFELVSGLKVNFHNTGLEVLEWKMGKWRDSQKF

SEQ ID NO: 215112 - protein, 233 aa, Glycine max
  Coding DNA Sequence Number=SeqID_98334
  Gene Ontology: Mol. function=oxysterol binding; Cellular component =cytoplasm; Biological process=steroid metabolic process
  Homolog annotation: Hit_ID=Q8LN57; Match level="QueryCoverage=96%, HitCoverage=24%, E-value=2e-86, Identity=66%"; Hit description =Putative oxysterol binding protein
MRIQGNQDYSCNLKFKEQSIIDRNPHQVHGIVQDKNGKILSTLLGKWDDSMYYINGDYSGKGKGYESMSDAHLLWKRSKPPKFPTRYNFTRFAITLNELTPGLKEKLPPTDSRLRPDQRHLENGEYDMANSEKLRLEQRQRQLIVDSSLRRKKGLERCYLAQGYQHPNSLSMERLARKMQESGWEPRWFGRDKESGTYRYLGGYWEARKQGNWNSCPDIFGHIPSDHVSDEGQ

SEQ ID NO: 215113 - protein, 239 aa, Glycine max
  Coding DNA Sequence Number=SeqID_98335
  Subcellular localization annotation: CTP_CleavageSite=23; ConfidenceScore=5.20e-01
RISLHQTLGLAGQLSGPCLAKPSMASRKHKSIGSRPTTQYDTRRFHSFGPWNRYMDNVLGRHILPERKVKIYHTKLDKFKAELDRRNFHKRHTNLVDNNIDSALVKEFYANLYSSEDPSPKQVRVRGHLVRIDADNLNTFLETPVILAEGETLPAYSRYCSFPIDYKEIEVALCIPGRGFVLNSEGHPRKILRKDLMTLPQMDMNVGALISGQITSIAQSNSSRLGFPALIIALCKARG

SEQ ID NO: 215114 - protein, 109 aa, Glycine max
  Coding DNA Sequence Number=SeqID_98336
MQPTRLDGINRSPSMIGKRARHYSVEWPGVFPWDGKRSSYVIGIGVNPGVGLEENFLVALEPMPKWALLAGRIRVGAGAWGGSLWMGAGALVCTSAELEESPVRAEKLG

SEQ ID NO: 215115 - protein, 80 aa, Glycine max
  Coding DNA Sequence Number=SeqID_98337
MTPDFMGQDDKGAEDDVSLCLSTGLLAPDCQRVQKTTLVSACYRTLSLTDSEILGYLRMSPDFTEDDVSLRVSTGLLAPD

SEQ ID NO: 215116 - protein, 243 aa, Glycine max
  Coding DNA Sequence Number=SeqID_98338
  Gene Ontology: Mol. function=protein binding; Cellular component =membrane; Biological process=steroid metabolic process
  Homolog annotation: Hit_ID=Q8LN57; Match level="QueryCoverage=97%, HitCoverage=29%, E-value=9e-77, Identity=62%"; Hit description =Putative oxysterol binding protein
MSIFLGKTEKVDLENTVVDESQRQLNDQEASSRLRQEKSSEASASESEDDNERNDAAEEETDEDDSAFFDTRDFLSSSNSFKSNGSDIRASSFSSDDGLYTVESEEDVDPSIKSVGGNYPSVKRRRKLPDPVEKEKGVSLWSMIKDNIGKDLTKVCLPVYFNEPLSSLQKCCEEMEYSYLIDRAYEWGRRGNSLMRILNVAAFAISAYASTEGRICKPFNPLLGETYEADFPDKGIRFFSEKV

SEQ ID NO: 215117 - protein, 88 aa, Glycine max
  Coding DNA Sequence Number=SeqID_98339
MGHVALFVGHQTAATINNNNAISYSAKLEQQHTLKMQIEVSTINVRKKKLSTLEDGTGKGFTAVANLGDIGDGGKVSSMLQWEIQPRR

SEQ ID NO: 215118 - protein, 306 aa, Glycine max
  Coding DNA Sequence Number=SeqID_98340
  Gene Ontology: Biological process=steroid metabolic process
  Homolog annotation: Hit_ID=O80866; Match level="QueryCoverage=69%, HitCoverage=28%, E-value=4e-82, Identity=70%"; Hit description =Putative oxysterol-binding protein
  Pfam annotation: Domain name=PH; Domain location=74-202; Score=70.1; E_value=7.3e-18; Accession=PF00169.19; Description=PH domain
  Subcellular localization annotation: CTP_CleavageSite=59; ConfidenceScore=5.28e-01
MHPFCCVSAVSDNSSPAPFAAPAIAMPPLPGRSDSAPRHAQLHLCLSNGGVSGRASLPPAPAAVDVRINDLVGNGISGILHKWVNYGKGWRPRWFVLQDGVLSYYKIHGPDKIVVNSETEKGSKVIGDESARMISRNRNSNHAVNHRRKPLGEIHLKISTIRESRSDDKRFSVFTGTKRLHLRADTREDRVAWVEALQAVKDMFPRISNSELMAPVDNVAVSTEKLRHRLMEEGVSEAAIQDTEQIMRNEYAALQNQLQLLKQKQVALIDTLRQLEVHLMKSRKLHASQTGYSWWISTTAKKAGHS

SEQ ID NO: 215119 - protein, 548 aa, Glycine max
  Coding DNA Sequence Number=SeqID_98341
  Gene Ontology: Mol. function=protein serine/threonine kinase activity; Biological process=protein amino acid phosphorylation
  Homolog annotation: Hit_ID=Q019E0; Match level="QueryCoverage=35%, HitCoverage=19%, E-value=8e-42, Identity=51%"; Hit description=[T] KOG0578 p21-activated serine/threonine protein kinase
  Pfam annotation: Domain name=Pkinase; Domain location=369-546; Score=- 2.2; E_value=2e-08; Accession=PF00069.15; Description=Protein kinase domain
  Subcellular localization annotation: CTP_CleavageSite=48; ConfidenceScore=5.25e-01
MDENPNPSIPRASSSSSQEFLKQVQAALKRHRPLGTTQSHNVRPKRAMVALRKATNKLEEDPPSISDTCTGEGCKNEPSLLLESLSVGAHNKVQFLTEINNATAQPQATELENISSHMGSLALTDEASIGFNQHEKHQNMQQAESETSLVSEGGKTSMLPKRTIVTQDHLQQFKNFLRQPATQSSVVGLPCPTTTSVHSTSAPMLNSITHSNSCIDSGSHVAAEPYGNLNVNSRPIIQGYVKSPNISLKDTNRMSIDQVASAVQDCNSPIDAELTFKQSDPSKEQQGCMLKDTSISKYTSCHDDLLSKGQESAAVTNIQPQVLTSSSDLKLESSKLEKQEKNTSSKASSGIRKRAYDPELFFKVSGKLYQRLGKIGSGGSSEVHKVISSDCTIYALKKIKLKGRDYATAYGFCQEIEYLNRLKGKNNIIQLIDYEGVINGSFSNKDGRVKDDGYIYMVLEYGEIDLAHMLSQKWRELNGSNQTIDENWLRFYWQQILQAVNTIHEERIVHSDLKPANFLLVKGSLKLIDFGIAKAIMSDTTNIQRDSQ

SEQ ID NO: 215120 - protein, 219 aa, Glycine max
  Coding DNA Sequence Number=SeqID_98342
  Gene Ontology: Mol. function=protein serine/threonine kinase activity; Cellular component=spindle; Biological process=protein amino acid phosphorylation
  Homolog annotation: Hit_ID=Q019E0; Match level="QueryCoverage=58%, HitCoverage=13%, E-value=9e-26, Identity=46%"; Hit description=[T] KOG0578 p21-activated serine/threonine protein kinase
MGPDSLRKIHLKVGTLSYMSPEAFMCNESDASGNIIKCGRPSDIWSLGCILYQMVYGRTPFADYRTFWAKFKVITDPNHEITYEPVSNPWLLDLMKRCLAWHRNERWRIPQLLQHPFLVPPVPCHSSSSQDQTFKLLRLISKTCINDPEASQLCCQLQQLLGNPIKLTTRTLQSLVVSGVQHASVSGVQHASVSVSETHPCLVSNTHPCQCPTRIRVSV

SEQ ID NO: 215121 - protein, 40 aa, Glycine max
  Coding DNA Sequence Number=SeqID_98343
MCKPIDPKPNKVNIKKGETPGNLLALPNTRAPMASARNYK

SEQ ID NO: 215122 - protein, 70 aa, Glycine max
  Coding DNA Sequence Number=SeqID_98344
MESTVPSNWQNLTIEKYDDTTNPDEHLDVYITQVWVDVVSAKKDNDKPSSNKAQDDGRRDRLLDKWPQLS

SEQ ID NO: 215123 - protein, 60 aa, Glycine max
  Coding DNA Sequence Number=SeqID_98345
MSSNNYMRFLDRKLNEFLSGLGIKHRVTSVEHPQTNGQAETANKVILGKLKKQLDGAKGR

SEQ ID NO: 215124 - protein, 349 aa, Glycine max
  Coding DNA Sequence Number=SeqID_98346
MVLVKGSSSRESIGGEFNIHGYNNVVYEVSFDFHSLRSDFSSLIDFSAFKGSSNLLANMAKKVPNAKGEASASTNHAYGHDNGSETCPVTLHMVRLDATPPTEFVFMNREGMNKDFFYMYNFLFCDLRVKVLFDDFIMSMFWILDIASMQLHPNRWAAIQSLNPIWDLEGIMTQADDNMNVFRQAWLNQIVAAGEPSLNPATNQTSGPCDEHWSGSGEHSGHQEDTSWEKRLKQPIIGFQPDVATSLGNISAPNESRLLQPFLLAGPPYPDGNCFEARGSSKADALKDQFLKVEDSLNSALQANMKLVEDNKNLKDQVLRLTNDAKGLETCTLNVEALIRSQDTEISRL

SEQ ID NO: 215125 - protein, 61 aa, Glycine max
  Coding DNA Sequence Number=SeqID_98347
MKNSSFVPGRKCGHARPLPLHGNHGPLPYLYQQLNNGVKDFNEEAGEWKTQNLINQGNHSC

SEQ ID NO: 215126 - protein, 361 aa, Glycine max
  Coding DNA Sequence Number=SeqID_98348
  Gene Ontology: Mol. function=nucleotide binding
  Homolog annotation: Hit_ID=Q8LNP3; Match level="QueryCoverage=90%, HitCoverage=65%, E-value=1e-127, Identity=68%"; Hit description =Growth regulator-related protein
  Pfam annotation: Domain name=DUF246; Domain location=2-307; Score =317.4; E_value=2.6e-92; Accession=PF03138.5; Description=Plant protein family
MERHNYNMTNITNIRVQAWAPVSYYLGVVSPILQKEGVIRIAPFANRLAMSVPPHIQFLRCLTNYKALRFSSSISALGKKLVYQMIEKSSRTDGKYIAVHLRFEEDMVAFSCCVYDGGKAEKLEMDSVREKGWRGKFKRKDRIILPDLNRVDGKCPLTPLEVGMMLRGMGFDNNTSIYLASGKIYHAERYLAPLIKMFPNLYTKESLATSDELAPFMSCNKNHDKVYAPTSRMHVMIKDGYSSQLAALDYTVCLSSEVFVTTQGGNFPHFLMGHRRFLYDGHAKTIIPDKRKLVVLLDDVSISWRAFKDQMEDMLGESDRKGIMPKVLYRSNYLELNVGDGTLITARKIWVHCTNLGSYFQ

SEQ ID NO: 215127 - protein, 171 aa, Glycine max
  Coding DNA Sequence Number=SeqID_98349
MVYDYDALRWFGSVTHLASRGIIGLDIVPEVVEDLVAAVAGAGKRSVANEAGEGPHAHQQPRDVHQRQQEEVSEAPPRHDSGHQPPALGQVLRWPHPPPAPRTSRVPMRRRRRTRRAAAPAPAAAHADGLVCESESETVSASFGFHDEIISLKRERENDLMEVKNDVFYCV

SEQ ID NO: 215128 - protein, 110 aa, Glycine max
  Coding DNA Sequence Number=SeqID_98350
  Homolog annotation: Hit_ID=Q8LNP3; Match level="QueryCoverage=43%, HitCoverage=10%, E-value=4e-17, Identity=85%"; Hit description =Growth regulator-related protein
MSRINLSLKDDNLTMSGTKLFPKEDIGKKRKMSPGLNGFLIVEANGGLNQQRSAICNAVAVAGLLNAILVIPQFEFHNVWKDPSCGCSLQLQADLLLWQLLQPRCFSCIT

SEQ ID NO: 215129 - protein, 66 aa, Glycine max
  Coding DNA Sequence Number=SeqID_98351
MEILRILGTMARADDDYIYKSEKAGISDKKAWNENIYTSMKLGQVKPHFILMDPDKFVPNLGECFG

SEQ ID NO: 215130 - protein, 57 aa, Glycine max
  Coding DNA Sequence Number=SeqID_98352
MDKRSSVTRDDLGRNISRDGDGDNIESCQEVPYIHQLYDVRQMGLWGRAKLGNKTMD

SEQ ID NO: 215131 - protein, 107 aa, Glycine max
  Coding DNA Sequence Number=SeqID_98353
  Gene Ontology: Mol. function=ribonuclease H activity; Biological process=DNA integration
  Pfam annotation: Domain name=rve; Domain location=1-106; Score=0.4; E_ value=0.0055; Accession=PF00665.16; Description=Integrase core domain
MWGIDVIVAIKPKALNGHRFILVAIDYFTKWVEATSYSSITKSVVVRKIIIDNATNLNNKMMKEICEDFKIQHHNSTPYRPKMNGATEVANKNIKKIIQKMIVSYKD

SEQ ID NO: 215132 - protein, 218 aa, Glycine max
  Coding DNA Sequence Number=SeqID_98354
  Pfam annotation: Domain name=DUF1723; Domain location=88-134; Score =11.4; E_value=0.023; Accession=PF08330.1; Description=Protein of unknown function (DUF1723)
LVVPAPNVEVDVFLDDPMAPADVEDTGADIPTDTGAQAAEDEHEGFSGGPSDLSVLTQYADHFACSERPELKLSSHGRKVHSLGRLVPAIEGLVAGTGLSPLITFHLPVGELTITLDDVSSILHLPAVGDLHAFQPLHMDDAVQMLVDLLMVSAEAARAEIGQSDWEVRLGSGCSGAYVRPAKRCLYQQQPIAWRLHHTTTVVESTVDQDYDEDSSRV

SEQ ID NO: 215133 - protein, 149 aa, Glycine max
  Coding DNA Sequence Number=SeqID_98355
MSCFLLDFAIGQGGSVSEGSIEQPIMDSEVPSIVSPPLLRGGAIFHYCQGAYLGYYDPPPSASRGVRRARGGRDVRSSPHVRPSMSVGSLSSTPTITGYELVGVMISHLEGGTWSSTLLLYVQMPWIFFINGVLCYLKMDDSGIEKEEV

SEQ ID NO: 215134 - protein, 109 aa, Glycine max
  Coding DNA Sequence Number=SeqID_98356
MTKRVRITVRMTKLGLCLSSGPPPLDDKRVRITVRMTKLGLCLSSGPPPLDDKRVRITVRMTKLGLCLSSGPPPLDDKRVQITVRYLRVSWVQNDQTWSLLVIGPAASG

SEQ ID NO: 215135 - protein, 111 aa, Glycine max
  Coding DNA Sequence Number=SeqID_98357
MAMLSFWASKPAATIPPMLSLIEKDLQFPFMAQLISESGVRTREERGREVHFSRTFSEWRRGRRGEERYICQMKIARLFPGLGKDRRGHVRIQASRSPAGDIFTVMVLEVT

SEQ ID NO: 215136 - protein, 109 aa, Glycine max
  Coding DNA Sequence Number=SeqID_98358
MPNLMFMLPSLPFRIKLQAPKRKVAILKIVVSLNIKPETNVVQQDVTDNEKGLCDEDHLLGNNFCSTTFGMCMNYEHIVLFSIRYMGSPCFTVLAEAFKVSSTLFSWFD

SEQ ID NO: 215137 - protein, 142 aa, Glycine max
  Coding DNA Sequence Number=SeqID_98359
  Subcellular localization annotation: CTP_CleavageSite=71; ConfidenceScore=5.62e-01
FDQFPSVFPTFSTNKHWWRLRASFLLWKAHPCASPRSPAKGNVATARTCSPLKVRAFSPLKARTFSPLKARASQRSRTLHDNKDDDPKESKNEFKMLKIESRTLQGSRGNLISRIKNQDSRFKLPRIKIKIQDSRFKNQEKN

SEQ ID NO: 215138 - protein, 271 aa, Glycine max
  Coding DNA Sequence Number=SeqID_98360
  Gene Ontology: Mol. function=nucleic acid binding; Cellular component= integral to membrane; Biological process=protein amino acid autophosphorylation
  Homolog annotation: Hit_ID=Q9FNZ2; Match level="QueryCoverage=96%, HitCoverage=60%, E-value=8e-88, Identity=58%"; Hit description=Zfwd1 protein
  Pfam annotation: Domain name=WD40; Domain location=138-174; Score =26.2; E_value=0.00011; Accession=PF00400.22; Description=WD domain, G-beta repeat
  Pfam annotation: Domain name=WD40; Domain location=181-221; Score =9.6; E_value=2.8; Accession=PF00400.22; Description=WD domain, G -beta repeat
  Pfam annotation: Domain name=WD40; Domain location=53-89; Score=7.6; E_value=4.8; Accession=PF00400.22; Description=WD domain, G-beta repeat
  Pfam annotation: Domain name=WD40; Domain location=98-134; Score =36.7; E_value=8.1e-08; Accession=PF00400.22; Description=WD domain, G-beta repeat
  Pfam module annotation: Pfam domain module=WD40::WD40::WD40::WD40; Domain location=138-174::181-221::53-89::98-134
SGSTDGTVRIWDCHTGQCAKVINLGAEVTSLISEGSWIFVGLQNAVKAWNIQTMSEFTLDGPKGRVRAMTVGNNTLFAAAEDGVIFAWRGSSKADSPFELVASLTGHTKAVVCLAVGCKMLYSGSMDQSIKVWDMDTLQCTMTLNDHTDVVPSLICWDQYLLSSSSDRTIKVWACIEAGSLEVIYTHTEENGVVSLFGMPDAEGKPILFSSCRDNSVHMYELPSFSERGRLFAKKDVALIELGPGGLFFTGDESGLLMVWKWLEVPKVASS

SEQ ID NO: 215139 - protein, 108 aa, Glycine max
  Coding DNA Sequence Number=SeqID_98361
MGKQAHRCTETNIIFCTFCRPDPLKSGDMRGYLIVTRTFGQPVANKPVDARRLTSSAAPFVILTRESDDMRGYLMVTRTFGQPVANKPVDARRLTSSAAPFVILTREV

SEQ ID NO: 215140 - protein, 153 aa, Glycine max
  Coding DNA Sequence Number=SeqID_98362
  Gene Ontology: Mol. function=monooxygenase activity; Biological process=electron transport
  Homolog annotation: Hit_ID=Q1T1B4; Match level="QueryCoverage=87%, HitCoverage=34%, E-value=2e-11, Identity=27%"; Hit description =Cytochrome P450
  Subcellular localization annotation: CTP_CleavageSite=51; ConfidenceScore=5.30e-01
ESSRSVFNLAMLAKQGWKSKYFPNMNFLATKVGYNPSFCLKSTRTSRVVLKEGYKWTLGNGSNTYLYPDTRDLLNLIVNDLMKGGNEWNSEIINKMEWSLLRKFEGVLLLSLTLEANSKDLFVMIIWSMWKDRNDLLWNNSSSIPSLIVERAR

SEQ ID NO: 215141 - protein, 132 aa, Glycine max
  Coding DNA Sequence Number=SeqID_98363
MWMQRFTLIYIEQAEVFVFVMKMAISWQQKLSRRITTSRCLKENPVGHLLALEWLEDLHLSHAVVELDCKGFFDFVSSLILHKFPNFSVKFVRRQANAAAHALAKAAANNVSPYFYHTIPHCISYISMNESA

SEQ ID NO: 215142 - protein, 322 aa, Glycine max
  Coding DNA Sequence Number=SeqID_98364
  Homolog annotation: Hit_ID=Q941Y5; Match level="QueryCoverage=59%, HitCoverage=60%, E-value=4e-45, Identity=50%"; Hit description =Putative LRP1
  Pfam annotation: Domain name=DUF702; Domain location=117-282; Score =208.1; E_value=2.1e-59; Accession=PF05142.3; Description=Domain of unknown function (DUF702)
MNMLGLRDLFLIAPTPSQLHHHQQHQHQNQPISAEHHSNLPLPSQASLSVGLGIFPLLTVPHTNDVHAQVQDCANNNTNNTNTNYWNLKMCGPTEVNSTRKGVMNMEDEGSNKQMMESEESGGEFRVCQDCGNRAKRDCSFRRCRTCCKGRGFDCSTHVKSTWVPVSHRRGGSNSGGDHYDDDDGNASKRLRTLGSSKNVAATSHSSTSNATPTKSFDTSSCQQDAGFKQSLPRHVRAPAVFRCHRVSAIGSGEDEIAYMATVHISGHVFKGFLYDHGADTRNDVPSVSELQLGNNGSGKNNNRECSSAIGVPTSAYPASVC

SEQ ID NO: 215143 - protein, 136 aa, Glycine max
  Coding DNA Sequence Number=SeqID_98365
MTCGDKLRSSARSMSDKRAETNIFYAFCHLGAASRVINAQRQIMVILRRLSFRFHKLSDEHAETNYGHHVPFVIRGQSVERGDHVRWHAKTNYGHYVPCRPGSITSKDTQRQIMVILRLVSTGRNEFDSIRMMCRY

SEQ ID NO: 215144 - protein, 68 aa, Glycine max
  Coding DNA Sequence Number=SeqID_98366
MASWDLSSDRSSKVYIKLEDVHDKVVESLENHLSQNEHSVGEIKGSAKSDLESTCCAIKDLISGTLQV

SEQ ID NO: 215145 - protein, 203 aa, Glycine max
  Coding DNA Sequence Number=SeqID_98367
  Homolog annotation: Hit_ID=Q57H85; Match level="QueryCoverage=47%, HitCoverage=91%, E-value=8e-21, Identity=64%"; Hit description=ORF16- lacZ fusion protein
MPHSRGTASDILEEGGDDVKSAWPLWAGPHTCYNGNYNGKQGCKAERIRKDCLSSDCSLQLGNMKLESLVIADQHAAVNMYPGPVHTARHTLGIGFARSIGPMITHDFCVPLVPQRLLVVLLAHTTVGSSDWGEVVTSSERAVKKARRDGAQPAERTEVREHGEHRATTHSLRAAVTADRETSAGCEVKRLSVHGGCPGSQRR

SEQ ID NO: 215146 - protein, 129 aa, Glycine max
  Coding DNA Sequence Number=SeqID_98368
MHALLGSFNSGNWSDSKVLDSAGLSCRAFTRNQGAIILYMHRSPISNLAPLDLEIEATSGRNKAKRRRKLLQVTTVASILEEETHFSDLLSPDSPSSRESKTQLPEVITMAEEHDQRITLEDYSSSSTP

SEQ ID NO: 215147 - protein, 51 aa, Glycine max
  Coding DNA Sequence Number=SeqID_98369
MIAETEPFGSNENGEEEEEGVIEICVPDRGSTHNKKGEVDVRRNDATTRGL

SEQ ID NO: 215148 - protein, 415 aa, Glycine max
  Coding DNA Sequence Number=SeqID_98370
  Gene Ontology: Cellular component=nucleus; Biological process =regulation of transcription, DNA-dependent
  Homolog annotation: Hit_ID=Q9SNQ6; Match level="QueryCoverage=47%, HitCoverage=28%, E-value=4e-20, Identity=30%"; Hit description =Putative early flowering 3
MAEKSQTYNSRKTNLTKFMQDDFINSKNSLRTLDGEDTFITCGSAHRKNSSCSIIQNFKDEDKLSHSNLSCSLKSPNSFRKVNSPGAVDLKSAQYGKNRMEDHTEVSQNGQKPEKVLPHSLDGFDDMTYASLISLVKGKNSKSMNKKHRSLMEEKRSILIDSLKTLQGSNVRTHEELAVFEDQINSRDHHTEKPITSDVHKCAGELEIGRKCFLDNIDMNEDEETYSHSNAVNKANSECTLAMDISPDNVVGAIGEQQVWKKIFVKQVFELHRLIKVQRLIAGSPHVLLEDNLLLNKPPPKTSTTKKFQSDFASQKPSAVVKLDNKSVKVNTVEKTTNSVVGKIPIPCISNTTKGNLALASADSNSNSKQSPSYVYPQPGNQWLVPVMSPFEGLEYKPIIWPCPANAGFMAPING

SEQ ID NO: 215149 - protein, 137 aa, Glycine max
  Coding DNA Sequence Number=SeqID_98371
MEDPEVAKFREQGLKFLPEMEFLFKGFNTRTEETNDNIDDNTDMEVNEPEIDTTTQNTSLISSQLDRTIQTFESSASAQDPTSITACIAKLKDLPGLECGSELFYKATRLMKKRANMITFVALEKPELQLGWIKSDT

SEQ ID NO: 215150 - protein, 101 aa, Glycine max
  Coding DNA Sequence Number=SeqID_98372
  Subcellular localization annotation: CTP_CleavageSite=89; ConfidenceScore=5.64e-01
APQTLYRTTLPMNSYRKVAMPPKATGTSLRGGWNPSRSLKLALTEPNTKTNSSDSPIQLRSSTQKIKKEGSSTQIISVKPESFAQEPPKSETAKQTSTDYA

SEQ ID NO: 215151 - protein, 77 aa, Glycine max
  Coding DNA Sequence Number=SeqID_98373
MLGMDILAYCLELVILFLLDVRHSYAIPCGKYDYGQKRVLPFSALTNRLDYMEMGVGSNLVKLEVVWNTSEEVGNER

SEQ ID NO: 215152 - protein, 239 aa, Glycine max
  Coding DNA Sequence Number=SeqID_98374
MTCGDTFMVIRTICQPEASEPIDTQRLTSSFAPLSSRDDESNDMRRYIMIIRTFCQPEASEPVDTQRLMSSSAPLSSKDGESDDMRRYLMVIRTFCQPEASEPVDTQILTSSSAHLSSKDGEFDDMQRFLMVICTFFQPEASDPTDTLRLTSSYAPLSSRDDESDNIRRYLMVIHTFCKPEASESVDTQRLTSSSAPLSSKDSESDYMWRYLMVIHTFCQIEANEPVDTQRLTSSSAPS

SEQ ID NO: 215153 - protein, 183 aa, Glycine max
  Coding DNA Sequence Number=SeqID_98375
MVKDKGKVDTTKVRAALDEQLGSKEFQRLPTAWEVMEKTKKLKSREWEKYQHRRDEILQRSTEEGTSTQDSPNTATSINDNEIYLNVVGGPNYKGNVYGLGTLSKRFSCSKSALSTSIAPVEDQIEEMRETINKLNVELLAKANKEKTLEEKMLQMMENHDHQSQEMRQQMQQQIHQQNEQMQ

SEQ ID NO: 215154 - protein, 337 aa, Glycine max
  Coding DNA Sequence Number=SeqID_98376
  Gene Ontology: Mol. function=kinase activity; Cellular component =cytoplasm; Biological process=carbohydrate metabolic process
  Homolog annotation: Hit_ID=Q3JCM8; Match level="QueryCoverage=32%, HitCoverage=22%, E-value=1e-33, Identity=62%"; Hit description=4 -alpha-glucanotransferase
  Pfam annotation: Domain name=ROK; Domain location=125-314; Score =147.8; E_value=2.9e-41; Accession=PF00480.10; Description=ROK family
AAWEIPAYEPTAMNGAWYEAPGQALLQAISETFPQLSLVAEDLGIITADVDALRHAFDLPGMKILQFAFGGGEDNPYLPENVEENSVAYTGTHDNDTTLGWYQVAPENKKADASMPDANAAYRLGLDVGGTNLRLGVFLDSNLVEETRFQANYSAICKEFEPAKAWQTILQVTADAIRPLLDKYAGIQAIGIGFPGFIDPQTGVLAQSPNLPGLRNVNLGHDLGQLLGLPVRVENDANAAAYGEFCHLSQPAGGLLYLGLGTGVGAGLVVNHHVWAGQHGYALEAGHIIVVPDGPLCGCGNQGCVEQYASATGISRAYADLAGQTLSAQEIALAAQN

SEQ ID NO: 215155 - protein, 77 aa, Glycine max
  Coding DNA Sequence Number=SeqID_98377
MEERKKFDLIEERMRAIEGISDYPFVDMTELCLVPDIIIAPKFKVSDFDKYKGTTCPKNHLKMYCRKMGHTQEMRNS

SEQ ID NO: 215156 - protein, 83 aa, Glycine max
  Coding DNA Sequence Number=SeqID_98378
MVMQSVKFYNATETRRSKMGDANSNLRIWALLEVSGKFLAYGGSKLARLGELGGNHLPHLVNTWDSGASGTPVMLPYNSHNPK

SEQ ID NO: 215157 - protein, 33 aa, Glycine max
  Coding DNA Sequence Number=SeqID_98379
MGRLAAGEEPAKPKVSRMDLRLAKGRMRLAALN

SEQ ID NO: 215158 - protein, 258 aa, Glycine max
  Coding DNA Sequence Number=SeqID_98380
  Gene Ontology: Mol. function=phosphoric monoester hydrolase activity; Biological process=metabolic process
  Homolog annotation: Hit_ID=Q1SZL0; Match level="QueryCoverage=89%, HitCoverage=66%, E-value=2e-46, Identity=43%"; Hit description =Leucine-rich repeat
  Pfam annotation: Domain name=NAD_binding_4; Domain location=31-256; Score=12.0; E_value=2e-09; Accession=PF07993.2; Description=Male sterility protein
MNKARKNCQGVHRAPNHHQKQTQNLLNKISVEKILRVQPDIKKLYLLLRASNPYLATHRLQNEVIGKDIFRVLRDKWGADFGSFISKKVVAVAGDVSLNNLGIKDENMRSQMFEELNVIVHTAATTNFNEREMNSVSGLLASLAHKFDVVMHVPAIPLVGYDIAIGTNTMGAFHVVNFAKSCHKLGIVLHVSTAYVCGEAEGLIVEEPLHVNGMQKGSTKLDIELEKQLIEEKLKEFKAHNTDKEVITSVMKSFGLAR

SEQ ID NO: 215159 - protein, 234 aa, Glycine max
  Coding DNA Sequence Number=SeqID_98381
  Gene Ontology: Mol. function=zinc ion binding
  Homolog annotation: Hit_ID=Q7F1V5; Match level="QueryCoverage=60%, HitCoverage=8%, E-value=1e-37, Identity=56%"; Hit description =Putative sno protein
MPLSELKSKYRKISSLEKAQSGWEEEYEVSSKQYNIVISMVVPTNTFIWKCMHGPNCKIGNFCTVGRRLQEVNVLGGLILPVWGAVEKALSKQKTNCKTKSVQARLSHRRLRVVRIETTVDTQRIVGLLVPNAAVETVLQGSLSKTSVPHQVSTSKCASYSWYSFVDRSSGNTFFSDLVRSSTMNRSLAKICINNGLELEMKMRDLAIWQVMQFRCLGFNVKSIRDRDVNHQVG

SEQ ID NO: 215160 - protein, 286 aa, Glycine max
  Coding DNA Sequence Number=SeqID_98382
  Subcellular localization annotation: CTP_CleavageSite=33; ConfidenceScore=5.19e-01
MSSSPLSNVEPNSVTNEHSNTVSDLNRYPSELSSTSSSQSHTVFRIKENVDGIVNRFKARLLDVNNAFLNGLLKETIYMQQPQGTLLQFRFVVCKGIYHSGRSDLPFFSEAYSKPFVDSSSAPSALDLRKEDLIRENLHLRKGDLAQGQSVAEVRNCLRARCHRRSCRCLSPPFVPVLVAALRAGARRRRHGVVAVSPTPSAKKTKRKRYFPPAITAMAPPFETRHATAIRWRFFKKPPHLSAMALPWPVFNNTDYYHCDSSLYRSVVGALQYTTVTRPELSIAVN

SEQ ID NO: 215161 - protein, 256 aa, Glycine max
  Coding DNA Sequence Number=SeqID_98383
  Gene Ontology: Mol. function=zinc ion binding; Cellular component =nucleus; Biological process=positive regulation of transcription from RNA polymerase II promoter
  Homolog annotation: Hit_ID=Q7F1V5; Match level="QueryCoverage=87%, HitCoverage=16%, E-value=1e-83, Identity=69%"; Hit description =Putative sno protein
MGYMVRLGLWGDGTSFTDFREFLGALDRGGVGALELVAMDMKARGMYLCRTLSYEGAEFEVIEAPLEDKMMDMYKKAAEFWAELRVELLSASAFLNDKPNSSQLWRLYWASHQRFFRHICMSAKVPAAVRLAKQALVEEKSVVIGLQSTGEARTEEAVTKYGSELDDFVSGPRELLLKFVEENYPLPEKPELLPGEDGVKELQRKRHSATPGVSVKGRVRKVAKWQPPSDAESDEDSESIFPITNIQDRSPLCWVS

SEQ ID NO: 215162 - protein, 43 aa, Glycine max
  Coding DNA Sequence Number=SeqID_98384
MHMTQMQFKGSKSAPTYCHKAKNLVPESGSQPTRTGEAVVDIQ

SEQ ID NO: 215163 - protein, 49 aa, Glycine max
  Coding DNA Sequence Number=SeqID_98385
MEDLITKRNSLSQNNANVITLAQQLLTIILLLAPCCSHSASTNKVRNHH

SEQ ID NO: 215164 - protein, 495 aa, Glycine max
  Coding DNA Sequence Number=SeqID_98386
  Gene Ontology: Mol. function=protein binding; Cellular component =integral to membrane; Biological process=xylan catabolic process
  Homolog annotation: Hit_ID=Q949G7; Match level="QueryCoverage=97%, HitCoverage=85%, E-value=1e-127, Identity=35%"; Hit description =HcrVf3 protein
  Pfam annotation: Domain name=LRR_1; Domain location=117-138; Score =2.9; E_value=81; Accession=PF00560.23; Description=Leucine Rich Repeat
  Pfam annotation: Domain name=LRR_1; Domain location=145-166; Score =11.8; E_value=1.8; Accession=PF00560.23; Description=Leucine Rich Repeat
  Pfam annotation: Domain name=LRR_1; Domain location=169-191; Score =3.7; E_value=58; Accession=PF00560.23; Description=Leucine Rich Repeat
  Pfam annotation: Domain name=LRR_1; Domain location=193-215; Score =10.5; E_value=3.1; Accession=PF00560.23; Description=Leucine Rich Repeat
  Pfam annotation: Domain name=LRR_1; Domain location=217-240; Score =13.3; E_value=0.88; Accession=PF00560.23; Description=Leucine Rich Repeat
  Pfam annotation: Domain name=LRR_1; Domain location=242-264; Score =9.1; E_value=5.6; Accession=PF00560.23; Description=Leucine Rich Repeat
  Pfam annotation: Domain name=LRR_1; Domain location=266-288; Score =13.7; E_value=0.68; Accession=PF00560.23; Description=Leucine Rich Repeat
  Pfam annotation: Domain name=LRR_1; Domain location=338-360; Score =8.2; E_value=8.4; Accession=PF00560.23; Description=Leucine Rich Repeat
  Pfam annotation: Domain name=LRR_1; Domain location=362-384; Score =13.2; E_value=0.94; Accession=PF00560.23; Description=Leucine Rich Repeat
  Pfam annotation: Domain name=LRR_1; Domain location=386-408; Score =15.8; E_value=0.16; Accession=PF00560.23; Description=Leucine Rich Repeat
  Pfam annotation: Domain name=LRR_1; Domain location=410-431; Score =8.5; E_value=7.5; Accession=PF00560.23; Description=Leucine Rich Repeat
  Pfam annotation: Domain name=LRR_1; Domain location=47-70; Score=0.6; E_value=2.2e+02; Accession=PF00560.23; Description=Leucine Rich Repeat
  Pfam annotation: Domain name=LRR_1; Domain location=72-94; Score=8.1; E_value=8.7; Accession=PF00560.23; Description=Leucine Rich Repeat
  Pfam annotation: Domain name=LRR_1; Domain location=96-115; Score =0.7; E_value=2.1e+02; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1; Domain location=117-138::145-166::169-191::193-215::217 -240::242-264::266-288::...
  Pfam module annotation: Domain location=338-360::362-384::386 -408::410-431::47-70::72-94::96-115
MEFVASGNNLTLKVGPNWIPNFQLTYLEVTSWQLGPSFPLWIQSQNQLPYVGLSNTGIFDSIPTQMWEALSQVSYLNLSRNHIHGEIGTTLKNPISIPTIDLSSNHLCGKLPYLSSDVFWLDLSSNSFSESMNDFLCNDQDEPMGLEFLNLASNNLSGEIPDCWMNWTLLVDVNLQSNHFVGNLPQSMGSLAELQSLQIRNNTLSGIFPTSLKKNNQLISLDLGENNLSGTIPTWVGENLLNVKILRLRSNRFGGHIPNEICQMSLLQVLDLAQNNLSGNIPSCFSNLSAMTLKNQSTDPRIYSQGKYIVSYSATESIVSVLLWLKGRGDEYRNILGLVTSIDLSSNKLFGEIPREITYLNGLNFLNMSHNQLIGHIPQGIGNMRSLQSIDFSRNQLFGEIPPSIANLSFLSMLDLSYNHLKGNIPTGTQLQTFDASSFIGNNLCGPPLPINCSSNGKTHSYEGSDGHGVNWFFVSIDSWIYCGILDSDCSFADL

SEQ ID NO: 215165 - protein, 99 aa, Glycine max
  Coding DNA Sequence Number=SeqID_98387
GGVGVETPHSQGLLLHDGALYLKALKPSELVDSGLHKQLEMQFHQFRKDRTFSIRVEFIPDKWLRLSLKEHFSMLVLLLHRDPAIGITDAGGAGCHDAR

SEQ ID NO: 215166 - protein, 253 aa, Glycine max
  Coding DNA Sequence Number=SeqID_98388
  Gene Ontology: Mol. function=transition metal ion binding; Cellular component=nucleus; Biological process=proteolysis
MCRKDIDPLKLDDLKNEAVIILCLLEMYFLPSIFNIMVHLIVHLLREIKCYGLIYLWWMYPVERYMKILKGYTKNLHHLEASIIERYIAEEVIEFCSKYIEKAKPVVLLESQHDERMEVHHEALAKESNPKMTKNRVLKEQNKTFLNQFKDIIFDDNNASETLRKLADGPKRNVITWHGYDINKFSFYPKSQDNKSTLQNSGVSLSAESQHFATVRGDNPRIASMPYFGVIEEIWVLNYDKFTIFVFKCKWVR

SEQ ID NO: 215167 - protein, 269 aa, Glycine max
  Coding DNA Sequence Number=SeqID_98389
  Gene Ontology: Mol. function=helicase activity; Biological process =viral genome replication
  Homolog annotation: Hit_ID=Q1SRJ5; Match level="QueryCoverage=99%, HitCoverage=36%, E-value=1e-78, Identity=47%"; Hit description =Probable helicase [imported]-Arabidopsis thaliana-related
MFITLTCNPNWPEIHRLLNPLNLKAADRPDIISKVFKLKYEQMLMNLTKNHMLGKVIAYEIDQIISAEIPSQQDDPELYSLVKNHMVHGPCGSLNPGSPCMKEGKCSRFYPKMFQPHTVLDADGFPVYRRRNNGNAIEKNGVIIDNMYIVPYNPRLLRKYQAHINIEWCNENTSIKYLFKYINKGYDRVTAVLIDEDNGQTENGGTHNDEIKEYLDCRYICPCESTWRIFGFPIHGKKPAVERLHFHLLGQHSVLYEDHDDIHDVLSKP

SEQ ID NO: 215168 - protein, 131 aa, Glycine max
  Coding DNA Sequence Number=SeqID_98390
  Homolog annotation: Hit_ID=Q47522; Match level="QueryCoverage=36%, HitCoverage=59%, E-value=2e-22, Identity=100%"; Hit description=LacZ protein
MRKEKIPHQAPFAIQAAQLLGRAIGAGLFAITPAGERGMCCKAIKLGNARVFPVTTLSTLEDPLDTLNFTKRCRRCQEFADVPCISPNNLHSLSSPWSFAMWRLPFRHVGNGHTGTATKGPRSCEILTCHY

SEQ ID NO: 215169 - protein, 65 aa, Glycine max
  Coding DNA Sequence Number=SeqID_98391
  Gene Ontology: Mol. function=RNA-directed DNA polymerase activity; Biological process=DNA integration
MKTPRHPTTYLGLDEESAKMDGTQYKAMIGSLLYLIGYKPDILFSVFLSAIFQKEPREVHLTAIK

SEQ ID NO: 215170 - protein, 56 aa, Glycine max
  Coding DNA Sequence Number=SeqID_98392
MSLEGSYQFRFLDVEKVFNMDGWLIVCVNASDFHGWDCLNNEGVCKGHCREMRARV

SEQ ID NO: 215171 - protein, 55 aa, Glycine max
  Coding DNA Sequence Number=SeqID_98393
MAKDIVNEDQVTLVTERLKDLSETDEDDEGLVRVALQKRKVAALEASHPKKAKKA

SEQ ID NO: 215172 - protein, 51 aa, Glycine max
  Coding DNA Sequence Number=SeqID_98394
MRATKANPKIVSPLMTILSRSFESMHYPHNCVHLYLLCISTDSEWYLQGNH

SEQ ID NO: 215173 - protein, 122 aa, Glycine max
  Coding DNA Sequence Number=SeqID_98395
MTSKVLGVKVENWVRNYDSYVTRALYKDNVDKDGDQKIIVYNLMCEKEKIWVNILNKSVLHKASSKTTLFDLHKFVLFQLMKNLPFDLPHTIYINMLRNLEDLGDLDDIYYAALLNKLLWDQ

SEQ ID NO: 215174 - protein, 177 aa, Glycine max
  Coding DNA Sequence Number=SeqID_98396
  Homolog annotation: Hit_ID=Q9M143; Match level="QueryCoverage=42%, HitCoverage=14%, E-value=7e-19, Identity=66%"; Hit description =Putative RING zinc finger protein
MALAKELATLKFLHRRVSDLDIDEEEVLKLATLGNGANSKDTIDTLKRCMVMRNRSYKELMAKCNILGRGKARYSKKLEKAKEKITKLKTREEEQRVLWCQWLQRKQENLPERDDGSEKGGFATRAQPGWLCETLRCGSRTMAMKRVALRDSAWGVRSNGSNEGRFARLSVSNEKSF

SEQ ID NO: 215175 - protein, 525 aa, Glycine max
  Coding DNA Sequence Number=SeqID_98397
  Gene Ontology: Mol. function=transferase activity; Cellular component= membrane
  Homolog annotation: Hit_ID=Q5VQN0; Match level="QueryCoverage=87%, HitCoverage=83%, E-value=1e-180, Identity=68%"; Hit description =Exostosin family protein-like
  Pfam annotation: Domain name=Exostosin; Domain location=106-457; Score=180.1; E_value=5.4e-51; Accession=PF03016.6; Description =Exostosin family
  Subcellular localization annotation: CTP_CleavageSite=62; ConfidenceScore=5.51e-01
MAGKNNQRSNSRIFLFFFLLAFSLLLFLFSLSPLRTPSSPSPTHFHVPIAETSFVASLDHFLAHAQTSLKDHTARDVTKLDDAVFRSETDRLYSDPYYPVSLPLRVYVYDMPPKFTHDLLWLFKNTYRDTSNLTSNGSPVHRLIEQHSIDYWLWADLIAPQSERLLTSVVRVHRQEEADLFYIPFFTTISFFLMEKQQCKALYREALKWITDQPAWKRSGGRDHILPVHHPWSFKSVRRYVKNAIWLLPDMDSTGNWYKPGQVYLEKDLILPYVPNVDLCDAKCLSETNPKRSTLLFFRGRLKRNAFLDRGLILFFPTCGGKIRSKLGAELSGADGVVIEEGTAGEGGKEAAQRGMRKSLFCLSPAGDTPSSARLFDAIVSGCIPVIISDELELPFEGILDYRKICIEKEFFLEKYNEAEVKIAVFISSNDAVKPGWLLKYLKGIRPAHIKEMQQNLAKYSRHFLYSSPALPLGPEDLVWKMMAGKVVNIKLHTRRSQRVVEGSRSQCTCECRPGNITNTASIIS

SEQ ID NO: 215176 - protein, 299 aa, Glycine max
  Coding DNA Sequence Number=SeqID_98398
  Gene Ontology: Mol. function=oxidoreductase activity; Cellular component=cytosol
  Homolog annotation: Hit_ID=Q2A977; Match level="QueryCoverage=93%, HitCoverage=99%, E-value=1e-79, Identity=54%"; Hit description=RNA recognition motif (RRM)-containing protein
  Pfam annotation: Domain name=RRM_1; Domain location=5-72; Score=44.6; E_value=3.4e-10; Accession=PF00076.12; Description=RNA recognition motif. (a.k.a. RRM, R
MAVSVKVSNISSTATEQDLREFLAFPGKIEYIEMQSDKGNSQVAYVTFSNPEGAETAVLLSGAVVCGQSLTIALAPDHALPASAASVFNYHDQATQTSNAESGESGLRKAEDVVTGLLAKGFILGKDALNRAKSFDERHQLTSTATAKVVSLDQKVGFTEKISAGTVIVNDKMKEMDEKFQVSEKTKSAISVAEQSVSSAGSAIMKNRYVLTGATWVTGAYSRVAKAAEEVGQKTKEKVLAQDNQGKTEEGAHVHTSISEPNQPSKTEPQQATTANQPSKPEQQATKDGQPSNSATTKD

SEQ ID NO: 215177 - protein, 330 aa, Glycine max
  Coding DNA Sequence Number=SeqID_98399
  Gene Ontology: Mol. function=kinase activity; Cellular component =intracellular; Biological process=intracellular protein transport
  Homolog annotation: Hit_ID=Q9LFL3; Match level="QueryCoverage=100%, HitCoverage=74%, E-value=1e-108, Identity=63%"; Hit description=TOM (Target of myb1)-like protein
  Pfam annotation: Domain name=GAT; Domain location=253-330; Score= -15.4; E_value=0.027; Accession=PF03127.5; Description=GAT domain
  Pfam annotation: Domain name=VHS; Domain location=44-179; Score=85.1; E_value=2.1e-22; Accession=PF00790.9; Description=VHS domain
  Pfam module annotation: Pfam domain module=GAT::VHS; Domain location =253-330::44-179
MSDNLMGKVNALGERLKIGGAEVGRKMSAGMSSVSFKVKEFFQDSSHAGKLVGEATSEALHEPDWATILHICDLINADQLNTAELVRAIKKRVVAKSPRGQYLALVLLEALVKNCDKAFLEVATERVLDEMVKLIDDPQTILNNRNKALIMIEAWGESTIELRYLPVYAETYKSLKSRGIRFPGRDNESLAPIFTPPHSAITPEADVSFADLIQYDIHGQSLTSVTPPRSATTPEADVSLAHLMPQDIHMQSFKSEQIKETFDVARNSIELLSTVLSSTMQQNVLKDELTTTLVQQCRQSQTSVHRIVETAWDNEAVLVEALNVNDEIQK

SEQ ID NO: 215178 - protein, 211 aa, Glycine max
  Coding DNA Sequence Number=SeqID_98400
  Gene Ontology: Mol. function=protein transporter activity; Cellular component=mitochondrial inner membrane; Biological process=protein transport
  Homolog annotation: Hit_ID=Q019D8; Match level="QueryCoverage=60%, HitCoverage=81%, E-value=5e-13, Identity=32%"; Hit description=[U] KOG3225 Mitochondrial import inner membrane translocase
  Pfam annotation: Domain name=Bacteriocin_II; Domain location=110-136; Score=2.4; E_value=0.084; Accession=PF01721.9; Description=Class II bacteriocin
  Pfam annotation: Domain name=Tim17; Domain location=37-173; Score =57.8; E_value=3.6e-14; Accession=PF02466.9; Description =Tim17Tim22Tim23 family
  Pfam module annotation: Pfam domain module=Bacteriocin_II::Tim17; Domain location=110-136::37-173
MADDSAKGIENASLNSTQLENPQIEPIRLPSVEEIRGQDIWNNCAVRSVVSGVMGGGLGIFMGLFLGALDNPLMQEEMTGRQQFIYQAKQMGRRSWSSAKAFAVMGFIFSAAECVVEKARAKHDITNTVVAGCATGGAISAKVGKGLVVEECIIDFQELYALVLMFCLLVADGKDHDLKDDGEENGCKEEYLVLVGVKLDFSLLGNISVGH

SEQ ID NO: 215179 - protein, 74 aa, Glycine max
  Coding DNA Sequence Number=SeqID_98401
MFLVFNSALKGLDDTPQPKSKAGARLIVVKYFNDVRPLEAERLKALRIQWTEYYLKVRNKSQDVRELFHIRLLN

SEQ ID NO: 215180 - protein, 67 aa, Glycine max
  Coding DNA Sequence Number=SeqID_98402
MKAEKWETTATWIYLTVTGKRLKHLLDQRQSSRFKAMSVAARLSLQSHKVRQNLISLSKDAPIITLH

SEQ ID NO: 215181 - protein, 332 aa, Glycine max
  Coding DNA Sequence Number=SeqID_98403
  Gene Ontology: Mol. function=nucleic acid binding
  Homolog annotation: Hit_ID=Q5Z807; Match level="QueryCoverage=89%, HitCoverage=80%, E-value=2e-40, Identity=35%"; Hit description=Zinc finger protein-like
MEKGVDIYMFSNSGNLMLMGLEDRAVLINSKIQIPLDLGLALAHNNSRRPFENKWNRQSSKPQQNGVKSENNPKQSEHHICTDPENCKRQIAVDFEQEKPLWILTCYSHCKGAPCDIVGDISYEELRASAYEDANRGMSLQSIVEKERNILKSKLVEFDKLLSEPYKIPISSSLGSQTPQSIGANANPFSTSQSNGPLSVSSFSQLSTPLNMGFERPSAPLTNTPTKPGFFGSGGNSLASNTANLNSNGVFGVQSGPYSTPLDLKMFPGSTQETSTAFSNSGPTSMFQTTPDVQLLSQSQVEKVSVDPSIWLKEKWNPGEIPEEAPPDTFVR

SEQ ID NO: 215182 - protein, 492 aa, Glycine max
  Coding DNA Sequence Number=SeqID_98404
  Gene Ontology: Mol. function=ribokinase activity; Biological process =D-ribose metabolic process
  Homolog annotation: Hit_ID=Q8L993; Match level="QueryCoverage=98%, HitCoverage=99%, E-value=1e-156, Identity=60%"; Hit description =Carbohydrate kinase-like protein
  Pfam annotation: Domain name=PfkB; Domain location=139-467; Score =45.2; E_value=2.2e-10; Accession=PF00294.14; Description=pfkB family carbohydrate kinase
  Subcellular localization annotation: CTP_CleavageSite=52; ConfidenceScore=5.55e-01
MSLSLLRIFSSPHLSTSLFFPTPTLSSLCPSFLSKLPNAPSPLIVLCHRDASASKQGHLGVPEGAERDSGSEEDDDAVEQPMRASYDDDEDEEEGALSSLVFPERWDVLGLGQAMVDFSGMVDDNFLKNLGLEKGTRKVVNHEERGRVLQAMDGCSYKAAAGGSLSNTLVALARLGSRSEKVPAINVAMTGSVGSDLLGGFYREKLRRANVQFLSAPIKDGTTGTVIVLTTPDAQRTMLAYQDILGILKFLLPLLANTMSSMNSEDANISVLWCQGTSSTVNYDASLANAVSKTNILVVEGYLFELPDTIKTITKACEKARSNGALVAITASDVSCIERHFDDFWEIIGNCVDLVFANGNEARALCNFEAKESAASAARYLSHFVPLVSVTDGPTGSYIGVKGEAVYIPPSPCVPVDTCGAGDAYASGILYGLLRGISDLRSIGSLAAKVAATVVGQQGTRLRISDAVKLAESFEFQLDSSSVGTDHNISSV

SEQ ID NO: 215183 - protein, 289 aa, Glycine max
  Coding DNA Sequence Number=SeqID_98405
MDEIHKVQEQIKADTEALKEKMATIVEAMMSIKEIVEVSAAYQTRARARVMGEVEKVQEQMKADMEAMKEKMAKMMEAIISMKKIKEVDMVAVATTNVVAKVNPMPPSGLNQMNHPTSNMVGKDLGSTDDPMMCKFKMSTPSHHMACLPTIHHPMWHTLSMKISITPLRYSLRTNNLNLIRHISLKPWGRHHHNLADFEPWLGYATEGQVVGGIPFENTLESPQFRPQPQPLHFAVGRAPPAMAEKGKADHLKERLRAIEGGEDYAFANLEKLFLIPKHGHSQVQGAGL

SEQ ID NO: 215184 - protein, 230 aa, Glycine max
  Coding DNA Sequence Number=SeqID_98406
MIQFHEIESFLKGGMNILTAHSQEWEQELSSNYQYEEERTPNLEKLLNRKLSRGTKVTTFLSKCSKRGSNMDKLLMQFMETTKSTQQALQSVEIQVGELAEAVTQFMSRREKSFVEAEAQEKSPIKEHESREKDEEKDDEQTQQQWEKYSTVENQQGNILQSNNLPHQLIDKKGRQGEHEETLSAILSLITNTFLEMIWNVLPDYMKFMEFLAKRRNFKEDVFFVTFMPP

SEQ ID NO: 215185 - protein, 389 aa, Glycine max
  Coding DNA Sequence Number=SeqID_98407
  Gene Ontology: Mol. function=binding; Cellular component=anaphase -promoting complex; Biological process=regulation of mitotic metaphase/anaphase transition
  Homolog annotation: Hit_ID=Q9STS3; Match level="QueryCoverage=97%, HitCoverage=66%, E-value=1e-168, Identity=74%"; Hit description=Cell division cycle protein 23 homolog
  Pfam annotation: Domain name=APC8; Domain location=1-143; Score =195.5; E_value=1.2e-55; Accession=PF04049.4; Description=Anaphase promoting complex subunit 8  Cdc23
  Pfam annotation: Domain name=TPR_1; Domain location=321-354; Score =32.7; E_value=1.3e-06; Accession=PF00515.18; Description =Tetratricopeptide repeat
  Pfam annotation: Domain name=TPR_1; Domain location=355-388; Score =18.0; E_value=0.034; Accession=PF00515.18; Description =Tetratricopeptide repeat
  Pfam annotation: Domain name=TPR_2; Domain location=160-193; Score =3.7; E_value=12; Accession=PF07719.7; Description=Tetratricopeptide repeat
  Pfam annotation: Domain name=TPR_2; Domain location=253-286; Score =5.9; E_value=6.7; Accession=PF07719.7; Description=Tetratricopeptide repeat
  Pfam annotation: Domain name=TPR_2; Domain location=321-354; Score =25.9; E_value=0.00014; Accession=PF07719.7; Description =Tetratricopeptide repeat
  Pfam annotation: Domain name=TPR_2; Domain location=355-388; Score =9.2; E_value=2.8; Accession=PF07719.7; Description=Tetratricopeptide repeat
  Pfam module annotation: Pfam domain module=APC8::TPR_1::TPR_1::TPR _2::TPR_2::TPR_2::TPR_2; Domain location=1-143::321-354::355-388::160- 193::253-286::321-354::355-388
MGSLILTRKCGFRAAEQLVGIEADNAKFTPSNTRFHRGSSSIRRKYRTHETAVTPVVGVSYDATPVLEEDELVDGDFYLLAKSYFDCREYKRAAHVLRDQMGRKSVFLRCYALYLAGEKRKDEETIELEGPLGKSDAINHELVSLERELSTLHKNGQADPFCLYLYGLVLKQKGNESLARVVLVESVNSYPWNWNAWTELQSLCKKVDTLNSLNLNSHWMKDFFLASVYQELRMYNDSLSKYEYLLGTFGYSNYIQAQIAKAQYSLREFDQVEAIFEELLKNDPYRVEDMDMYSNVLYAKECSASLSYLAHRVFMTDKYKPESCCIIGNYYSLKGQHEKSVVYFRRALKLDKNYLTAWTLMGHEFVEMKNTPAAVDAYRRAVDIDSPMR

SEQ ID NO: 215186 - protein, 75 aa, Glycine max
  Coding DNA Sequence Number=SeqID_98408
MAPMGSSYCDGVNRVYNAWRKPCLEGAPLHVEGGDGKPIVLRRGVVFEELVDLKDPTKGFGAIKPGDIEFQAVRG

SEQ ID NO: 215187 - protein, 328 aa, Glycine max
  Coding DNA Sequence Number=SeqID_98409
  Gene Ontology: Mol. function=RNA-directed DNA polymerase activity; Cellular component=chromatin; Biological process=chromatin assembly or disassembly
MVQAADLARLQEEKLLDAHSLSRARQPSTLVVPPHGPYPDEEDATLNDPTQLERPPGPLDTTNPTQAQITLHSLSGHLALTSSPTRSLVPPYSSSATLLVLAVPCLTFLDELKKHLIRDPQFIQLRRDISAQPADYLDYSIAQDLIMKGGRIWLPQGFQFIPTLLAEYHLTASSGHMDAAKMVAQLIENFTWQGLRKDVENFVKACVDCQHAKYETKRVVGLLCPLPVPHYPWEDLSLDFITGLPPFRGNTTILVVVDRFSKGIHLGMLPMSHSALTVVILFIDIVRKIHRMPRSLVSDRDPLFPSHFWQVLFRLSGTRLRMTSAYHP

SEQ ID NO: 215188 - protein, 1314 aa, Glycine max
  Coding DNA Sequence Number=SeqID_98410
  Gene Ontology: Mol. function=binding; Cellular component=membrane; Biological process=signal transduction
  Homolog annotation: Hit_ID=Q1SYF4; Match level="QueryCoverage=87%, HitCoverage=88%, E-value=1e-110, Identity=31%"; Hit description =Frigida-like
  Pfam annotation: Domain name=Frigida; Domain location=884-1168; Score= 108.3; E_value=2.2e-29; Accession=PF07899.2; Description=Frigida-like protein
  Pfam annotation: Domain name=M; Domain location=324-344; Score=2.5; E_ value=60; Accession=PF02370.7; Description=M protein repeat
  Pfam annotation: Domain name=M; Domain location=415-435; Score=2.6; E_ value=57; Accession=PF02370.7; Description=M protein repeat
  Pfam annotation: Domain name=M; Domain location=46-66; Score=5.5; E _value=24; Accession=PF02370.7; Description=M protein repeat
  Pfam annotation: Domain name=M; Domain location=597-617; Score=4.9; E_ value=28; Accession=PF02370.7; Description=M protein repeat
  Pfam annotation: Domain name=M; Domain location=681-701; Score=1.2; E_ value=88; Accession=PF02370.7; Description=M protein repeat
  Pfam module annotation: Pfam domain module=Frigida::M::M::M::M::M; Domain location=884-1168::324-344::415-435::46-66::597-617::681-701
MERGSINSEQRLQSLERRIEEKEKQLGSVKRQLGREIDAKEREYDVVRRSVEERNRELEAKTNQLESVQRRISECDRELRLKEEECNWKLDRMHRVITERQELYQKTQRDIQDTDRELAEKDARLCLIVDLIREREQELRAKDAEFHQLYDRVHMMQDDVRTLTNKVAERNEELRTKEEELDVVRRLINEQGSDTVKSMRARINQLLREVRSSREEIVSLNCFMEKRSLEFEKKEKDFEATRNKFEEIVRELQSKDKQYEVTGKELELKEARFKVQLKDFESKEKRFEGQMKDLGFKMKQFEWKEARFEGQVKELKSKEKWVEEQMKDLEFKRKQFEGKQKELELKEAQFEGQVKELKSKEKQFEEQMKVLEFKMKEFVGKQKVFELKEARFEGQVKELESKEKGFEERVMNLESKEKQFEGQAKELESKQKRYEGQVKELQSKQNQFEGLVRAHELKEKQFKGEVWELGSREKQCEGRLKELESNEKLYERKVRELGSREKQYERRVKELESNEKLYERKVRELGCREKQYERRVKELESNEKQCERRLKEVESNEKQYETKVKELVSNEKQYEKRVLELKSNEKRFEIQVKGLESKEKQIEGQTMDLESKKDQYEGQVKELESKEARYKVLHEELESIQKQIAGQMKDLESKKNQFEGLVKEFELKEIQFKKQLKELKQNEKPFEGKVKDSESKQNQSESLRKSFEEEQVSKQKSNDQQQFTDANSSNNSANLFNQQHLTDADNSKNLLLFINLLEKYELMCSQVSNALQTFANPTKLVLDTIKGFYASHSRQELIEYGASISRRICNLLMDELKKSSPVIGIRVKQEAKKLASHWKANLVVGDKDCLEVLDFFKFVATYEIGSSFDAIELQRLLDIISLQYQTLHALGKTEEPPDNQSSPTIDGRNLQFPYIEHTNEFISANMLVDLHPSSDPAKVVLDMIQIPIGSEKKGGEGVIIIDESHIFLLEQLMRISPRVKPHVREEAQKIAFNLEANIRESAENSLTILGFLYLLSIYGLVSHFNKDGLLKLFESAAQHKQAVELFRTLGFVDKIFDFVQNLIMKQQHIVAVRFICAYKLADKIQPVDLLRQHMEKVKSVTKRFVCKKKSIEQKLKARDEEIASLGTVLKCISENNLESQDLVKEINERIVDLEQQKENIVRSASGPSSKVEVQQPEEKTCAGEAVTQLQKAGEKQCDKEAVTVTVHKPEEKKRDTGVLLPINNQWGNISKRPRTAVTHPRFTPSPQYQRVFMPVPGAPQFGLPAAYFVPANSMGVARSGNTGTHYCVFAAKLCIWNSFIGSISNRAYLMVEFA

SEQ ID NO: 215189 - protein, 327 aa, Glycine max
  Coding DNA Sequence Number=SeqID_98411
  Gene Ontology: Mol. function=specific transcriptional repressor activity; Cellular component=mitochondrion; Biological process =negative regulation of proteolysis
  Homolog annotation: Hit_ID=Q45Q23; Match level="QueryCoverage=76%, HitCoverage=86%, E-value=1e-124, Identity=90%"; Hit description=PHB2
  Pfam annotation: Domain name=Band_7; Domain location=36-228; Score =102.2; E_value=1.5e-27; Accession=PF01145.15; Description=SPFH domain  Band 7 family
MNFNNVNVPKVPGGGVAALLKVSIIGGLVVYGAANSLYNVEGGHRAIVFNRVVGVKDKVYPEGTHIMIPLFERPVIYDVRARPHLVESTSGSRDLQMVKIGLRVLTRPVPDQLPTVYRTLGENYNERVLPSIIHETLKAVVAQYNASQLITQRENVSREIRKILTQRASQFNIALDDVSITSLTFGKEFTAAIEAKQVAAQEAERAKFVVEKAEQDKQSAVIRAQGEAKSAQLIGQAIANNPAFITLRKIEAAREIAQTISNSANKLNDVVVEMFFWRGSSNQLQSTPSWYVNDDQDIRKYFAAFHLYDALPAAVLIDDFGDFFDDK

SEQ ID NO: 215190 - protein, 200 aa, Glycine max
  Coding DNA Sequence Number=SeqID_98412
  Gene Ontology: Mol. function=heat shock protein binding; Cellular component=integral to membrane; Biological process=protein folding
  Homolog annotation: Hit_ID=Q6Z899; Match level="QueryCoverage=81%, HitCoverage=89%, E-value=5e-25, Identity=41%"; Hit description=DnaJ protein-like
  Pfam annotation: Domain name=DnaJ; Domain location=11-72; Score=62.5; E_value=1.4e-15; Accession=PF00226.21; Description=DnaJ domain
MAAADNTNPKDYYKVLEVEYDATDENIKLNYRRLALKWHPDKHGGDSAVTAKFQEIIEAYNGKKIPYFCFFLDCRLAYLSIAGKLKIDSVMEITLNFINRSVSGTSCGLFYSLAPQVLSDPAKRLDYDLTGICEIEKYSLQEYLARFKSMILTCNGLGINQTDRWMQLDVDVLKEYDNFGRHSFDVILCNQSQIRTTLNS

SEQ ID NO: 215191 - protein, 122 aa, Glycine max
  Coding DNA Sequence Number=SeqID_98413
  Gene Ontology: Mol. function=binding; Cellular component=anaphase -promoting complex; Biological process=regulation of mitotic metaphase/anaphase transition
  Homolog annotation: Hit_ID=Q9STS3; Match level="QueryCoverage=98%, HitCoverage=20%, E-value=7e-44, Identity=66%"; Hit description=Cell division cycle protein 23 homolog
  Pfam annotation: Domain name=TPR_2; Domain location=20-53; Score =18.7; E_value=0.021; Accession=PF07719.7; Description=Tetratricopepti de repeat
  Pfam annotation: Domain name=TPR_2; Domain location=61-94; Score =13.6; E_value=0.7; Accession=PF07719.7; Description=Tetratricopeptide repeat
  Pfam module annotation: Pfam domain module=TPR_2::TPR_2; Domain location=20-53::61-94
MLDDAIKCYKRAVNCNDREAIALHQLAKLHSELGHTEEAAFYYKKDLERMESEDREEPTMIEALLYLAKYYREQQKFEEADVYCTRLVDYTGPERETAKSLLRGMQLTQSSFPSMDVEHFPP

SEQ ID NO: 215192 - protein, 285 aa, Glycine max
  Coding DNA Sequence Number=SeqID_98414
  Gene Ontology: Mol. function=alcohol dehydrogenase activity; Cellular component=mitochondrion; Biological process=retinoid metabolic process
  Homolog annotation: Hit_ID=Q43169; Match level="QueryCoverage=89%, HitCoverage=71%, E-value=6e-78, Identity=53%"; Hit description =Alcohol dehydrogenase
  Pfam annotation: Domain name=ADH_N; Domain location=47-160; Score =88.9; E_value=1.6e-23; Accession=PF08240.2; Description=Alcohol dehydrogenase GroES-like domain
  Pfam annotation: Domain name=ADH_zinc_N; Domain location=191-285; Score=42.0; E_value=2.1e-09; Accession=PF00107.16; Description=Zinc -binding dehydrogenase
  Pfam module annotation: Pfam domain module=ADH_N::ADH_zinc_N; Domain location=47-160::191-285
MRIYRVLSQELDLQHEDFKGSFIAATICWGIGKPITVEEIQVDPPKATEVRVKMLCASICHTDISSTEGFPHGKFPLALGHEGVGVIESVGDQVKNLKEGDVNCVSEKTNLCLKYPVMWTGLMPDNTSRMSIRGERIYHITSCATWSEYMVSDANYILKVDPTIDRAHASFISCGFSTGFGAAWKEANVESGSTVAVFGLGAVGLGAVIGAKLQGASRIIGIDTNENKREKGEAFGITDFINPGDSDNSASELVKELTGGMGVDYSFECTGVSTVLTESLEATKI

SEQ ID NO: 215193 - protein, 69 aa, Glycine max
  Coding DNA Sequence Number=SeqID_98415
MKLGVTIQFGNPAQDAIEPLMEALEEDYKDGNGMNESQQFIEGVMDLEERINRSETMTKKLKIAKFGPY

SEQ ID NO: 215194 - protein, 72 aa, Glycine max
  Coding DNA Sequence Number=SeqID_98416
  Gene Ontology: Mol. function=chromatin binding; Cellular component =chromatin; Biological process=chromatin assembly or disassembly
  Homolog annotation: Hit_ID=Q1SAV4; Match level="QueryCoverage=98%, HitCoverage=18%, E-value=5e-09, Identity=44%"; Hit description =Integrase, catalytic region
MEQTGLVAYKLRLPEGSRIHFIFHYSLLKPFHGALSGDPQLPLSDTAIDNQPLITLLTIVDSRCLLDSSTPK

SEQ ID NO: 215195 - protein, 59 aa, Glycine max
  Coding DNA Sequence Number=SeqID_98417
  Subcellular localization annotation: CTP_CleavageSite=35; ConfidenceScore=5.02e-01
MKMQASSTHVAESTQVLKVRKVQRFGCKANQLGVLCLARASSDLAREDRALSARSALSG

SEQ ID NO: 215196 - protein, 75 aa, Glycine max
  Coding DNA Sequence Number=SeqID_98418
NPLSEKKQRRVWLTPPLKHVGDNDGVIVRSVVGPRKEAEECAQEPEEHPMDFEHRQSKRYMEYIYSLICSNMEYI

SEQ ID NO: 215197 - protein, 110 aa, Glycine max
  Coding DNA Sequence Number=SeqID_98419
  Subcellular localization annotation: CTP_CleavageSite=32; ConfidenceScore=5.12e-01
MNNITHLSARLLHSSSFPFSSLTITGVRLVVLLNTVVIISWPNLKDEKSTTGKQGLGIKDRPKKVDGCYFQDFADNDSLEQPANDDIIKVEKIIEGVWRIIETEIAQSSY

SEQ ID NO: 215198 - protein, 103 aa, Glycine max
  Coding DNA Sequence Number=SeqID_98420
  Gene Ontology: Mol. function=protein binding; Cellular component =fimbrium; Biological process=cell adhesion
  Homolog annotation: Hit_ID=UPI00005F9DA7; Match level="QueryCoverage =95%, HitCoverage=56%, E-value=9e-30, Identity=65%"; Hit description =COG3539: P pilus assembly protein, pilin FimA
  Pfam annotation: Domain name=Fimbrial; Domain location=28-102; Score=- 21.3; E_value=0.0013; Accession=PF00419.10; Description=Fimbrial protein
MKLNKVLLAASVVMGMSSFAHAADQGHGKVTFHGSIIDAPCSIDTKSIDQKIELGSISNVLLASGGTTTPEPFQILLKDCSLDTAKTVTTTFSGMEGTAAGTL

SEQ ID NO: 215199 - protein, 377 aa, Glycine max
  Coding DNA Sequence Number=SeqID_98421
  Homolog annotation: Hit_ID=Q8TGM5; Match level="QueryCoverage=10%, HitCoverage=61%, E-value=3e-07, Identity=70%"; Hit description =Uncharacterized protein ART3
  Subcellular localization annotation: CTP_CleavageSite=58; ConfidenceScore=5.01e-01
YPEGNFGGNQLLDGSISLSPLYPSQTNDLHVCSHSNPSQKIRVGRRCNPQGDPTNQLPCALRVYSPVDSHTCQTPWSVFQDGPNGEPTGRRQERAGAEARQGRALPSTIAMMTSPRAYQQPGLGPPSQSASVNVPSRSADRLSPFHIRPGHIAGPHPLPSRQFQALFDSLFKVFHLSLAVLVRYRSLASISLGRNYRPIGAAFPNNPTRRQRLVGTWARSATEDASPDYNSDAEGDRFSWWAFPGSLAVTKGILRVAPPDLRSRWERACTQRVVDGSRTDRLARDWSRAWLIHHFITAKSAMNPDFNQPRGGRALGLMASGATCVQRLDGSRDSAIHTKYRISLRSSSMQEPRYPLPRVIDEEAGRTGRRGHPLPPD

SEQ ID NO: 215200 - protein, 52 aa, Glycine max
  Coding DNA Sequence Number=SeqID_98422
MPWAQNSTAHHSAYFGNRTLEAASRATFAEMPRFLMLFSLSLVQQEGSKDKA

SEQ ID NO: 215201 - protein, 81 aa, Glycine max
  Coding DNA Sequence Number=SeqID_98423
HQHDHSYPNVDERCYLATFCPATTTLIPPAKVPAGLCHHDIKCPSPPTRLLVTPINRAFIEKYCTPRQAQVEAPQQPGDDQ

SEQ ID NO: 215202 - protein, 61 aa, Glycine max
  Coding DNA Sequence Number=SeqID_98424
MVDQQATKSKAKAQDVKEALLGGNLELATKKLPAKWSRKGTIEEGSSAAPQADIGFDKHRS

SEQ ID NO: 215203 - protein, 132 aa, Glycine max
  Coding DNA Sequence Number=SeqID_98425
MGQDSWSVVRNHLLKELANFSEDCIKLFGGTERFEELRMSLLVDGLTKVTTDKWMDITDMRHVIASRIELTFFSHTQKVYLKERCPLPPVSLLWSSNCHPQAKSWPNPYISRMQHYKSFVMFKRDYVDINDD

SEQ ID NO: 215204 - protein, 107 aa, Glycine max
  Coding DNA Sequence Number=SeqID_98426
MLCRDDSRGTPSPGPRESHLTDLSSLAHEAPGFVFVARTRRPGRTGRRGHPLPPDGSVDFSQRRGQRTRSRRRNPEHFTGPFQSVGATGGVYKGQGRSQRELMTRAY

SEQ ID NO: 215205 - protein, 208 aa, Glycine max
  Coding DNA Sequence Number=SeqID_98427
  Gene Ontology: Mol. function=structural molecule activity; Cellular component=extracellular region; Biological process=keratinization
  Homolog annotation: Hit_ID=Q28658; Match level="QueryCoverage=83%, HitCoverage=86%, E-value=8e-24, Identity=35%"; Hit description=Small proline-rich protein 3
LHVLAFRGLHTLAFRGLHALAFRGLHVLPYRGLHALTLRGLHVLTFRGLHVLAFRGLHVLPFRGLHALAFRGLHALAFRGLHALAFRGLHVLAFRGLHVLAFRGLHALAFRGLHVLAFRGLRTLAFRGIAHARLQGTARLHALAFSGLHALTFRGLHIRAFRELKFLCHPPDLGGRSTVRAQSEEEETSANPAHQHDHSYADVDDVAT

SEQ ID NO: 215206 - protein, 177 aa, Glycine max
  Coding DNA Sequence Number=SeqID_98428
MPLALMRRLSPSCYAYQGKTSPGPPLGDGDCTYKTPCGPGEVQQGPGVSALITGLCQLNGVPVAPSKVIRSPINRAFIEKHCTPKQAQGQALQQLEEDQHPAADAPTPPQEEVSSLRSMSDRLQRIELQMHRVRTPVLSLGPPPRSSRPQWLGLGTFGGGDEAQEDEDMADMLDFLL

SEQ ID NO: 215207 - protein, 46 aa, Glycine max
  Coding DNA Sequence Number=SeqID_98429
MDEERQRTFMELVTETSRKRYGTKIGEELAAQLAQVSSGRLNEMVA

SEQ ID NO: 215208 - protein, 263 aa, Glycine max
  Coding DNA Sequence Number=SeqID_98430
  Gene Ontology: Mol. function=chitin binding; Cellular component =extracellular region; Biological process=chitin metabolic process
  Homolog annotation: Hit_ID=UPI000044A8F0; Match level="QueryCoverage =97%, HitCoverage=99%, E-value=2e-37, Identity=27%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MLHALTFRGLHVLAIRGLHDLTFRGLHVLAIRGLHALTLRRLHVLDIRGLHALTFRGLHVLAIRGLHALTFRGLDVLSLRGQHALTFRGLHVIAIRGSHVVTFRGLHVLAIRGLDAHTFRGLHVLPIRGLHALTFRGVHVLAIRMLHTLTFRGLHVLAIRGLHDLTFRGLHVLAIRGLHAHTFRGLHVLTIRGHYALTFRGLHVLAIRMLHALTFRGLHVLDIRGLHALTFRGLHVLAIRGSHAFTFRGLDVLTLRGQHTLIF

SEQ ID NO: 215209 - protein, 157 aa, Glycine max
  Coding DNA Sequence Number=SeqID_98431
  Pfam annotation: Domain name=Transposase_21; Domain location=1-118; Score=-46.9; E_value=1.3e-10; Accession=PF02992.5; Description =Transposase family tnp2
MMLSMMISGPRQPGNDIYVYLSLLIEDLTKLWDKGVLVFDGFRKKTFQMRAMIFCTINDFPAYGNLSGYNVKDIFEQVQPIDDEGNLPVGENSSLLQRILDTFDGLQTYVGERFDALELQVDMRFDEMDSRITKVEGDVTYIRTCFDLPPPPPPPSS

SEQ ID NO: 215210 - protein, 68 aa, Glycine max
  Coding DNA Sequence Number=SeqID_98432
MTLVSACYRALGLMDSKSVSTDNHLGISACPLTSRGQCDRNCRAVDKSEALAPTYPQLMMRNSEKRSS

SEQ ID NO: 215211 - protein, 86 aa, Glycine max
  Coding DNA Sequence Number=SeqID_98433
MGAKYLEVVKRGSHPNNGWSPDEIRAQNDHNVSLHVFGDDRAWVARRRMTIICLCVPPDMIASGWRKGVGNDHNLSPPTSRLTAPE

SEQ ID NO: 215212 - protein, 116 aa, Glycine max
  Coding DNA Sequence Number=SeqID_98434
LKAIEEGRDHAFANMVELYLVPDVVIPLKFKVLDFDKYKGTTCPKNHLKLYCQKMGVYMKDEKLLVYFFQESLIGAVVTWYTNLKTSRVHSWRDLMVAFIRKYQYNFDMAPDRMQL

SEQ ID NO: 215213 - protein, 87 aa, Glycine max
  Coding DNA Sequence Number=SeqID_98435
MTEKEMITMIVGTLLVFYYEKMVGYMPSNFADFVFTDKRIEVGLRRGKIDYLALMDEKARENEENEKEGGTHAATDVPTWPNFPPAQ

SEQ ID NO: 215214 - protein, 78 aa, Glycine max
  Coding DNA Sequence Number=SeqID_98436
MMREYRAQLDAERARKLSQGRNHSSSKSKHAKAFFLIPASNETAHSNLQIRGTKFQGSTAAERERCFLISETFMFFQR

SEQ ID NO: 215215 - protein, 327 aa, Glycine max
  Coding DNA Sequence Number=SeqID_98437
  Gene Ontology: Mol. function=siderophore-iron transporter activity; Cellular component=membrane; Biological process=siderophore transport
  Homolog annotation: Hit_ID=UPI00006B3FB4; Match level="QueryCoverage =98%, HitCoverage=46%, E-value=1e-54, Identity=36%"; Hit description =ferrichrome-iron receptor
  Pfam annotation: Domain name=TonB_dep_Rec; Domain location=154-299; Score=23.5; E_value=0.00075; Accession=PF00593.14; Description=TonB dependent receptor
MFDTHQRSVFATGPGSEVYQLIRFAYTTEEDLQSFNNENQVSKTVALGDWAHHLLAGFDYQKLNSQFHYRYATATPGIDMRDPDYSQIHENALGLYTAQKNRLSYQQNGYYLQDQVAFGGLNLLASLRYDDYRSVTTNYLQNGDKAWVSQDRVTKRLGALYAFDNGISPFISYSEGFAPVSPKGTLTAKEVKPTTSKQVEGGVKYLLADYATTLTASVFNIRQKNVVTSDPGFLNYSQTGEVESKGAELSVVSRPTDNLTLIANYAYTHAINTEDDKYQGKRPTQVPENAFNLWGDYTFENTPLKGLMLGAGARYTGSMEISPANDA

SEQ ID NO: 215216 - protein, 112 aa, Glycine max
  Coding DNA Sequence Number=SeqID_98438
MEKVAWPGTQPSLVRKGGGPSAQVPQQVDHASLEATIPEPFVFKEGGTQQLADPPTPVHEMPADPSTPLLEILEDLSTLVLGLTTTPPATPMLHFIDEEGTQDQDTQQDDQS

SEQ ID NO: 215217 - protein, 148 aa, Glycine max
  Coding DNA Sequence Number=SeqID_98439
AHENPRAFTCIFGPIFLESSIREMLGAPSNIADHFLLLFFFQFLLLLRDTASQASSSSPQTSLRVEDAEKNGERGLTVEAFGRPVRSSSETSGNIPEEVFFRKQPNVFRKNTSSGSLPEHLFRKLSGRSSSSESIPEEVFFRKKGSSG

SEQ ID NO: 215218 - protein, 270 aa, Glycine max
  Coding DNA Sequence Number=SeqID_98440
  Gene Ontology: Mol. function=chitin binding; Cellular component =extracellular region; Biological process=chitin metabolic process
  Homolog annotation: Hit_ID=UPI00006A17C9; Match level="QueryCoverage =97%, HitCoverage=100%, E-value=6e-34, Identity=32%"; Hit description= UPI00006A17C9 related cluster
  Subcellular localization annotation: CTP_CleavageSite=99; ConfidenceScore=5.34e-01
RVALLKERTCIPLNMRTCSPLKARACSPLKARTNSPQKLRACSPLKAMTCSPLRAKTCSPLKVRMCSPLKVRACSPLKVRTCSPLKGRTCSSLKGEDVYSSEGEGMKPSEGEGVQPSEGEGVYPLMARANNPLKMRACSPLKARACSPLKARTCSPLNARTCSPLNARTCSTLKATARSPQMTRTSSPLTGRTCSPMKARACSPLKARTYSPLKARAFNPQKSRACHPLKARMCSPLKARACSPLKERTCSPLKVRTCSPLKVRACSPLK

SEQ ID NO: 215219 - protein, 303 aa, Glycine max
  Coding DNA Sequence Number=SeqID_98441
MTFKIIMSLSPFSLLSLLSNIEITNGHIDSQDPIKEFYVLPKGPVPPEGQSNHLHRVLPHPSSNSNSDASNIKFFQIPRRVVNNLTSKGFHVLPKGPVSPEGQSNHLHSAPPHPSSNSNRDASNIKSFQVPRRVFNNHPSKGFHVLPKGPIPPEGQSNHSHHALPHPSSNSNSDASNIKFFQIPRRVVNNLTSKRFHVLPKGPIPPKGQSNHSHSAPPHPSSNSNSDASNIKSFQVPRRVFNNHPSKGFHVLPKGPIPPEGQSNHSHHVLPHPSSNSNSNASNIKFFQILRRVVNNLPSKGFH

SEQ ID NO: 215220 - protein, 176 aa, Glycine max
  Coding DNA Sequence Number=SeqID_98442
VCTFDDLLPCIEKITLLSEEEDRILEAHEDAPPSQPQFEHQQFNILRQSVETRGLARRRETVDAATYSLPPMPERQHGMYYTPPTFTQEPPQMPPMYSYPHDFQLGYSFAGIFGSSPSSTGTPSFTQSGQVSTPNAPLTGLWNVPGDIPDMDDLLGVDLRHDFSAEADQVDEKGES

SEQ ID NO: 215221 - protein, 157 aa, Glycine max
  Coding DNA Sequence Number=SeqID_98443
  Gene Ontology: Mol. function=binding; Cellular component =intracellular; Biological process=protein kinase C activation
  Homolog annotation: Hit_ID=Q9FIF7; Match level="QueryCoverage=65%, HitCoverage=37%, E-value=3e-24, Identity=44%"; Hit description =Arabidopsis thaliana genomic DNA, chromosome 5, P1 clone:MNC17
  Pfam annotation: Domain name=PPR; Domain location=27-61; Score=35.3; E_value=2.1e-07; Accession=PF01535.11; Description=PPR repeat
  Pfam annotation: Domain name=PPR; Domain location=62-96; Score=1.8; E_ value=4.5; Accession=PF01535.11; Description=PPR repeat
  Pfam module annotation: Pfam domain module=PPR::PPR; Domain location =27-61::62-96
MAIMYSRCADIDEAQALFDGVRVKAVSTYNSMIGGLALHRKSIEAVVLFSEMLKERVRRNGITFVGVLNGCSHGGLVDLGGEIFESMEMIRGIEAEEEHYGCMVQILVAVKGIASGLGLEHAIVHEGKKVTNLNEEPIRQSGSSHVMANLHLEDKLL

SEQ ID NO: 215222 - protein, 60 aa, Glycine max
  Coding DNA Sequence Number=SeqID_98444
MQNGVGNAKEWCPRSEGWPISWVMALLSEREKFWGLLNVRSQSRDDDLLTTNLMLAHTRP

SEQ ID NO: 215223 - protein, 71 aa, Glycine max
  Coding DNA Sequence Number=SeqID_98445
  Gene Ontology: Mol. function=transcriptional repressor activity; Biological process=regulation of nitrogen utilization
  Homolog annotation: Hit_ID=Q9SDZ0; Match level="QueryCoverage=81%, HitCoverage=18%, E-value=4e-14, Identity=68%"; Hit description =Isoflavone reductase homolog 2
FCPSEFGNDVDRTHAVEPAKSAFATKAKVRRAIEAEGIPSLMCQATSLLGKIVKTLERIYVPEEQLLKQIE

SEQ ID NO: 215224 - protein, 154 aa, Glycine max
  Coding DNA Sequence Number=SeqID_98446
MDLVKYIFEKPALTGWIARWQCFTRGNPGDLQPFDPEIDRTFHRLVRHGVHPGHSMHFEHSEHSVEGDSEYSDFEHSTTNFHTENMAQPPPRERTLREMAAPDFTYESLCIQYPDEGVPDVLKTGLIHLLPSFMVLQVKILISILRSSILFVPP

SEQ ID NO: 215225 - protein, 165 aa, Glycine max
  Coding DNA Sequence Number=SeqID_98447
  Gene Ontology: Mol. function=RNA-directed DNA polymerase activity; Cellular component=intracellular; Biological process=RNA-dependent DNA replication
  Homolog annotation: Hit_ID=Q1SAS4; Match level="QueryCoverage=94%, HitCoverage=6%, E-value=2e-59, Identity=63%"; Hit description=RNase H, putative
MSPAKEDWEVKPHQEEMKIVNLGVGEERKEVKVGTSMTTHIQDELVDLLRDYQDIFAWSYQDTPDLSPNIVQHRLPLNLECSPIKQKLRRMKPEMSLKIKEEVKKQFDVGFLDVARYPKWVAKIVPVPKKDGKVRMCVDYRDLNQASPKDDFPLSHIDILVDDMA

SEQ ID NO: 215226 - protein, 79 aa, Glycine max
  Coding DNA Sequence Number=SeqID_98448
MNKSELSQTRVIRLNLSVENPLRGTVHEPQANLGATIDTSEPYTGAIRGTVHEPQANLGVDKKFLPGRSKTQKGSLSKY

SEQ ID NO: 215227 - protein, 146 aa, Glycine max
  Coding DNA Sequence Number=SeqID_98449
VKVGVEEVKDAEAIVPVPTDEVILVGQALNTFLAWPIHLVKRVSEQAVVSPAKPPDRPNPEVNDPLYLMTLTIPQLFLKPLQVMWDATVFRVFNPYFPLYIKHEDLSEIAHGGQCLIISVIQLWILHLTETSMRVGNSDVYGFLEP

SEQ ID NO: 215228 - protein, 546 aa, Glycine max
  Coding DNA Sequence Number=SeqID_98450
  Gene Ontology: Mol. function=peroxidase activity; Biological process =glutathione biosynthetic process
  Homolog annotation: Hit_ID=Q0KCF0; Match level="QueryCoverage=80%, HitCoverage=90%, E-value=0.0, Identity=72%"; Hit description =Uncharacterized conserved protein
  Pfam annotation: Domain name=DUF404; Domain location=93-394; Score =610.7; E_value=1.3e-180; Accession=PF04169.4; Description=Domain of unknown function (DUF404)
  Pfam annotation: Domain name=DUF407; Domain location=419-546; Score =217.9; E_value=2.4e-62; Accession=PF04174.4; Description=Domain of unknown function (DUF407)
  Pfam module annotation: Pfam domain module=DUF404::DUF407; Domain location=93-394::419-546
  Subcellular localization annotation: CTP_CleavageSite=27; ConfidenceScore=5.25e-01
MPSRSPTFGPVPPRPPGSGSRPAHAIAASVHPEGSQPPPTRGYLPPGGPPSAPAQAGTRVAYSFRPATHGRTTAAPKPAVSICNGGAMKDRSSRPAAYDEMRDSAGGIRSHYQAFERWHQEQSAEAMAARRLEADLSFRRVGITFSVAGDAAGTERLIPFDMIPRIIPADEWRRLEAGLKQRVRALNMFIHDIYHGHEIVRAGVVPAEQVFLNAQYRPEMQDVDVAEDIYCHIAGVDIVRAGAGEFYVLEDNLRVPSGVSYMLENRKMSMRLMPDAFSRIKVEPVAHYPDLLLDNLREVAPHGGDDPTVVVLTPGMYNSAYFEHAFLAQQMGVELVEGQDLFVEQNTVYMRTTQGPRKVDVIYRRLDDDFLDPLSFRADSALGVPGLLSVYRAGRVTLANAIGTGIADDKSTYLYVPDMIRFYLGEEPILSNVPTWRCGRPDELSHVLANMHDLVVKEVHGAGGYGMLVGPSASRAEVESFKDRVRANPANYIAQPTLALSTVPTYVESGVAPRHVDLRPYVLCGKDIRTVPGGLCRVALTEGSLV

SEQ ID NO: 215229 - protein, 329 aa, Glycine max
  Coding DNA Sequence Number=SeqID_98451
  Gene Ontology: Mol. function=sugar porter activity; Cellular component=membrane; Biological process=transport
  Homolog annotation: Hit_ID=Q66E93; Match level="QueryCoverage=99%, HitCoverage=100%, E-value=1e-123, Identity=68%"; Hit description =Putative ABC sugar transporter, permease subunit
  Pfam annotation: Domain name=BPD_transp_2; Domain location=39-313; Score=144.8; E_value=2.3e-40; Accession=PF02653.6; Description =Branched-chain amino acid transport system  permease component
MPDFSRLRPHSSQGWLAWVLLAFMVFFSLASDQFLTVQNLLDLAESYAVTGIFALGLFVVLVTGGIDISFAAVASVVQYLIASLFVQFQFDNALLSILLAIVCGTLFGVINALLITSLRVVSIIITISMQSLLFGLLMWVTGGKSLYSLPDWWITLRSVLPFSVQGNSFQIGLPLAIMLVIAALTALLLNKTNLGRQLYAVGGDAESARRIGIRVGLIHVFAYGWLGAMAAIGGLVQVYRMGEVVPNALVGGELDVLAATVLGGASLMGGKGTVSGTLMGVFLIAILKNGLNLIGVSNYFMNIVVGGTIMVAIAVTHYKKRKETDVSFV

SEQ ID NO: 215230 - protein, 192 aa, Glycine max
  Coding DNA Sequence Number=SeqID_98452
  Homolog annotation: Hit_ID=Q6K832; Match level="QueryCoverage=19%, HitCoverage=5%, E-value=7e-07, Identity=71%"; Hit description=Lipase class 3 protein-like
MFLHVGLSQQVVIAKHKGYVSGSLSDEGKVGLGGDSGKSESSLEKGIVDRSDALDVDAKVDNMARCFRTNQRILVRKGNKDELGKTIGREQEEPPKFSNWPNEREVLSAAKVSKKMKLKFTKEWIAYLRLPLPIDVYKEILKPAFTIIADHEMKCLLLLIRGTHSIKYTLIAVTGNVRGTISSNYLALKLLQ

SEQ ID NO: 215231 - protein, 98 aa, Glycine max
  Coding DNA Sequence Number=SeqID_98453
MLLKKKGYDGCKALLSGYLPFQDIMKDPWFQIGIMRPIAFSTKESFVEDNIDFNGEDALNVNCNNSNNDNRKMIMVHHCGKSSSITCGRVTGEKKRGS

SEQ ID NO: 215232 - protein, 66 aa, Glycine max
  Coding DNA Sequence Number=SeqID_98454
MVLIMVGLYSFLWDKNNETMRTAQQPIVAAAEISNVTDFPARAESIATIVTSSSRMNSIVLKLEKS

SEQ ID NO: 215233 - protein, 59 aa, Glycine max
  Coding DNA Sequence Number=SeqID_98455
MENHRIVLYVFHLNLSHNLVVVRSQIMYQVLFTPVSLVEERPPPKKENKGGRRGGRKGT

SEQ ID NO: 215234 - protein, 34 aa, Glycine max
  Coding DNA Sequence Number=SeqID_98456
MSFCHTFQVPARPTKFIGEELSTTVAIDSARAGK

SEQ ID NO: 215235 - protein, 181 aa, Glycine max
  Coding DNA Sequence Number=SeqID_98457
  Gene Ontology: Mol. function=protein serine/threonine kinase activity; Cellular component=cellular bud neck; Biological process =protein amino acid phosphorylation
  Homolog annotation: Hit_ID=Q9FVI7; Match level="QueryCoverage=100%, HitCoverage=52%, E-value=2e-87, Identity=85%"; Hit description =Putative serine/threonine kinase GDBrPK
  Pfam annotation: Domain name=Pkinase; Domain location=1-181; Score =34.7; E_value=1.3e-10; Accession=PF00069.15; Description=Protein kinase domain
  Pfam annotation: Domain name=Pkinase_Tyr; Domain location=7-174; Score=-163.9; E_value=0.021; Accession=PF07714.7; Description =Protein tyrosine kinase
  Pfam module annotation: Pfam domain module=Pkinase::Pkinase_Tyr; Domain location=1-181::7-174
MEYASGGELFERICNAGRFSEDEARFFFQQLVSGVSYCHSMILIVKGMSMQQICHRDLKLENTLLDGSTAPRVKICDFGYSKSSVLHSQPKSTVGTPAYIAPEVLTRKEYDGKVADVWSCGVTLYVMLVGAYPFEDPEDPRNFKKTIGKILSVQYSVPDYVRVSMECRHLLSQIFVASPEK

SEQ ID NO: 215236 - protein, 593 aa, Glycine max
  Coding DNA Sequence Number=SeqID_98458
  Gene Ontology: Mol. function=DNA binding; Cellular component=oxygen evolving complex; Biological process=DNA integration
  Homolog annotation: Hit_ID=Q1SKN1; Match level="QueryCoverage=99%, HitCoverage=41%, E-value=1e-156, Identity=47%"; Hit description =Integrase, catalytic region
  Pfam annotation: Domain name=rve; Domain location=2-118; Score=44.7; E_value=3.1e-10; Accession=PF00665.16; Description=Integrase core domain
  Pfam module annotation: Pfam domain module=RVT_2::rve; Domain location=318-574::2-118
MHTKAETRKIVTDFVAYVETQFDSRVKILRSDNGAEFLMNDFYARKGIIHQTTCVETPEQNGIAERKHQHLLNVTRALLYQAQLPLHFWCFALLHATYLINRIPTPFLKNISPYEKLYAQPCDISNIRVFGCLCYISTLQNHRQKLDPRAHPCIFLGFKPHTKGYLVYNLHSHNITASRNIIFYENHFPILHEPHQTDNTLTHISPIPFSNNTPVYPVNPNDTTQTTISPINSSTSTQDNSSPTSPYTSTPSLHRSMRTRHPPTYLQDFHRALTSHTDTSSTKVRLSHSHKHFIMSITTVAEPRSYAEASSHDCWIKAMQVELKALQQNHTWILTPLPPHKKAIGCRWVYKVKHNADGTIERYKARLVAKGYTQQEGLDYLDTFSPVAKLTTVRMLLALAALRKWHLRQLDVNNAFLHGDLNEEVYMKPPPGLIMDNPNLVCHLQRSLYGLKQASRQWFTRLSSFLLSQGFCQSSADHSLFLYSHIDNTVTAILVYVDDIILAGDNLEYITHVTKLLDQTFSIKDLGLLKFFLGLEVARTSHGIHLCQRKYVLDIISDSGMLSSQPASTPMEYSTRLSASMGTPLSETSASSY

SEQ ID NO: 215237 - protein, 97 aa, Glycine max
  Coding DNA Sequence Number=SeqID_98459
  Gene Ontology: Mol. function=protein serine/threonine kinase activity; Biological process=protein amino acid phosphorylation
  Homolog annotation: Hit_ID=Q9FVI7; Match level="QueryCoverage=68%, HitCoverage=19%, E-value=3e-12, Identity=58%"; Hit description =Putative serine/threonine kinase GDBrPK
MEGGSWQMNDVNNPSQSVEEVLSIIQEARKSLNVPKVGGLLIGGSMDLDDLDADEDLEDLQTSGEFVLFPYVHFALSPITHVDVLRFRNFQNHVPFS

SEQ ID NO: 215238 - protein, 103 aa, Glycine max
  Coding DNA Sequence Number=SeqID_98460
MVSKVEEAKKRNRIKKQIQCNKGKIGMFKRSSSNMEEDGASFAILLLACIALCTFQPANTCPITCESSGHGSAHASNNVTYLLHALWLSVTQNKYSDLYSFIG

SEQ ID NO: 215239 - protein, 200 aa, Glycine max
  Coding DNA Sequence Number=SeqID_98461
  Gene Ontology: Mol. function=zinc ion binding; Cellular component =nucleus; Biological process=transcription
  Homolog annotation: Hit_ID=Q1SPG0; Match level="QueryCoverage=86%, HitCoverage=44%, E-value=2e-51, Identity=53%"; Hit description=Zinc finger, SWIM-type
MNGKAPSSVITDGDVAMNNAIRRVFPNAFHRHCAWHLIRNAQSHLKNTDILPFLKRLMLIELEASEFEQKWNEMVSRFGLQDNTWLNELYVKRRMWSPAHICGNFFAGIRMASRCEALHDHIGKYVDSRTNLIDFVEQFHRCLTFFRYREIEVDYFDYGDVIVETNFHSMERSADIEPKIPVPVNSNTFKTYQFRLDQYA

SEQ ID NO: 215240 - protein, 123 aa, Glycine max
  Coding DNA Sequence Number=SeqID_98462
MATPVTGGGGGGDPNPPHSGAAPPVHPAPVNTNLNHIITEKLDSTNYLFWKSQVEPIIHGYNLLHFIHEVQIPQRFATIEDANAGRVTEVFRLWDQQDQLLLSWLHSTISAPILLMFVKCKSL

SEQ ID NO: 215241 - protein, 90 aa, Glycine max
  Coding DNA Sequence Number=SeqID_98463
MNQKAKPYYMTLDLKFNLHFSYLGFYIHDSMETIIERFNKQNNNHHRLMDATSAIKILDLILMYFIFLVLVELNWFINSTVKSIGHADSN

SEQ ID NO: 215242 - protein, 279 aa, Glycine max
  Coding DNA Sequence Number=SeqID_98464
  Gene Ontology: Mol. function=cysteine-type peptidase activity; Biological process=proteolysis
  Homolog annotation: Hit_ID=Q6L4B6; Match level="QueryCoverage=80%, HitCoverage=51%, E-value=9e-66, Identity=53%"; Hit description=Ulp1 protease family protein, putative
  Pfam annotation: Domain name=Peptidase_C48; Domain location=67-278; Score=42.9; E_value=1.1e-09; Accession=PF02902.9; Description=Ulp1 protease family, C-terminal catalytic domain
  Subcellular localization annotation: CTP_CleavageSite=69; ConfidenceScore=5.25e-01
MESDFWSNVPQRLRTKRKSKFNGKEALSTPKVVLSKSKETISRSNKALSTLKEALSRPNKALSTPKEVLSTLKEALSRPKEKLNSGDFDIYLKKIWKIFSGDRLRHFTCFDSLWFSLYRAAPSKDKVLTWIKKEPIFSKSYVFVPIVCWGHWSLLILCHFGESLESTTKSRCMLLLDSLEMTNPRRLEPEIRRFVLDIYKTEDRPEAKHLVSQIPFLVPKVPQQRDGNECGFFILYFINLFLEHAPDNFSMEGYPYFMKKDWFSFEDLDRFYERLDSLN

SEQ ID NO: 215243 - protein, 227 aa, Glycine max
  Coding DNA Sequence Number=SeqID_98465
  Gene Ontology: Mol. function=histone acetyltransferase activity; Cellular component=nucleus; Biological process=regulation of transcription, DNA-dependent
  Homolog annotation: Hit_ID=Q93ZR1; Match level="QueryCoverage=93%, HitCoverage=39%, E-value=1e-99, Identity=81%"; Hit description =Probable histone acetyltransferase ELO3
MAAAAVAEVRKAPRPGKGGYEAHGLSEEEARVRAIAEIVSSMVDLSHKGQNVDLNALKSAACRKYGLSRAPKLVEMIAALPDAERETLLPKLRAKPVRTASGIAVVAVMSKPHRCPHIATTGNICVYCPGGPDSDFEYSTQSYTGYEPTSMRAIRARIDQLKRLGHSVDKVEFILMGGTFMSLPADYRDYFIRNLHDALSGHTSANVEEAVAYSEHGATKCIGMTIE

SEQ ID NO: 215244 - protein, 276 aa, Glycine max
  Coding DNA Sequence Number=SeqID_98466
  Gene Ontology: Mol. function=protein serine/threonine phosphatase activity; Cellular component=protein serine/threonine phosphatase complex; Biological process=protein amino acid dephosphorylation
MEEGLGKRELEGEVVSRVAEVISAIKNAKHVDQVICALHSLATILFPFDPSLLSDSIDQSYGDKVQVPSAEKRHAWWRVFYRGAAFPTLARFLLLDVASNWLGCFPFSAQKYVYDVFFVRGLVTEVLQILVPFLQLSSSDGLDVNAVLSNSESIYYRLLVLCLLENNGALQLAREFGGSSKLKSVTDVQIKMDVSMVAQIVASIPDKARMNSMASLSSQVFSVFFKQIVVQLLSLAEERETILLDNVDMDEMDKNGALLFVGEMFSRICRRGSAGN

SEQ ID NO: 215245 - protein, 68 aa, Glycine max
  Coding DNA Sequence Number=SeqID_98467
MQCRIVAGERWAFVGEKSGVSVFVQVKLRWEIGFLTLHICCPRPFSGDNVEGGIGWDEECHALYPSRS

SEQ ID NO: 215246 - protein, 245 aa, Glycine max
  Coding DNA Sequence Number=SeqID_98468
  Homolog annotation: Hit_ID=Q53PU8; Match level="QueryCoverage=84%, HitCoverage=43%, E-value=1e-33, Identity=39%"; Hit description =Expressed protein
MGVEDLCFEGLETCYLLDFIPPKEFLFDLSRKSKCKIVGFDHRKSVLGHIPPANDCPENIMINVNLEKSSSSVVYEYFAGKCEDANISNVISHTAMTEIEICLNFIKGEAPCLVDSKDKGRVELMLKYIEDGDLRRWSLPGIRAFNIGLSEWRSSYHVFAEFVLFFEKSSWQLLKLSAEDLITKGNSCVSSRQNAASKLLEKAFRVRLGRGFYGECLGVRADGNSNLSDEIGKLLSVKSAATGLR

SEQ ID NO: 215247 - protein, 467 aa, Glycine max
  Coding DNA Sequence Number=SeqID_98469
  Gene Ontology: Mol. function=GTP binding; Cellular component=signal recognition particle, endoplasmic reticulum targeting; Biological process=SRP-dependent cotranslational protein targeting to membrane
  Homolog annotation: Hit_ID=Q5CY59; Match level="QueryCoverage=89%, HitCoverage=64%, E-value=2e-34, Identity=26%"; Hit description=Kelch repeats protein
  Pfam annotation: Domain name=Kelch_1; Domain location=103-157; Score =11.3; E_value=0.2; Accession=PF01344.15; Description=Kelch motif
  Pfam annotation: Domain name=Kelch_1; Domain location=246-296; Score =16.8; E_value=0.048; Accession=PF01344.15; Description=Kelch motif
  Pfam annotation: Domain name=Kelch_1; Domain location=42-98; Score =25.8; E_value=0.00015; Accession=PF01344.15; Description=Kelch motif
  Pfam annotation: Domain name=Kelch_2; Domain location=103-157; Score =25.3; E_value=0.00022; Accession=PF07646.5; Description=Kelch motif
  Pfam annotation: Domain name=Kelch_2; Domain location=246-307; Score =2.5; E_value=18; Accession=PF07646.5; Description=Kelch motif
  Pfam annotation: Domain name=Kelch_2; Domain location=42-98; Score =26.0; E_value=0.00013; Accession=PF07646.5; Description=Kelch motif
  Pfam module annotation: Pfam domain module=Kelch_1::Kelch_1::Kelch _1::Kelch_2::Kelch_2::Kelch_2; Domain location=103-157::246-296::42 -98::103-157::246-307::42-98
MKQVEMRIEEGVRYYNDLFVFDLDQFKWQEIKPKPGAMWPTARSGFQLFVYQDDIFLYGGYSKEVSSDKSNSEKGIVHSDMWSLDPKTWEWNKVKKSGMPPGPRAGFSMCVHKRRALLFGGVVDIEVEGDVMMSLFLNELYGFQLDTNRWYPLELRKEKSTKDKLKKIEQNCPDDVNKINPACTTREETEESEDEENNIDDISKNIASNMSIDDGETLTKSEGKAEESSAKLDIQSSLPEVVKPCGRINACMAVGRDTLYIYGGMMEIKDQEITLDDLYSLNLSKLDEWKCIIPASESEWVEASDDDEENEDDDEDESDGDSLTDEDEDDEEEEEEEAQNASVQVGDAVALIKGVGKNLRRKERRVRIEQIRASLGLSDSQRTPSPGESLKDFYRRTNMYWQMAAHEHTQHTGKELRKDGFDLAEARYRELKPILDELALLEAEQKAEEAEGPETSAKKRGKKKTRN

SEQ ID NO: 215248 - protein, 519 aa, Glycine max
  Coding DNA Sequence Number=SeqID_98470
  Gene Ontology: Mol. function=coproporphyrinogen oxidase activity; Cellular component=cytoplasm; Biological process=porphyrin biosynthetic process
  Homolog annotation: Hit_ID=Q9FMJ4; Match level="QueryCoverage=86%, HitCoverage=87%, E-value=1e-153, Identity=58%"; Hit description =Oxygen-independent coproporphyrinogen-like protein
  Pfam annotation: Domain name=HemN_C; Domain location=348-459; Score =46.8; E_value=7.4e-11; Accession=PF06969.6; Description=HemN C -terminal region
  Pfam annotation: Domain name=Radical_SAM; Domain location=57-242; Score=90.5; E_value=5e-24; Accession=PF04055.11; Description=Radical SAM superfamily
  Pfam module annotation: Pfam domain module=HemN_C::Radical_SAM; Domain location=348-459::57-242
  Subcellular localization annotation: CTP_CleavageSite=40; ConfidenceScore=5.72e-01
MLKSTFTPIFWVLTPKPKPPKLPPQAITNTFFTSSTTHVRHNAPLNPTTPPPPSSAYIHLPFCRKRCHYCDFPIVALGSASTQTNDDPRVSNYIHWLCREISATNVDQPADASTITPLKTVYFGGGTPSLVPPRMVASVLDTLRLKFGLREDAEISMEMDPGTFDAEKMREMVVLGVNRVSLGVQAFQEELLRACGRAHGLKEVHEAIDVVKLCGVENWSIDLISSLPHQTSEMWEESLRLAIESQPTHVSVYDLQIEQGTKFGRFCNYGCRDPKNLYIAAAITVAETLKILMLQAQLWYSPGEFPMPSETQSAEFYKMASRMLSDANYNHYEISSYCKSGYECKHNFIYWKNKPFYGFGLGSTSFVGGLRFSRPRKVNDYINFVQNLENGLVNSSVKGHISGKDTIMDVVMLSLRTAQGIDLKSFQESFGSSVVLSLLEAYKPYVESGLVVCLDEHRRTIRIDDLNSSLSKTNAEGRVAYIRLSDPEGFLLSNELIALAFGVIDSWKDMPPYKEAEAT

SEQ ID NO: 215249 - protein, 215 aa, Glycine max
  Coding DNA Sequence Number=SeqID_98471
  Gene Ontology: Mol. function=GTP binding; Cellular component=signal recognition particle, endoplasmic reticulum targeting; Biological process=SRP-dependent cotranslational protein targeting to membrane
  Homolog annotation: Hit_ID=Q00WR6; Match level="QueryCoverage=78%, HitCoverage=39%, E-value=2e-42, Identity=44%"; Hit description=[R] KOG0379 Kelch repeat-containing proteins
  Pfam annotation: Domain name=Kelch_1; Domain location=124-175; Score =30.6; E_value=5.6e-06; Accession=PF01344.15; Description=Kelch motif
  Pfam annotation: Domain name=Kelch_1; Domain location=68-120; Score =6.1; E_value=0.79; Accession=PF01344.15; Description=Kelch motif
  Pfam annotation: Domain name=Kelch_2; Domain location=124-175; Score =23.2; E_value=0.00092; Accession=PF07646.5; Description=Kelch motif
  Pfam annotation: Domain name=Kelch_2; Domain location=68-120; Score =15.7; E_value=0.16; Accession=PF07646.5; Description=Kelch motif
  Pfam module annotation: Pfam domain module=Kelch_1::Kelch_1::Kelch _2::Kelch_2; Domain location=124-175::68-120::124-175::68-120
MGKKTKKPGKGKEKTERKTARAEEKKARRETKKLSPEDDIDAILLSIQKEEAKKKEVHVDDNVPAPSPRSNCSLTVNPLKETELILYGGEFYNGNKTFVYGDLYRYDVEKLEWKLVSSPNSPPPRSAHQAVAWKNYVYIFGGEFTSPNQERFHHYKDFWMLDLKTNQWEQLNLKGCPSPRSGHRMVLYKHKIILFGGFYDTLREVRLLMLLDFFC

SEQ ID NO: 215250 - protein, 185 aa, Glycine max
  Coding DNA Sequence Number=SeqID_98472
  Gene Ontology: Mol. function=oligopeptide transporter activity; Cellular component=integral to membrane; Biological process =oligopeptide transport
  Homolog annotation: Hit_ID=Q1SFU4; Match level="QueryCoverage=54%, HitCoverage=17%, E-value=5e-35, Identity=75%"; Hit description =Oligopeptide transporter OPT superfamily
MANCESKDSLTLGRTMKFVSCMVTFLAGQSTNSLSNKINSKCMLQNLGDLKLGHYMKIPPRSMFLVQKEVTGHVQVTVFSWTHQSSIGPTLVWILHKTFPKQSWIPLINLPVLQGATGMMPPATPLNYNAWIIIGTIFNFFIFRYSKKWCQRYNYVLSAALDAGVAFMPGKHKSQKGFFLCAPTK

SEQ ID NO: 215251 - protein, 50 aa, Glycine max
  Coding DNA Sequence Number=SeqID_98473
MEHRCKYHKYLEHTLTIAKKGEIRGLNKMPAKICAHLSPAKLCISSYQQG

SEQ ID NO: 215252 - protein, 132 aa, Glycine max
  Coding DNA Sequence Number=SeqID_98474
  Homolog annotation: Hit_ID=Q1T3R4; Match level="QueryCoverage=39%, HitCoverage=7%, E-value=3e-20, Identity=88%"; Hit description =Peptidase aspartic, active site; Oligopeptide transporter OPT superfamily
MAEVKSEDPENANKREKEEEESPIEEEGLTVKNTDDPTQPVWTFRMWFPGLLSCSLLSFLNQFFAYRTEPLFITQITVQLWVRLVLRGGDCYHCQGVVWNEDIVGCFMASHHHGEFEYNKHQKDLQTRENLT

SEQ ID NO: 215253 - protein, 163 aa, Glycine max
  Coding DNA Sequence Number=SeqID_98475
  Homolog annotation: Hit_ID=Q8LGT9; Match level="QueryCoverage=96%, HitCoverage=48%, E-value=1e-55, Identity=72%"; Hit description =Phosphoglycerate mutase-like protein
MGEFIPVTEEEVLASINFFFPLLIFHWQVLRLQMPECLCLFKFLFQLDSDEDTWWKANVRETKEELAARGMKFLNWLWTRKEKEIAIVTHSGFLFHTLNAFGSDCHPLVKKEISKHFANCELRSMVIVDRGMIGLEQSTTNYPGKIPSGLDLPSDVADEKSEK

SEQ ID NO: 215254 - protein, 130 aa, Glycine max
  Coding DNA Sequence Number=SeqID_98476
  Gene Ontology: Mol. function=DNA binding; Biological process =regulation of transcription, DNA-dependent
  Pfam annotation: Domain name=B3; Domain location=45-123; Score=6.7; E_ value=0.013; Accession=PF02362.12; Description=B3 DNA binding domain
LPKEIKDSDISNQDDESHFKTAPPLSCVVTNDNDNVSLKLPEYLPLTRRVKPFTHKKMVVLLRDSQMRLWPVFYHEQPRLLTHGWLDFSRANNIQPEDECIFEVEPDPESRYQRILAYILGSYTTMTSRQ

SEQ ID NO: 215255 - protein, 524 aa, Glycine max
  Coding DNA Sequence Number=SeqID_98477
  Gene Ontology: Mol. function=transporter activity; Cellular component= integral to membrane; Biological process=transport
  Homolog annotation: Hit_ID=Q9FGR5; Match level="QueryCoverage=97%, HitCoverage=97%, E-value=1e-177, Identity=58%"; Hit description =Transmembrane transport protein-like
  Pfam annotation: Domain name=DUF983; Domain location=202-280; Score= -30.7; E_value=0.019; Accession=PF06170.3; Description=Protein of unknown function (DUF983)
  Pfam annotation: Domain name=Sulfate_transp; Domain location=178-489; Score=-82.3; E_value=3.3e-05; Accession=PF00916.10; Description =Sulfate transporter family
  Pfam annotation: Domain name=Xan_ur_permease; Domain location=98-476; Score=-59.0; E_value=6.5e-06; Accession=PF00860.11; Description =Permease family
  Pfam module annotation: Pfam domain module=DUF983::Sulfate _transp::Xan_ur_permease; Domain location=202-280::178-489::98-476
MGRDLCASGKMEGLRSSWSQMEKAFNEAVSKSFVGRYFKLEARKSCFTRELRAATATFLTMAYIITVNATIIGVSGGTCTTKDCSSMDCKVKSDIEYQSCLAKTKNDLVVATAVSGLVGSVAMGLFANLPLGLAPGMGPNAYFAFNLVGFHGTGPLSYQTALAVICVEGIVFLLVSALGLRGKLAKLIPHSVRLGCAAGIGLFIAFTGLQAGLGVGLIGPDAANLVTITACKVVDPETGACVGGKLQSPKFWLGLVGFIITSYGLMKNVKGSMIYGILFVTLVSWFRHTEVTYFPNTPLGDANYNYFKQVIGFHNIESTAGVLSFSGFNKREVWVALATLLYVDVLAITGTMYTMAEIGGYVDEKGQFEGSTIVGSALGVSTTATFVESSAGMREGGRTGLTAFFIGFFFFLSLFFTPLLASVPPWAIGPSLVMVGVMMMKVVKDIDWTNTKDAVPAFATMLLMPLTYSIANGIIGGVGLYIALSLYDYAASIVNWLRKMRRMVAKEQNQVSATAGVDSAVEMI

SEQ ID NO: 215256 - protein, 89 aa, Glycine max
  Coding DNA Sequence Number=SeqID_98478
  Homolog annotation: Hit_ID=Q1T3G5; Match level="QueryCoverage=92%, HitCoverage=41%, E-value=1e-38, Identity=89%"; Hit description =Putative ZW10 protein-related
MDYSAGSSLFPLHRCKTIHLVRHAQGIHNVEGDKNYKAYMNPDYFDAHLTPLGWQQVDNLRKHVRDSGLINTIDLVIASPLMRFFSLIT

SEQ ID NO: 215257 - protein, 80 aa, Glycine max
  Coding DNA Sequence Number=SeqID_98479
MSSMILMASARGFSMRPKEKKVQVDDVSLSVADPLSEWHPLSETSSSLSMLGNPRRGSVKDVLAQCAASPPSEVVVPSST

SEQ ID NO: 215258 - protein, 432 aa, Glycine max
  Coding DNA Sequence Number=SeqID_98480
  Gene Ontology: Mol. function=DNA binding; Biological process =regulation of transcription, DNA-dependent
  Homolog annotation: Hit_ID=Q851V5; Match level="QueryCoverage=23%, HitCoverage=9%, E-value=3e-07, Identity=29%"; Hit description =Putative auxin response factor
  Pfam annotation: Domain name=B3; Domain location=8-85; Score=33.8; E _value=6.2e-07; Accession=PF02362.12; Description=B3 DNA binding domain
MGSDLYIPPAFSSTVSDLVNKKIALNDSSERQWNVKVSGFNGSFAFMEGWSTFSLNHGVKVGYLLVFNYVKDLHFDVKIYDPSACEKLNFPKTRNQKKRSRGRSGSPVRDCMLVGQESNALVVTQHYVPKMKSQRSEVDLVVRKNGEESGQLMCISELHEDPCYSTSLEFDQSHGVNGTMKIVNGDLKVSNVDYGSHIFENDAIVCSKDTMFEGIFSMAAALDISEFEMSGRSTSLGEADKSTHDKTSTLNIEENKESKAIMYSGEAQECQFSNVLESDQAAISKKEPALHIDGSCNTKNKFNEISNHLDTYIHNGEMKKLPVDKTPKLYSSVDKLNVTGLPKETKGKLDHYSDPFNQDNESHFKTAPPLMSNGEAQECQFSEGLDLAFYYFYFTLAYFQKVIKQQYPKKNLLCIFVVLVTPNRTSMESQMT

SEQ ID NO: 215259 - protein, 47 aa, Glycine max
  Coding DNA Sequence Number=SeqID_98481
  Homolog annotation: Hit_ID=UPI00001623CC; Match level="QueryCoverage =87%, HitCoverage=2%, E-value=7e-12, Identity=73%"; Hit description =ATGSL08 (GLUCAN SYNTHASE-LIKE 8); 1,3-beta-glucan synthase/ transferase, transferring glycosyl groups
VKAAISAIRYTDQFPRLPAGFKISGQRDADMFDLLEFVFGFQPLTFK

SEQ ID NO: 215260 - protein, 153 aa, Glycine max
  Coding DNA Sequence Number=SeqID_98482
  Homolog annotation: Hit_ID=Q1SID8; Match level="QueryCoverage=44%, HitCoverage=27%, E-value=7e-18, Identity=60%"; Hit description=SNARE domain, putative
MKLKAENENETKGRRRNRNEIALRNRKWKNAFTSTVDELDKAIFIASKDPSLYGIDEVEVENQRKWTSDTRTLVSTTKKAVQAGKGLNNVSLKGMHKELMRLPRMIDIKKCCRMIELTQGCYHMTCGLTKQKVLSKGTCRQVDEDLNGKVVPC

SEQ ID NO: 215261 - protein, 164 aa, Glycine max
  Coding DNA Sequence Number=SeqID_98483
MANSLVSYVGFSPQSKLLSSSYRPSLLSSLIIIASDGNLSKAFSQPIMLITNMYSPKIQKYQKIPLPLYLSCAWLHYSLLVETKKYSLGSSSSMDSFASGKMNGAEWRRKRERRRHFKEKMSLEEAHHHRRSWIRAWKKKEMNEGRGREEHKILCSKRALKSEV

SEQ ID NO: 215262 - protein, 44 aa, Glycine max
  Coding DNA Sequence Number=SeqID_98484
MGNLASHDKWGILGHRKRLEGYTRESFLTTDENEWLSLNLSPSE

SEQ ID NO: 215263 - protein, 414 aa, Glycine max
  Coding DNA Sequence Number=SeqID_98485
MGVRTVAAVGELVEVDDEVEELRRLDRARVLLRTPWKPLIHHTVEATINGETYQIVIVEEREADGGMRNQWARKHTYSSEDIDFDDIDDDSVHAGMLKNHDFLHPRNGIDDEGWPDEAHNHCGSLPAGPTLFECPPGIDQRTTAPLLRIQIAKRPEEYQQPSAGYASADADPKTRGLLSGAEDSMRDSQKKNLNRIRGFLSGAESIDQGQTEDDLVFTSGPKNEPKMPHNILINMKKSVCEAGPSKQSPASPNQQWNFRGSLLLLKNAYEQQATSFGLPIEMTLTKDTSACSKQQTNNKSCQKTSAVSEWKVFVRKKRSCHKQAQHSGEQSTQCEVPLSAATLPPAAIGSPEAIGTTRKPEEGDIQEAVSQWELAKSMGVHTELDQAAIINRITEMENRDKKEAAQMGNRQSAS

SEQ ID NO: 215264 - protein, 540 aa, Glycine max
  Coding DNA Sequence Number=SeqID_98486
MSSFIFDSAIGMGGSDFREETHCGAFDRKSSSSERLRVSLRQGGVVLETLRHPPAIAGFEWVGDNVLKYRSSITSVASVAAIQHQLFKFDSNVFRHFKDHFFKVLAIDIVDDGLFKSFDENLLTLVEKVNKAILEQLLASLDARAILSLPSMDDPFAALDGIMGDFAWRPLVKQARPVGGTMPPCTIAVSIRERGQPSVEVSPNTGVVEVSPDVLSSVLAKRKQDDDDGVSGHKKSRAPSSLRAMREAVRLTLGSGCPLSLQDPPPSSSIIQAFVLVAAVIATPAPPPSPAMFALEISTSPWAEVSALATLASTVDAPLFIVVVPLLSTGVATTSASMVPHSSSPLVPSLAVLVSTSPSTSSQPSISLDHIYTSCDVFSLWGVECYGFYLGLPPMKFGDLGREREKAPRGAKKGGVLRVRRVECLKVANAIVAFVEAVKSNHQLSSKVDSVLAKLLCTRLDSDELFERCKRLHKEKNELVEEVEGIASKKDEFTKDLDLGLFDPFKDMKDGVLLDEEDIATEEEASEEQDAEDQGDDVNV

SEQ ID NO: 215265 - protein, 321 aa, Glycine max
  Coding DNA Sequence Number=SeqID_98487
  Gene Ontology: Mol. function=RNA-directed DNA polymerase activity; Biological process=RNA-dependent DNA replication
MSSTRSCLKHKTLFEGFNPPPTLMTDTDALQQLQNHIAKMERHHEEELRKLKAYHDQLEACVKCPQGDKHSVHTLPGYTQGESHPRHTFKTQNDSSLSHIHHPIGQTTHRYPFVDRIMETDLTLGWKPLNLEWYNGTIDPYEHLGAFLSQENLYTNDNAFLCHVFPMSLKGTTLTWYDGLPPKSIESFDTLVYQTPQTNSQMEATNKFILNALHTRLDKSKGLWKEEFPSSSNPSSALGESHFSKGLSNPRFALNESHITKGSSNPRSVLGESRFSKGSSNPRSAFGEFFYRNLRNTSLQEHQKPKDHLGYTLLQKPKARP

SEQ ID NO: 215266 - protein, 224 aa, Glycine max
  Coding DNA Sequence Number=SeqID_98488
  Gene Ontology: Mol. function=RNA-directed DNA polymerase activity; Biological process=RNA-dependent DNA replication
MILCQVFPTSLKGATLTWYGGLPHQSIDSFDTLVECFNSQYATSQLHCLTSTAKASLHQVDDEPLRKFIDKFGQIAVQIRNLNPEVVLHSMLLVLRPGSETKYDRLEKSMRKEKVAQELTHISRTSNTNQTSVNLFRGYQEAFNAEIPIQLPPTPHPRLGLNITKHCKYPHNHDHNTEDCWTLKDKIEELTHVGYPTQFVKKLDDNRTRGKYEGHHEDYPKHKC

SEQ ID NO: 215267 - protein, 243 aa, Glycine max
  Coding DNA Sequence Number=SeqID_98489
MVIANLMVSKVFIDQDSSTESGNKRLCRPNDHLWLGNTLNELAVIVSTPHLRDEAPYLDGRNCNCQGRLEASPTVDLDKLHPPFGGSNSQIMSVDEEFQIKTLAIYGTTRGYQDDAFDVDLCDDTIDKCPKPIEELVKLQLGLKLGQYTQLSRDLTSHEEEIDKMLKAQFIRVVRYSTWLANIVMVKKANGKWCMCTDYTNLNKACPKEAYPLPNIDKILDDASGLPDTGYRDLDDATSSEER

SEQ ID NO: 215268 - protein, 392 aa, Glycine max
  Coding DNA Sequence Number=SeqID_98490
MAIMACMEDKFPFIGAAPGYPPFFYIYCCIFEVLNLTLPLNTFQCALLRRLNVAPSQLHRNSWVMLIGKIGWVSLNNLSKFYSNMFRRFKDHFFKVKAISAIDDRLPLMHAGKGEPRFPFYRKSDPIRFKSFDECLMSSGERVGPAGDDMPPPSTIIPEPSTREGGHTVARVDLSQSFDTTEDEVFEVTPNVPSLSANKRKRNERAGESGAGAASTPSSIVLAMSTSGSTTLAHSSFVVVPLLSIGVTTIGPEQDYFFGDEVAKWRATARIIWRMKRPKMANATIALAKAIRSNHQFSSRVDDVFTKLVSTRLDESELKVMKEKKVNKELEKELLMFKKKAVEQHEKGFFKIVLDLSLFDSLKDVKDGQLLDEDEIVVGEENDDEGDHEANV

SEQ ID NO: 215269 - protein, 71 aa, Glycine max
  Coding DNA Sequence Number=SeqID_98491
MVGVPENESSGPDEESSTRRLVAIRRDSGLGKAARGGHAPVFGKHWSGTWLPFWSSDQLGWVALFEAHRTL

SEQ ID NO: 215270 - protein, 118 aa, Glycine max
  Coding DNA Sequence Number=SeqID_98492
MKVIALKQTSHDMIAHKGKARAAVEELKRFLVVDSLEEVNRKLDKFYMVLILKSLHSDFDYVRDQVLAGDQVSSMDSFITRLLRVPHALKEENPANTMETSTMVAPQTWHGSTDWRRA

SEQ ID NO: 215271 - protein, 164 aa, Glycine max
  Coding DNA Sequence Number=SeqID_98493
  Homolog annotation: Hit_ID=Q9XEG1; Match level="QueryCoverage=46%, HitCoverage=4%, E-value=2e-17, Identity=49%"; Hit description =Putative callose synthase catalytic subunit
AIWSIEAIFCTASGPRWLHLPLLTTLERNSNSSDNSFYFRIYLLVLGVYAAIRLFLGLLLKFPACHALSEMSDQSFFQFFKWIYQERYYVGRGLYERMSDYCSCQENGRRLTGDDKGGEVKVAPRPMTYATTTRCLPSACDDTFLWMMQCDSVVIADQLECARQ

SEQ ID NO: 215272 - protein, 78 aa, Glycine max
  Coding DNA Sequence Number=SeqID_98494
MITDNSDNSGDHVGNNNSDHDDDQHDGSSESSEGHVGSIDDDHSDNHDGSSSNYVGGDNDGYDDDDHGGSCDNNFNIN

SEQ ID NO: 215273 - protein, 618 aa, Glycine max
  Coding DNA Sequence Number=SeqID_98495
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=UPI00001623CC; Match level="QueryCoverage =83%, HitCoverage=26%, E-value=1e-161, Identity=62%"; Hit description= ATGSL08 (GLUCAN SYNTHASE-LIKE 8); 1,3-beta-glucan synthase/ transferase, transferring glycosyl groups
  Pfam annotation: Domain name=Glucan_synthase; Domain location=147 -618; Score=-136.3; E_value=0.0025; Accession=PF02364.6; Description =1,3-beta-glucan synthase component
MECGNSFAVITAEEPTGEPPFLGGGGGGRGYHIEISERIRNDPELAKGAAKAVHDLYEVVTHELVSSDLSEELILILLSILILVFMPMLLYDICPTVTGENLDTWNILARARDEGRLFSKIVWPNDPEIKELVKRLHLLLTVKDSAANVPKNLEARRRLEFFSNSLFMDMPSAKPVSEMLPFSVFTPYYSETVLYSTSELQKENEDGISILFYLQKIFPDEWENFLERIGRGASTGDAELQESSSDSLELRFWASYRGQTLARTGNKFLAAFWRADHWEVVAYEHFALQFVILIFILMKFDMDICWQSVVSIVDNYSQNNFITSQDFESSREARAQADLKFTYVVSCQIYGQQKQRKAPEAADIALLLQSLKGGDLASYCGGGIWVEFIGNEALRVAFIHVDESTTDVNTSKVFYSKLVKADINGKDQEIYSIKLPGDPKLGEGKPENQNHAIIFTRGEAVQTIDMNQDNYLEEAMKMRNLLEEFHANHGLRPPSILGVREHVFTGSVSSLAWFMSNQETSFVTLAQRVLANPLKIAPVSLVLTGVASILVEAMEMDQSALDTIVYPRFIVGPPAFATLKVGSFGHEEECWKAALLAASIVGFTEPALVAASLGVALP

SEQ ID NO: 215274 - protein, 68 aa, Glycine max
  Coding DNA Sequence Number=SeqID_98496
MQLLTETRSLPRWWKSKTELQVLNADNKPPNARQMNLQGKQTAPGGEEARTSSQKQANGTRKRNVRDA

SEQ ID NO: 215275 - protein, 100 aa, Glycine max
  Coding DNA Sequence Number=SeqID_98497
MLGSEHEGEGIAKGTREESESRNPRKNNGKKKKLKEFNGSVEEEKGVGFVEEVRNEKRAKSCCSTVVCWCRGGLCCACVEEETGEELRKGHANTGRGACY

SEQ ID NO: 215276 - protein, 153 aa, Glycine max
  Coding DNA Sequence Number=SeqID_98498
  Homolog annotation: Hit_ID=Q9SLZ4; Match level="QueryCoverage=99%, HitCoverage=15%, E-value=5e-61, Identity=74%"; Hit description =Retinoblastoma-related protein
MEDGKSENGGDQVESRFFEFCKNGLALEEKSCKEAANLFGETKHILLSNFSSMGNGTSEEAERYWFAFILYSVKKLIQKNDEGEKEDTENIGLSLCRILRAAKLNIADFFKELPQFVVKAGPTLSNLYGTDWENRLEAKEMHANAIHLKILSK

SEQ ID NO: 215277 - protein, 139 aa, Glycine max
  Coding DNA Sequence Number=SeqID_98499
MPPVFLYDDNDCDLKSPLKKPDSASTPSPTACGVKEDFSVLTNDEEEEDVIAGIRNDFTELVASSRTGSSKSARLTVTPNFPDCHLPLQSSTFPLFSPMIVGTQRASLMEQYEKVEKIGSRPRHQRDHRVEEDSPRAGG

SEQ ID NO: 215278 - protein, 108 aa, Glycine max
  Coding DNA Sequence Number=SeqID_98500
  Subcellular localization annotation: CTP_CleavageSite=26; ConfidenceScore=5.12e-01
MAETMAETLFKFFGFHFLHTCINRVVAGRGRRSRRTESPESQVEVAVAAQLQWRNRERVSRAVWRIDRGGSFNAREVLRRDPAPRRAAALAAATATTLNRPASPAFVA

SEQ ID NO: 215279 - protein, 272 aa, Glycine max
  Coding DNA Sequence Number=SeqID_98501
  Homolog annotation: Hit_ID=Q9STM4; Match level="QueryCoverage=19%, HitCoverage=11%, E-value=3e-14, Identity=62%"; Hit description =Putative zinc finger CCCH domain-containing protein ZFN-like 6
  Pfam annotation: Domain name=zf-CCCH; Domain location=77-103; Score =19.6; E_value=0.0034; Accession=PF00642.15; Description=Zinc finger C-x8-C-x5-C-x3-H type (and similar)
MSSLATGSSANIVSMVLEFLTELLGAQFPFVNSLRRTGKLEAGARRRVHGEEKERSRIIDQVVIQTIKCVQEFPKRPGDSECSYFLKTGHSRFKSNCKFHHPKDWIATLPPCNLNDKGVPLRPLKIGGDLSQLSSFYVPPPSTIARLDQKLVNTNSAASADVAENGGGEAEVVELGDCTRHAAKALVIGEVIATLEEIIEDVEGGRDSEVVVVGKGNRVDKGGAKRVDGVFVSETQHELGLRADLHDSDRVFWGISQKINTISNGDYSRETK

SEQ ID NO: 215280 - protein, 1124 aa, Glycine max
  Coding DNA Sequence Number=SeqID_98502
  Gene Ontology: Mol. function=nucleic acid binding; Cellular component= intracellular; Biological process=chromatin modification
  Homolog annotation: Hit_ID=Q9STM3; Match level="QueryCoverage=77%, HitCoverage=68%, E-value=0.0, Identity=47%"; Hit description =Putative zinc finger protein
  Pfam annotation: Domain name=JmjC; Domain location=215-280; Score =28.3; E_value=2.1e-06; Accession=PF02373.13; Description=JmjC domain
  Pfam annotation: Domain name=JmjN; Domain location=22-63; Score=42.2; E_value=1.7e-09; Accession=PF02375.7; Description=jmjN domain
  Pfam module annotation: Pfam domain module=JmjC::JmjN; Domain location=215-280::22-63
MVGVCEGNGEVLAWLKSMPVAPEYRPSAAEFQDPIGYIFKIEKEASKYGICKIIPPFPPSSRKTAIANLNRSLAEAGSTFTTRQQQIGFCPRRPRPVQRPVWQSGDRYTFSEFESKAKSFEKTYLKRHSKKGSGSGSGLGPLETETLFWKATLDKPFSVEYANDMPGSAFSPKCRRTGDPSSLADTPWNMRAVSRAKGSLLQFMKEEIPGVTSPMVYVAMLFSWFAWHVEDHDLHSLNYLHMGAGKTWYGIPRDAAVAFEEVVRVHGYGGEINPLEAANIATPEWLRFAKDAAIRRASLNYPPMVSHFQLLYDLALALCSRIPAGISAEPRSSRLKDKKKGEGETVIKELFVQDVLQNNDLLHFLGQGSAVVLLPRSSVDISVCSKLRVGSQQSINVSNSEGMHSSKGFVSDDLAFNRSHGIKQGKSFYSVKDKFSTLCERDRISSFDVNDNISISSSNPLQRDTERETCQGDGLSDQRLFSCVTCGILSFSCVAIVQPREPAARYLVSADCSFFNDSVVGWMKKNVQDGIHDVPFQSSQVALNMVSENGNTALALLASAYGNSSDSEEDQIAVDSHESNVINSASESLLSYTRDSHASPMTALDRGDYIPSKSSSYEDFIHRRLECFENTRTVANSTSNCSQDAHNAERSLSNNAMMVPFDNKKASMVLQSDEDSSRMHVFCLEHAAEAEQQLRPIGGANLLLLCHPDYPKIEAEAKMVAEDLGIDYMWKNIEYSHASKEDEEKIQSALDSEEAIPGNGDWAVKLGINLFYSANLSRSPLYSKQMPYNSVIYSAFGCSSPASSPVEPKVYQRRVNRQKKIVAGKWCGKVWMSNQVHPLLAKRDFEDIEDEKLLIGLILPDDKIERSESTPKSEATSRKSGKKRKKTAENGRFRKGSYANKNLLSDNSTEDKPNLLPRSILRSKKVRHVERDCAALKGGYSPPYHHRKPSNNQTNFTESYAVSDDSLDDDDHMQQRRNVKIEKAKFMDNDVVSNDTMDNDSDWQQREDVSSKQVEDTEGDAISEDSLDVGSLQLQRKTSKGKHPKYIGEEDIISDDQMESHFQKRQKRIPESRQGKYLTGKDIISDDQLELKMKKQQRRNPKSRQAKYLNEEDIASDDQLEGHY

SEQ ID NO: 215281 - protein, 563 aa, Glycine max
  Coding DNA Sequence Number=SeqID_98503
  Gene Ontology: Mol. function=nucleic acid binding; Cellular component= intracellular; Biological process=chromatin modification
  Homolog annotation: Hit_ID=Q9STM3; Match level="QueryCoverage=95%, HitCoverage=32%, E-value=9e-84, Identity=39%"; Hit description =Putative zinc finger protein
FNCGEAANIATPEWLRFAKDAAIRRASLNYPPMVSHFQLLYDLALALCSSIPASISAEPRSSRLKDKKKGEGETVIKELFVQDVLQNNDLLHILGKGSDVVLLPHSSVDIFVCPKLRVGFQQSINVRNSEGMHSSKGFVSDDVVFSRSQGIKQEKSFYSVKDNFTTLFERNRISSFDVNGNIRASSSNPLQRDNDRETGQGDSLSDQRLFSCVTCGILCFSCVAIVQPREPAARYLMSADCSFFNDWVVGSGVSSNKFTIALEEATIAEPNMYTGRFVSHVQNAGLHPVVLTLVYQGNGKQEHALVSSALYEAFMLCIWKHNLGWMKKNVQDGIHDVSVQSSREALNTESENGNTALALLASAYGNSSDSEEDQIADESHESNVINSASECLLSHTQDSYASPMTALDKGDDFPSTSASCEDVHRRFECNLSHQSLDHSLKKQDYNITSGVTFENTRTVPNSTSNCSQQAHNADRSLSNKSMVAFDNKNTSMVLQADEDSSRMHVFCLEHAAEAEQQLRPIGGAHILLLCHPDSEFKLVKKQGNHGYKTMSLVMGIMSVYVAK

SEQ ID NO: 215282 - protein, 259 aa, Glycine max
  Coding DNA Sequence Number=SeqID_98504
  Gene Ontology: Mol. function=nucleic acid binding; Cellular component= intracellular; Biological process=chromatin modification
  Homolog annotation: Hit_ID=Q9STM3; Match level="QueryCoverage=99%, HitCoverage=21%, E-value=1e-89, Identity=58%"; Hit description =Putative zinc finger protein
  Pfam annotation: Domain name=JmjC; Domain location=199-259; Score =9.4; E_value=9.8e-05; Accession=PF02373.13; Description=JmjC domain
  Pfam annotation: Domain name=JmjN; Domain location=22-63; Score=42.2; E_value=1.7e-09; Accession=PF02375.7; Description=jmjN domain
  Pfam module annotation: Pfam domain module=JmjC::JmjN; Domain location=199-259::22-63
MVGVCEGNGEVLSWLKSMPVAPEYRPSAAEFQDPIGYIFKIEKEASKYGICKIIPPFPPSSRKTAIANLNRSLSEAGSTFTTRQQQIGAAIATPQRVRVQSQVLREDIPQTHSKKGSGSGSGLGPLETETLFWKATLDKPFSVEYANDMPGSAFSPKCRHAGDPSSLADTPWNMRAVSRAKGSLLQFMKEEIPGVTSPMVYVAMLFSWFAWHVEDHDLHSLNYLHMGAGKTWYGVPRDAAVAFEEVVRVHGYGGEINPL

SEQ ID NO: 215283 - protein, 72 aa, Glycine max
  Coding DNA Sequence Number=SeqID_98505
MSLPLFFPEKIRYEAEQGLVELTSRMCPFLPLAGFLVILLLPPQRFNIFGLGSVVMSRLMMGLLRLKRSQRR

SEQ ID NO: 215284 - protein, 90 aa, Glycine max
  Coding DNA Sequence Number=SeqID_98506
  Homolog annotation: Hit_ID=Q2QTX4; Match level="QueryCoverage=38%, HitCoverage=9%, E-value=8e-08, Identity=65%"; Hit description =Exodeoxyribonuclease III family protein, expressed
MAKPTLKLLLCLDCHPLLKIESIASQLADSMEHAPGGSWWMPTDFCMKIRTWSEVSHGLETQWEGFYGSDHCPVTLELSPSSNSQNEDPI

SEQ ID NO: 215285 - protein, 91 aa, Glycine max
  Coding DNA Sequence Number=SeqID_98507
MQHWQDPFDLYYVMVLQKQALCVSPLEIHGHGAKKEAVILNTPSQDDPIQQQPAVLARVDIYNEFCYVLKTRTLGERRIQCEHSVYQPNRS

SEQ ID NO: 215286 - protein, 147 aa, Glycine max
  Coding DNA Sequence Number=SeqID_98508
  Gene Ontology: Mol. function=catalytic activity; Biological process =metabolic process
  Homolog annotation: Hit_ID=Q2QTX4; Match level="QueryCoverage=75%, HitCoverage=35%, E-value=2e-22, Identity=41%"; Hit description =Exodeoxyribonuclease III family protein, expressed
MKRFFKVVEKDSDGSVKKPRENDSEAEESNEKKEPLKFMTWNANSFLLRVKNNWPDFTNLITTFDPDLIAIQEVRMPAAGAKGASKIQGEIKDDTSAAREEKKDWTHCWSAPSLAGGGDGYLQGTPYSSWCVINVVRVFRLKVGRYG

SEQ ID NO: 215287 - protein, 738 aa, Glycine max
  Coding DNA Sequence Number=SeqID_98509
  Gene Ontology: Mol. function=isomerase activity; Cellular component =cytoplasm; Biological process=protein amino acid phosphorylation
  Homolog annotation: Hit_ID=Q8LDN5; Match level="QueryCoverage=94%, HitCoverage=99%, E-value=0.0, Identity=68%"; Hit description =Topoisomerase-like protein
  Pfam annotation: Domain name=MA3; Domain location=158-269; Score =156.8; E_value=5.8e-44; Accession=PF02847.7; Description=MA3 domain
  Pfam annotation: Domain name=MA3; Domain location=322-433; Score =159.5; E_value=8.8e-45; Accession=PF02847.7; Description=MA3 domain
  Pfam annotation: Domain name=MA3; Domain location=456-567; Score =146.3; E_value=8e-41; Accession=PF02847.7; Description=MA3 domain
  Pfam annotation: Domain name=MA3; Domain location=619-728; Score =157.2; E_value=4.2e-44; Accession=PF02847.7; Description=MA3 domain
  Pfam module annotation: Pfam domain module=MA3::MA3::MA3::MA3; Domain location=158-269::322-433::456-567::619-728
MENNVFVMAAKSSTSVVQCMRVVLLKKNAFGKIVMLFEGFLTDGQREILKIASQNVENLSSSPKSPSSLLAEHHHHVRAPSGGGKAQTAGHAARNVRRSHSGKYGRAKKDGAGGKGTWGKLLDTDGESRIDKNDPNYDSGEEPYQLVGSTVTDPLDDFKKAVVSIIEEYFSNGDVDLAASDLRELGSNKYYPYFIKRLVSMAMDRHDKEKEMASVLLSALYADVISPAQIRDGFFMLIESADDLAVDILDAVDILALFLARAVVDDIIPPAFLARAKKALPEPSKGVQVIQTAEKSYLSAPHHAELVERRWGGSTHITVEDVKKRIADLLREYVDSGDTLEACRCIRELGVSFFHHEVVKRALVLAMEIHSAEPQLLKLLKEAAEEGLISSSQMVKGFSRLEEVLDDLALDIPSAKTQFQSLVPKAISEGWLDASFLKPSSEDGDIVVEDEKVRKYKKEVVTIIHEYFLSDDIPELIRSLEDLGAPEYNPIFLKKLITLAMDRKNKEKEMASVLLSALHIEIFSTEDIVNGFVMLLESAEDTALDILDASNELALFLARAVIDDVLAPLNLEEISSKLPPKCSGSETVRMARSLVAARHAGERLLRCWGGGTGWAVEDAKDKIMKLLEEYESGGVVSEACQCIRDLGMPFFNHEVVKKALVMAMEKKNDRMLDLLQECFSEGLITINQMTKGFTRIKDGLDDLALDIPNANEKFSFYLEHALKKGWLLPSFDSTATDV

SEQ ID NO: 215288 - protein, 399 aa, Glycine max
  Coding DNA Sequence Number=SeqID_98510
  Homolog annotation: Hit_ID=Q1S7C5; Match level="QueryCoverage=36%, HitCoverage=14%, E-value=8e-19, Identity=31%"; Hit description =Integrase, catalytic region
MAAQSNAFLAPSFPHSIAHKLDDLTFLLWRQQVEPVIKSHCLQCFVVNPQIPLRFLSEEDHEAGIESPVYEVWHQQDQVLLTWLQSTLSTSIASRQLRTQLQATNLGGKSMHEFLSQIKALLDALASFGSLIMLQEHVDSILEGLPSDYHSIIAIIESLNLSRSTLSDSPSINYSQAHRKSLAVSSNDYSMPNKTNPESFLAFRGGSGCGGGGGHGRGGGRFANFQCQYYQPNSTLVLHDPLSPNYSQATSTQSQKITTIIHRIVTIMAKILVILDLLMFELITITNLPVTIISPILVLCSQMLNLNPIPLIGFQILVLHFMLLENHKTSNNYSLSEGPDPVLSNGGYGGAMAVLCGGFFEKTPPNSGGVAGFKWRCHGGRRRLNDGGRMAVMMEETFF

SEQ ID NO: 215289 - protein, 77 aa, Glycine max
  Coding DNA Sequence Number=SeqID_98511
METEIRIPCLARISSEDRRREWIWESEEAKKRNEMDENMKGKGAPTSQAFIYKDGTNTSLYPRVSAMCPVFNRHLPR

SEQ ID NO: 215290 - protein, 520 aa, Glycine max
  Coding DNA Sequence Number=SeqID_98512
  Gene Ontology: Mol. function=binding
  Homolog annotation: Hit_ID=Q6PGP7; Match level="QueryCoverage=61%, HitCoverage=21%, E-value=3e-10, Identity=23%"; Hit description =Tetratricopeptide repeat protein KIAA0372
  Pfam annotation: Domain name=TPR_1; Domain location=137-170; Score =18.2; E_value=0.03; Accession=PF00515.18; Description=Tetratricopepti de repeat
  Pfam annotation: Domain name=TPR_1; Domain location=228-261; Score =14.7; E_value=0.095; Accession=PF00515.18; Description =Tetratricopeptide repeat
  Pfam annotation: Domain name=TPR_1; Domain location=262-295; Score =22.5; E_value=0.0015; Accession=PF00515.18; Description =Tetratricopeptide repeat
  Pfam annotation: Domain name=TPR_1; Domain location=351-384; Score =21.8; E_value=0.0024; Accession=PF00515.18; Description =Tetratricopeptide repeat
  Pfam annotation: Domain name=TPR_2; Domain location=137-170; Score =19.9; E_value=0.0094; Accession=PF07719.7; Description =Tetratricopeptide repeat
  Pfam annotation: Domain name=TPR_2; Domain location=228-261; Score =19.6; E_value=0.011; Accession=PF07719.7; Description=Tetratricopepti de repeat
  Pfam annotation: Domain name=TPR_2; Domain location=262-295; Score =20.7; E_value=0.0052; Accession=PF07719.7; Description =Tetratricopeptide repeat
  Pfam annotation: Domain name=TPR_2; Domain location=351-384; Score =22.5; E_value=0.0015; Accession=PF07719.7; Description =Tetratricopeptide repeat
  Pfam annotation: Domain name=TPR_2; Domain location=431-464; Score =0.3; E_value=30; Accession=PF07719.7; Description=Tetratricopeptide repeat
  Pfam annotation: Domain name=TPR_2; Domain location=480-513; Score =10.5; E_value=2; Accession=PF07719.7; Description=Tetratricopeptide repeat
  Pfam module annotation: Pfam domain module=TPR_1::TPR_1::TPR_1::TPR _1::TPR_2::TPR_2::TPR_2::TPR_2::TPR_2::TPR_2; Domain location=137 -170::228-261::262-295::351-384::137-170::228-261::262-295::351 -384::431-464::480-513
MAEKLGAAEESSNSKAFHHTATKLVVLADLNVDPPEAEAEEVDSSLVPPPPITILGNDENSQDKSSLSKDTDSIEGESKKLNKLSKSRSRKTDSSLDCVADVDGDQHVQGPPSSREEKVSSVKTGLVHVARKMPKNAHAHFILGLMYQRLSQPQKAVLAYEKAEEILLRPEAEIDRPELLSLVQIHHAQCLILESSSENSSDKELEPHELEEILFKLKQSVRSDIRQTAVWNTLGFILLKTGRMQSAISVLSSLLSIAPENYDCLGNLGIAYLQIGNLELSAKCFQELILKDQNHPAALVNYAALLLCKYASVVAGPGAIAAEGALTDQIMAANVAKECLLAAVKADSKSAHVWANLAYAFSISGDHRSSSKCLEKAAKLEPNCMSTRYAVAIHRIKEAERSQDPTELLSCAGNEMASIIRDSDSSLVEIPIVWSGLAMVHKAQHEIAAAYESEQNGLREVEERAVCSLKQAIAEDPNDAVQWHQLGVHSLCARQFKTSQKYLKAAVACDKDCSYAWSNL

SEQ ID NO: 215291 - protein, 99 aa, Glycine max
  Coding DNA Sequence Number=SeqID_98513
  Gene Ontology: Mol. function=cysteine-type peptidase activity; Biological process=ubiquitin cycle
  Homolog annotation: Hit_ID=Q2QTR5; Match level="QueryCoverage=85%, HitCoverage=12%, E-value=3e-23, Identity=63%"; Hit description =Expressed protein
MKQVEVRRSLHSRLGLPYDRPLLRISNALDFSKLKNNDMVSLQKGSTLLRDVHIGIPSSGVTGGTVSLVQGSYEYFHYLHNGYNDSAVANYGLDMGKVI

SEQ ID NO: 215292 - protein, 923 aa, Glycine max
  Coding DNA Sequence Number=SeqID_98514
  Gene Ontology: Mol. function=DNA-directed DNA polymerase activity; Cellular component=DNA polymerase III complex; Biological process =DNA replication
  Homolog annotation: Hit_ID=Q9SB72; Match level="QueryCoverage=93%, HitCoverage=99%, E-value=1e-172, Identity=43%"; Hit description=DNA polymerase III like protein
  Pfam annotation: Domain name=AAA; Domain location=333-516; Score= -4.8; E_value=0.00049; Accession=PF00004.19; Description=ATPase family associated with various cellular activities (AAA)
  Pfam annotation: Domain name=DNA_pol3_delta; Domain location=374-644; Score=-78.1; E_value=0.012; Accession=PF06144.3; Description=DNA polymerase III, delta subunit
  Pfam module annotation: Pfam domain module=AAA::DNA_pol3_delta; Domain location=333-516::374-644
MDGRRHSVDIPISKTLVALRRVRSLRDPTTNSMSKLSSLVDNVHWENGSANEISLRFSDATRLCDSDDNAAFRSRNLGFKGHREPDDADFVLNHGLLNSRLKPSGMSCKDDQRDDELVYSKPNLQCTSGDKSPSESCGSNHGGKGLDLACIVLPSNNFKDGDSCYVGTARSSQLGRIDCSKSAKKSLRKNQVNPSELAGSIASNEGSPCPSGYDAFSPYCASVGINQDVDVLDNNDNGCGISCCWSKSPRFRESNLYGEIEDRPLITHRVDETDLHAHRSMRHNGGGGISPTLETPRSLSMKFRPKSFSDLVGQNVVVRSLLGAISRGRITSFYLFYGPRGTGKTSASRMFAAALNCLSVVEQRPCGLCRECVLLFSGRSKDVKEVDSVRINRADQVKSLIKNASIPPVSSRFKVFFIDECQLLNGETWASISNSLENLSQYVVFVMITPDLDKLPPSAVSRAQRYHFPKVKDADIVCRLEKICAEEGLEFEQDALDFIAAKSCGSVRDAEMMLDQMSLLGKKINISLAYELTGIVSDDELLDLLDLALSSDTSNTVIRARELMRSRIDPLQLVSQLANLIMDILAGKCENGGSEVRSRFSRRYSSEADLQKLNNALKVLSDTEKHLRFSKNQTTWFTVALLQLSSVDCQSVDANDTKLSLRGACNGGQSLEHFDTGLCDNKSYRLEVPEDHKGTLDSIWYKATEMCHSGQLKNFLRKKGKLSSLHVDRSTACLAIAELEFHHRHHVSKAEKSWKAIASSMQFILGCNIELRITYAPCASDPKSPYHLNERGSESDYADNNSENPKKDRTSTSDCGMDAATALRSSEGNLLSSGERFLNRSFQETKRTSFAKVDFSKEEGYNCAHLDPSMLDSDNNHSNCFPKTLWLQKKFRSSYSSKLTFQGILPQKDFVVSVPKKCTCSGT

SEQ ID NO: 215293 - protein, 80 aa, Glycine max
  Coding DNA Sequence Number=SeqID_98515
MILEMDLSPTDQDTNASIEGMPLAQGSLLVKVGIVQDSLPAKIGNLVQKAALFKLKTLNKNNSISRISVGNIKDMKDNLA

SEQ ID NO: 215294 - protein, 356 aa, Glycine max
  Coding DNA Sequence Number=SeqID_98516
  Gene Ontology: Mol. function=cysteine-type peptidase activity; Biological process=ubiquitin cycle
  Homolog annotation: Hit_ID=Q2QTR5; Match level="QueryCoverage=96%, HitCoverage=51%, E-value=2e-43, Identity=33%"; Hit description =Expressed protein
MADDSNRSVRLLCRPKQLNTKGSDPGIHFWLIGSPFFPPLTVASFLRRIHTLPSSASPDLPKESEDLRTLIPKGFEVVGALASGDDTHARTAVDAARALMNLLYGDGTDRPVIGAVCGSDSGELRFVVSESENATGLESVSSVIEERDSEKFVWENGCLLHCELPIKLPLYYSLKNPTDVEKSYAQVTESVIAKLRDPQAVYMLEMSNKASRDISPPVIIRGVQLDFSTDLSKIKPLAEDDDGFNASSLSCSYFSISSKAGSPVFSAEGHHQLLLCLLQNTFQLLVIEIELLISVQEETRLLVVDIKLDVLCYSSRELPLKYAVSNLIIPGLVDQLNVVQKLMLPNLLAQHPRVRQ

SEQ ID NO: 215295 - protein, 262 aa, Glycine max
  Coding DNA Sequence Number=SeqID_98517
  Homolog annotation: Hit_ID=Q2HSY3; Match level="QueryCoverage=43%, HitCoverage=63%, E-value=2e-07, Identity=25%"; Hit description =Nucleic acid-binding, OB-fold
MTLGCRLGRLNSIAEIDDQKETWKIVVRVINMWIIPRSPKFIVELNLVHKKTYVIHNFEVEKNNGHYKATRHGFKINFVKATKVTPHKILEILETMYNFTMFDDIVSGSTNTDFSIDVIGEVVEIVQWNLHGKPKKVVFTMKDGWFRMDVIVGQPHESAIFTLWDRECYALIKETAAEIKQKMIDKDEVLPSISMMNEINDASESQCFSATTESDPTLLGSITLAKHILPLSHSQLDEISFEDLSSIQLSLTRLDKKHIKTE

SEQ ID NO: 215296 - protein, 127 aa, Glycine max
  Coding DNA Sequence Number=SeqID_98518
MTSQKNQLSVTDNVSLSARRKINAICHRTTILCDCLTMSHFFMKERMVALDGEYSAGERIEKTSNLKEHDDKLEGQIKKELEEDLVTKDINKGDEGEMVVRKIVVDGKVGEESRPTSPFSETKEWQG

SEQ ID NO: 215297 - protein, 173 aa, Glycine max
  Coding DNA Sequence Number=SeqID_98519
MTRPTRKPPQRVARCPWHHWCKVQQHEPGPGSAAALQQWWRRFDGGRVGLADDHGGVTTKGGAVVRKEEEEEGGEEEETEKKNKEKRRKHESERVRNKGLLDEKRRKHESERVRNEGLPNGPSSSLTKLIKLHHWIGSFFFLGSVPHSSVSFAETFLFFLLCNLLSLDLMGSL

SEQ ID NO: 215298 - protein, 137 aa, Glycine max
  Coding DNA Sequence Number=SeqID_98520
  Homolog annotation: Hit_ID=Q2R1R7; Match level="QueryCoverage=80%, HitCoverage=6%, E-value=6e-21, Identity=47%"; Hit description=AT hook motif-containing protein, putative
MDGYMHDIFKTCARQNILDSLLVTKLKEMLDEHNVFAKSFRMAKDRYDYFQIENLNLLLITDGKKDGRIYNLPIVLEVAAVIVGDANQSINRDIILERQSGHLQRINELHPSYLGLQYPFLFPYGEDGTAVISNIEI

SEQ ID NO: 215299 - protein, 169 aa, Glycine max
  Coding DNA Sequence Number=SeqID_98521
  Subcellular localization annotation: CTP_CleavageSite=19; ConfidenceScore=5.01e-01
MMTKVMTKSSKVNQRMSSRCSRRNQEQFKTQEEKLKNTSRFKKKDEFKNQDSRIKLQESRSRFKIEDSRIKRRLNQDKGYIYLGLTENKRGYISCGSVLVEGTSTRFKENKGGYIPCGSLLAKYYELAKIMMQITRTEEMFNTIIAKDQTYGEVSRPFVVRWKDQLEHH

SEQ ID NO: 215300 - protein, 508 aa, Glycine max
  Coding DNA Sequence Number=SeqID_98522
  Gene Ontology: Mol. function=RNA-directed DNA polymerase activity; Cellular component=chromatin; Biological process=chromatin assembly or disassembly
  Pfam annotation: Domain name=Chromo; Domain location=388-441; Score =13.0; E_value=0.028; Accession=PF00385.14; Description='chromo' (CHRromatin Organisation MOdifier
  Pfam annotation: Domain name=rve; Domain location=157-313; Score =66.8; E_value=7e-17; Accession=PF00665.16; Description=Integrase core domain
  Pfam module annotation: Pfam domain module=Chromo::rve; Domain location=388-441::157-313
MGVILSQKNHPIAFFSKLFCPTLLCASTYVRELAAITTAELQKELNANPLFLEYRRRIQDNPSEHPDCTITQNFILQKCRLWLPKDSPIISTILTKFHSTPTGGHMGLAKTLARVGENFIWTSMMKDIKLFIATCLVFQQTKNDHCKSVGLLCPLPVQTRPWEDLSLDFIVGLPPYQGHSTILLIFDRFSKGMHLGLLPAHYTAFEVAKVFMEISGKLHSTPRSLVSNRDPLFISHFWQELFKLNGTTLRMSTIHHPKMDRQTEVMNRVIEQYLRAFVHDKLTMWDHFLMWVEWSYNTSTHLATGMSPYEITFGKKPPTLPQYLAGDSNVDVVDTWIGPVAYKLALPPTSRIHPVFHCSILRPYRPPLSSTETPILLPSSAEDNQPIITPLTILTTKWQGSGSLRQLLVLVQWSGLLPEDTSWEPWLTLKETYILEDKVVFDAHGNVIAKDIEHQHPEQESSKKHQEAETEPESEAIQVWHGMLSTAASGNAANDPEFLLSAKVAPFC

SEQ ID NO: 215301 - protein, 66 aa, Glycine max
  Coding DNA Sequence Number=SeqID_98523
MRHNVIAKDIEHQHAEQESSKKHQEAKTEPESEAIQVWHGMLSTAASGNAANDPEFLLSAKVAPFY

SEQ ID NO: 215302 - protein, 52 aa, Glycine max
  Coding DNA Sequence Number=SeqID_98524
MGRSLSPNPSIRYCILHVHQKETEVEKECNKTRREQLTPGDLRPLPPKAKAN

SEQ ID NO: 215303 - protein, 207 aa, Glycine max
  Coding DNA Sequence Number=SeqID_98525
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=62%, HitCoverage=8%, E-value=6e-34, Identity=49%"; Hit description=Chromo
MAEATRMKDLVADLKQVTDIVSKHDSATTPHDSATIDTHRGYSSILPMHTQYYHPFRGLSYHKHPDWSFVVKNPIVTGEWLFRAEQFSSYYETSDAQKLTIVAVHFEGPVVPWFQMLQKANLIPTWAALAQAIEKQFGPSQFDSPRAQLFKLSQTNSVADYYTKFMTLANRVEGLTEPALLDCFISGLRDPIRRDVIAQSPPTLLRA

SEQ ID NO: 215304 - protein, 97 aa, Glycine max
  Coding DNA Sequence Number=SeqID_98526
  Gene Ontology: Mol. function=3'-5' exonuclease activity; Cellular component=intracellular
MAMTMTASNNNPTVFFNPTTSKYLAGKQRVVGLDTEWIPVEKTKKKVAILQLCIENKCLIIQLFHMDNIPQSLRSFLMDSNFEFVGVGVMKDLMMLN

SEQ ID NO: 215305 - protein, 956 aa, Glycine max
  Coding DNA Sequence Number=SeqID_98527
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=90%, HitCoverage=67%, E-value=0.0, Identity=42%"; Hit description=Chromo
  Pfam annotation: Domain name=rve; Domain location=649-775; Score =33.0; E_value=1e-06; Accession=PF00665.16; Description=Integrase core domain
  Pfam module annotation: Pfam domain module=RVT_1::rve; Domain location=243-495::649-775
MAPPSPVVESDSTALLHHLSLQAYQGSPSCATIRFKGFIAGKLVQVLLDGGSSNSFIQSRLAHNLQLPMEPTADVKVMVGKEHYLHAEGVVRDLPLIISGQTIRFPAYVLPVLGAVVVLGASWLATLGAHIADYSSTSIKFYLDDAFVTLQGDTSYCHSVAQFHHLKRYSATHAIAELYTLSCSPHDSSVTHSMDLPADLHPDLVAIIRQFFMVFDVPKGLPPPRTQDHSIPLQDGLIQPSTSPFSASVILIRKKDGSWCFCTDYRALNVVTVKDSFPIPTVDELLDELKGSKFFSKLDLRFGYHQILVRPEDCHKIAFRTHNGHYEWLVMPFGLTNAPVTFQALMNDHLAIVLDCLRQHQLFAKLSKCSFGQHKLEYLGHIVSDQGVEMDPSKVQAVQDWPCLAIVTQLKAFLGLTRYYCRFINRYASIAGPLTDLLQKDDFRWTSEADNGHPIAFFFKKLSSRMQKQSAYVRELYAITEAVAKFCHYLFGHYSIIWTDQRSLKHITDQIIQTPEQESLLPKLLDFNFSIEYKPGPTNQVADALSWSFYMALSNPQANLLNDIKGVVASSPTMQQLIQQFQYDPASMPQHKLRNGLLFLHHCVIIPIEARELITRILLEFHSSPIGGHVGFLRTYARLATYFFWHDMRKDIFWEDVAMDFITGLPLSKGYYVILVVIDCLSKFAHFASLRSNFTAQQVAEVFLQNVGTSLRISSVYHPQTDGQSEALNKCLEMYLRCFVSENPHLWVSFLPWAELWYNSSFQTSIGMTPFNILYGRDPPTIIPSVVRDDTPFDVHVQLRTEVVFQVGDFVFVKLQPYQQHSVRLQRHQKLSIHYFDPFKVLERIGNVAYKLELPSDAKIHPVFHVSLLKLCQGDPVSQYIPLPPISSSGGSQLQPIVVLDTHKVLFDGEGNVMIKNAEGVTSKEHMEGDPSRKDNVHNSVRRSNRMRNVPARFRN

SEQ ID NO: 215306 - protein, 81 aa, Glycine max
  Coding DNA Sequence Number=SeqID_98528
MGELEYAELRQGGTKQLNIQFFKTIQARMRDPNYQFSPDVKLKPKSKLVREKYGKRQSSEGEKYEKDNIEAEVRLIMLFCL

SEQ ID NO: 215307 - protein, 101 aa, Glycine max
  Coding DNA Sequence Number=SeqID_98529
  Gene Ontology: Mol. function=transcription cofactor activity; Cellular component=nucleus; Biological process=regulation of transcription, DNA-dependent
  Homolog annotation: Hit_ID=Q1S7L7; Match level="QueryCoverage=72%, HitCoverage=19%, E-value=3e-07, Identity=45%"; Hit description=Zinc finger, TAZ-type; BTB/POZ
  Subcellular localization annotation: CTP_CleavageSite=70; ConfidenceScore=5.16e-01
MDSPAVSSIHFHNAHVLPEPDLFMHTPGGFGIPSFRKRHCVQPSRQNPRRSRRRRHGLRSVPLLLQELIGCAQVHGGGHGQVRNPPSSIVARVFGAAAEAE

SEQ ID NO: 215308 - protein, 639 aa, Glycine max
  Coding DNA Sequence Number=SeqID_98530
MWLRNLLNVWPFRVDELRDSKQLVKKLSVPEDTKQFVFAVRDPQTQTLIYILSVLNLSERSASDATCLIREIKPDAVLVQAAAAAAAAVSPFSQLQSEEEEQQHFVPLPTSSFGVLKRCLVDTIGTDKYETVAGNFVLREIFGTSFHGPLLAAKRAAEDVGSSFFVIESPSPSPSCWGNNSNNNSDSDCNNGGGVVDSGSHFRSLVNCLVPQQHAASWAPSALKRFSLDKELRMMLAKALSWNSGPLLLSSSVLERGSIEEIRPSSSYETPGFARSIYPLLEDLYSIFGDLPSLGKALAHVQKMLLDVNRGEVLDKSTVSEVYTFRIAVEGLRIALNNKGLRPVNGKGAAKSDKIEFSDLPIDDKSHALFAQAIRSQAVKFKTIVVVVDASALAGLRKHWDTPLPVEVKELIGELITNSEGKGVMLNHNEKKRLLTDKSMVAVGAGATAVLGASSLTKVVPASTLVKVVTFKIPTSLKIGLSQMQKVLAFAFGPSKVVAPGIATSGAKTSGIMKAAVSTEKIRGVAHSVIASAQKNSISVMRTAFYEIMRKRKVQHVGFLPWATFAGSIGTCSGLLFYGDGIECAVESLPAAPSIASLGRGIQHLREASQAVMQTEGSPELSPPSPARCNSSLANCCKR

SEQ ID NO: 215309 - protein, 294 aa, Glycine max
  Coding DNA Sequence Number=SeqID_98531
  Gene Ontology: Mol. function=DNA binding; Biological process=DNA integration
  Homolog annotation: Hit_ID=Q1SH28; Match level="QueryCoverage=71%, HitCoverage=20%, E-value=5e-27, Identity=33%"; Hit description =Integrase, catalytic region
  Pfam annotation: Domain name=zf-CCHC; Domain location=43-60; Score =5.3; E_value=0.13; Accession=PF00098.13; Description=Zinc knuckle
  Pfam annotation: Domain name=zf-CCHC; Domain location=81-98; Score =11.3; E_value=0.013; Accession=PF00098.13; Description=Zinc knuckle
  Pfam module annotation: Pfam domain module=zf-CCHC::zf-CCHC; Domain location=43-60::81-98
MDPMPAISKKFLYVAQQEHQLSGNTSLNLSLEPKENSINAVKTVCDFCGRVRHTKNVCYSKHGIPSNYDGKNKGNNTRSGKTCTHCGKNGHTVDICYRKHGFPLGYKFYNGKTTANNIVAVDSRATDYQIQHQESQEAICFSLEQYKALLALIQQPSFGNTAFTKPQDTNTQARIGTVEVRHDLYQLTPDHIIPHTICSTTVRPQCNIIPIDLWHFRMGHPSSERLQCMQSYYPFLQNNKNFTCNTCHYAKHKRLPFSSSNSHASNSFDLLHIDIWGPCSKISMHGHRYFFNYC

SEQ ID NO: 215310 - protein, 161 aa, Glycine max
  Coding DNA Sequence Number=SeqID_98532
MGCHHRRIKHKASHISSMADWEGVEKECIGVDVMQDRGNTSLGCKRLFGGGSDLQSSFTNMERGLDMYYHIPIAKNGETRNSKCNLGKDIAVANRIGPGEVYDEELLSMGTTLRQRASGDDHVFQPPPLTPKQDDTLASKNQPGDNDEAKSLRVRDFHNQE

SEQ ID NO: 215311 - protein, 113 aa, Glycine max
  Coding DNA Sequence Number=SeqID_98533
MALRELSRDRMCACVAQNCQLGADPEAVTHNFCVVHAICCYCMLQGSSFSCMLITLSEIKELRWWSGGDSYHLTPDSGMTSLLVAKDYSSVMHRAPPIFSRISVYYVGFWMKY

SEQ ID NO: 215312 - protein, 405 aa, Glycine max
  Coding DNA Sequence Number=SeqID_98534
  Gene Ontology: Mol. function=cysteine-type endopeptidase activity; Cellular component=endoplasmic reticulum; Biological process =proteolysis
  Homolog annotation: Hit_ID=P25803; Match level="QueryCoverage=99%, HitCoverage=100%, E-value=1e-175, Identity=76%"; Hit description =Vignain precursor
  Pfam annotation: Domain name=Inhibitor_I29; Domain location=40-95; Score=65.2; E_value=2.2e-16; Accession=PF08246.2; Description =Cathepsin propeptide inhibitor domain (
  Pfam annotation: Domain name=Peptidase_C1; Domain location=128-387; Score=408.5; E_value=9.6e-120; Accession=PF00112.13; Description =Papain family cysteine protease
  Pfam module annotation: Pfam domain module=Inhibitor_I29::Peptidase _C1; Domain location=40-95::128-387
MAMKKLLWVVLSLSLVLGVANSFDFHDKDLASEESFWDLYERWRSHHTVSRSLGDKHKRFNVFKANVMHVHNTNKMDKPYKLKLNKFADMTNHEFRSTYAGSKVNHHRMFQGTPRGNGTFMYEKVGSVPPSVDWRKNGAVTGVKDQGQCGMGEGCCTQPYPCICKEAVSGFEPMTNRSPRHNFTAAPGLALLCSCWAFSTVVAVEGINQIKTNKLVSLSEQELVDCDTKKNAGCNGGLMESAFEFIKQKGGITTESNYPYTAQDGTCDASKANDLAVSIDGHENVPANDENALLKAVANQPVSVAIDAGGSDFQFYSEGVFTGDCSTELNHGVAIVGYGTTVDGTNYWTVRNSWGPEWGEQGYIRMQRSISKKEGLCGIAMMASYPIKNSSNNPTGPSSSPKDEL

SEQ ID NO: 215313 - protein, 109 aa, Glycine max
  Coding DNA Sequence Number=SeqID_98535
  Subcellular localization annotation: CTP_CleavageSite=51; ConfidenceScore=5.17e-01
MNLTDQSHLYTSSGSFVMHDAQDRTNTVYSYYLLDPTSVSVSWVGNKPNMRASVTVNLAVLAECDRQIRLKMEQENMKDDARWKLLVRKVASAKALSSLALPKRKLDQS

SEQ ID NO: 215314 - protein, 349 aa, Glycine max
  Coding DNA Sequence Number=SeqID_98536
  Gene Ontology: Mol. function=DNA binding; Cellular component =membrane; Biological process=DNA integration
  Homolog annotation: Hit_ID=Q1RYT8; Match level="QueryCoverage=82%, HitCoverage=71%, E-value=1e-43, Identity=40%"; Hit description=IMP dehydrogenase/GMP reductase
MQAELQALQLNNTWTLTTLPPHKTVIGCRWVYKIKYQVDGSIERYKARLVAKGYTQMEGLDYLDTFSPVAKLTTVHLLLALAALHNWHLHQQVYMHVPPGLSVDKPHLVCRLQRSCTGSSKPAGNGLLASLRSLFPMIFNNLPLIIPSSCASMDLGNLKFFLGLEIARSSRGIHLCQRKYTLDILSDSGMFGSHPTSTPMDYSTCLQASSGTPLSSESSSSYHRLGVGILDAPSLGFLFISVPPTSPGNQRSNPQSLAAFPKLNVSTIQIASNLVFHKRTKNIEVDCHIIRHKININLIKLLPVSSSMQLADIFTEALSPAIFQGLCSKLGMMNLHSQLAGSSQQQLVN

SEQ ID NO: 215315 - protein, 109 aa, Glycine max
  Coding DNA Sequence Number=SeqID_98537
MGGFGCGKRPMRQEFRPCALLVELKCPKRALKLIWGGILGSVLELRSRGVDKGSIASDTSTILDFVFLKLNDCHHLGLEMKQLKGMWEANNLISEAFNINEVLDHYATL

SEQ ID NO: 215316 - protein, 187 aa, Glycine max
  Coding DNA Sequence Number=SeqID_98538
MDILNQIFHPDDISVVIHTLVAAVNFEDKLIGSKSQADVMEGYLLEATWGCEESNGSNNVGTQGHKQNHRGPRGGGSNSYSTVNVANSSHGDNQQDIGISSSSNSSHGISKEQPQQIAHALSMMNATGNMMLMQMLQTRDKIDISPTNKREHYHQLLRIKPPMCSFECNMDATLFEESNRIALLQIM

SEQ ID NO: 215317 - protein, 61 aa, Glycine max
  Coding DNA Sequence Number=SeqID_98539
MGEIQDDVISLKLATKLSRAVFVGLGPLVPIPKLARRILLFLFLATKICSLTLYGRIGDGS

SEQ ID NO: 215318 - protein, 634 aa, Glycine max
  Coding DNA Sequence Number=SeqID_98540
  Homolog annotation: Hit_ID=Q00M75; Match level="QueryCoverage=7%, HitCoverage=7%, E-value=3e-07, Identity=62%"; Hit description=PPR -repeat containing protein
MVLLNYMSSYAWHAKVVLTLAAFAVIFGEFWLVAQLSAENTLAKSVALLKQLPDIAENFMSLKPHFEALIRLVKAAMDVTMCIVEFKELPSEYISEDTPPMSVASTHIPIASYWVIRSIVACSSQIASLVGMRNESISSTTEAWELSSLAHKVSSIYEHLKNQLVLCYQYIDDKRHIEAFHNLIRLFETVHVDNMKILRALIYAKDDVLPLVDGTTKSRVSLEVLRRKHVLLLISDLDLSQEEILVLDNLYKDARARGDTHYEMVWIPVVDKATWNETSKQKFEYLQSLMAWYSVYDPFIIEPSAIKYIKEVWNFSKTAILVALDPQGKLSSPNVVHMLWIWGNLAFPFTSEKEESLWKQEIWSLELLVDGIDPTVLEWMTDGKLICLYGGEDLEWIEKFTTTAISVAKAGKFELEMAYVGKSNAKERMQKMIKTFTTRKFSYFWPNVTSIWFFWTRLESMLYSKLQHGRTVENDDIMSQVMTVLSFDGSDRGWAIFCRGATEMARAKGDSALICLQDFDKWKDRIEEDGVVQAMNDYLNKNKPPHHCNRLILPGSTGGIPQKVVCAECGRQMEKYFMYRCCVDKAASPGVAVKLCLGDLLVMGSNPKTVSLHMQECIPPPYLRIAKSLWAMGY

SEQ ID NO: 215319 - protein, 390 aa, Glycine max
  Coding DNA Sequence Number=SeqID_98541
  Gene Ontology: Mol. function=ubiquitin-protein ligase activity; Biological process=vesicle-mediated transport
  Homolog annotation: Hit_ID=Q08ET6; Match level="QueryCoverage=83%, HitCoverage=78%, E-value=1e-121, Identity=62%"; Hit description=RING- finger protein
  Pfam annotation: Domain name=Copine; Domain location=92-230; Score =244.2; E_value=2.7e-70; Accession=PF07002.6; Description=Copine
MGLQQPHFPQSQDNGSVGHYGYSPQSYGGGRAPEQGKSLDRKYSRIGDDYKSLDQVTDALAKAGLESSNLIVGIDFTKSNEWTGGRSFQRRCLHHIGHEQNPYEQAISIIGKTLSSFDEDNLIPCFGFGDASTHDQEVFSFYPDERFCRGFEEVLERYRELVPQLKLAGPTSFAPVIEMAITIVEQSGGQYHVLVIIADGQVTRSVDTEHGQLSAQEKKTVEAIVKARHVSSVKKLSVSCAEHEIMSKNMDRSRKETEFALAALMEIPSQYKATLELNILGACRGKDIDRIPLPPPLYGAASFNSPKTSRQYSSRPSAPSSRHDVSTNPPATSASDNQVCPICLTDPKDMAFGCGHQIGRTCGLISHTIDITLKFSCNCVSVGNVNEGTG

SEQ ID NO: 215320 - protein, 734 aa, Glycine max
  Coding DNA Sequence Number=SeqID_98542
  Gene Ontology: Mol. function=transferase activity, transferring glycosyl groups; Cellular component=cytoplasm; Biological process =carbohydrate metabolic process
  Homolog annotation: Hit_ID=Q9SCM1; Match level="QueryCoverage=98%, HitCoverage=97%, E-value=0.0, Identity=49%"; Hit description =Imbibition protein homolog
  Pfam annotation: Domain name=Raffinose_syn; Domain location=8-721; Score=1046.9; E_value=0; Accession=PF05691.3; Description=Raffinose synthase or seed imbibition protein Sip1
MMITAAPTVNDECLTVRGRAVLTHVPGNIVVSPVGTESAFLGATSSISSSRHVFVLGILQGYKLLSLFRVKIWWMIPRIGRSASDVPMETQFLLLEAREESALEDELSSDSEEPTTENSCYILFLPVLDGQFRATLQGTQSNELQFCIESGDAHVQTSQSLEAVFVNSGDNPFELIRDSIKMLEKHKGTFCRLENKRIPAHLDWFGWCTWDAFYTEVSPNGIREGLQSFSNGGCSPKFIIIDDGWQETLNTFHKEGEPVIEGTQFATRLIDIKENKKFTDAGSYNSCDNLHNFVDSIKQNMNVKYVYMWHALAGYWGGLLPSSDTMKKYNPKIVYPIQSPGTTGNLRDIAMDSLEKYGVGVIDPEKLYDFYNDYHSYLASCGVDGVKVDVQNLIETLGSGYGGRVSLSKRYQEALEQSVTRNFKDNNLICCMCHNSDSIYSSKNSAAVRASEDFMPREPTLQTLHIASVAFNSLLLGEIFVPDWDMFHSKHETAEFHAAARAVGGCAVYVSDKPGNHDFKILEKLVLADGSVLRARYAGRPTRDCLFEDPVMDGKSLLKIWNLNVLTGVVGVFNCQGAGCWPLKSLEAAPLRITISGKVRPLDVEFLEEVAGLLSKISCRGKLEVSLETLHCEIYTVSPIRVFGHDVLFAPIGLLDMYNSGGAVEALDCTMDVAQCIIKIKGRGCGRFGAYSNVRPKLCVVDMKEEEFFYNREDGLLTITLAGEGNSKDIEFVY

SEQ ID NO: 215321 - protein, 242 aa, Glycine max
  Coding DNA Sequence Number=SeqID_98543
  Gene Ontology: Mol. function=oxidoreductase activity; Cellular component=integral to membrane; Biological process=electron transport
  Homolog annotation: Hit_ID=Q76M94; Match level="QueryCoverage=97%, HitCoverage=47%, E-value=1e-71, Identity=52%"; Hit description =Cytochrome P450
  Pfam annotation: Domain name=p450; Domain location=1-236; Score= -85.5; E_value=4.4e-07; Accession=PF00067.12; Description=Cytochrome P450
MGANKEEEYKDLVDVLLEVQRNGSDEMPLTTDNIQAIILDMFAAGTDTTFITLDWAMTELLMNPQAMEKAQKEVRSILGERRVVAESDLHQLEYMRAVIKEIFRLHPQVPVLVPRESMEDVVIEGYRIPAKTRFFVNAWAIGRDPESWEDPNAFKPERFLGSDIDYRGQDFELIPFGAGRRGCPAITFATAVVELALAQLLYIFVWELPPGITAKDLDLTEVFGISMHRREHLHVVAKPYFP

SEQ ID NO: 215322 - protein, 310 aa, Glycine max
  Coding DNA Sequence Number=SeqID_98544
MVYDLNDIFVSLPNKRTCFKKHDLEMGKLDMNAKFDIGEATKVKTKVMSTVATRWRQFKSTLTSKFVFAKSEGQQTQDVVTKYGLDPEAWKQFEETRLTPNWEGIRKRAQSIQKHNDCPHVLSCGGYDLLEKKLLDQKRKRIQEEALLSENAASLDEPPSPIKRHVKWKIARTRAVGNMTSESAQEIADKIDSLEEQVTQGSFVPHGRQDILNTAIGRPEHGGRVRAAGSGVTITQYYGRASRTCSSSSTSISQQQLDEVVVRLREDMTGQIREELRTQIKEELRTQLEEENKRSLEIMTNALKEAIKKE

SEQ ID NO: 215323 - protein, 81 aa, Glycine max
  Coding DNA Sequence Number=SeqID_98545
PDNYLKGIIIRSVLFFNTFALALLSNINILRFLVFNSALKGLDDTPQPKSKAGARWIAVKYFSDVRPLEAERLKVFRIQWA

SEQ ID NO: 215324 - protein, 81 aa, Glycine max
  Coding DNA Sequence Number=SeqID_98546
  Subcellular localization annotation: CTP_CleavageSite=58; ConfidenceScore=5.47e-01
MAGLSTLARPASTNGGTPSSLLLSLSRQHQWRYLLSPSQPVPLLRIVAPLIPPLSLTVQASRQCQWRHPRKQQEALEHRQK

SEQ ID NO: 215325 - protein, 205 aa, Glycine max
  Coding DNA Sequence Number=SeqID_98547
  Homolog annotation: Hit_ID=Q00V05; Match level="QueryCoverage=31%, HitCoverage=12%, E-value=3e-07, Identity=43%"; Hit description=[S] KOG2490 Predicted membrane protein
  Pfam annotation: Domain name=DUF747; Domain location=1-119; Score= -187.6; E_value=0.025; Accession=PF05346.2; Description=Eukaryotic membrane protein (cytomegalovirus gH-receptor) family
NILLVYVCEMIIDIIKHSFIAKFNDIKPIAYSEFLEDLCKQTLNMQTECAKKNLTFVPLAPACVMCTFSFYNSFLGYSSSHSSIYCKPSSQSPSMEAFLDSAFFSNDLCHAHKPQGSHWHGTTEACHMTLFNIHIGTSPHSFSSSVGSEYIARAQRVPMEKENCMKMNNRIGKWFDILYADNNAVETKRFGGGEKTISLSTMRSQ

SEQ ID NO: 215326 - protein, 283 aa, Glycine max
  Coding DNA Sequence Number=SeqID_98548
  Homolog annotation: Hit_ID=P49351; Match level="QueryCoverage=36%, HitCoverage=41%, E-value=2e-35, Identity=59%"; Hit description =Farnesyl pyrophosphate synthetase 1 (FPP synthetase 1) (FPS 1) (Farnesyl diphosphate ...
  Homolog annotation: Hit description=synthetase 1) [Includes: Dimethylallyltranstransferase (EC 2.5.1.1); Geranyltranstransferase (EC 2.5.1.10)]
  Pfam annotation: Domain name=polyprenyl_synt; Domain location=42-263; Score=-114.6; E_value=0.051; Accession=PF00348.8; Description =Polyprenyl synthetase
MVVNFVLTHLLLEVASPIIFLPSTIPLPLNFKKQKTPLMKKIQGLQAPHGATSTIILCIIFLFSDVDEGEGSNDVGSDALNFVGLTPVDVGAVRDASDIEDVSGLELGYVGLEGGLVLEAARVVLEGDVLGTIEGAANPARAAVDEEVEGMGRGGSVGWEVQQNSVMSGFSGFMAGHVVTYALLMVGEDLDKNVDVKNILVEMGTYFQIGTDIEDFKCSWLIVKAVELSNEQQKKVLQENYGVFEEYESGSYAKVVSSIEAHPSKAVQAVLKSFLAKIYKRQK

SEQ ID NO: 215327 - protein, 180 aa, Glycine max
  Coding DNA Sequence Number=SeqID_98549
  Gene Ontology: Mol. function=oxidoreductase activity; Cellular component=integral to membrane; Biological process=electron transport
  Homolog annotation: Hit_ID=P24465; Match level="QueryCoverage=74%, HitCoverage=30%, E-value=3e-14, Identity=33%"; Hit description =Cytochrome P450 71A1
MLKTISNTLRSNREEKKNNFHRNPLSIETGTEKQSGNKGTKNSNDVDFSNYDEEWRQKKNTCVVEPLSQKKVRSFRSIQEEVVAELVEGVREACGSERERPCVNLTEMLIAASNNIVSRCVHGRKCDDRIGGGGGSSCSFGVLGRKLGWVDSLTGLIPEMKAMSVTIDAFFDEVIAEHEE

SEQ ID NO: 215328 - protein, 404 aa, Glycine max
  Coding DNA Sequence Number=SeqID_98550
  Pfam annotation: Domain name=DUF747; Domain location=274-404; Score= -128.8; E_value=1.8e-05; Accession=PF05346.2; Description=Eukaryotic membrane protein (cytomegalovirus gH-receptor) family
MALRNGGRKISFEVLSVEDESDPTERNRKKRRHRASKKKKKLLDRADSDSADPRSAPLENGGACNGFELDASRYCGGGGGGGGSVVVCEEVREAESVCAVAEARGAESEEATAVRGGIEGFNFGELRQRNVNCGSSEDLAASVVVRDEKEDGGVNASPVEKATNEPDRNVVKKLETVESLDWKRIMAEDPNLEKSPVSYFLEEMHNGNSLRSTTTLGNEKERERVYDTIFRLPWRCELLIDVGFFVCFDSFLSLLTVMPARIMMTIWRLLKTRQFKRLSTMEVSDFGCFLILSSGVVLLQQTAQAITLSTCIVAHNNALFALLVSNNFAEIKSNVFKRYSKDNVHSLVYFVSASLASTLAFRLKAYLNSTILPYCTWAVLTLLAGSLSPNVKIDCWLNPPLLLC

SEQ ID NO: 215329 - protein, 214 aa, Glycine max
  Coding DNA Sequence Number=SeqID_98551
  Gene Ontology: Mol. function=hydrolase activity
  Homolog annotation: Hit_ID=Q6ZJ14; Match level="QueryCoverage=90%, HitCoverage=80%, E-value=1e-57, Identity=51%"; Hit description =Calcineurin-like phosphoesterase family-like
MPTFLMAAHSLVFHDIVDGFCPKDQSLGTIKKVVDEFEMFRGGLVSKTLDGRAYYDFSPVPEYRFVVLDGYDISAIGWPKDHPKRLEALKILREKNPNEDKNNPVNMEGLERRQQNLNRKWLSVAIYLPLDPGAASEKGLVWNYDEIMNLIHKYNCVKVCLAGHHHRGGCSIDSRGIHHRVLEAALECPPGTNQYVLNMLLPFERGKDATRSIA

SEQ ID NO: 215330 - protein, 96 aa, Glycine max
  Coding DNA Sequence Number=SeqID_98552
MKYRIFGKYPVVLYSLGRRRSRLSYIRGHVQNFIRYAKVIVGKEHIGVSLGLNITNFSRGSNLHHIEANTSSFCMLDVLSQIKMQNLQLENFNPDV

SEQ ID NO: 215331 - protein, 831 aa, Glycine max
  Coding DNA Sequence Number=SeqID_98553
  Gene Ontology: Mol. function=RNA-directed DNA polymerase activity; Cellular component=chromatin; Biological process=chromatin assembly or disassembly
  Pfam annotation: Domain name=RVP_2; Domain location=173-301; Score= -46.8; E_value=0.0045; Accession=PF08284.2; Description=Retroviral aspartyl protease
  Pfam annotation: Domain name=rve; Domain location=504-660; Score =88.6; E_value=2e-23; Accession=PF00665.16; Description=Integrase core domain
  Pfam annotation: Domain name=zf-H2C2; Domain location=445-486; Score =12.7; E_value=0.0075; Accession=PF09337.1; Description=His(2)-Cys(2) zinc finger
  Pfam module annotation: Pfam domain module=RVP_2::rve::zf-H2C2; Domain location=173-301::504-660::445-486
MKLDVPRFNGIDPLGWIFKINQFFEYHGTLEHDHLTIASFYIEGRALAWFQWMTSNGQFTSWPGSVAQYLSNFEDLVNKIIGLPPPFLLSCFISGLTLEIRCEVQALQPLTLVQAASLTRLQEEKLLDGWVLPQGRPPPTAPVEIASRYEHGLCFNCNEKYHRGHCYPLDNPDPFQAQISFNSLADHLSPETLRLLGTISNHQVVVLMDGGNTHNFIQEELVTKLRFSSRETSPLWVMVGNRQHLECTRRCEAVTIEIQTTKFIIDLYVLPISRANIVLGVEYLRHIVSQGGVELMAAKATTTEPFQWTDLAQFAFEQLKRALLDALVLALLDFQLSFTVETYTSGVGMELFAIMAAVIQTPKQHMYLAHLMGYDYQIQYRSGANNQVTDALSRLPEQNASTLLILSIPCLTFMGDLHQQLANLPKRIWLPRGLPIIPTLLTEYHSTPTGGHMGVTKTLAHLSENFCWPAMRTNVTQFVASCLDCQHTKYETKRLAGLLCPLPVPHRPWEDLSLDFIIGLPPYHRHTVILVVVDCFSKGTHLGMLSSSHMTHAVACLFIDIMAKLHGLPRSLVSDRDPFFVSHFWQELFRLSGTQLCMSSAYHPQSDGQTEVLNHVVEQYLRAFVHQRPRTWGKLLPWVEWSHNTSWNVGTSTTPCEITFGRKSFNFPEYIIGTSNIDVVDDLLVNREETFHFIRKKLLKAQALMKQHADTRRKEDKFGKLAKRFYGPFQVIERIGQGTLTIADTMELPKKFINAQPIITPLTILDHRHSSSTGKPRWEDYHLEDKVILQGPRDDSRTQGTKISTKKNAGVQIEGRGKRAITKPAYLRDYV

SEQ ID NO: 215332 - protein, 635 aa, Glycine max
  Coding DNA Sequence Number=SeqID_98554
  Gene Ontology: Mol. function=nucleotidyltransferase activity
  Homolog annotation: Hit_ID=Q10LS4; Match level="QueryCoverage=45%, HitCoverage=29%, E-value=7e-72, Identity=50%"; Hit description =Expressed protein
  Pfam annotation: Domain name=PAP_assoc; Domain location=159-248; Score=-1.0; E_value=0.094; Accession=PF03828.9; Description=PAP25A associated domain
MYSFKNIEIPDLNDIEKILQVLPFGSVPLKTYLPDGDVDLTTLIHEDAEDDLAQAICNVLKSGDDSEYQVRLVKCTVKNIAVDISFNQMAGIYTLRFLEQVDQLVGKNHIFKRSIILIKGWCYYDSRLLGGHHGLLSTYAVEILVLYIINRFHSSVRGPLEVLYIFLDYYGSFDWDHNYISIWGPKSLSSLPEIAEAPECDQGEFLLQKEFLGNYKNMCSYPAGASETLTHEFPVKFMNILDPLRNDNNLGRSVSIASLHRLRFAFSYGVQKLKQIFTLPGENMGAALEKFFSSTLNRNGKGERADVSVPVAPFGTGRFEEPVLYGDCENYCGGLQYVQLYHNYAMPVIVDSNSPASPDDILAPTQQNWSLFYQGATDVYIPAQKLYHPTYSLEGGGKSRGTGTYIPDLNYNSYWDMRTKASRPRRFASSKYNAFPRSPLKKQQVEEVHSEIDIINANSDSRLFEFSSEDFPVRPCNSNAIPPTQAQESTPLEKFHFETDMDGTSRSLEFSNEDFPLLPKVCSETHMEGNSRSFGLSKKEFPLLQSACKTVLSGSAKLTKQAKSFPSFKESKLKNIEFGTFKKSQSLTEPGLSTKDEREDSDISLTQKTVLVFPKVAIERKDESPESNEKMDQQC

SEQ ID NO: 215333 - protein, 66 aa, Glycine max
  Coding DNA Sequence Number=SeqID_98555
MGAPVMDPLDQPGQVEALGHVQPMDVVEPMEPVQVVEQVERTSHQEPKALVVFPGGPKDTSLLTSC

SEQ ID NO: 215334 - protein, 371 aa, Glycine max
  Coding DNA Sequence Number=SeqID_98556
  Gene Ontology: Mol. function=protein serine/threonine kinase activity; Cellular component=spliceosome; Biological process=protein amino acid phosphorylation
  Homolog annotation: Hit_ID=Q2QLI7; Match level="QueryCoverage=88%, HitCoverage=35%, E-value=1e-165, Identity=84%"; Hit description =Protein kinase domain containing protein, expressed
  Pfam annotation: Domain name=Pkinase; Domain location=11-326; Score =198.0; E_value=2.3e-56; Accession=PF00069.15; Description=Protein kinase domain
  Pfam annotation: Domain name=Pkinase_Tyr; Domain location=11-306; Score=-61.7; E_value=1.1e-08; Accession=PF07714.7; Description =Protein tyrosine kinase
  Pfam module annotation: Pfam domain module=Pkinase::Pkinase_Tyr; Domain location=11-326::11-306
YRIGEILDGRYEVTAAHGRGVFSTVVRGKNLKMGNGEPEEVAIKIIRSNDTMYKAGMDELVILKKLVGADPDDKRHCVRFLSSFRYRNHLCLVFESLNMNLREVLKKFGRNIGLRLTAVRAYAKQLFIALKHLRNCGVLHCDIKPDNMLVNESKNVLKLCDFGNAMFAGKNEVTPYLVSRFYRAPEIILGLPYDHPLDIWSVGCCLYELYIGKVLFPGLTNNDMLRLHMELKGPFPKKMLRKGAFTEQHFDQDLNFLATEEDPVTKKTIKRLILNIKPKDIGTLITGSPGEDPKMLANFKDLLEKVFVLDPDKRLTVSQALNHPFITGKGWLAQSRFGIEPYRGLANNPPPDSKLNSFGSLQCSSWAEGDK

SEQ ID NO: 215335 - protein, 661 aa, Glycine max
  Coding DNA Sequence Number=SeqID_98557
  Homolog annotation: Hit_ID=Q2QLI7; Match level="QueryCoverage=34%, HitCoverage=26%, E-value=4e-24, Identity=33%"; Hit description =Protein kinase domain containing protein, expressed
MATDARDSRRKHHRSSSPEDVDRSSKRHKHRHNSHRHRHGSKKRDEEVEFDDRTIAAVPSPTSHRYLHDDDVEEGEILEDEALDGEVGKKETESDVEPGEIKVTGDRDVRSDNQNSYFRCFSVSHFLLVTKQSTVILCFRTEPLTKISETRNEDIRDDKFISPAIDAQDDVSPNRSSSETRDGKHAQARTDGVGNGYLDPKSSKGDKWQNGELGHFKGNEKLKGDFHDPTLEANVRKAHYHRNSSSESGGEKYRMSGSSPSHGRYRSRSRSIGHTRDRSRSRSIIDEYPHSKRRRFDYDHDEERVRARGREHGHGSVVDDRREYGIRYHNREARDRDVDRDLHGEKKQEETSRGKEIEWEHKRGKERERSRDRYRRDIEKDRSREREEDRDRRQEKERDRSWDTVMERDRRREKERDRSRDRIRGGKRDKDPENERDDKHRARDNIKKRERHDDKYRHKDRDTANGKNRHLHHEDGDDNGDRYRKHSRHEENEYRWERKRNSDNPVKVYSSMGSTAEVGESKLTSSEVEPDDLEEDTLQLPEQEEEDLNRIKEESRRRREAIMEKYKKQHQQVEEAVGNEGNDKKAAIPNDISEARDGKNDDADYLEPSFAVGKSPENVNVASKKMSPAGGLGEGTPKSERSEDKFCDDIFGETPTGVRKS

SEQ ID NO: 215336 - protein, 44 aa, Glycine max
  Coding DNA Sequence Number=SeqID_98558
MAEERTVVARAEVSYGIRFKAGPDLTYKYNYGISHVPYKRAHII

SEQ ID NO: 215337 - protein, 59 aa, Glycine max
  Coding DNA Sequence Number=SeqID_98559
MGSEIYPEDHENPRAFFSSSSPILLGGPPSCPFNKGCSQSDVRDLRAYLGHVHPDEGQL

SEQ ID NO: 215338 - protein, 96 aa, Glycine max
  Coding DNA Sequence Number=SeqID_98560
MKMKANKTRNELKVSDSNTYWLKNEERMKNERRTMKNEGKSSQICSRKRFESVTEAFRLDFSSRNKFYGSITEVSEAPETSFQQNMEELAAQLLPP

SEQ ID NO: 215339 - protein, 156 aa, Glycine max
  Coding DNA Sequence Number=SeqID_98561
MVDKLQESTIIQDLKEVRFQYLEEDFVMISGVNEDNVQEEMLEEGDGWANMFECIVKWKKGQNFGSRLVWVNIYGIPMKLWNEACLRSVISELGNLVSNNEATQNLDCGDRARVLLKALLITLAKLIKMVKINGHVYQVRVEEEDGAWKNGCKCKD

SEQ ID NO: 215340 - protein, 59 aa, Glycine max
  Coding DNA Sequence Number=SeqID_98562
MDDGGYYSTTTSLSSSIGQVMSPKSPLFGLVDFHGKRKQMVKIQVLEREIGLFQFDFKF

SEQ ID NO: 215341 - protein, 561 aa, Glycine max
  Coding DNA Sequence Number=SeqID_98563
  Gene Ontology: Mol. function=malate transporter activity; Biological process=response to aluminum ion
  Homolog annotation: Hit_ID=Q5FAM2; Match level="QueryCoverage=88%, HitCoverage=88%, E-value=1e-142, Identity=51%"; Hit description =Putative expressed protein
  Pfam annotation: Domain name=UPF0005; Domain location=73-545; Score =656.8; E_value=1.7e-194; Accession=PF01027.11; Description =Uncharacterised protein family UPF0005
MNNQQQSERMPARVGSFRHSFLEKSKERLLSKKDCKDFDDDDNAAPKRSFLDALSDGVISFHNWSRDVASKLYEMGRSDRRKVIFAVKAGLSLAIVSLVIYIEEEQFSKYSVWAILTVVVVFEFSIGATLNKGFNRALGTISAGVLALGIAQLSVLVGRAFEGLIIVVSIFIAGFCASYVKLYPAMKQYEYGFRVFLLTFCIVLVSGRTELQFFSTAFYRSVLIGIGAGVSLSVNICIYPIWSGEDLHKLVVKNFIGVATSLEGCVNGYLQCVAYERIPSKILVYQASDDPLYRGYRTAVQSSTQEETLVDFALWEPPHGPYKMFNYPWRSYVKVSGALRHCAFMVMAMHGCILSEIQSPPEKRLVFYDELQKVGIEGAKVLRTLGSKVERMEKLSTGDILLDVHEAAEQLQMKIDQLSFLLVNYESWEAAREHKEKEQPENLIDVKDNENKPPEITSLDEIGDGPKLSVRIEPSMPESNLLPQTASKSFLGKSHLSFFADGIVNEPESKVYESASSLSLGTFASNLIEFVARLQNLVDEFQDLSEKAKFKDPLNKLCSSS

SEQ ID NO: 215342 - protein, 293 aa, Glycine max
  Coding DNA Sequence Number=SeqID_98564
  Gene Ontology: Mol. function=carboxylesterase activity; Cellular component=nucleus; Biological process=metabolic process
  Homolog annotation: Hit_ID=Q0ZPV5; Match level="QueryCoverage=87%, HitCoverage=93%, E-value=3e-81, Identity=53%"; Hit description=CXE carboxylesterase
  Pfam annotation: Domain name=Abhydrolase_3; Domain location=73-269; Score=139.7; E_value=7.7e-39; Accession=PF07859.3; Description =alphabeta hydrolase fold
MATLTSNLNLRPQQYTVPKDYPPHGSVVEEIQGLIRVHKDGYVERPQVVPCVTASTMSPELNVTSRDMVIERFCVGSAAWSCYHDFLARLSTKVGCVIMSVNYRLAPENPLPAPYDDGLKAIMWLHQQHNNKGSGTEWWTSKCNFSSVFLGGDSAGANIAYNVATRLCACDGAALTLRPMNLKGLILIQPFFGGEVRTDSEKGMAQSPGSALNLAASDSYWRLALPCGAKRDHPWCNPFGEVGGVEAHAYLGKRVEYGVFRGVGHAFQILSKSQVAKSRTKEMMARVKSFMAL

SEQ ID NO: 215343 - protein, 456 aa, Glycine max
  Coding DNA Sequence Number=SeqID_98565
  Gene Ontology: Mol. function=protein dimerization activity; Cellular component=nucleus; Biological process=regulation of transcription, DNA-dependent
  Homolog annotation: Hit_ID=Q9ZPJ6; Match level="QueryCoverage=97%, HitCoverage=97%, E-value=1e-100, Identity=46%"; Hit description =Transcription factor PERIANTHIA
  Pfam annotation: Domain name=bZIP_1; Domain location=165-225; Score =26.4; E_value=9.9e-05; Accession=PF00170.11; Description=bZIP transcription factor
  Pfam annotation: Domain name=bZIP_2; Domain location=165-215; Score =20.8; E_value=0.0048; Accession=PF07716.5; Description=Basic region leucine zipper
  Pfam module annotation: Pfam domain module=bZIP_1::bZIP_2; Domain location=165-225::165-215
  Subcellular localization annotation: CTP_CleavageSite=66; ConfidenceScore=5.23e-01
MQSFNTTESESTSPLYSHSPFYHRGNDPSRNPTRFSDLQHSFRQHDAVDLSSSSVFGAKSSNVAVVASNLQCGTFNTNLGCAEFGSIEQRGMFQRGTNSATTVSMGNRHVENWAEDSQHTEDTCTDIDTDDKNQCFSTVSWCNGVGDGALVVVDSQDQSKTKVKAEDQKTVRRLAQNREAARKSRLRKKAYVQQLETSRVRLAQLEQELQRARQQGAFIATGNQGDRSHSAVGNGALAFDMDYARWFDEHQRLINDIRSAINSQMDENELHLLVDGVMAHYDELFRLKSIGAKADVFHILSGMWKTPAERCFIWLGGFRSSELLKIVRNQLEPLTEQQLMGIYNLQQSSQQAEDALSQGMDALQQSLSETLSSSSLGPSGSGNVAEYMGQMAIALGKLATLENFLHQADLLRQQTLQQMRRILTTFQAARALLVINDYVSRLRALNSLWLACPREY

SEQ ID NO: 215344 - protein, 593 aa, Glycine max
  Coding DNA Sequence Number=SeqID_98566
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q9ZP04; Match level="QueryCoverage=99%, HitCoverage=63%, E-value=0.0, Identity=78%"; Hit description=Alpha-D- xylosidase precursor
  Pfam annotation: Domain name=Glyco_hydro_31; Domain location=1-446; Score=704.6; E_value=7.1e-209; Accession=PF01055.16; Description =Glycosyl hydrolases family 31
DVVENYKKAKIPLDVIWNDDDHMDGHKDFTLNPVNYPHSKLLDFLDRIHSIGMKYIVIIDPGIAVNSSYGVYQRGIADDVFIKYEGEPFLAQVWPGAVYFPDFLNPKTVSWWVDEIRRFHELVPVDGLWIDMNEASNFCSGKCTIPKGKVCPSGTGPGWICCLDCKNITSTRWDDPPYKINASGVQAPIGFKTIATSAVHYDGVLEYDAHSIYGFSQAIATHKALQGLKGKRPFILSRSTYVGSGKYAAHWTGDNKGTWEDLRYSISTMLNFGIFGVPMVGSDICGFYPAPTEELCNRWIEVGAFYPFSRDHANFYSPRQELYQWESVAESARNALGMRYKLLPYLYTLNYEAHVSGAPIARPLFFSFPTYTECYGLSTQFLLGSSLMISPVLEQGKTQVTALFLPGTWYNLFDLTQTIVSKDGNYVTLDAPLHVVNVHLYQNSILPMQQGGMISKDARMTPFSLIVTFPAGATDGEAKGNLFLDDDELPEMKLVNGYSTYIDFHATIKEGTVKIWSEVQEGKFALDKGWVIDTINVLGLNRNGALPKIEIDGEPLMSLSNVQVSTTQHKYLYGQGDGDKILMVGLKGLNIPV

SEQ ID NO: 215345 - protein, 543 aa, Glycine max
  Coding DNA Sequence Number=SeqID_98567
  Gene Ontology: Mol. function=nucleoside-triphosphatase activity; Cellular component=membrane; Biological process=proteolysis
  Homolog annotation: Hit_ID=Q7XI12; Match level="QueryCoverage=87%, HitCoverage=82%, E-value=2e-96, Identity=69%"; Hit description =ATPase-like protein
  Pfam annotation: Domain name=AAA; Domain location=147-386; Score= -33.6; E_value=0.073; Accession=PF00004.19; Description=ATPase family associated with various cellular activities (AAA)
  Pfam annotation: Domain name=AAA_5; Domain location=147-282; Score= -18.5; E_value=0.046; Accession=PF07728.4; Description=ATPase family associated with various
  Pfam module annotation: Pfam domain module=AAA::AAA_5; Domain location=147-386::147-282
  Subcellular localization annotation: CTP_CleavageSite=20; ConfidenceScore=5.12e-01
MISHFISSLRPPRFPRNGIPCTASPEIRRPSDRFYGSSPSTSRPEDLNLFLELLPLTLRRELKPLARFPSGDWVISEQPIAQEDLRHAISKVGEFSDDNRSGIDRSLHRISAIRNRKMQIIGLTCRVGRAVGGSAEIIRDLVEDGGSILVIGPPGVGKTTLIREIARMLADEFRKRVVIVDTSNEIGGDGDVPHAGIGRARRTQVPNVNMQHGVMIEAIENHMPETIIIDEIGTELEALAASTIAQRGVQLVGTAHGMTIENIIKNPYLQILVGGIESVTLGETSDLTNNDITSSEIESSKDDKDHPRTWSTNWSTSVPVMTRSSRMQVYTYKILEADLLQVAKVMGLEDVIDVTDDIGTAEAILASSSEIRQNPWIRGVAKFHHVPVFVIKSNTMAQVVKAVRMILGLEFFGPTPKKALNECLDIEIEDDEPKRKPSLEEIDALEEVRLAIEYIVIPGGEPVELLPRRSEIIARQLELVQSYQLAAEKSGSDQNPRLQILPLRLNTKKPSKSTIGRKKTSPTSMSTGDSGNGISVTKASYFS

SEQ ID NO: 215346 - protein, 145 aa, Glycine max
  Coding DNA Sequence Number=SeqID_98568
  Subcellular localization annotation: CTP_CleavageSite=61; ConfidenceScore=5.29e-01
MDLGAEGKGFNTLGIQISLKIIEEKKKKKRRKSRPRSFRNASVTNFVNLLLRSSSFFIICRSSTRSFDRSFKPRLQPEGTSSPGQASYFRHEWELGKGCQHSIVKEIGRIRKEEERKRNEVEALPNRDCDQPLHRSLFGVLRATI

SEQ ID NO: 215347 - protein, 80 aa, Glycine max
  Coding DNA Sequence Number=SeqID_98569
  Homolog annotation: Hit_ID=O22703; Match level="QueryCoverage=39%, HitCoverage=10%, E-value=3e-08, Identity=84%"; Hit description =Putative RNA-binding protein
MAAKEENRIFVGGLSWDVTERQLEHAFARYGKILECQNGFFVAEAHFFQFSDKMIACGSNCRARAGDLCGLDMWNLVQGR

SEQ ID NO: 215348 - protein, 93 aa, Glycine max
  Coding DNA Sequence Number=SeqID_98570
MEKFFIPSYTSKDKKITPKGIDSTLSTSYAYKQLKDEYNERLSVGTCLSKHNNPLTLTVYIEFGCHPTMISEKLNSSLQQQQQKCTMLVPYEK

SEQ ID NO: 215349 - protein, 46 aa, Glycine max
  Coding DNA Sequence Number=SeqID_98571
MPGRIQRQRPIKGWTQVEARIMIDRSSSHAQLWTSGKAVGRQPSIL

SEQ ID NO: 215350 - protein, 131 aa, Glycine max
  Coding DNA Sequence Number=SeqID_98572
MDPATGKVDGPHKKKLTTYLGIFARNKVDVTHENWKQVLAAQKDLIWEDIHAKFDILEASDLRMKKKILQTMGEWWRPFKSDLTSKWAHAADKDGVDDTVCEKYDISKEPNFVRAAETLPGRMCKRRHMPF

SEQ ID NO: 215351 - protein, 158 aa, Glycine max
  Coding DNA Sequence Number=SeqID_98573
  Gene Ontology: Mol. function=transition metal ion binding; Cellular component=cytoplasm; Biological process=lipid metabolic process
MDRSWMNETHMSPAYEEGVEEFLQFASKRSRPDEDGNFFCPLVLSLVNMKARYGWSDKSFSSLLQVVQDMLIEKNTLPKSYYQDKKILCPMGMEYSKIHACTNDCILYIHEFEEMHKCPKFGVSRYKIKDDNKCSSNEKIKEGPPSEGVVVSSNHSKV

SEQ ID NO: 215352 - protein, 33 aa, Glycine max
  Coding DNA Sequence Number=SeqID_98574
AQWCPLWNFSSQVKQRPRCRGGKQSPPGIVASR

SEQ ID NO: 215353 - protein, 98 aa, Glycine max
  Coding DNA Sequence Number=SeqID_98575
MVIVKNLFFLQEGQTGGLYQGHWLIGLHLPTYLWCETRYEATEKEKGGNTYNAVGEVLKLGKVLGHGAFLSELAKCSDRVIVLRQSETSAQSLEEHRP

SEQ ID NO: 215354 - protein, 147 aa, Glycine max
  Coding DNA Sequence Number=SeqID_98576
MWVSTGPRSQPTAPLSIGALIASMSESSKNMGSSDRLEEALIRLTNQNMYLGESVNSVTLKIDELIQRLGPALSTPSPTPPPLPPPFPIRAVTHKMRLDVPRFDGTEPLGWIFKINQFFEYHGTPEQDKLAIASFYMEAAPSHGSSG

SEQ ID NO: 215355 - protein, 363 aa, Glycine max
  Coding DNA Sequence Number=SeqID_98577
  Gene Ontology: Cellular component=integral to membrane
  Homolog annotation: Hit_ID=UPI00005F7CA5; Match level="QueryCoverage =96%, HitCoverage=84%, E-value=1e-91, Identity=48%"; Hit description =COG4452: Inner membrane protein involved in colicin E2 resistance
KKRRERANGGAAGAASPLFAAGVASGAGGTECGSAQVGHLSDAGLPGAAELQGAFRPAGAGGFATRQRDRRPAVPAGGAERLSRHQEHFPAGNAAAGDPRTADAGGAATKSGAERRLHPDAGGHQQPVTGAAGAQQRAAAAKQLAAPEFPRQLPAGRTQGDGARCVPLRRWHYRRGQAAGLQRQPGRTGRSLSVDRARSQIRAAVYRADIYGVFPVRNPDRAAGAPDSIPAGRRGAGVVLPDSAGLLRTPGIRSRLPGGQHRLQRTDRLLPERRAARQAARCAVRREPIAVVRRALFAAAVGGQCVGAGGGAAVRHSGGHYAVDAQVGLVSGGRSGASGKGDAGRRRRATLPSVEISGGNRAR

SEQ ID NO: 215356 - protein, 61 aa, Glycine max
  Coding DNA Sequence Number=SeqID_98578
MDDGGYYSTTTSLSGSIGQVMRPKSPLSGLVDFHGKQKQMVKIQVLEREIGLLQHIKASKS

SEQ ID NO: 215357 - protein, 107 aa, Glycine max
  Coding DNA Sequence Number=SeqID_98579
MAKFDPDIVLEFYANAWPTEEGVRDMRSWVRGQWIPFDADAFSQFLGYPLVLEERQECEYGQRRNRADGFDEEAITQFIISVSYQVKGIIFKVQRLEMITFQVKRIA

SEQ ID NO: 215358 - protein, 119 aa, Glycine max
  Coding DNA Sequence Number=SeqID_98580
YCTQRQAQGNAPQAADAPPPHQAGPTGSFDTEQYLRHLVRQQAANHRAHVQTHDCLYQLSLSLQSQGFTSFPCPTPDQFGAEVAWPGDWPEARAGGAPAEAPAEAPDEADEAREDEEMT

SEQ ID NO: 215359 - protein, 100 aa, Glycine max
  Coding DNA Sequence Number=SeqID_98581
MRDKDINFIHFIVTVVYNNGFTRDSPQISASPHQLDLAPYASSPYNAQWNATGLLHDKHTLRSSRILGEMEVDEPWLGLWLPLNYQVDMGASQHRTLELG

SEQ ID NO: 215360 - protein, 119 aa, Glycine max
  Coding DNA Sequence Number=SeqID_98582
MGKLDHLKERLRAIEGSEDYAFANLEELFLVPNIITPPKFKVLDFDKYKGITCPKNHLKMYCRKMGAYAKDEELLIHSFQESLTGVVVTWYTNLEPSRVHSWENLMVAFVRQCRYNGFG

SEQ ID NO: 215361 - protein, 521 aa, Glycine max
  Coding DNA Sequence Number=SeqID_98583
  Homolog annotation: Hit_ID=Q535K6; Match level="QueryCoverage=99%, HitCoverage=86%, E-value=0.0, Identity=82%"; Hit description=Nitrate and chloride transporter
  Pfam annotation: Domain name=MFS_1; Domain location=29-489; Score =9.7; E_value=0.00011; Accession=PF07690.6; Description=Major Facilitator Superfamily
  Pfam annotation: Domain name=Nodulin-like; Domain location=23-268; Score=495.3; E_value=7.2e-146; Accession=PF06813.4; Description =Nodulin-like
  Pfam module annotation: Pfam domain module=MFS_1::Nodulin-like; Domain location=29-489::23-268
MAITGVHGWGDIKSLSVQVITGRWFVVFASFLIMAAAGATYMFGLYSSDIKTTLGYDQSTLDLLSFFKDLGSNVGILSGLINELTPPWVVLAIGAILNFFGYFMIWLSVTKKIAKPKVWQMCLYICIGANSQSFANTGSLVTCVKNFPESRGAVLGILKGYVGLSGAIITQLYHAIYYDDTRSLILLIGWLPAAISFAFLRTIRYMKPVRKPNELKVFYNFLYVSLGLAGFLMVMIIVENKVNFTQSEFGVSAAIMLFLLFLPLTIVSIEEYKVWQGKRLALVDPSPVKVVTDQGEKVKPNETINGSNNNSVSSNDTKWWENVFSPPARGEDYTILQALFSVDMLILFMTCICGVGGTLTAIDNLGQIGTSLRYPKKTRSTFVSLVSIWNYLGRVFSGFVSEHFLQKYKFPRPLMLTLTLLLSCVGHLLIAFDVPNGLYVASVIIGFCFGAQWPLLFAIISELFGLKYYATLYNFGSVASPLGLYVLNVKMTGYLYDKEAKKQLAASGLTREEGHELNCVG

SEQ ID NO: 215362 - protein, 95 aa, Glycine max
  Coding DNA Sequence Number=SeqID_98584
MNNLVLSDINKPENTSRWIKPVCCWHFKVQYWCICFHQIHGARFLYGSMSLKCRWRICSYKLGHLFKLELFLVSKLKQHRYWQLLIGLLIRGFKM

SEQ ID NO: 215363 - protein, 186 aa, Glycine max
  Coding DNA Sequence Number=SeqID_98585
MEVFIPYHGKISCIRAADVVSYRYAEGIMWHRTNHGWVKMNVDGVDSGVSHGLRRSYALMRDHLGNFVSAFSVRIETCSITEVDPWLRQQGFQRIIMESDSLNVIGFSIVNCIKQLASLGEGNQVADKLAKDNFTMSIPQQIFHVVFKSSYRHLSSVLASQASKNLIEKGCSSSRKNAYGGSKSHP

SEQ ID NO: 215364 - protein, 54 aa, Glycine max
  Coding DNA Sequence Number=SeqID_98586
MLHQLDAGKERTVEGLKQPETGLWALMKHVRNFKAGKLLFIIYRNLLRGGDKHN

SEQ ID NO: 215365 - protein, 1780 aa, Glycine max
  Coding DNA Sequence Number=SeqID_98587
  Homolog annotation: Hit_ID=Q9FM57; Match level="QueryCoverage=17%, HitCoverage=20%, E-value=1e-16, Identity=27%"; Hit description =Arabidopsis thaliana genomic DNA, chromosome 5, P1 clone:MDF20
AWLGHPDYEDIVKKAWQIIRGDVLSKLQGVKESKKDLQLQYNPVLDQEEILCAKTTLFIDVKRRRNVGDGEARRADLRAKEANHRPITTTVPSLGATPFPQTPPQRNSPSAMALQLFPSGKSTRELVSISNSVVVMYEPQRLGQFSFAKFDPNLVIMYSFSAGLSKDDLVSEVLISQPQYIVPFPGLYSNLDAVSCGVHYPIGLHNEGRALEKECNTGDGVSNLPDCSVNYAVSASSGPPELDSGAVSPPQNQIEARASDSHHDPAPSLAKLQRSKPRQKALELRNSAKAPRRLSREDDNASVCAGTVTGSAPSSQEAEHAMESDVVKDFHSNIQSCSMEETKACDCVTKYSGRMTRSKSSFQKFNSLNVASPSVAKEDGPPPNNLNESFEIVNQPCFANGSCGVNEANKGDYQSNEAGKSVHDERLTKSRSSSQARCNSELLKLDSTLGSGKGVGFCDHRQPITHAELTELSKVADCNNGSGRNTVKDGNSCLSKQESNIHGMIKLLRSSCPSPGHDLLMTSGSVRSIDKSVPLPQPLIPQNSQDPVVSVVGTLSTQKDPDFSALKPKDHLSRSGSETIEKVQSKKFWNIQPTKLDATRLSSSPKYSKLDIEIGRNSAVKENVAALATSGNMRAVATSANEGSLRPVSSSNFYGGSLHAESVNVEAVVDEKVLDAQENIPYDALPTDNVEHRFAAIVDEVDADSDGLVEKDPSCVIPKVRQNVSVMKLPADFIMSVMPMQLDFDDVEETSVSGICSSDLKEGQQGVSPEEPLNSLEPVKLLEEETSSVCQIKCNSSGEMPLLQMREVPIREGEPYMEYCASHFKEEDIARATLSAVPPNKEIPMVQNEFCIRTSSLMYHSSPSQVAGENSSRSLSKEVMPSKFVSVNSKLENVECSTKLANFSSEAVMGNDLHKSTDESVTNFTIGFPFSAPMDDVNVGLAQQPPNSITLCKDGEVLHKTLHSDGKITSFSTDFQIFRISPKSFTYDVEHSCPQHKRRKIDIETERFRSASSNLLEKPCDSIDQGPVSRSLSIEEDSREVALEVQHLPSDPEDDTGHQSISNIPTDEKQYNGECQTMEDSSLKVRKEEEDQIRERNRNYLEFGEVKMLRDTEQRNREKSKSCILDGRDRSEDTLVLAVAKTSGFSIDPTMGCTMDEKVELWHHQVSCGQECAEHLERSTSSRKVCPGGNAKFSNGMPASPGMQCLDLVGTGETIAELEGLIMQADNAQPCIAGDQIDLEEIDLPSNSIDYTSLGKSRFMHSSSYNSLTPYKLHNIPEPYQSLPNGLLEGLGIRTSLSLSDGSPRSLSDCQPNCKGQYTSSVQTLWDRINSNLGSSGKRKSLKLDLPCITEENENVDEIAGTCQMGIDSKEMAGSNIREPLAEIVDNVNPSASVLQDDILTGGREDILSTEFNLSGTCNKAKHKLDKQDGNRKRFTRKGKENHNISLGANGVKRTAESVCKRPSRGKLSGKDSMKQGSFNNIVSNVSSFIPLVQQKQAAAVVTGKRDIKVKALEAAEAAKRMAEKKENERKMKKEVLRIERERLELELQKKKKEEERKKKEAQMAAKKRQREDEEKKEKEKKRKRVNDMKKQQQEHEKILAKKEEIKIQRRATGEVLENKKIMDERENYKNLPVQDKRECNMEKISETEPLAMRDSANDKTKEPHPEYSESVNDCANNGQVMDNLIKAAEDDDLIIKDSLQEQSYEISPYRGSDDEDEDEDDLPNNKFIPSWASKHSLSLIVSSQKMDPETIFPPQSFCNIAEASATVAEHSDFSNTGLC

SEQ ID NO: 215366 - protein, 364 aa, Glycine max
  Coding DNA Sequence Number=SeqID_98588
  Gene Ontology: Mol. function=binding; Cellular component=nucleus; Biological process=metabolic process
  Homolog annotation: Hit_ID=Q2QXH1; Match level="QueryCoverage=89%, HitCoverage=65%, E-value=1e-83, Identity=35%"; Hit description=SEC14 cytosolic factor, putative
  Pfam annotation: Domain name=PPR; Domain location=150-184; Score =32.0; E_value=2.1e-06; Accession=PF01535.11; Description=PPR repeat
  Pfam annotation: Domain name=PPR; Domain location=252-286; Score =44.7; E_value=3e-10; Accession=PF01535.11; Description=PPR repeat
  Pfam annotation: Domain name=PPR; Domain location=287-321; Score =17.7; E_value=0.043; Accession=PF01535.11; Description=PPR repeat
  Pfam annotation: Domain name=PPR; Domain location=323-357; Score =11.9; E_value=0.29; Accession=PF01535.11; Description=PPR repeat
  Pfam module annotation: Pfam domain module=PPR::PPR::PPR::PPR; Domain location=150-184::252-286::287-321::323-357
MGVQKATGVSWKWSKLKGPMMPKGPRKLSVISEAKPESSKVENVVHMDRVSNLHYLLQLCAKTGSSMGGRACHAQIIRIGLEMDILTSTMLINMYSKCSLVHSTRKKIGALTQNAEDRKALKLLIRMQRECSSIKDASQMFESMPEKNAVTWSSMMAGYVQNGFHDEALLLFHNAQLMGFDQDPFNISSAVSACAGLATLVEGKQVHAMSHKSGFGSNIYVASSLIDMYAKCGCIREAYLVFEGFVEVRSIVLWNAMISGFARHALAQEAMILFEKMQQRGFFPDDVTYVSVLNACSHMGLHEEGQKYFDLMVRQHNLSPSVLHYSCMIDILGRAGLVQKAYDLIGRMSFNATSSMWGSVRGLS

SEQ ID NO: 215367 - protein, 334 aa, Glycine max
  Coding DNA Sequence Number=SeqID_98589
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q9LEC9; Match level="QueryCoverage=82%, HitCoverage=29%, E-value=1e-119, Identity=73%"; Hit description =Alpha-glucosidase
MASSIRLVTLCLSYLLLTWLLHVTAEEATSSSNKIGLGYRLISIKDAPDGSLVGLLQVKQNNNVYGPDLPLLRFYVKHETENRLRVHITDAKKQRWEVPYNLLPREQPPALNQYIVWSRKKNLVSVSEYSGSGSDLVFSYISDPFSFSVKRKSNGDTLFDSNSNEFNSLVFKDQYLEISTKLPKDASLYGLGENTQPHGIKLYPNDPSTLYTTDVSAINLNTDLYGSHPVYMDLRNEGGKPYAHGVLLLNSNGMDVFYRGTSLTYKIIGGVLDFYFFAGPTPLNVVDQYTSLIGRPAPMPYWAFVCICISHLGATEPFPFVEELLIDKTGACYL

SEQ ID NO: 215368 - protein, 77 aa, Glycine max
  Coding DNA Sequence Number=SeqID_98590
MSRNLTDYAIVPSLASEMLWNFTDCALTLPFNSRHVAELHGSPNDGCQVPRSGQAKVASHQTDGSRTKLGYDTSKEV

SEQ ID NO: 215369 - protein, 102 aa, Glycine max
  Coding DNA Sequence Number=SeqID_98591
MENLRTALGQSICGAQDSLVGGCMNDNQFMGLRIKVENGELANSARQSIRGAPDSLGSRLVGGGCMNDNQFMGLRIKVENGELANSARQSIRAAPDSLVEDA

SEQ ID NO: 215370 - protein, 119 aa, Glycine max
  Coding DNA Sequence Number=SeqID_98592
MQTPCVKESREVLRNQPSVCAMSDDSKPSDKIEGIHESTKVVMVRTKNQSYEEPPSNKRKQFETSTSSIPQQTQMQHKPIDDTNKFFNKYDEARYYVSLKREVYTKRKVQLKEEEFNVI

SEQ ID NO: 215371 - protein, 109 aa, Glycine max
  Coding DNA Sequence Number=SeqID_98593
MMLNPFPSAPHTYLSENKGRRLHSSSPRGWKMSPKLPFCSHFEYFAHFLPKHHKTLQIGRQLTLSSSLRPRTCDTNDRLKLTLPEEKRLPMIGEGYEDVQNKKEDPKGA

SEQ ID NO: 215372 - protein, 387 aa, Glycine max
  Coding DNA Sequence Number=SeqID_98594
  Gene Ontology: Cellular component=nucleus; Biological process=protein modification process
  Homolog annotation: Hit_ID=Q84L31-2; Match level="QueryCoverage=81%, HitCoverage=72%, E-value=6e-70, Identity=77%"; Hit description =Isoform 2 of Q84L31
  Pfam annotation: Domain name=UBA; Domain location=219-261; Score =41.4; E_value=3e-09; Accession=PF00627.21; Description=UBATS-N domain
  Pfam annotation: Domain name=XPC-binding; Domain location=326-384; Score=111.2; E_value=3e-30; Accession=PF09280.1; Description=XPC -binding domain
  Pfam annotation: Domain name=ubiquitin; Domain location=51-122; Score= 34.1; E_value=4.8e-07; Accession=PF00240.13; Description=Ubiquitin family
  Pfam module annotation: Pfam domain module=UBA::XPC-binding::ubiquitin ; Domain location=219-261::326-384::51-122
MTKCLLMLLWILIISGNYVFGGCMFLTIEIFLNALYDPNLEFYFNKCVNASSFSQVDFVICFCHPLVSEVKKNIETVQGADVYPAAQQMLIHQGKVLRDASTLEENKVVENTFIVIMLSKSKSPSGEGSTTSTAPSTKAPQTSTVPASTPPASVVPQASAPAPAPAPAATGALPASVTAPISSPSPAPAPTPAPISSGTAVEGSDIYGQAASNLVAGSNLEGTIQQILDMGGGSWDRDTVVRALRAAYNNPERAVEYLYTGIPEQAEAPLVAQVPASAQPTNPPADAPQTAQPAPVTSAGPNANPLDLFPQGLPNVGSGAAGAGSLDFLRNSQQFQALRAMVQANPQILQPMLQELGKQNPHLMRLIRDHQADFLRLINEPAEGAEG

SEQ ID NO: 215373 - protein, 43 aa, Glycine max
  Coding DNA Sequence Number=SeqID_98595
  Gene Ontology: Cellular component=nucleus; Biological process =response to DNA damage stimulus
  Homolog annotation: Hit_ID=Q9STA6; Match level="QueryCoverage=86%, HitCoverage=9%, E-value=6e-14, Identity=92%"; Hit description=RAD23 protein
  Pfam annotation: Domain name=UBA; Domain location=3-36; Score=23.4; E_ value=0.0008; Accession=PF00627.21; Description=UBATS-N domain
MPFSLEAMGFDRAIVLEVYFACNKNEELAANYLLDHMHEFEEQ

SEQ ID NO: 215374 - protein, 492 aa, Glycine max
  Coding DNA Sequence Number=SeqID_98596
  Gene Ontology: Mol. function=signal peptidase activity; Cellular component=integral to membrane; Biological process=signal peptide processing
  Homolog annotation: Hit_ID=Q5H5E3; Match level="QueryCoverage=73%, HitCoverage=56%, E-value=1e-161, Identity=79%"; Hit description =Protease IV
  Pfam annotation: Domain name=CLP_protease; Domain location=86-279; Score=-92.4; E_value=0.06; Accession=PF00574.13; Description=Clp protease
  Pfam annotation: Domain name=Peptidase_S49; Domain location=139-292; Score=210.3; E_value=4.5e-60; Accession=PF01343.9; Description =Peptidase family S49
  Pfam module annotation: Pfam domain module=CLP_protease::Peptidase _S49; Domain location=86-279::139-292
DTLPEGIAAAGGDLAKFALQQKLVTSLKTREEFEDLMIERGVADDDADGGFRNVDFGTYLGQLDARRNPVDNRPQVAVVVAAGEISGGDLPAGRIGGESTSALLRAARDDENVKSVVLRVNSPGGEVFASEQIRREVVALQAAGKPVVVSMGDLAASGGYWISMNADRIYADPSTITGSIGIFGMVPNFSRALDKIGVHTDGVGTTRFAGAFDVTRPMDPAVGQVIQSVINKGYADFTGRVADARKKPVEAVDEVARGRVWSGAQAKERGLVDAFGGLKDAVADAASRAKLGKADAYRVRYIEKAATPFAQFVSGFAGSRAGAWMLSDSGMARMVLARTMPEVDTQLRFVENAAREKGNGTPPCPCARSQQRHRRFSARAWRGPVAAGSHGPWPAVPAASPDWAWAGVGKRTAARWPAGTWTGSGCAWRQSVMGVRAVSHPRQGAAVSAYPCRIETQRARPRRAHDPATVAPGRPDRPDHRRQRRHRPCHRA

SEQ ID NO: 215375 - protein, 185 aa, Glycine max
  Coding DNA Sequence Number=SeqID_98597
  Homolog annotation: Hit_ID=Q1T493; Match level="QueryCoverage=89%, HitCoverage=37%, E-value=4e-22, Identity=30%"; Hit description =Nucleic acid-binding, OB-fold, subgroup
GDQIHAICKSDHLKSWKADLKENCTYVMHNFKVVKNDGQFRVCEHEYKLFFIGVTVVREADLHELPFKEFRFVEFANVVAGNFVSGLGEILSCTLWENYCAQFLSYLNERGDDGPMVIILTHARIKDAQGSYPASVSNSFKASKLLINDPILEIQEFKERLLDLGVEVSRVLLPGDQASSQVSGG

SEQ ID NO: 215376 - protein, 467 aa, Glycine max
  Coding DNA Sequence Number=SeqID_98598
  Gene Ontology: Mol. function=protein binding; Cellular component =integral to membrane; Biological process=defense response to fungus
  Homolog annotation: Hit_ID=Q1SWI7; Match level="QueryCoverage=99%, HitCoverage=85%, E-value=6e-91, Identity=35%"; Hit description =Leucine-rich repeat
  Pfam annotation: Domain name=LRR_1; Domain location=104-126; Score =20.9; E_value=0.0047; Accession=PF00560.23; Description=Leucine Rich Repeat
  Pfam annotation: Domain name=LRR_1; Domain location=128-150; Score =17.6; E_value=0.045; Accession=PF00560.23; Description=Leucine Rich Repeat
  Pfam annotation: Domain name=LRR_1; Domain location=152-174; Score =2.2; E_value=1.1e+02; Accession=PF00560.23; Description=Leucine Rich Repeat
  Pfam annotation: Domain name=LRR_1; Domain location=181-203; Score =1.3; E_value=1.7e+02; Accession=PF00560.23; Description=Leucine Rich Repeat
  Pfam annotation: Domain name=LRR_1; Domain location=205-227; Score =13.8; E_value=0.64; Accession=PF00560.23; Description=Leucine Rich Repeat
  Pfam annotation: Domain name=LRR_1; Domain location=229-251; Score =12.3; E_value=1.4; Accession=PF00560.23; Description=Leucine Rich Repeat
  Pfam annotation: Domain name=LRR_1; Domain location=253-276; Score =7.1; E_value=13; Accession=PF00560.23; Description=Leucine Rich Repeat
  Pfam annotation: Domain name=LRR_1; Domain location=278-301; Score =4.9; E_value=34; Accession=PF00560.23; Description=Leucine Rich Repeat
  Pfam annotation: Domain name=LRR_1; Domain location=32-54; Score =17.1; E_value=0.064; Accession=PF00560.23; Description=Leucine Rich Repeat
  Pfam annotation: Domain name=LRR_1; Domain location=326-349; Score =5.4; E_value=28; Accession=PF00560.23; Description=Leucine Rich Repeat
  Pfam annotation: Domain name=LRR_1; Domain location=351-373; Score =6.8; E_value=15; Accession=PF00560.23; Description=Leucine Rich Repeat
  Pfam annotation: Domain name=LRR_1; Domain location=375-394; Score =0.7; E_value=2.1e+02; Accession=PF00560.23; Description=Leucine Rich Repeat
  Pfam annotation: Domain name=LRR_1; Domain location=396-417; Score =4.0; E_value=51; Accession=PF00560.23; Description=Leucine Rich Repeat
  Pfam annotation: Domain name=LRR_1; Domain location=424-443; Score =11.6; E_value=1.9; Accession=PF00560.23; Description=Leucine Rich Repeat
  Pfam annotation: Domain name=LRR_1; Domain location=448-467; Score =4.8; E_value=36; Accession=PF00560.23; Description=Leucine Rich Repeat
  Pfam annotation: Domain name=LRR_1; Domain location=56-78; Score =19.4; E_value=0.013; Accession=PF00560.23; Description=Leucine Rich Repeat
  Pfam annotation: Domain name=LRR_1; Domain location=8-30; Score=15.5; E_value=0.2; Accession=PF00560.23; Description=Leucine Rich Repeat
  Pfam annotation: Domain name=LRR_1; Domain location=80-102; Score =17.1; E_value=0.064; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1::LRR_1::LRR_1::LRR_1::LRR_1; Domain location=104-126::128 -150::152-174::181-203:...
  Pfam module annotation: Domain location=:205-227::229-251::253 -276::278-301::32-54::326-349::351-373::375-394::396-417::424 -443::448-467::56-78::8-30::80-102
MPLGNWTSLGKLDLSYNQLEGNIPTSLGNLTSLVELDLSYSQLEGNIPTSLGNLTSLVKLDLSYNQLEGNIPTSLGNLTSLVELDLSYSQLEGNIPTSLGNLTSLVELDLSGNQLEGNIPTSLGNLTSLVELDLSYSQLEGTIPTSLGNLCNLRVIDLSYLKLNQQVNELLEILAPCISHELTNLAVQSSRLSGNLTDHVGAFKNIERLDFSNNLIGGALPKSFGKLSSLRYLDLSINKFSGNPFESLGSLSKLSSLHIDGNLFHRVVKEDDLANLTSLTEFGASGNNFTLKVGPNWIPNFQLTYLEVTSWPLGPSFPLWIQSQNKLEYVGLSNTGIFDSISTQMWEALSQVLYLNLSRNHIHGEIGTTLKNPISIPTIDLSSNHLCGKLPYLSSNVLQLDLSSNSFSESMNDFLCNDQDEPMQLEFLNLASNNLSGEIPDCWMDWTSLVDVNLQSNHFVGNLPQSM

SEQ ID NO: 215377 - protein, 163 aa, Glycine max
  Coding DNA Sequence Number=SeqID_98599
  Homolog annotation: Hit_ID=Q8GU83; Match level="QueryCoverage=43%, HitCoverage=4%, E-value=4e-26, Identity=78%"; Hit description=PDR -like ABC transporter
RKRKSAQYANRLSPRVGRFINAAGTTGFPTGKRALILMKAGGRLTYAGPLGKHSSRVIEYFESIPGVPKIKDNYNPSTWMLEVTSRSAEAELGIDFAQIYRESTLYDRPAGMQAWHWPSFYNVVTGKTLALPNLIALQHIPLSPAGVIAKRPAPIALPNSCAA

SEQ ID NO: 215378 - protein, 159 aa, Glycine max
  Coding DNA Sequence Number=SeqID_98600
  Homolog annotation: Hit_ID=Q9LK64; Match level="QueryCoverage=59%, HitCoverage=6%, E-value=2e-14, Identity=49%"; Hit description =Multidrug resistance-associated protein 3
MVKLAPLEKPLLNGDSNVSNNYVPIKARGNENLTWYSNVGFFSILTFSWMIPLITLGNEKTLEHEDLPHLATDDSVDGILPTFTNKLESECGVSNEGRSTQGWGERHSDDDELRVAMRDLVSGGRRPEGAFARVSVGGQGEARVWERLMSARREKAFQF

SEQ ID NO: 215379 - protein, 109 aa, Glycine max
  Coding DNA Sequence Number=SeqID_98601
MQHITKDVESKVKAKGVILDVEAKGAMPEVEPKGAIPEVKAEGVSEDVALKVESKDSKIEEDPEEDLDWMDEYLKEALSDDLPKGFVSIMCLFFASLACRSSCGDVQMH

SEQ ID NO: 215380 - protein, 244 aa, Glycine max
  Coding DNA Sequence Number=SeqID_98602
  Gene Ontology: Mol. function=chitin binding; Cellular component =extracellular region; Biological process=chitin metabolic process
  Homolog annotation: Hit_ID=UPI00006A17C9; Match level="QueryCoverage =97%, HitCoverage=100%, E-value=3e-31, Identity=32%"; Hit description= UPI00006A17C9 related cluster
MPFTSEDYMSSPSEDYTSSASEDYTSLPSEDYPTSPSEGYTTSPSEGFKSSPSDDYTSSPSEDYKSLPSVDYIGLHTLAFRELHAVAFIRLHALSFRGLHVLAFRGLHVLGFRGLHVLAFRGLPDLTFRGLNDFAFRGLHVLSFRGLHVPAFRGLQALAFRGLHVLTFRGLHALTLSGLKTLTFRGLHVLVFRGLHAIAFKGEHFHAFRGLHALAFRGLHTLAFRGLHVLTFRWLHVLAFRGLH

SEQ ID NO: 215381 - protein, 159 aa, Glycine max
  Coding DNA Sequence Number=SeqID_98603
  Gene Ontology: Mol. function=oxidoreductase activity, acting on NADH or NADPH, quinone or similar compound as acceptor; Cellular component=photosystem II; Biological process=ATP synthesis coupled electron transport
  Homolog annotation: Hit_ID=Q3ZVC7; Match level="QueryCoverage=75%, HitCoverage=54%, E-value=1e-53, Identity=93%"; Hit description=NADH dehydrogenase subunit 2
  Pfam annotation: Domain name=Oxidored_q1; Domain location=23-145; Score=-98.0; E_value=0.01; Accession=PF00361.10; Description=NADH -Ubiquinoneplastoquinone (comple
MAITEFLLFILTATLGGMFLCGANDLITIFVALECFSLCSYLLSGYTKKDVRSNEATTKYLLMGGASSSILVHGFSWLYGSSGGEIELQEIVNGLINTQMNWVQAFPQPLLINGLLTYTKECGSFDKFLSLLSISEMFGFFQNSMDMQKRNAIPTRTKT

SEQ ID NO: 215382 - protein, 87 aa, Glycine max
  Coding DNA Sequence Number=SeqID_98604
MTTGRVWIEFCLPHPIPKTEWVTSHPRPRWSWRDEFGDAFMADNENPIPESEFGYRRKSDPDQLRFFSSKSEWVRGEPHMFESHCHA

SEQ ID NO: 215383 - protein, 103 aa, Glycine max
  Coding DNA Sequence Number=SeqID_98605
MRGYLMVIDPFRKPGANEPVDAGRLTSSSIPFVILTMKSGDMWGYIIVTRTFRQPGENEPVDARRLTSSSAPFVVLTREVRVTLWLPTPFVNRGKTSPLTRKD

SEQ ID NO: 215384 - protein, 45 aa, Glycine max
  Coding DNA Sequence Number=SeqID_98606
  Homolog annotation: Hit_ID=P61843; Match level="QueryCoverage=65%, HitCoverage=17%, E-value=5e-07, Identity=80%"; Hit description =Photosystem I assembly protein ycf3
KSNEGVNADALFPFLKAIRQGDSEVAESWFNQAAEYWKQAIALTP

SEQ ID NO: 215385 - protein, 132 aa, Glycine max
  Coding DNA Sequence Number=SeqID_98607
  Homolog annotation: Hit_ID=Q7MZX7; Match level="QueryCoverage=85%, HitCoverage=99%, E-value=8e-37, Identity=64%"; Hit description =Similar to putative lipoprotein YjeI of Escherichia coli
MASLSDKLLRNSQHRMGNKMRIKALLGLSAAMLLAGCSPTHELTAAGQQIKFTDSKPAAECQLLGEVTGTQSNWLSGNGGEGSSMCGAANDLRNKAAAMGGNVIYGANSPNQNLLSSFAPLDSKMVGQVYKC

SEQ ID NO: 215386 - protein, 41 aa, Glycine max
  Coding DNA Sequence Number=SeqID_98608
MFVAALQSARMSQNLEQHKLEDKNPGAPNNHCSKPKVKKQH

SEQ ID NO: 215387 - protein, 125 aa, Glycine max
  Coding DNA Sequence Number=SeqID_98609
MESQVIIWEDIQAKFEIPEASDSRTKKKVLQTPTRTVWTTVSVKNTALAWRNGPNFVRPAEIPRGRMCGKKHKPSRKQKLMVEKTKKKLEEAAQSGSTEGVINPPSPIRRHVKWKMARTKKTGQM

SEQ ID NO: 215388 - protein, 509 aa, Glycine max
  Coding DNA Sequence Number=SeqID_98610
MGTEMGQHAKEVWHPSEQGKDFPIDVKKDKSLGKDIYHNVVLTNVLEAYGIIRKFLYETPKETPLVDGSILSKIHQKFGLNTGPDDQLDAVWEKVVEEDYKVAPTPQCPPPTRVSPKAIDAMAHVSRRVSPKKQQPSSTIERLRELNKTDNDEDGLVFRKCKAAPTLVETHTPHVKKVKPTQASLPPTQPCTNKREKRGAQRTKHPAKSKLLLMLLMIFNLLRFLPFENRPQFSILSTSITIHLDYFEHLGPLAIDPNLTAKDITRLFFHMAFLVENACNIKRRLDMEFRPTTNWTQLPLDVEEEIVTCPPSMHKDHEVAPSSIALNQSKGIKVLPPPTWKRLHPKISKPSSSTALCKSVYKIPSRASREVPPFLCPKHIQLFAPMLQFISLVYGHQAIPLTKDDIFNVGMIMMHCDLTNQWLRYPLGIHIRPTATIKFMPDRVASRDVVMKTFTLKLDVEFDQNDAMLCYFKDMYENSYLASTLEYDKKDISNHKHGADLASNKDLQI

SEQ ID NO: 215389 - protein, 162 aa, Glycine max
  Coding DNA Sequence Number=SeqID_98611
MGSKRKRKGCDNQLSTDREGGFDGGDFSGEGGGASLGFIVDVGVGIIARGGNGGRTVGGSLCCMSMFTLNSIESLKDLSEAFKVFLISILIFMRSARNLFSVVSFRLACYRVMIKIEKVFFEFRVVCPSNDNGSSHSSFMIPVKVENEASANWRGVMNEAQV

SEQ ID NO: 215390 - protein, 103 aa, Glycine max
  Coding DNA Sequence Number=SeqID_98612
MKVDDHDGLCMPSDLIVFGWQRRLKIVLKTTKADDHDGLHMPTDLIVSRRKKGRQRETAIVLKTMKADEHEGLRIPSDLIVSGWQKRLNSLGQKTLKSSKRDR

SEQ ID NO: 215391 - protein, 44 aa, Glycine max
  Coding DNA Sequence Number=SeqID_98613
MPFITRGFSDPNARVLRGVRKAWDAVQRKDKELRGNGNGIINRY

SEQ ID NO: 215392 - protein, 57 aa, Glycine max
  Coding DNA Sequence Number=SeqID_98614
SSSSFLSKAILGGEAPSSLAYSLVDASIEAPQASFHHKVTARAPKKERRIGTNSWLA

SEQ ID NO: 215393 - protein, 77 aa, Glycine max
  Coding DNA Sequence Number=SeqID_98615
MPRTHDAILYYNGKWNMPPQNKFVGCAFIGKNPKKFQIPSTCTIDELKNLIKQVAPKGIPPLGIHESQTVLFDGTRE

SEQ ID NO: 215394 - protein, 98 aa, Glycine max
  Coding DNA Sequence Number=SeqID_98616
MPHKSVMQEISKLQSSLEEITHQLRRGNYLSMDENAELAAMRKRIESYQSMVMKARAEAKESDGVMSDLKEEIERLRRVNTQAPVPGNEDPALQKEIH

SEQ ID NO: 215395 - protein, 94 aa, Glycine max
  Coding DNA Sequence Number=SeqID_98617
MKLEAKTLIELDRERQRAAKIEGDLKQTIKAATKAQSSFMTQTAKSQKLINELRENIGLLKGQLKSRHKKNAVLKGNVTRSPNSKADLPSERNL

SEQ ID NO: 215396 - protein, 85 aa, Glycine max
  Coding DNA Sequence Number=SeqID_98618
MGCTHVPEIYPKAHENPRAFSCIFVPIFLESSVQCRWGEHFSEINEKKEKEEAKTRLRHFLIASVIDSYVVLHHSSFVLRSSTGM

SEQ ID NO: 215397 - protein, 77 aa, Glycine max
  Coding DNA Sequence Number=SeqID_98619
MGFESEKGGGGGLDGGGWWWNIRVSRWWRKCLGNGCLWLWVKAKCLGLGKGWKSGWNTYWWLRLNRRKRYWGNNNIE

SEQ ID NO: 215398 - protein, 163 aa, Glycine max
  Coding DNA Sequence Number=SeqID_98620
MCNLEDQPGKKAKQKVDSKTRCTTAIMRKVEAEAEKTRPNKLVSKPITVTAKAPKMVESTLVIIVEKPKKDTENEAPTKSTSHEATSKDATAVIVHTNTSGPNPINSAPLEVVTKAEVKEMIGLVMDYFTEKQRTENEEFIHNMQQTISTQFSSLGESLILNL

SEQ ID NO: 215399 - protein, 82 aa, Glycine max
  Coding DNA Sequence Number=SeqID_98621
MIYTTGGCTTRIISFQQVRYALCQEVCDDIAERLERHLSLGVVTPSSSTHEVIEECLKMDRSVTQDHLVYVRSRRRRRTDQA

SEQ ID NO: 215400 - protein, 81 aa, Glycine max
  Coding DNA Sequence Number=SeqID_98622
MASGNRLPRSNRALVIDYQLCVIDYTVYIAGFHILKLCNSSLASGNRLPMLCNRLPEKKTLEAYLLTTCSGYGTHCVVTRS

SEQ ID NO: 215401 - protein, 111 aa, Glycine max
  Coding DNA Sequence Number=SeqID_98623
  Gene Ontology: Mol. function=RNA-directed DNA polymerase activity; Cellular component=intracellular; Biological process=RNA-dependent DNA replication
ELHPELKRMVEQEDREMKPHQEETKIVNLDYQDIFAWSCQNIPGLNLDIVQNRLPLNPGCSPMKQKLRMKPEMSLKIKEEVKKQFDGGFLAVARYPEWVANIVPVPKKDGK

SEQ ID NO: 215402 - protein, 81 aa, Glycine max
  Coding DNA Sequence Number=SeqID_98624
  Gene Ontology: Mol. function=solute:hydrogen antiporter activity; Cellular component=integral to membrane; Biological process =regulation of pH
  Homolog annotation: Hit_ID=Q2HVU5; Match level="QueryCoverage=92%, HitCoverage=9%, E-value=2e-11, Identity=57%"; Hit description=Na+/H+ antiporter-like protein
  Subcellular localization annotation: CTP_CleavageSite=63; ConfidenceScore=5.33e-01
MLQVGPPEKSTHIDVNKLLLCPWPAKATAKANKTHAATSLKAAAAMAVSPTRVVSSLSSAKMRASTGKAVMDRDTPKNTKC

SEQ ID NO: 215403 - protein, 463 aa, Glycine max
  Coding DNA Sequence Number=SeqID_98625
  Gene Ontology: Mol. function=solute:hydrogen antiporter activity; Cellular component=integral to membrane; Biological process =regulation of pH
  Homolog annotation: Hit_ID=Q2HVU5; Match level="QueryCoverage=97%, HitCoverage=53%, E-value=1e-136, Identity=57%"; Hit description =Na+/H+ antiporter-like protein
MKVVSRKGENDAVDEIYVCLTLAGVLACGFVTDLIGIHSIFGAFVFGLTVPKNGSFARRLMERIEDFVLGLLLPLYFASSGLKTDVTTIRGGAAWGLLCLVIFTACAGKILGTFVVAMFCMIPARESLTLAVLMNTKGLVELIVLNIGKEKKVLNDEMFAILVLMALFTTFMTTPIVMSIYKAAKTQRKLGDINSLSSKVNEFRVLACIHGPNNIPSIISFIESSRSTAKSLLKLFMVHLVELSERSSSITMVQRAHKNGFPFFSRSHRDTWQDRLAGAFQGYGQLGQVKVRSTTAISSLSTMNEDICHVAEDKRVTMIILPFHKQWRMEMDEDNNNENCRVLENVGHEWRLVNQRVLKNAPCSVAVLVDRGCGNLPQTPSPIVAQRVCIIFFGGPDDREALELGKKMIEHPAVKVRVVRFVEKDDLMNGNDTVLSFSHDENGDKSYSFSTAKMNHQKEKVKL

SEQ ID NO: 215404 - protein, 336 aa, Glycine max
  Coding DNA Sequence Number=SeqID_98626
  Gene Ontology: Mol. function=calcium ion binding; Cellular component =extracellular region; Biological process=pathogenesis
  Homolog annotation: Hit_ID=Q5PFI0; Match level="QueryCoverage=79%, HitCoverage=71%, E-value=1e-19, Identity=30%"; Hit description=Large repetitive protein
LPRTTHHIVGETVVEAIKQGVALEALSLAQFKQFSAAIGEDVYPVLSLQSCLDKRNARGGVAPQQVPVTFDSASVNDGGFIVDGEITRDTRPALNGYAGRGVTLECYHNGELVGSTLSDAQTGYFSFTLPATLAGGSHQFMAQVAAMPQSASAPFTLIVEDAGFVPVTLTAMHSGTQFIWPEESTTQTQPTFSGKGQPGSRIELFDNDEPLGSALVDSDHKWTFTPSHALAAGEHQIVVTCGAGNVSAPVSLIVADDVTGDVARPEALSGLHLHDLLASVPVNLFQDAELNPDTQQYELVLNNDDLQQELTQSGIVGHSLVLTEQDLQQLLGDVPL

SEQ ID NO: 215405 - protein, 334 aa, Glycine max
  Coding DNA Sequence Number=SeqID_98627
  Homolog annotation: Hit_ID=P69486; Match level="QueryCoverage=23%, HitCoverage=51%, E-value=9e-29, Identity=83%"; Hit description =Scaffolding protein D
  Pfam annotation: Domain name=gpD; Domain location=107-243; Score =180.0; E_value=5.9e-51; Accession=PF02925.6; Description =Bacteriophage scaffolding protein D
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGIRSSIKLIQASAVLDLTEDDFDFLTSNKVWIATDRSRARRCVEACVYGTLDFVGYPRFPAPVEFIAAVIAYYVHPVNIQTDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 215406 - protein, 171 aa, Glycine max
  Coding DNA Sequence Number=SeqID_98628
MATMIKAMMSMKKIMEVNAAIVASSSVVAEVDPTPPSGLNQINHPISDMVGQRGKELGSTGGPHFVQVQNKHAILPFGLPPNYTPPNVVHTPIENVNDSTPILIESQQPQSDHAPIPQPMGGTHEIPHHNLANFKPCLEYATEGQAVGGVPLPNTLEGPQFCPQPQPLHFK

SEQ ID NO: 215407 - protein, 335 aa, Glycine max
  Coding DNA Sequence Number=SeqID_98629
  Gene Ontology: Mol. function=RNA-directed DNA polymerase activity; Biological process=RNA-dependent DNA replication
KFTGCATMLSFDFRHATELHELPNDGAKYLEVVKRGSHPNNGWSPDEIRDSPNVKTNAFANHGGSTINAVEECGPQRPKQMKDVVTSRRFILEALREASMISFDWYRGDSCLVYSGATHDVETCSTTEELLQGMMDKGMGVAMHKPRGFQPITVKKPTLFPYKSDKMVPWKYAPRRHDGRKKDSIIEDLSVTKVTNISGTSGVTRSGGIFAAPELPVRAIDLKGKAKDFSKKGISVDEATEFLRIIQQSEFKVIEQLNKTPARISLGKNGVARGFLDKLVMLEGGEEIKDEVDSTFLITPFLELEIKEAVWSCDGDKSLGLDGFDFQFSRRVGNS

SEQ ID NO: 215408 - protein, 155 aa, Glycine max
  Coding DNA Sequence Number=SeqID_98630
  Subcellular localization annotation: CTP_CleavageSite=50; ConfidenceScore=5.48e-01
MEKISHTWGVKNIIYRSSSFFVRSSSFFSLQLFFRRFPQINVGGDSAHFSFMEDAPVSLASPSLRRVGCDKGVCCRSSNIVYPHSSHGLKMKSTTMQLVATYPLAGGRGEKKGRVFRKGECAGVTTNVYLRKMLEKTKRKRPVNFENKGSGVVYA

SEQ ID NO: 215409 - protein, 175 aa, Glycine max
  Coding DNA Sequence Number=SeqID_98631
MAHNQGWEQELGLYNQYEEERTSNLETKSTQQALQSVEIQVGELADVVTQFMSRREKSFVEAEAQEKSPIKEHESREKDEEKDEEQAQQQWDKYSIVENQQENILPSNNLPHQLIDKKGSQGEHEETLSDILSLITNTFLEMIWNVLPNYMKFMEFLAKRRNFKEDVFFVTFMPP

SEQ ID NO: 215410 - protein, 111 aa, Glycine max
  Coding DNA Sequence Number=SeqID_98632
MDEDQWMYEGIMPEEVDMDYENEEECGVNEPHVDCSNPFNTSQETEIIWIVIVRSNTNTGSKGRASFVLIGCEMSDEYRCRKKEFVRRDTGTRKCECPFKLRGKPVVGRQD

SEQ ID NO: 215411 - protein, 107 aa, Glycine max
  Coding DNA Sequence Number=SeqID_98633
MPRAQNSTDTIVPILGKELWRHQDEQLLQRYLGFINATCRRRNQERVRKFLQDLEATAIPEEEPQSFEASSSFPIVGHSHLDHIEDHIMDEEPRRVTLEDYSSSNVP

SEQ ID NO: 215412 - protein, 169 aa, Glycine max
  Coding DNA Sequence Number=SeqID_98634
MENNDDEGWYHDPRSVKVALLRESRQVALHCHFRIPLALHSFLQRVTLHLALQPLPDENPKAAQIQGPTTRVRTKQSEDILQQMVAAILDKAQVEKDEGPELLSEFIVEPIPNLSRLNPCGVYLDLSSISGSGVNRFRDLYQGCGDKSGVVKDVSLLKGKRGRGKAFWD

SEQ ID NO: 215413 - protein, 73 aa, Glycine max
  Coding DNA Sequence Number=SeqID_98635
MRPSSTCALSARHALSVQGKTGAKRGVKHEDVGFVTRAKREPRTKRAIQQKHTLSLQQALSARSECTKRAVSR

SEQ ID NO: 215414 - protein, 38 aa, Glycine max
  Coding DNA Sequence Number=SeqID_98636
GEEPSRAAIEDPTVDEDLIANLAGADWGPWADLGGGST

SEQ ID NO: 215415 - protein, 52 aa, Glycine max
  Coding DNA Sequence Number=SeqID_98637
MRAITCSRAMHKLSKGRQQSSPCYLEDRTCFFAYFIQSAPPNLSGGHIKRKT

SEQ ID NO: 215416 - protein, 513 aa, Glycine max
  Coding DNA Sequence Number=SeqID_98638
  Gene Ontology: Mol. function=kinase activity
  Homolog annotation: Hit_ID=Q2HUI1; Match level="QueryCoverage=98%, HitCoverage=95%, E-value=1e-87, Identity=44%"; Hit description =Phytochrome kinase substrate 1-like protein, putative
MEREILTKTVRNRDASFSSYLRPDNKATPITTAAPIEDATTELSIFDARKYFNDDDSSNNNNNNANNIQKVSISRVSPMERIPERGDAIITEATRYSSASSSVDSYAQIRNYRAQSFHTATPTASSEASWNSQTGLLSHPPGAIPVSMQNPQNPKNLPNPKFSKSIWLLRRKCPCTGKKSVRVKESTQESKSQISQQERDYEHHNNNNVRNHITPNNWILNQTPAPIPALAPATATIVAAKSQQFNNSNSHRVVSSVRVPFTDGFTFPVLHPNNSISKLKLANVNSVVEEDPPRESLEVFRPPDEPSPNPSPKQLNFPFPAKANVVEDDAASDASSDLFEIESFSTATQSTYPAAYRRNSRDSFDEASATASASASTSTTATATSTATGFFYGRRSMDEGSTTPTITECYEPSEASIEWSVTTAEGHDDAVSNGVVVEEKWKRKGGNGLLVSCRSQKAVSVGPQPVKCGSEGQRNATSSLSSHVNVIGSVNKPPLAHARGHRNAPRVSLAFAT

SEQ ID NO: 215417 - protein, 73 aa, Glycine max
  Coding DNA Sequence Number=SeqID_98639
MRSKRGVHFHDDPTVNKSRIVVLLGQDWVYARKEKTQCEGNFFHHIHYLENPKGLSVCGKNNGFWKMKKGKRI

SEQ ID NO: 215418 - protein, 43 aa, Glycine max
  Coding DNA Sequence Number=SeqID_98640
MASKIEVALGAIPFDSPTIFDKIINKEIPSIVVYEDDKVLLNA

SEQ ID NO: 215419 - protein, 85 aa, Glycine max
  Coding DNA Sequence Number=SeqID_98641
  Homolog annotation: Hit_ID=Q6K5F4; Match level="QueryCoverage=83%, HitCoverage=23%, E-value=4e-08, Identity=43%"; Hit description=2 coiled coil domains of eukaryotic origin (31.3 kD)-like protein
  Pfam annotation: Domain name=Isy1; Domain location=1-85; Score= -132.2; E_value=0.075; Accession=PF06246.3; Description=Isy1-like splicing family
MARNEEKAQSMLNRFITMKAEEKKKPKERRPFPTSECRDLSEADKFSKTKFSQIGPSFTSMTLSGKNCHKLQTSHTATPLPPSFL

SEQ ID NO: 215420 - protein, 96 aa, Glycine max
  Coding DNA Sequence Number=SeqID_98642
  Subcellular localization annotation: CTP_CleavageSite=56; ConfidenceScore=5.03e-01
MYFAWWRGGGPRLCRCGLVLSVGGFVSFVVTGSIAALRFGIVLVGVHLALSVSSLRANKKGHTTFFFNAQRPNRNSNYIVFAGDKDCYLQRLDHFI

SEQ ID NO: 215421 - protein, 315 aa, Glycine max
  Coding DNA Sequence Number=SeqID_98643
  Subcellular localization annotation: CTP_CleavageSite=45; ConfidenceScore=5.41e-01
MSIFCSNKSDSSSCSSCLARSFKNSAWSMSSLVTALQESPSTICSHSHYSHHATEFSTPRDQSFGIATSKVDDYNNNNNLSTCLSDIDEWLEHANKFCKSSIHLTESVHSGQNGSQEEEDSRLSAICNTYLAAQEHELHNITLPCVREESPFFQGQTRHACTYKPPKCEGYEHTKMMDDIVRRKQEEDERDARKKAKHVELMLKLRRKENAINDWELQQTRKAMDKMDKIQAFIITFEKIKEQTTKHKQFKHNELERKQFRASARTQKKICLVRQKAEKQKLNLRRSTMKRFQQMQTSETHSPSQISWASHLPLC

SEQ ID NO: 215422 - protein, 1090 aa, Glycine max
  Coding DNA Sequence Number=SeqID_98644
  Gene Ontology: Mol. function=3'-5'-exoribonuclease activity; Cellular component=cytosol; Biological process=negative regulation of transcription from RNA polymerase II promoter
  Homolog annotation: Hit_ID=Q1RY91; Match level="QueryCoverage=99%, HitCoverage=45%, E-value=0.0, Identity=83%"; Hit description=CCR4 -Not complex component, Not1
APGSEVQDKILFIINNVSAANVEAKAKEFTEILKEQYYPWFAQYMVMKRASIEPNFHDLYLKFLDKVNSKALNKEIVQATYENCKVLLGSELIKSSSEERSLLKNLGSWLGKLTIGRNQVLRAREIDPKSLIMEAYEKGLMIAVIPFTSKVLEPCLNSLAYQPPNPWTMGILGLLAEIYSMPNLKMNLKFDIEVLFKNLGVDMKDVTPTSLLKDRKREFEGNPDFSNKDVGGSQSQMITDIKSGLVPPVNQVELPLEVTNPSNTGAHPHILSQYAGPLHISSGALMEDEKVTPLGLSDSLPSAQGLLQANPGPVPFSISQIPTQIPNIGTHVIINQKLSGFGLQMHFQRAVPIAMDRAIKEIVSSIVQRSVSIATQTTKELVLKDYAMESDETRILNAAHLMVASLAGSLAHVTCKEPLRASISGQLRTSLQNLNIANEILEQAVQLVTNDNLDLGCAVIEQAATDKAINTIDTEIGQQLSLRRKHREGMGSTFFDANLYPQGSMGGVPEPLRPKPGQLSLSQQRVYEDFVRLPWQSQSSPSSHSMSSGVAVQSGTGLTGTNGSVSGQSNPGYPVTTGYEGVSRPLDDMTESNLAPHFSASSINIRAADSVSQHSLEKDSVASFPSAASTPELHAVDSSEVKESGTSSQPLVTSGAVERLGSSFLEPSLTTRDALDKFQIVAQKLEAMVSNDSRDGEIQGVISEVPEIILRCVSRDEAALAVAQKVFRGLYDNASNNIHVTAHLAILTAIRDVCKLAVKELTSWVIYSEEERKYNKEITVGLIRSELLNLTEYNVHMAKLIDGGRNKAAMEFSISLLQTLVVEEPKVISELHNLVDALAKLATKPGCPESLPQLLEMIKNPGAISSSNAGKEDKARQSRDIKVPGLLPANREEFNSIDSIEPDPAGFREQVSMLFTEWYRICELPGANDTAFAHFILQLHQNGLLKGDDLTDRFFRLLTELAVAHCLSTEMINSGSLQSQPQQTMSFLAIDIYAKLVFSILKGSNKLFLLSKILAVTVRFIIKDAEEKKASFNPRPLFRLFINWLLDLGSLEPVTDGANLQILTGFANAFHALQPLKVPAFRLGFSTCDS

SEQ ID NO: 215423 - protein, 804 aa, Glycine max
  Coding DNA Sequence Number=SeqID_98645
  Gene Ontology: Cellular component=cytosol
  Homolog annotation: Hit_ID=Q1RY91; Match level="QueryCoverage=99%, HitCoverage=33%, E-value=0.0, Identity=75%"; Hit description=CCR4 -Not complex component, Not1
MAQIEELCANPGYLSFHEQIHNVIMFLKQSEGLSKHVDSFMQILSLVQFKDTPPFVLTPLLPDEMHEADFLRWNMELFHDSGENDFDAILADIQKEMNMGDIVKELGYGCTVDVSQCKEIFSLFLPLTENTLSKLLGAIACTHIGLEDNQNTYLTFRAAHGYNVPELPPLNSWNIDVLIDTLKHLAPHTNWVRVIENLDHEGFFLPSEEAFSFLMSVYKHACKEPFPLHAICGPVWKNTEGQLSFLKYAVSAPPEIFTFAHSGRQLAYVDAINGHKLQNGHANHAWLCLDLLDVLCQLAEKGHASIVRSIFDYPLKHCPEVLLLGLAHINTAYNLLQQEVSLIVFLMIVKSGVGSGMILHLWHVNPNLVLRGFVDSQNNDADSIVRIVDICQELKILSSVVEIMPSYYSIRLAAVASRKEFLDLEKWLSSNLTTYKEAFFEECLKFLKDSHFGGSQNLSGKSFHQSGAILSLYAEAAATILKVLKSHTDLVASRQLSEELERLHVSIIDTNPRLQNGGTADSSTSDGYADDIEAEANSYFHQMFSDQLTINAMVQMLARFKESSVKREKSIFECMIANLFEEYRFFPKYPERQLKIAAVLFGSVIKHQLVTHLSLGIALRYVLDALRKPADSKMFLFGSLALEQFVDRLIEWPQYCNHILQISHLRSTHSEIVSFIEQALARISSGHLDVDGASHASVISNHHSAQATIGHVELSGSSVIQPGQQHLSLQLQQRRENPLDDRHKASVGSSTDVKPLLSSLGKSSVLTPTDASSTNKLHSTVSTSSMLSSSSPGFVRPSRGTTSA

SEQ ID NO: 215424 - protein, 54 aa, Glycine max
  Coding DNA Sequence Number=SeqID_98646
MLDCVLNHTHALALVRVVEIVVENATKFVKGKNGLIVLDVRLNGTTCVECLGHA

SEQ ID NO: 215425 - protein, 101 aa, Glycine max
  Coding DNA Sequence Number=SeqID_98647
MEVDTDPFITQANYVELVHILMVDVVLEDNCVQPTPIFVANVVPKVGDKKKSSHSKENLDRLSEELEMENTEIYFEARDTLTKFLIGKKDVDQKVPGMPIC

SEQ ID NO: 215426 - protein, 775 aa, Glycine max
  Coding DNA Sequence Number=SeqID_98648
  Gene Ontology: Mol. function=protein-N(PI)-phosphohistidine-sugar phosphotransferase activity; Cellular component=cytoplasm; Biological process=phosphoenolpyruvate-dependent sugar phosphotransferase system
  Homolog annotation: Hit_ID=Q1RY91; Match level="QueryCoverage=94%, HitCoverage=49%, E-value=1e-157, Identity=71%"; Hit description=CCR4- Not complex component, Not1
  Pfam annotation: Domain name=Not1; Domain location=579-775; Score =69.4; E_value=1.1e-17; Accession=PF04054.5; Description=CCR4-Not complex component, Not1
NSMIEADREQEVIKTQDLKELLGELEMDASIEPNFHDLYLKFLDKVNSKALNKEIIQATYENCKVLLGSELIKSSSEERSLLKNLGSWLGKLTIGRNQVLKAREIDPKSLIIEAYEKGLMIAVIPFISKILKSCQSSIAYEPSNPWTKGILRLLVEIYSMPNLKMNLMFDIEVLLKHLGVDMMDVTPTSLLLKDRKREMEGNPDFSNKDVGASSKMIIDLKCGPVPPVNEAELPLVVTNPSNTGAHPHVVSQYAGPLHISSGALMEDEKFTPLGLSDQLSSAQVLLQATPASAPISISRLPIQIPDIGTRAIINEKLGGFGLQMYFNRASPGAAVKLCLGDLLVMGSNPETASLHMQGQLRNSLQNLNITNEILEQAMQLVTNDNIDLGFAVIEQVAADKAKNTIDTEITQQLFLRRKHREGFSSTFFYANKEEFKGVDSVEPDPSGFCKQVAVLFKEWYRICEFPGANDTASAHFILQLHQNGLLKGDDVTDHFFRQLMELAIAHCLSTEVINLGSLQSQPPTMSFLAIDIYAKLVFSILKGSNELVLLSKIMAVTVRFIIKDAEEKNALFNPRPVFRLFINWLLDLGLLEPVTDGANLQILTVFANAFHALQPLKVPAFRSFMPKMLTGNGQKGWPYIQRLLVDLFQFMEPFLRHAELGEPVRVLYKGTLRVLLVLLHDFPEFLCDYHFTFCDVIPSSCIQMRNIILSACPRSMRLPDPSTPKLKIDLLQEINQSPSILSEVDAALKAKQIKTHVDEYLKACPHPSLNWFVIN

SEQ ID NO: 215427 - protein, 538 aa, Glycine max
  Coding DNA Sequence Number=SeqID_98649
  Homolog annotation: Hit_ID=Q1RY91; Match level="QueryCoverage=99%, HitCoverage=32%, E-value=0.0, Identity=77%"; Hit description=CCR4 -Not complex component, Not1
MELLHDSGENDFDAILADIQKEINIGDIVKELGYGCTVDVSGCKEILSLFLPLTDNALSKLLGAIAYSNTGLEDNQNTYLTFRAAHGYNVSELPLLNSWNIDVLIDTVKQLAPQTNWIRVIENLDHEGFFLPCEEAFFFLMSVYKHACKEPFPLHAICGSVWKNTEGQLSFLKYAVSALPEMFTFARSGRQLAYVDAVNYHKHQNEHANNAWLCLDLLDVLCLLAEKGHTSIVRSILDYPLKHCPEVLLLGMAHINTAYNLLQREVSLIVFPMIVKSPAGSGIILQLWHVNPNLVLRGLMDSQNNDADSIIRIVDICQELKILSSVVEIIPSYYSIRLAAFASRKEFLDLEKWLSRNLTTYKDVFFEECLGFLKDAHFGGSQNLSGKSFHQSGAVLSLCVETTATFLKVLKSHTDLVTSRQHSEELERLHISIIDCSQLHSAVSTSSMPSSRGFVCPSRGATSIRFGSALNIETLAAAAEKRETPIEAPGSEVQDKISLMINNTFAANIDSKAKEFTEILKEQYYPWFAQYMVMKRLA

SEQ ID NO: 215428 - protein, 150 aa, Glycine max
  Coding DNA Sequence Number=SeqID_98650
MHPAVPNSVNCQQKKEHINNQSNQSDNTKKIPNMNQLKNKEQPEANLIRSLAKPIICLVLEIRVIQRVAKHKNRALNKTGYEQRCKSIKHGEKELAENGVKVDFVQRTEEKANLVGGEVGHGGGRGITKNKSHHRERKLKLVEKKNKKKE

SEQ ID NO: 215429 - protein, 46 aa, Glycine max
  Coding DNA Sequence Number=SeqID_98651
MDTHLRVIGDPMNEVQRGKGHKPLFKDLPSECGGEAATVRYGLISK

SEQ ID NO: 215430 - protein, 69 aa, Glycine max
  Coding DNA Sequence Number=SeqID_98652
MSRASPTLSLALCMVLSSPMTCLAHGRSGEVEAVSLMGGVRQADVMVSSVLVTIHEEGNWLSFAFFLFF

SEQ ID NO: 215431 - protein, 895 aa, Glycine max
  Coding DNA Sequence Number=SeqID_98653
  Gene Ontology: Mol. function=RNA-directed DNA polymerase activity; Cellular component=chromatin; Biological process=one-carbon compound metabolic process
  Pfam annotation: Domain name=Chromo; Domain location=828-879; Score =28.5; E_value=2.3e-05; Accession=PF00385.14; Description='chromo' (CHRromatin Organisation MOdifier
  Pfam annotation: Domain name=rve; Domain location=564-727; Score =65.8; E_value=1.4e-16; Accession=PF00665.16; Description=Integrase core domain
  Pfam annotation: Domain name=zf-H2C2; Domain location=505-546; Score =19.4; E_value=0.00097; Accession=PF09337.1; Description=His(2) -Cys(2) zinc finger
  Pfam module annotation: Pfam domain module=Chromo::RVT_1::rve::zf -H2C2; Domain location=828-879::192-361::564-727::505-546
MVGNDQYLECQSICDAIFINIQNHSFLVDLHVLPISGANVVLGVQWLKSLGPVLTDYTTLSMQFIYQGQLIKLQGDPEANLSSISSSQFRRLCQTQHQGLYFHITVLADTPSSSMEDLPPPQLQVLLDQYAILFQPPQTLPPPRTTDHHIHILPQSTPVNVQPYRYPHFQKREIELQVESMLQKGLIRPSNSPFSSPVLLVKKYDGTWRFCVDYRALNSLTIKDRFPIPTIDELLDELGGAQCFSKLDLLQGYHQIRMNSADIPKTAFRTHHGHYEFRVMPFGLCNAPSSFQATMNFIFRPFLCRFVIVFFDDILIYSSVEPMPDKIAAIINWPQPHSAKAVRSFLGLASFYRKFIHGYAMIVDPLVKATITEPLQWTPQTEHAFQTLKVALSTAPVLALPNFQEPFTVETDASSNGMGVVLSQRDHPIAYFSKPFTKKLLTASTYELHQQVANDPQYCQHRQDIINSPATYPDFTIRQNLILQKGRIWLPRNLPLIRTLLLEYHSTPIGGHMGVAKTIARLSENFIWSGLRSDVTTFVANCAKCQFTKYETKRTAGLLCPLPVPFQPWEDLSLDFITGLPPFQGKSVLLVVVDRFSKGIHLGILPPSHTAHMVASLFIDIVVKHHGIPRSLVSDRDPMFISGFWQELFKLSGTHLRMSSAYHPQSDGQTEVMNRITFGHKPFSFPEYIMGTSKLDAVDDFLKHREEVFNCIRQKLLKAQSNMKSTADAKRRDVNYEVGNWVLLKLRPYRQQSAKATPISSGKLAKRLYGPFRILERVGKVAYHLQLPEGARIHPVFHCSLLKPFHGDPNADITPPLPEHFLNDQPIISPLAILDCRRSSSEADAPWEVLVQWRGLSPDETSWEDWEQLKQDHHLEDKVILQGPREIDSSRETLT

SEQ ID NO: 215432 - protein, 140 aa, Glycine max
  Coding DNA Sequence Number=SeqID_98654
MSKFDPEIVMEFYANAWPTEEGVRDMRSWVRGQWIPFDGDAINQFLGHPLVLEEDQQCEYSQRRSQASGFDEEAIGIAPTRHLVDPKKSNRALGFPALITGLCQFYGVLVAPSKLIRPPINRAFIEKYCMPRKTQGQVPQ

SEQ ID NO: 215433 - protein, 66 aa, Glycine max
  Coding DNA Sequence Number=SeqID_98655
MSGERISSLQWLSLVTKTIGRCWNYRQLNNHATAFLLKMYAADCCTCNDVSAEARVVAFSARSIGD

SEQ ID NO: 215434 - protein, 242 aa, Glycine max
  Coding DNA Sequence Number=SeqID_98656
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=65%, HitCoverage=10%, E-value=8e-16, Identity=31%"; Hit description=Chromo
GRVILIRNEEKKPRGATMPSMEFLLTVEAKSPLSAGGNLLRGQALPSVRWWAIRWWKEGGKVGEGGGLGFLKGGERGGVDNGGSRVGGRARPRRLAHVGELLLLETCEARGLDQSGWLMGLDLPSNLRYQTGDEATKEKGRGQASSAVGEILEVRKILGHGARLGTGCGGGRGGGVGGVEEKAGETRWRSSSIFMATEGILKLVGGEGGSIGIRHGKEQREHQIDRSARALQLASRARTSEK

SEQ ID NO: 215435 - protein, 182 aa, Glycine max
  Coding DNA Sequence Number=SeqID_98657
MNTEVHIATSKEEDTTNTNAEVQIVKAKRRTIRPTGPGPRSQLQSTSTPINLVLSLLLSMADSDRASFSPDKLEDALSRLAKQQLYLGESVNAMTMKIDELLQRVSPAFSSTPPTPPPLPPPQPVPTPIHKLKLDVPRFDGSDPLGWIYKINQFFEYHRTPDSDKITIASFHMEGRALAWFQ

SEQ ID NO: 215436 - protein, 295 aa, Glycine max
  Coding DNA Sequence Number=SeqID_98658
  Gene Ontology: Mol. function=RNA-directed DNA polymerase activity; Cellular component=chromatin; Biological process=chromatin assembly or disassembly
  Pfam annotation: Domain name=Chromo; Domain location=245-295; Score =28.8; E_value=1.9e-05; Accession=PF00385.14; Description='chromo' (CHRromatin Organisation MOdifier
GRENVAADALSRLDSPEIMALQVHQPDSSMLSRIQQSWQTYPSLHQLPQLRQDILSWIHASGCSFHLGRDATLQKMKNMDCFNPYLFLSMYGSTSPWTSLKVFLFLLVNSDSPAQWSKWLPLAERWYNSTYHSTIKASPYEIVYGQAPPKREEMLKLLKFHMKRAHDRMKQLADKVQDRSNAKLAPKYYGPFLVEGKIGVVAYKLKSPLGSMVYNVFHVSQLKKFTGTATSGNFSPSPLLDTSQKEPAAIIDRMIVKRGNRAVTKVLVQWKHQLPEDVTWEFFYDLKQKFPHFNP

SEQ ID NO: 215437 - protein, 214 aa, Glycine max
  Coding DNA Sequence Number=SeqID_98659
  Gene Ontology: Mol. function=helicase activity; Cellular component =mitochondrion; Biological process=regulation of transcription, DNA -dependent
  Homolog annotation: Hit_ID=Q1RY94; Match level="QueryCoverage=98%, HitCoverage=67%, E-value=2e-88, Identity=49%"; Hit description =Pentatricopeptide repeat
  Pfam annotation: Domain name=PPR; Domain location=122-156; Score =36.5; E_value=9.1e-08; Accession=PF01535.11; Description=PPR repeat
  Pfam annotation: Domain name=PPR; Domain location=157-191; Score=8.2; E_value=0.79; Accession=PF01535.11; Description=PPR repeat
  Pfam annotation: Domain name=PPR; Domain location=17-51; Score=44.2; E_value=4.3e-10; Accession=PF01535.11; Description=PPR repeat
  Pfam annotation: Domain name=PPR; Domain location=52-86; Score=44.2; E_value=4.5e-10; Accession=PF01535.11; Description=PPR repeat
  Pfam annotation: Domain name=PPR; Domain location=87-121; Score=50.3; E_value=6.3e-12; Accession=PF01535.11; Description=PPR repeat
  Pfam module annotation: Pfam domain module=PPR::PPR::PPR::PPR::PPR; Domain location=122-156::157-191::17-51::52-86::87-121
MRLVSVLHEEGFKPDCFVYNTIMKGYCLLSRGSEVIEVYNKMKEEGVEPDLVTYNTLIFGLSKSGRVTEAKKLLRVMAEKGYFPDEVTYTSLMNGLCRKGDALGALALLGEMEAKGCSPNECTYNTLLHGLCKARLVEKAVEFYGVIRAGGLKLDTASYGTFVRALCREGRIAEKYEVFDYAVESESLTDAAAYSTLESTLKWLRKAKEQGLTV

SEQ ID NO: 215438 - protein, 284 aa, Glycine max
  Coding DNA Sequence Number=SeqID_98660
  Gene Ontology: Mol. function=RNA-directed DNA polymerase activity; Cellular component=chromatin; Biological process=chromatin assembly or disassembly
MAENTRSQASLREMEERLSSKMESRFVELAASMQQAIHLEVRDLAPIPVALDWLGKALQWHSAYIKSIGLENLPSWNEYRILLLDRFGDVCEDPMANLMKLRQIGSIIEYHEEFDSIVSRVDLSEEHQLHCFLGGLKQEVQMIVRMFQPNSVRKAYSLAKMYASSFSNTQAKLFVKNQKSSFVPKPPLLPNPSRSTNPLTINSSTKPQTPKHLTPAYMAERRSNGLCYFYEEEGSGPQEIDANVDYLKSGIIQNSDSPYPSPVVLVGKKDGAWRLCVDYRDLNK

SEQ ID NO: 215439 - protein, 214 aa, Glycine max
  Coding DNA Sequence Number=SeqID_98661
  Homolog annotation: Hit_ID=Q1RY94; Match level="QueryCoverage=99%, HitCoverage=50%, E-value=5e-50, Identity=49%"; Hit description =Pentatricopeptide repeat
  Subcellular localization annotation: CTP_CleavageSite=80; ConfidenceScore=5.56e-01
MGKIPPSFRSAIANPNSSLFRPQPPHFPNKQQQPRKPKPSKQQQNPSSSSLPLFKSPNLQDAKKLFNSDPRFPNSLLHSYAKLAQTPSDSVNFFNHITKTLSSFSPDRSTFHILLSHSSNSLSPIHQTLNLMLAAGITPDTTTADVAVRSLCSAARLDLAVELIKEFASKHCPPDTYTFNFLVKHLCKSRTVATVYDFIDEMREKFDIKPDLFT

SEQ ID NO: 215440 - protein, 40 aa, Glycine max
  Coding DNA Sequence Number=SeqID_98662
MRDNDDFDIDSDDDNENVWWNYGVGGGMMIMGLSLIEGAE

SEQ ID NO: 215441 - protein, 61 aa, Glycine max
  Coding DNA Sequence Number=SeqID_98663
MASVHTVIPPGGTCLRGQSRHWSWRDRLHYFLMQPDGTEAWARVLLHMHPVVALEDTRALY

SEQ ID NO: 215442 - protein, 505 aa, Glycine max
  Coding DNA Sequence Number=SeqID_98664
  Gene Ontology: Mol. function=hydrolase activity, acting on glycosyl bonds; Cellular component=cellulose and pectin-containing cell wall; Biological process=carbohydrate metabolic process
  Homolog annotation: Hit_ID=O81246; Match level="QueryCoverage=96%, HitCoverage=94%, E-value=1e-116, Identity=46%"; Hit description =Polygalacturonase precursor
  Pfam annotation: Domain name=Glyco_hydro_28; Domain location=93-498; Score=430.9; E_value=1.7e-126; Accession=PF00295.8; Description =Glycosyl hydrolases family 28
MSPQSVALPFFITMFVSFGVCFGSFLEDTYHLTNYQRYSMKPNNEHFGIMTRAYGSTPSTRSQRRINIDDYGAKASDGRDDTEAFEKAWDEACSTGGILVVPEEKIYHLKPITFSGPCLTNTAFRVYGTIKAWPKMSTYQNDRLHWIKFENVTNLRVDGGGTINGNGRKWWENSCKRNENLPCKPAPTCSIFIYEAPTLTRTPDTTRTQTLTQTREHLSNTSNSTRTRVSVSCRCRCQCRVEHRTRQETEAVTFYQCNNLRVTNLRFKNAQQMHIRFQKCNNVTASNLIVRAPGNSPNTDGIHVTETRNILISNSIIGTGDDCISIVSGSQNVRAIDVKCGPGHGISIGSLGAGDSKAQVSNVLVNRATFTGTTNGVRIKTWQGGSGYAKNVKFVNITMRNVTNPIIVDQNYCDQDKPCHEKDSAVKLSNIVYQNIRGTSASEVAIKFDCSKTVPCKGIYLQDVILTPEDHGGGGSSTIATCENLMEGPRGKEVKCCGKVGIKQR

SEQ ID NO: 215443 - protein, 77 aa, Glycine max
  Coding DNA Sequence Number=SeqID_98665
MTLLVRNVDSLVVQDEGNSLVKIKHTKNELSISKSQIPSKSRKRESPITIATNVEEEVDYVEVIPFNIPFSKHLVEL

SEQ ID NO: 215444 - protein, 95 aa, Glycine max
  Coding DNA Sequence Number=SeqID_98666
  Gene Ontology: Mol. function=DNA binding; Cellular component =mitochondrion; Biological process=DNA integration
  Homolog annotation: Hit_ID=Q1SDN3; Match level="QueryCoverage=97%, HitCoverage=7%, E-value=1e-27, Identity=60%"; Hit description =Polynucleotidyl transferase, Ribonuclease H fold
MAHLLEEFRVHFHHPATLYCDNKSALHIAVNPVFHERTKHIEIDCHIVREKVMIGLVKLLHVSSANQLADIYTKALMPGAFQFLYSKLGMSDIHS

SEQ ID NO: 215445 - protein, 133 aa, Glycine max
  Coding DNA Sequence Number=SeqID_98667
MDSLKPTCDPVPLLCATIQNHPQLFKLPAATVAVSSETCSLAHHRVKALEDKNLAGREKALRRPFDKLHTFFGFSKTFQLDIDKDVYNGELKPFAEIKGYDTLVAATILVQVVGAEVERSQVPSTPTMTGAVV

SEQ ID NO: 215446 - protein, 555 aa, Glycine max
  Coding DNA Sequence Number=SeqID_98668
  Gene Ontology: Mol. function=DNA binding; Cellular component=beta -galactosidase complex; Biological process=DNA integration
  Homolog annotation: Hit_ID=Q1SS72; Match level="QueryCoverage=94%, HitCoverage=68%, E-value=1e-80, Identity=51%"; Hit description =Integrase, catalytic region
  Pfam annotation: Domain name=zf-CCHC; Domain location=30-47; Score =6.1; E_value=0.096; Accession=PF00098.13; Description=Zinc knuckle
  Pfam module annotation: Pfam domain module=RVT_2::zf-CCHC; Domain location=285-473::30-47
MVLLQIMFPKEEEIIKSGSGRGSSSGRGSKICTHCGFTNHTVDECYEKHGYPPGHKLYKPQGSNINNINAVKEESDGIVLERNQEAQSDEVELTSQQYKALMIVLQQQNSIHNNSHVNQISGSNGSSNIHKGYAEPAEDWTGTVGMVGGLYRLKMLPLGDCKEHKSSFTTDFIPPNVSAFSCNRMSIDLWHFRLGHPSFESTLTGNGKKLDPRAATSVFLGFKPNTKGYITLDLKTRAVSVSRNMNPISITNSTPSTSQQITQTPRRSLRQSYGQACKDPHWVEAMNAKIKALELNDTWAAINHWHLKQLDVNNAFLHGDLNEEVYIILPEGMQADKPGEACELQRSLYGLKQASRQWYARLSSFLISHGYKQCASDYFLFLKHGSKTITVLLVYVDDIVLSGNDLAEIQHITHLLDNAFKIKDLSDLRFFLGFVVARTPSGINLSRRKYALDILTNSGMLGSKPLTTPFDYTTRLHKHSGSPLSTKDASSYRRLIGRLIYLTDTRPDITFVVQHLSPFVAEPTTAHQQAASRILRYIKGSPSAGILLSANSEVH

SEQ ID NO: 215447 - protein, 79 aa, Glycine max
  Coding DNA Sequence Number=SeqID_98669
  Gene Ontology: Mol. function=protein binding; Cellular component =cytoskeleton; Biological process=regulation of transcription from RNA polymerase II promoter
  Homolog annotation: Hit_ID=Q1T2F4; Match level="QueryCoverage=92%, HitCoverage=20%, E-value=2e-32, Identity=89%"; Hit description =Actin/actin-like
MLVLTSGFEERFQKESSQSSSAIRPTLVKPPEYMPENLTMNSAWVGGAILAKVVFPQNQHVTKADYDETGPSIVHRKCF

SEQ ID NO: 215448 - protein, 92 aa, Glycine max
  Coding DNA Sequence Number=SeqID_98670
  Gene Ontology: Mol. function=nucleic acid binding
MGMAGSTSRKQYHRLGPMFQLLPSKIQALIKHIEKNIPQKMKDPGSFTLPCKIRESYFEGFLCDLGASINLKPYSIFKKIGIRNAEPTNITL

SEQ ID NO: 215449 - protein, 636 aa, Glycine max
  Coding DNA Sequence Number=SeqID_98671
  Homolog annotation: Hit_ID=Q1RXW3; Match level="QueryCoverage=29%, HitCoverage=28%, E-value=5e-09, Identity=27%"; Hit description=Zinc finger, CCHC-type
MGKIRTYKVTALRAAKNLDSMSIEELVGTLKVYEQQLQQDERIKKGKSLALSAQKTKKSSTSKDFSSRSMSKKAFNAYTSFDNASNKQELNEDDQLAFISKMIRKMWRKRANPTGRAHPRKLGHFKFECPDLDKTNDNKNYFKTKDKKVLISTWENLDNTLYDEEIEEEENFCLMLGKNDGLKEQSQDVATLHQEIESLREFFSKFVGSTKNLDKLLRYSRCPSDRSGHGYEGNGDGPNKFEGSKFVKPPSLDKCCPGCFVWGAHACCSVVIPIGDFCSKEIHYETFDDESSSSERLVDPRHVGWGTSHPRMRVKPYGAPLDKEHVLVTTILPCYQGREKEELVAMVAESAKVIADLQAQLKESKSKLEKSELKALKERETSKELEEELLAFKKEAMEQHEKGFYKAIILFDPFKDVKDHELLDEEEIATTEEGVGEEQDVGANVPMKMKLDNKETHQGQDLGFDKPLEIRRGPPRVDLGFHKSLEIHRGSPRTDLGFEKPLEIRRGLPRVDLGFDKPLEIRRGSSRGKPWVLQAFGDSSRDVPSLVQLDLHDTVDKRVLTSYSPFMVVYVREVGIVLGVYGLSGSVHRPGGVSHEPLIGHVSLFVMVVGRGLELPRGGSCMRLDYVLTISEKRPQ

SEQ ID NO: 215450 - protein, 274 aa, Glycine max
  Coding DNA Sequence Number=SeqID_98672
  Gene Ontology: Mol. function=protein binding
  Homolog annotation: Hit_ID=Q1T2F4; Match level="QueryCoverage=86%, HitCoverage=40%, E-value=1e-39, Identity=89%"; Hit description =Actin/actin-like
ANKEQLVQLMFETFNISGFYASEQAVLSLYAVGRISGCTVDIGHGKIVNLIIPPRYLTEDDRVAGRINPDYEAWEVQDQTLLTWWISLTWCIWHHRNRIIFSNDSFNAYKLMEDAVFLCWTWFKNLEKGFHTPFHFWSSNIREDIAPVIEGAVNHIASRRFEFGGVDLTNFLAQELGKSNPLVNISISDVEKIKQQYSCCAEDELAYQKTKGSCPVETHTLPDGQGSERFVVTIPVFRRNDVVNEMGNIEVVYEVIGFLLVECYHRGGGKAMNL

SEQ ID NO: 215451 - protein, 68 aa, Glycine max
  Coding DNA Sequence Number=SeqID_98673
MFKCKLSIRAPRKTILAEKGGPLVLFENEDIIEKYGDELTKGHCIGQTTSLARSLVKGWVGKVEATWR

SEQ ID NO: 215452 - protein, 186 aa, Glycine max
  Coding DNA Sequence Number=SeqID_98674
  Gene Ontology: Mol. function=protein binding
  Homolog annotation: Hit_ID=Q1T2F4; Match level="QueryCoverage=52%, HitCoverage=27%, E-value=2e-39, Identity=78%"; Hit description =Actin/actin-like
MKLIYLSLMSQRLKDSRNKLGRRRSKAELSSLKVELVQKCWFIISNVTFWVGCSFSLLSSVPRVEARAPLRKSNTSVGLGFSFWCRAMEAAVVDPGSSLLKAGFAIPDQAPAMIIPTQMKRMLDDGSMTDNLTFDDIAVDPVCRGYVRDWDALEDLLHYVLYTGLGWEMGNEGQILFTDPLCTPKV

SEQ ID NO: 215453 - protein, 145 aa, Glycine max
  Coding DNA Sequence Number=SeqID_98675
QPGPTLDYPTRLENPSCLTQKWHDQREPPPQRVAHLPSATGDAILPPKILDRRLQEDWARAAKEGPRVLTNLREMSLAIKGDLIEAQRSSLHRSLTSKLPSTGAGGVTQGRQEENDGEEEEEENTGEEEEERKGEKREERERVRE

SEQ ID NO: 215454 - protein, 176 aa, Glycine max
  Coding DNA Sequence Number=SeqID_98676
  Gene Ontology: Mol. function=endoribonuclease activity; Cellular component=lysosome; Biological process=RNA catabolic process
  Homolog annotation: Hit_ID=Q40382; Match level="QueryCoverage=87%, HitCoverage=62%, E-value=3e-38, Identity=47%"; Hit description=RNase NE precursor
  Pfam annotation: Domain name=Ribonuclease_T2; Domain location=1-164; Score=121.5; E_value=2.3e-33; Accession=PF00445.9; Description =Ribonuclease T2 family
MDHFHPIAILLKIHLTNLRITNQSKITDLIPRAEKGWASLSCAGSKKTENNKTSSDNTRFWKHEWDKHGTCSDLILDQHAYFEATLNLKDRVDLLQILQYNGIKPDGNLYSIVNITKAITQAIGLEPGITCNTDPSGNRQLNEIYLCADKYASSFIECPILPSRKSCTDMVEFPIF

SEQ ID NO: 215455 - protein, 327 aa, Glycine max
  Coding DNA Sequence Number=SeqID_98677
  Gene Ontology: Mol. function=L-isoleucine transporter activity; Cellular component=integral to membrane; Biological process=amino acid transport
  Homolog annotation: Hit_ID=Q67WJ7; Match level="QueryCoverage=94%, HitCoverage=77%, E-value=6e-93, Identity=51%"; Hit description =Putative amino acid transport protein
  Pfam annotation: Domain name=Aa_trans; Domain location=2-326; Score =50.7; E_value=4.9e-12; Accession=PF01490.8; Description =Transmembrane amino acid transporter protein
MMFWYTGLLLQRCMNKHPLIKSYPDIGEVAFGLRGRAMISTFIYIELFLVAVELLILEGDNLEKLFPHMNFKIGSLRIEGKSGFVVLAALVILPTTWLRSLGALAYVSLGGVMVSIVLIGCVVWVGEIDGVGFHESGQLVNWEGLTTAVSLFAFCYCAHGVMPTLINSMNDRSQFGKVLIVCFVASTIIYGTIAVLGYAMFGDYLMSQITLNLPSKKISTKLAIYSTIINPFTKYAVLITPIANAIEEKWLLCKRKPIAILVRTTILVSTVLMALFMPFFGYVMAFIGAFFSVTISLLFPCICYLKMNKAARQFGLELIVIIVILFV

SEQ ID NO: 215456 - protein, 93 aa, Glycine max
  Coding DNA Sequence Number=SeqID_98678
  Homolog annotation: Hit_ID=Q8W4M7; Match level="QueryCoverage=65%, HitCoverage=8%, E-value=9e-08, Identity=62%"; Hit description=DNA repair helicase UVH6
MGFYILEPHLATSMRQQAMGSRLGTHREDRGSHGVAILSGENPRDNAKILPEFEVKGEDLGGGAKVVELVIKEKTAQRASSPSHGRCGCNRGA

SEQ ID NO: 215457 - protein, 64 aa, Glycine max
  Coding DNA Sequence Number=SeqID_98679
  Homolog annotation: Hit_ID=Q6K4E4; Match level="QueryCoverage=93%, HitCoverage=6%, E-value=9e-17, Identity=82%"; Hit description =Putative CRS1
MTNFRRLARTTAPHFALGRNRELQGLARAMVKLWETSAIAKLPSNEVFLIHEMTGWLKNSGYFS

SEQ ID NO: 215458 - protein, 250 aa, Glycine max
  Coding DNA Sequence Number=SeqID_98680
  Gene Ontology: Mol. function=RNA-directed DNA polymerase activity; Cellular component=intracellular; Biological process=RNA-dependent DNA replication
  Homolog annotation: Hit_ID=Q1S7B8; Match level="QueryCoverage=94%, HitCoverage=31%, E-value=3e-27, Identity=29%"; Hit description=RNA -directed DNA polymerase
MGGYMEEEWEWNFLWRRPLFDNEISKAINFLQHVESKVIQIQRRDDWVWTLDPSGQYTAKSAYRMMMGGATHGTQDRDFEELWKMKVPTKFAVFAWRLLRDRLPSKTNLQGRQVEIDDRTCLFCKNAEEEAGHLFFHCTKIIPMWWEFLSWVNNVGVFPQDPRQHFLQHESIVVDGLRTNRWKCWWLAVTWTIWKKRNDIIFSNDSFDINNMMEEATFLTWTWLRNLEKDFVIHFNQWSSNLREEGFVYH

SEQ ID NO: 215459 - protein, 427 aa, Glycine max
  Coding DNA Sequence Number=SeqID_98681
  Gene Ontology: Mol. function=RNA binding; Biological process =chloroplast organization and biogenesis
  Homolog annotation: Hit_ID=Q6K9C1; Match level="QueryCoverage=79%, HitCoverage=73%, E-value=3e-95, Identity=52%"; Hit description =Putative Tab2 protein
  Pfam annotation: Domain name=DUF1092; Domain location=92-424; Score =399.3; E_value=5.8e-117; Accession=PF06485.2; Description=Protein of unknown function (DUF1092)
  Subcellular localization annotation: CTP_CleavageSite=51; ConfidenceScore=5.62e-01
MATLSFNPVRIKSPTFKHSKLTTPSKRITIPCTTPSNSHPKLLHFRPRSVSESTQKEAPEAVLGEEEEEEEDDDDDPSAELSYVDPVTDPESITEWELDFCSRPILDARGKKVWELVVCDKTLSLQYTKYFPNNVINSITLKDAIVAVSDQLGVPLPRNIRFFRSQMQTIITNACNELRIRPVPSKRVLIIGFIPRNVTYEREEEVVVSVCFTLESNDIHVRGAPAYILCGSSDPFQCVSIILWLEERYETVYKKHPGFQEGSKPLLALDNPFPTELPDILYGERWAFVQLPYSAVREEISTFERGVCGSGLDLDLLGLDIDDKTLIPGLSVASSNSTALAALINGLEVCAVEADTARARLILSSGISTRYIYSTYKKTPETTSEAEAWEAAKKACGGLHFLAVQPDLDSEDCVGFFLLLDLPFPPV

SEQ ID NO: 215460 - protein, 380 aa, Glycine max
  Coding DNA Sequence Number=SeqID_98682
  Gene Ontology: Mol. function=DNA topoisomerase (ATP-hydrolyzing) activity; Cellular component=chromosome; Biological process=DNA topological change
  Homolog annotation: Hit_ID=O24308; Match level="QueryCoverage=100%, HitCoverage=25%, E-value=0.0, Identity=86%"; Hit description=DNA topoisomerase 2
  Pfam annotation: Domain name=DNA_gyraseB; Domain location=75-233; Score=173.8; E_value=4.2e-49; Accession=PF00204.15; Description=DNA gyrase B
MGKKSEPVITKCKVGENWTKVTFKPDLEKFKMDYLEEDVVALMKKRVVDMAGCLGKTVKVELNGQVIRMKSFRDYADLYLKSAEKSRPVPLPRIHAKVGERWEICVSLSDGQFQQVSFVNSIATIKGGTHVDYVTNQITNFVMNKVNKKKKDANVKAHNVKNHLWVFVNSLIDNPAFDSQTKETLTTRQASFGSKCDIPESMLKEVANSGIVDTLLSWADFKQSKDLKKSDGTKTQRLRGIVKLEDANDAGGRNSEKCTLILTEGDSAKALAMAGLSVVGRDHYGVFPLRGKLLNVREASSKQIMDNEEIQNIKKILGLQQNKEYTSVKSLRYGHLMIMADQDHDGSHIKGLLINFIHSFWPSLLKVPSFMVEFTTPIIR

SEQ ID NO: 215461 - protein, 147 aa, Glycine max
  Coding DNA Sequence Number=SeqID_98683
MYLEFKDKGPPYYTKESYAVVQHSRKSRIILRVLLKNTFAPKTIAHMSSHLVDKHRQIYCSGSPLQTIYVKGSLFRQLTEWVCFEGGAASRIGGKSVLPPISPFLLVIQPIPPFVLARHPSEAMPPYVLAIHPFPFRYSNWRDMSWQ

SEQ ID NO: 215462 - protein, 502 aa, Glycine max
  Coding DNA Sequence Number=SeqID_98684
MAPKRSEATVISGINIKEHANNTTFLDNFSSRHYATIVVAPGCVEECLVFDKDWEKDITQKTVDIMLYGSPCPITDDKKVMIDFLITTNQAYMCRLIHSFMFNMEIPKLGHETIPSKTNSTPSPSTSVTIFLTHHTQPKHALSLIRRKEVVAFAKAKKRSLAEEEHKRNLDADAKLATLASKLSEDILDGVILESLNTLSVEKEKRHSVEKANMMEIDVIEASLVEVGDDIIETDPEIVPIRPSNQTFKCILSCTPDCIMGSKETEFWKDRLEKVWEKRGDIGTHILHLEMQKVKLEKLNLTNIWKIGFSSIGHFSYSSWYILPEEEVYALGVYGDRKPEIKEFPLWQIVALNPNKVEHDEIIFSTPLDIQQLMGLICVVNVVLPWDHSKSEKTFQIQEILMGAPVEIESNVEVESSSMVVQVYDPSFSRAYVCMIEDELVKTREALAQALKDCAHITYWKPPRPSTPPGSPIHFSFDSDDSSDEFQQKLDEEVSEQKREKK

SEQ ID NO: 215463 - protein, 117 aa, Glycine max
  Coding DNA Sequence Number=SeqID_98685
MANVCIPIFIMLSDFDVRELEDISLVANNNEHVRDDGDGNEIEVGYESVQANAFESEPCIENEDNEEDDNEHVEYVDGDNDMIFEHYFAKIVHEECNDINSFVDVYIVDMDNVTLMF

SEQ ID NO: 215464 - protein, 137 aa, Glycine max
  Coding DNA Sequence Number=SeqID_98686
MECTMLTGHRKLTMSVIDKVQIENFKKVDIRPPKCDLDVVGFEEKWYPHLLWRIMFGLDNCMRKRRMWSPTHIRVDCKICNVSASFKRSLTNSYGVANESEEIETKEIIDIVLDPPLISHKDCGPKENRHVGRHRRT

SEQ ID NO: 215465 - protein, 56 aa, Glycine max
  Coding DNA Sequence Number=SeqID_98687
MLLLETNLRWQLATAGGVQWIMENLVVADIVIVLADLDEAKSYKQTRKPTREAYRS

SEQ ID NO: 215466 - protein, 63 aa, Glycine max
  Coding DNA Sequence Number=SeqID_98688
MIKAKGLVDKVNKDVVRVDGCGSKREGVGGSELGSQVVEGERSKVVAVEEVGDEVKDGFTGGK

SEQ ID NO: 215467 - protein, 662 aa, Glycine max
  Coding DNA Sequence Number=SeqID_98689
  Gene Ontology: Mol. function=copper ion binding; Cellular component =periplasmic space; Biological process=electron transport
  Homolog annotation: Hit_ID=Q9SW88; Match level="QueryCoverage=99%, HitCoverage=90%, E-value=0.0, Identity=80%"; Hit description=Amine oxidase
  Pfam annotation: Domain name=Cu_amine_oxid; Domain location=292-662; Score=684.6; E_value=7.1e-203; Accession=PF01179.10; Description =Copper amine oxidase, enzyme domain
  Pfam annotation: Domain name=Cu_amine_oxidN2; Domain location=79-165; Score=136.3; E_value=8.2e-38; Accession=PF02727.6; Description=Copper amine oxidase, N2 domain
  Pfam annotation: Domain name=Cu_amine_oxidN3; Domain location=172 -272; Score=158.4; E_value=1.9e-44; Accession=PF02728.6; Description =Copper amine oxidase, N3 domain
  Pfam module annotation: Pfam domain module=Cu_amine_oxid::Cu_amine _oxidN2::Cu_amine_oxidN3; Domain location=292-662::79-165::172-272
MEAKNLWRFLVLSIGVVLVLLVTRLPNKEALDCNLYSGWCTSKNRFYSSAHPNNPIKKPSSFSTYHHNQHHDESEIPEHPLDPLTIQEFNKVRTILSNHPLFKSSSTYTLNSVVLEEPDKKLVLKWKKGDPPLPRKASVVAYVKGDSHVLTVDLETGQVASHKTTGSVSGYPTMTMEDMVGVLEVPLKSTEFNRSITKRGVNLADLACLPISSGWYGTPVEENRRLIKVQCYSKEGTVNFYMKPIEGVTALVDMDRKEVLAISDNGQNIPVANGINTDYRYSIQKLNGELRLLNPISLEQPKGPSFTIEGHLVKWANWEFHLRPDPRAGTIISQAKVRDPDTSKLRSVMYKGFTSELFVPYMDPTEGWYFKTYMDAGEYGFGLQAMPLDPLNDCPRNAYYMDGVFASSDGTPYLQPNMICIFESYAGDIAWRHAECPITDLKVTEVRPKVTLVVRMAAAVANYDYIVDWEFQTDGLIRAKVGLSGILMVKGTTNENMDQVPNQEYLYGTLLSENIIGVIHDHFITYYLDMDVDGSDNSFVKVNIKKQETSRGESPRKSYLKAVKKVAKTEKDAQIRLQLYEPSEFHVVNPLKKTRVGNPVGYKLVPGATAASLLDPEDPPQKRAAFTNNQLWVTPYNKSEQWAGGLFVYQSKGDDTLQVWSN

SEQ ID NO: 215468 - protein, 227 aa, Glycine max
  Coding DNA Sequence Number=SeqID_98690
  Gene Ontology: Mol. function=RNA-directed DNA polymerase activity; Biological process=RNA-dependent DNA replication
MARRMNKVLEGIINKRQSAFFNGRHLLHSVLVANEMVDYAKRIKKKCLIFKVNYEKAYDSGFGVGKWLSHDRVDLDTQRFEIRSPFSSLLVQCGSEGLENRTPHWTKPSLPWISLHRRPPIECDLEWHEILVVNKMSRILEDLNGCVTTCPFVGERGKTHGCAFQRRKDARSRHQRLFVENVGKTEGNRKVDKSGALAPTYPPLKRKSDLRSSFLRVNRAILFYLKR

SEQ ID NO: 215469 - protein, 137 aa, Glycine max
  Coding DNA Sequence Number=SeqID_98691
  Gene Ontology: Mol. function=nucleic acid binding
MKVEQHFGCHHTIEERKVPFATLSFQGYALYWWTYLVRERRIHGDPLVKYWNDLKSALRKRQLPSYYERELMDKLQRFRQGSMSAEEYRKPTSKSYGSHSYPKKDQGQGILGAAPSKPKYDKRDEEEKLEKQKQKEG

SEQ ID NO: 215470 - protein, 119 aa, Glycine max
  Coding DNA Sequence Number=SeqID_98692
  Homolog annotation: Hit_ID=Q2RBQ6; Match level="QueryCoverage=29%, HitCoverage=3%, E-value=1e-07, Identity=65%"; Hit description =Expressed protein
MLSSSPSKVRVRDSISTSTALVTVHDRYASPLYPVNVIRVSSAVVKARQDGKTKDLAIEVVNGTTTVVQTDRNPFHSHQSGWFFKAIMNDEGERNFLLCAEEMDLIDQQLKPCKCGYEV

SEQ ID NO: 215471 - protein, 284 aa, Glycine max
  Coding DNA Sequence Number=SeqID_98693
  Gene Ontology: Mol. function=oxidoreductase activity; Biological process=electron transport
  Homolog annotation: Hit_ID=Q4H439; Match level="QueryCoverage=88%, HitCoverage=48%, E-value=1e-102, Identity=73%"; Hit description =Polyamine oxidase
  Pfam annotation: Domain name=DAO; Domain location=8-283; Score=-48.7; E_value=0.0098; Accession=PF01266.14; Description=FAD dependent oxidoreductase
  Pfam annotation: Domain name=TPK_catalytic; Domain location=103-213; Score=-25.7; E_value=0.015; Accession=PF04263.7; Description=Thiamin pyrophosphokinase, catalytic domain
  Pfam module annotation: Pfam domain module=DAO::TPK_catalytic; Domain location=8-283::103-213
MDSPSRPSVIIVGAGISGIAAAKVLAENGIEDLVILEASDRVGGRIRKESFGGVSVELGAGWIAGVGGPQPNPVWELGVQFGLRTCFSDYSNARYNIYDRSGNIIPSGIAADSYKKAVDSAIEKLRKLEEEEATAYGDDHSNNIKNNETKPPSTPETPIELAIDFILHDFEMAEVEPISTYVDFGEREYFVADERGYDYLLYKMAEEFLFTSKGRILDNRLKLNKVVRELQYSKSGVTVKTEDGCVYETNYVILSVSIGVLQSDLLAFNPPLPRTEEVKGFGCA

SEQ ID NO: 215472 - protein, 164 aa, Glycine max
  Coding DNA Sequence Number=SeqID_98694
MTSKLYMEVPEGARGAGMEASGAGAGAGGAEEEAFQQFVRIYAKLMARLKDLKVNESGTTPRAMHSAVMSVRLEYDKTLQVWARVVRSFLRSFQGAPSVFRTNPRPGMQSLEASSYRSGCEWQNLEYVEYLSPGSKTTGVSRNVLRGHINVTIRLPGQGLVPPT

SEQ ID NO: 215473 - protein, 90 aa, Glycine max
  Coding DNA Sequence Number=SeqID_98695
MKNKEPNVLCHLRLPSTWEASLRSKEGRFLGKLEEESFLEKLEGATHTPPIAKLTPIAKYMKIQWEASLRSKKDSFLEKLDEGYSHPSNS

SEQ ID NO: 215474 - protein, 177 aa, Glycine max
  Coding DNA Sequence Number=SeqID_98696
  Gene Ontology: Mol. function=oxidoreductase activity; Biological process=electron transport
  Homolog annotation: Hit_ID=Q4H439; Match level="QueryCoverage=99%, HitCoverage=36%, E-value=1e-68, Identity=71%"; Hit description =Polyamine oxidase
MENAYPGSNILVVTLTNGESKRVEAQLDEETLREAMAALRDMFGSNIPDAIDILVPRWWNNRFQRGSYSNYPIISNHKVFHDIKAPVGRIFFTGEHTSERFNGYVHGGYLAGIDTSKALLEEMRKEKESQTLLLEPLLALTGPLTMSKPETVSNIHKCDIPTQLYLSGKLGIPEAIL

SEQ ID NO: 215475 - protein, 161 aa, Glycine max
  Coding DNA Sequence Number=SeqID_98697
  Homolog annotation: Hit_ID=Q9SL29; Match level="QueryCoverage=22%, HitCoverage=5%, E-value=1e-08, Identity=78%"; Hit description =Putative cyclic nucleotide-gated ion channel 15
MFDVLHQLKINVTFKEAKAAKKACEDSTNLIINGRRANCNLAFLGAHRPKSSSNVSPPPPQPQGGSNGGIVKNVNNALGPPPAINHVQPYHYPVRTTALPFHNHTLPFYGSLGQGLLTSTFVGEIMFAIVVATLGLVLFGLLIGNMQKIMPKDKDHDLLPI

SEQ ID NO: 215476 - protein, 153 aa, Glycine max
  Coding DNA Sequence Number=SeqID_98698
  Subcellular localization annotation: CTP_CleavageSite=82; ConfidenceScore=5.87e-01
MALYSFFSPSLLYPPSHIPRRLFCPKASLSSSSPESKASQSVSSATSTTTSPTPSVESRPPDPAFNYALTNPNGNPIVRIVRATESSIERKKGIGDLMVEGSLTSSSYQELWRSIRNRNGKGIGDLVIFDFRFLALLAVGGSLAGSLLCFLNV

SEQ ID NO: 215477 - protein, 89 aa, Glycine max
  Coding DNA Sequence Number=SeqID_98699
MAILRNEKEHSTSVELAFLRRWTRVFKSNVIVEGGCFYIGRKRIVLETLDKRSRAYNSTDVESIAFYIVVGLSTTLFLMCSTTVILRPM

SEQ ID NO: 215478 - protein, 94 aa, Glycine max
  Coding DNA Sequence Number=SeqID_98700
  Homolog annotation: Hit_ID=Q8S6I8; Match level="QueryCoverage=68%, HitCoverage=5%, E-value=6e-07, Identity=41%"; Hit description =Putative retroelement
MAFFRLELPEEYGVSNTFNITDLFPFVSVVDSHDEGSTDLRTNPLQEGGDDAILPRRGPVTRAMARRLQEDWARDAGEGPRVLMSLRVDFGPMG

SEQ ID NO: 215479 - protein, 99 aa, Glycine max
  Coding DNA Sequence Number=SeqID_98701
  Gene Ontology: Mol. function=structural molecule activity; Cellular component=microtubule; Biological process=microtubule-based movement
  Homolog annotation: Hit_ID=P33628; Match level="QueryCoverage=78%, HitCoverage=69%, E-value=5e-26, Identity=77%"; Hit description =Tubulin alpha chain
MKWILGYLPPSTVLKMRKPLVAGEVVGGVFLTRDELFGVEELTVGVVADLIDDDGFKVDKESMGDVLAKSSFAEGVEGVVGYIKGGVRRHHAVGLNTMF

SEQ ID NO: 215480 - protein, 353 aa, Glycine max
  Coding DNA Sequence Number=SeqID_98702
  Gene Ontology: Mol. function=2-oxoglutarate decarboxylase activity; Biological process=menaquinone biosynthetic process
  Homolog annotation: Hit_ID=Q15KI9; Match level="QueryCoverage=84%, HitCoverage=17%, E-value=5e-81, Identity=51%"; Hit description =Chloroplast Phyllo
  Pfam annotation: Domain name=Abhydrolase_2; Domain location=119-311; Score=-72.9; E_value=0.022; Accession=PF02230.7; Description =PhospholipaseCarboxylesterase
  Pfam annotation: Domain name=Abhydrolase_3; Domain location=133-319; Score=-90.9; E_value=0.083; Accession=PF07859.3; Description =alphabeta hydrolase fold
  Pfam module annotation: Pfam domain module=Abhydrolase_2::Abhydrolase_ 3; Domain location=119-311::133-319
MAVVSAAFESSLSLSAYTQFSSYLELLSLGTFKVLDDAASGTVAHGLGTYRWLKEDVTPSPLLICRNPQTGFVEASVANASRLVHDFQVNQKVISYIIAEEQVHRYQYKVELNNLSCSFEVRETGLKTNDNVLVFLHGFLGTGEDWINIMKTFSGSAKCISVDLPGHGKSILHGVKGAGEEPLLSLETIADLLHKLIHHIAPEKVTLVGYSMGARIALYMALKFCTKTKGAVLISGSPGLKDKLSRKIRTAKDDSRALAVIAHGLELFVSSWYAGELWKSLRSHPHFNRIIASRLQHDDMQNLAQMLSGLSIGRQPWGRRSVKKEHRRENNKELRPLHMTKRAVFEMHEQRVD

SEQ ID NO: 215481 - protein, 92 aa, Glycine max
  Coding DNA Sequence Number=SeqID_98703
MDTETNQLSLVVEEEDGFVFHVEHEQNVDLGLCLVGRILTSKANPFLDYEGEDGKVVDAGEGSLFGTKSEATLIEEEKRMFVDMLTKKVVKE

SEQ ID NO: 215482 - protein, 208 aa, Glycine max
  Coding DNA Sequence Number=SeqID_98704
  Gene Ontology: Mol. function=2-oxoglutarate decarboxylase activity; Biological process=menaquinone biosynthetic process
  Homolog annotation: Hit_ID=Q15KI9; Match level="QueryCoverage=82%, HitCoverage=9%, E-value=1e-46, Identity=55%"; Hit description =Chloroplast Phyllo
  Pfam annotation: Domain name=MR_MLE; Domain location=47-143; Score =63.1; E_value=9.3e-16; Accession=PF01188.11; Description=Mandelate racemase  muconate lactonizing enzyme, C-terminal domain
MAILNAIADAKGSNMLNILYPSINGNNKCERSLNVQICALIDSNGSPTEVANVAAKLTEEGFSAIKLKVARGGDPMHDAALIQEVRKKVGCQIIIRADANRTWTYEEAMKFSSLVKDCNLQYIEEPVQDEDDILKFCEESGLPIALDETIDNIQENPMEKLAKFTHPAIAAVDRDNWDRVRCLVGRLRSVVWSGILCAGLNWCVYSEN

SEQ ID NO: 215483 - protein, 58 aa, Glycine max
  Coding DNA Sequence Number=SeqID_98705
MTTNQNFASTIPSFHPISRKLDDSTSYYGGNSPQIPIHFLIEADCEAGNGNPAYTDWE

SEQ ID NO: 215484 - protein, 324 aa, Glycine max
  Coding DNA Sequence Number=SeqID_98706
  Homolog annotation: Hit_ID=Q0KIN0; Match level="QueryCoverage=42%, HitCoverage=10%, E-value=6e-13, Identity=27%"; Hit description =Integrase core domain containing protein
MSMSVSVSGVCVKVRASWTESDRKLKSKQKKAELKEAMCVAQHEQMDCMVEIESSINANANFHRIALEAPPTSTFVSDGCKEFYREGFILSLVLEEGSVGYGENDHLSVMGSSRSNGRPGSGRGLHWGRLIMVWTSARGVGTGATDSHPMPIVYPELRSYKGIGGADSLVLYLGIVWQYNLGAIYTPMCSSSSNDLFWLQLQHLGTAVQLWFQDQSRADHLTTKLKDVPTENQALKNCYDVWTEAKKVYFNDVHRVYNFFTALTNIKLENADIADMPFTTDVETFYKQHDQFFMVLALIGLPSNLDAVCNRILSGPIVPTCDMV

SEQ ID NO: 215485 - protein, 384 aa, Glycine max
  Coding DNA Sequence Number=SeqID_98707
  Homolog annotation: Hit_ID=Q1SM26; Match level="QueryCoverage=31%, HitCoverage=30%, E-value=2e-21, Identity=41%"; Hit description =Nucleic acid-binding, OB-fold
  Pfam annotation: Domain name=DUF223; Domain location=147-242; Score= -3.2; E_value=0.0058; Accession=PF02721.5; Description=Domain of unknown function DUF223
  Subcellular localization annotation: CTP_CleavageSite=69; ConfidenceScore=5.85e-01
MAVALYSTLASSGLHRDVPSRNPISSFLSSFSSSFFGCLQLGGCAISPRKSIQQTSFFFPLLLCILVVVQSHREEASNRQAFFPFVVMHVCLYLQGHPRRSIQQARIMARIPNKIKGINGSKETLKLAVRITDLWFVGTPDKSEQAEMIIVDSDGDQIHVVCKRDQLKSWKLDLKENCTYVMHNFKVIKNDGQYRVCDHPYKLVFTGVTVVRQTDLDNVPFKKYNFTQFANIIAGHFQPGLLVGLYPPSVSNSLKASKLLINQPVAEIQEFKHRLSELGIEVHSVITPRGQGSSQLSGSSQLSSKDAFFYKYKAKSIYKINNITEVLVLFMFCIDSTHQPVDDQSNHYVVSTRILFVLPWAPLPELLWKIIHGVIRLASNVTKN

SEQ ID NO: 215486 - protein, 280 aa, Glycine max
  Coding DNA Sequence Number=SeqID_98708
MREKQGEGERDRVREKERNRVRERIRVRERNRVRDTETRVRERVGATEGNRRRGREREPESTHRRRDNHHQRFSSRRSSARTWTNEDAGYNHHNGVEVRWSTDKQEEYDHTNNHGVWHEVSHRRKRRLVEIRGSMESPKWQERKVTWRDKGDITTFYFSRFPEGVKEGDLWQIFQKWGKVWEVFIPKTKNREECYIHTEGGTYSQNAYGESGGGETKRPWDQTAFVCGGGKTGYARRRSLLSEEGTPPLYLNGHAETSGLELTYGVQRMATEGLGWETEE

SEQ ID NO: 215487 - protein, 74 aa, Glycine max
  Coding DNA Sequence Number=SeqID_98709
ASSRIHIALPDSSDPPHHESQSLSRTADHDPLLRLPLTPTKRQISQECDDEARSSQISPAQLSSNKLGKHVKIE

SEQ ID NO: 215488 - protein, 141 aa, Glycine max
  Coding DNA Sequence Number=SeqID_98710
  Gene Ontology: Mol. function=RNA-directed DNA polymerase activity; Cellular component=chromatin; Biological process=RNA-dependent DNA replication
MQEDDIPKIVFRTHEGHYEYLVMPFGLVNAPATFQFTTNLVFRPLLRQCMLVFFDDILIYSLDWPTHLFHLVEVLSLLAQHHLVANRNIISAKGVEMDPSKVIIGGSSGTKGVEECDGQAGGATEAASVGAKTQTKRRLPR

SEQ ID NO: 215489 - protein, 76 aa, Glycine max
  Coding DNA Sequence Number=SeqID_98711
MIKVQTKFRNSAVLKCSADSSLINVVMDMLADAETSSKMNIPVSNSNHSAQHESQSLSVTTYHDPLLGLPLTPTKR

SEQ ID NO: 215490 - protein, 123 aa, Glycine max
  Coding DNA Sequence Number=SeqID_98712
MEGSKKYLPVRRKKEAAGRVFAASEEVSEQHTFSLYKWEKSKEYCFRRFGATHSSHAYLHPVQHLRSTPYPVSMLTKSGCATVCVTTHCAKFLAQQIHATCQLPVELCPYLWRNTNKNRPPDK

SEQ ID NO: 215491 - protein, 102 aa, Glycine max
  Coding DNA Sequence Number=SeqID_98713
MQFLQQGITYSFHHLSTISFFPSSAPPFLIYHCLPQPTHVEAPSIEGIGPSSPTPIIPPVAIDSDLPIAIRKGWRQAMIDDMQALESNLMWDPMDRSLVGCR

SEQ ID NO: 215492 - protein, 111 aa, Glycine max
  Coding DNA Sequence Number=SeqID_98714
  Gene Ontology: Mol. function=thiamin pyrophosphate binding
  Homolog annotation: Hit_ID=Q15KI9; Match level="QueryCoverage=91%, HitCoverage=5%, E-value=5e-23, Identity=52%"; Hit description =Chloroplast Phyllo
MGRVEWEIKFQITAECSLTEPYVAHVMSEALSSESALFLGNSMPIRDANIYGCSWSICYQSVSSLLLNSDLPINLVRVAANRGASGIDGILSTAIGFAVGCNKKDYTVSLK

SEQ ID NO: 215493 - protein, 161 aa, Glycine max
  Coding DNA Sequence Number=SeqID_98715
MAKPSAHLVSRVAAAKLAPRAMAVSPTPLAKCHALEKQTPCEGSSLEHPILRGVVVVFLGFLSPKELQPSSVSFSASNPTRYSSVLLRSIPFLRLPLYKDVMVDNVVCFTNSKIVDNKYISRDNTQDVPEKSISFQMLYNLDKRKRIEYAPTVFQDLMVIA

SEQ ID NO: 215494 - protein, 253 aa, Glycine max
  Coding DNA Sequence Number=SeqID_98716
  Gene Ontology: Mol. function=2-oxoglutarate decarboxylase activity; Biological process=menaquinone biosynthetic process
  Homolog annotation: Hit_ID=Q15KJ0; Match level="QueryCoverage=64%, HitCoverage=52%, E-value=1e-24, Identity=38%"; Hit description =Truncated PHYLLO protein
  Subcellular localization annotation: CTP_CleavageSite=6; ConfidenceScore=5.10e-01
MNLAVSALGGWRVCNGAMFLVEGGGNGLGMGSGRVCSRSRSRSEVGGVRVGVRLDGPVPLNDDVLEKEVVFEQCVTRTLSPALTLEEGLEKLKEALQILNSPSPSSPTGFLRFQVALPPSPKAFTLFCSQPHSSSVFPLIYVSKNDADSKSLYVNGTRGVCGIGAAVSFLPPTPNHRTFLNRYISSDSTNVVAYGFMDVNLDDDVSHQEGSFWFFIPQVMCHVWSTIDTWKSKCTRAALKKLNLVEDRSIPRV

SEQ ID NO: 215495 - protein, 77 aa, Glycine max
  Coding DNA Sequence Number=SeqID_98717
MGISHSLMGISHHSKRNCLFPGIVFPIPMIECGFLYIPMGILYHSSPAITCEKLLLKTDTQFESHSSPGRLRLITPV

SEQ ID NO: 215496 - protein, 228 aa, Glycine max
  Coding DNA Sequence Number=SeqID_98718
  Gene Ontology: Mol. function=binding; Cellular component =mitochondrial inner membrane; Biological process=protein kinase C activation
  Homolog annotation: Hit_ID=Q1RXQ0; Match level="QueryCoverage=99%, HitCoverage=33%, E-value=4e-67, Identity=72%"; Hit description =Tetratricopeptide-like helical
MATFAQNGLGNKTIETYEDMLRIECKPGHISYVVVLSCCNHMGLVVEGKHYFDSMTQVFGISPTNEHFACMVDLLGRAGLLDQAKNLINGMPFKPNATVWGAILGACRIHHDSILAETATKKLMELNVEDFGGYVLLANIYAEFGELENVADMRKSQKYHSEKLAFAFGLLSLPPWMAIQVTKNLRVCNDCHLVIKLLSLVTSRELIIRDGFRFHHFKDGFCSCRDYW

SEQ ID NO: 215497 - protein, 384 aa, Glycine max
  Coding DNA Sequence Number=SeqID_98719
MDIRRKMERELALLRKKKMEELWHHFKKWGDVREIFIPKRRNNSGRRYGLARFKGTPTQVAPGANLKGQHERNGNEEHNIEPHSCESSASSVYLDIAPDNTKWLDEAWVGRLKNPTMLERLEDHLLWDVGADSRTNANRRKPRWCPDVPLIGKVESDPVFGLQANWVQCWGIPIVAWDAKQIQKIVAGMGDMVDLDNDGEDVWRRDRARVVEECGYVTQHCYCRRRSDMGSSEEIESIESEFSTLILGFVDASEKEDQSEDTTVSETEAGLRGTTLSPNVDNGNHRIPIIHNGQREKENPQDNGNTSRLMKNTQKVNKQGTKGSWVVSQAARQWRGKNLTYPDEVARKVGELHTVGIINPTEEVLFNHEDGKQVGEVSSDVEGP

SEQ ID NO: 215498 - protein, 92 aa, Glycine max
  Coding DNA Sequence Number=SeqID_98720
MEGDIGRQEVHIKWVNPNKGWACLNTDGAVKGPSIWVRSLKAGRTMSIRLLGSRCRFVSKAVDYAAYISMNDHRIRTGKFTLKFYFTSLLLE

SEQ ID NO: 215499 - protein, 120 aa, Glycine max
  Coding DNA Sequence Number=SeqID_98721
  Subcellular localization annotation: CTP_CleavageSite=12; ConfidenceScore=5.07e-01
MASIIAAICSFMASMSASIYSCTFSALPITLALAQIFNMVHDISVKVKLEVTGTSTALNVFGSRRRSDKWVYDPNIVGSWYLTHMHDDAMTHAKWECDNEQMHERYVHYDAEEMFMRCMI

SEQ ID NO: 215500 - protein, 73 aa, Glycine max
  Coding DNA Sequence Number=SeqID_98722
MKLGESFTGPECLILSKEIKTLLANLMQRQMRLSDAILPPRALDKRLQEDWAKDAREGPRVLMSLRVNFGSMG

SEQ ID NO: 215501 - protein, 274 aa, Glycine max
  Coding DNA Sequence Number=SeqID_98723
  Gene Ontology: Mol. function=nucleobase transporter activity; Cellular component=membrane; Biological process=nucleobase, nucleoside, nucleotide and nucleic acid transport
  Homolog annotation: Hit_ID=Q62DM4; Match level="QueryCoverage=95%, HitCoverage=55%, E-value=1e-72, Identity=52%"; Hit description =Cytosine/purines/uracil/thiamine/allantoin permease family protein
  Pfam annotation: Domain name=Transp_cyt_pur; Domain location=26-274; Score=-137.6; E_value=0.0012; Accession=PF02133.6; Description =Permease for cytosinepurines, uracil, thiamine, allantoin
MSAQIPAADYSGAEKQRLSETRSIDYIPLSERHGHPFSQFTLWFGGNLQITAIVTGALAVVLGGDVVWSIVGLLVGQIVGAAIMSLHAIQGPSLGLPQMITSRMQFGVFGAVIPLVLVCIMYVGFSASGTVLAGQALAKLVNVSNAAGMIIFSAIIIVIAVLGYRVIHKLGKVASVIGVLAFVYLFITLLSSHDLAAVWQNQHFSVASFLLAVSLSSSWQIAFCPYVSDYSRYLPVDVSAKKLFSSVFFGTVLGTQASMTLGVIVAAIAGKAFS

SEQ ID NO: 215502 - protein, 213 aa, Glycine max
  Coding DNA Sequence Number=SeqID_98724
  Gene Ontology: Cellular component=integral to membrane
  Homolog annotation: Hit_ID=Q05LH6; Match level="QueryCoverage=91%, HitCoverage=78%, E-value=2e-15, Identity=31%"; Hit description =Hypothetical protein precursor
  Pfam annotation: Domain name=DUF1275; Domain location=1-201; Score =75.6; E_value=1.5e-19; Accession=PF06912.2; Description=Protein of unknown function (DUF1275)
MAFGAFGFFPSHMTGNTSQISAEVNGSDLHDLLFLAVLIFAFVCGAMLARLTVAYGLKRNLRTIYCLVLLAEGIFLLLTSLVEILWYSERNNGEILVTLSLLMGIHNSTSTQLSSGRVRSTHVTGTLTDAGIALGSWLRASFSQSEAADRDGHRTVLFTHLVTIFSFLSGCVIGYLLFRHLGFEAMAGLGIVLALIAVGGIARTLHLTGMRFW

SEQ ID NO: 215503 - protein, 107 aa, Glycine max
  Coding DNA Sequence Number=SeqID_98725
MVFHLTSLALLVIGCSSTIHQENELKNDIHTLVGCLLPSVSPGQELETNFLRLPKGLKEQMLSHMQLKFKTAELQQEVSDDFIAQLVSETKAEYYPSKVLKLALWLA

SEQ ID NO: 215504 - protein, 86 aa, Glycine max
  Coding DNA Sequence Number=SeqID_98726
MEHEHQHLKLPQCPPSPDDVVHDCQLLAVGVSLSEACALSENHALGEALNPLSELGESEKHLRAQRIISSLYEAFVSSHAKRTQLA

SEQ ID NO: 215505 - protein, 184 aa, Glycine max
  Coding DNA Sequence Number=SeqID_98727
MLCATFNIVFSELNPSTYVIVVTKAKGKERFGIGPLMLEHKLLAYVVACIITLRGSNHAQLTEEDLLLINLMQGKMKIKWINILVYIMLKTKRIGSFKCPYAVLISRILDYFGVDTQEEVFGFVEAKFEVKTKVLKQMGYIKIEEDGIGWIEKNREDQTEQEEVEEKPMSPFEQMMLAKMDEHG

SEQ ID NO: 215506 - protein, 146 aa, Glycine max
  Coding DNA Sequence Number=SeqID_98728
  Homolog annotation: Hit_ID=Q5XM22; Match level="QueryCoverage=85%, HitCoverage=71%, E-value=4e-11, Identity=38%"; Hit description =Resistance-like protein HAAS-2
MKFASTRWDEAARAYLFHLVGCTLFANKIATYVEVKFLDFFRDLKGCSMYSCGTTTLTYLCEHLTSASFDGTKQISAYATLLQETRHRIGRLLQRMIDHRLVTQGTDAYFVTEEALALARGVTDDGAMNTNRARGDTKGGHGKGGH

SEQ ID NO: 215507 - protein, 74 aa, Glycine max
  Coding DNA Sequence Number=SeqID_98729
MKNGGKPSRNHPRKRLGSVMEALRLEFSKQKQFFSQISREKREVVAAQLAWASWVASTRRHRLLLEHPERSKWA

SEQ ID NO: 215508 - protein, 126 aa, Glycine max
  Coding DNA Sequence Number=SeqID_98730
MEKRKATSNFRHSKDMHLSNGEINLAHPKQRQTKLKSGQAHPEFLKVVDTKTSLFFNQKSQLAAFLANSKSKESLAKNLKEVLQLLQQEEDEGSSSKREENESSEENDDPFYQNEDDCFGISLNDD

SEQ ID NO: 215509 - protein, 345 aa, Glycine max
  Coding DNA Sequence Number=SeqID_98731
MTTFICSIGVILLHVKDRVLDSIRERGHLLIAENEYSVVLFQNDKGFQDGLKLIIEDQHALELAKYAINCNVEVHMYVQHIPHAKVEILEHVVDGESVASDVDMQHPTNEGAIDQGDVHVVDDHVVGVVDATEKGEVHDQGGLEADIESKSSDDGNFNPSMVDENSVQTSLEFETESNVDDDASIEAHGTGINEELFFDFLDIVDLNEDYLIEELQSDNDGEGGFANKPRIFVKTPSGLGMEFSTLAEFKDVMLEYSVLIGREVNQEVPTNLPKRAKLAQGNMLLGFEGTHSPSKRKEGLVGEEIIGGVAEEVSDEKEDGAPSVPTKDVPYPLEPSKKDKEFHFA

SEQ ID NO: 215510 - protein, 94 aa, Glycine max
  Coding DNA Sequence Number=SeqID_98732
MKHSPPEKALMNAIECLMNEKEKDLKACLDDLNKLKEIPPREYAFEKLKKDTLAEKPKVELKVLPLHLKYVFWKRIMHKWLSSAMLYLQPKKHN

SEQ ID NO: 215511 - protein, 99 aa, Glycine max
  Coding DNA Sequence Number=SeqID_98733
  Homolog annotation: Hit_ID=Q2R4C3; Match level="QueryCoverage=57%, HitCoverage=8%, E-value=7e-09, Identity=55%"; Hit description=Gpi16 subunit, GPI transamidase component family protein, expressed
MALPPLCILLFLVFLLSATSTQQEEEFTEELLLKPLPDRKVLAHFHFQSDSPPLAAADESSSFDRHHHLFPKSISQLMLDKISELDSELKQLGAAFTLD

SEQ ID NO: 215512 - protein, 188 aa, Glycine max
  Coding DNA Sequence Number=SeqID_98734
MEPAHACAFAHLRRKLIQPGARGKCPKTIMIVGWIDRPLRSLYDFKSRKFHLVTYQSVTIHCHPSMGCKIDPKALCFYSILPPRVLDRSLQEDWARAAKEGPRVLMNLRDIMSSLCSRDFFVFSCILAWGELSYSRRCLVKALASHLKETSFEAQNFVLLSLHSSSPTFKLLSMASYGGKLVLDSSSP

SEQ ID NO: 215513 - protein, 94 aa, Glycine max
  Coding DNA Sequence Number=SeqID_98735
MVLGASSPLVLVKVRHLELGNDHVWVLGTALLAIVGGALPTAKCKGCGCGRNCGPSKVFGMSIPPTACLSVAYSRQGSKSARLWWGISCVSPTV

SEQ ID NO: 215514 - protein, 143 aa, Glycine max
  Coding DNA Sequence Number=SeqID_98736
MRQVAGGYTQVIIRTKTTSADPDPCVRDALYGNPHTFQRQKCLQSLDAFKDDNDPHLHFEDYNGNFSDSLTVENLHGFVHRNVSEALRKHLGLDFLHRNKFFSSKTAEMHSIGVKDKFTQPPSPIYSQNAEVFATQTLLEEDF

SEQ ID NO: 215515 - protein, 47 aa, Glycine max
  Coding DNA Sequence Number=SeqID_98737
MAKRMPCCHMERKGGELGNQTHPHLIFTPLQFWGVLRRGKKDLEHFN

SEQ ID NO: 215516 - protein, 62 aa, Glycine max
  Coding DNA Sequence Number=SeqID_98738
MPSLTSGMSRNFTNCLTMGAKYLEVVKQGSHPNNGWSRDEIRELTIYQQFVLPPQMSSSHIG

SEQ ID NO: 215517 - protein, 169 aa, Glycine max
  Coding DNA Sequence Number=SeqID_98739
  Gene Ontology: Mol. function=protein binding; Biological process =defense response
  Homolog annotation: Hit_ID=Q6R270; Match level="QueryCoverage=84%, HitCoverage=11%, E-value=6e-38, Identity=57%"; Hit description =Disease resistance protein
MVAGALVSTFVQMTIDSLASRFGDYFRGRKHHKKLLSNLKVKLLAIDVVADDAELKQFRDARVRDWLFKAKDVVFEAEDLLEEIDYELSKCQVEAESQPIFNKVSNFFKPSSLSSFEKEIESRMEQILDDLDDLESQSGYLGLTRTSGVGVGSGSGSKVLEKLPSASSV

SEQ ID NO: 215518 - protein, 78 aa, Glycine max
  Coding DNA Sequence Number=SeqID_98740
MPRQTQGDAPQASDAPPPPHQADPAGSLGMEQQFRAEVAWPEAQAGEKPAGFPGEAEEARMDEEMTDLLGFSGGSGAM

SEQ ID NO: 215519 - protein, 86 aa, Glycine max
  Coding DNA Sequence Number=SeqID_98741
  Subcellular localization annotation: CTP_CleavageSite=28; ConfidenceScore=5.42e-01
MFFSMKNTIFTLSSSPNATQTLTPPSPPLMTTSGCHEPSLLAVEPPHQEEHFNQSGILRILLKDSVEKIPPILHFKASMRVFLHFL

SEQ ID NO: 215520 - protein, 540 aa, Glycine max
  Coding DNA Sequence Number=SeqID_98742
  Homolog annotation: Hit_ID=Q10EW2; Match level="QueryCoverage=94%, HitCoverage=97%, E-value=9e-96, Identity=42%"; Hit description=Auxin- regulated protein, putative, expressed
  Pfam annotation: Domain name=DUF966; Domain location=32-449; Score =502.5; E_value=4.7e-148; Accession=PF06136.4; Description=Domain of unknown function (DUF966)
MEARMRKYRQVSPERAKVWTEKSPKYHQNRKVPVLYYLCRNRQLEHPHFMEVPLSSPDGLYLRDVIDRLNALRGRGMTSLYSWSCKRSYKNGFVWHDLCEDDLILPAHGSEYVLKGSELFYESNSERFGPISNGKIQSLKQLPEPVTCRSHDEASTSSSMTEKETRNSQEDDDLSPRQQTGSSDVSPQSRAGKSDSLSLPLTEYQIYKNDGLADASTQTEENVNKPETQKTCTRGVSTEDDGSLEPECHEIGETQVPQVKYNSEICRDTVSPPPSTPSSSGGKTETLESLIRADVSKMNSFRILEEERIRMQTNARLKASNLLMQLISCGSISVKNHSVGLIPSYKDRLSHSKFPSPLFSTSVTFGDFDCVAEKAKVMGLKLEDKEYYSGSVVESKVLKEGDGHGVLKRSSSCNAERTSEELKSQDTEASSSLGNSKYAPQSVKASSTKQQPSECMRSPVSDGSRNSTDKTYGLGISPVPSIGSSKRITELSAGSGRKQSKRVDSFREEERECVLTSYSFQSLIDEFDFNSTGLLQELGL

SEQ ID NO: 215521 - protein, 187 aa, Glycine max
  Coding DNA Sequence Number=SeqID_98743
MVKTRGLGHALGRVVGRGLGRGDGDDSDGAPQHRRPTASAHRRRVTVIVDDVVPAVPADSSAVPETEAVVARDEPMVDADAQDTGPDTDAQDIGTQDAADEPEGFLGGPKDPSVLTEYADHVAANVWSGQECPELMLCSHGRKEHNLGRLVPAIDDMVAGIGLSPLIACSIDTGDRGLISSFADRWH

SEQ ID NO: 215522 - protein, 118 aa, Glycine max
  Coding DNA Sequence Number=SeqID_98744
MSSSCESCIPIVQKSNADDLNPLCGSMKCLQTCNYTKPTINKREEDECARGTVVAKGRRKRRSNHAVGNVKDVRSQEDERRKGGGAEPNLQRRKQEARRSQRKERAEELVMLGVQVLI

SEQ ID NO: 215523 - protein, 62 aa, Glycine max
  Coding DNA Sequence Number=SeqID_98745
  Homolog annotation: Hit_ID=Q8LRT1; Match level="QueryCoverage=68%, HitCoverage=5%, E-value=3e-08, Identity=58%"; Hit description=Acyl -CoA synthetase-like protein
MIVRANILGMWPQTRRCSPFLQSSLLSGNGGVPSNEWKDVPDIWRSSAQKYGDTIVHYSFLS

SEQ ID NO: 215524 - protein, 251 aa, Glycine max
  Coding DNA Sequence Number=SeqID_98746
  Pfam annotation: Domain name=DUF1635; Domain location=18-251; Score =339.5; E_value=5.7e-99; Accession=PF07795.2; Description=Protein of unknown function (DUF1635)
MDNQRSPLLSWAYYFQGKSMEELRQSLIYTTLELEQTRVAVQEELKKRDEQLLNLKDLLSKTIRERDEAQEKCQRLLLEKLVFQQQLQHAAPVSGISSIEDEPRRGIDSNNGHSSSDCEESIVSSPVIDHLPQPQPQSMIELTPDKPLPEKGKLLQAVMKAGPLLQTLLLAGPLPQWRHPPPPLESFEIPPVTIPSPPPPPLQLLHQDTFFNKTNGSSSTTTNCGRLSRKRVFCDGSDSPTETKYQRLVLH

SEQ ID NO: 215525 - protein, 65 aa, Glycine max
  Coding DNA Sequence Number=SeqID_98747
MWNVLLCSAKCAMVIYGQGKGRKSHMDSLQQRKQIDVTNLASTALKHYIDTSFPVMDARSPEKRA

SEQ ID NO: 215526 - protein, 131 aa, Glycine max
  Coding DNA Sequence Number=SeqID_98748
MKSEVGLYLSCEIVNYPSPLPRLHCSCRPRTTAPLSPFHAYLRKALHFFSDLRKIRWLRFASIGLEGRVIVVVVAAATLVADVLTQLAWKGELLRWFCLCHWFPSMSSPWWLRWCRRRWFLIATARCACCW

SEQ ID NO: 215527 - protein, 458 aa, Glycine max
  Coding DNA Sequence Number=SeqID_98749
  Gene Ontology: Mol. function=transferase activity; Cellular component= membrane; Biological process=cellular metabolic process
  Homolog annotation: Hit_ID=Q5BM98; Match level="QueryCoverage=93%, HitCoverage=98%, E-value=1e-180, Identity=69%"; Hit description =Secondary cell wall-related glycosyltransferase family 47
  Pfam annotation: Domain name=Exostosin; Domain location=100-407; Score=310.2; E_value=3.7e-90; Accession=PF03016.6; Description =Exostosin family
MSEQKKPPKSRVFYLRMKLLHKQGNKPQQDKNNNWFHTYYKWVLWLSFSLYFFTSYLITSNPNNTNTPTSHVSNSESNVVPRTLVESTSNTLGVLKNMKVFVYELPPKYNTDWLANERCSNHLFASEVAIHRALLTSEVRTFDPYEADFFFVPVYVSCNFSAVNGFPAIGHARTLISSAVNLVSTEYPFWNRSRGSDHVFVASHDFGACFHTLEDVAMADGIPKILKNSIVLQTFGVIHPHPCQDVENVVIPPYVAPESVRSTLEKFPVNGRRDIWAFFRGKMEVHPKNVSGQFYSKRVRTEIWRKFNGDRRFYLQRRRFAGYQLEIARSVFCLCPLGWAPWSPRLVESVALGCVPVVIADGIRLPFSSAVRWSEISLTVAERDVGKLGKILERVAATNLSVIQKSLWDPGTRRALLFNNNKKVEEGDATWQVMVSLSEKLGRSYRRSLVGDQLKSDT

SEQ ID NO: 215528 - protein, 168 aa, Glycine max
  Coding DNA Sequence Number=SeqID_98750
  Gene Ontology: Mol. function=transition metal ion binding
MHAKKNVDDSEIGTLLNIQGKTKDGLKYHQDLLDMVYESSCIRYHKVNEYFCPQHVTQCQQKRKNKVIDPRQLDDLENEATIVLSQLEMYFPLSFFDIMVHLNLLGFLKLVMTEHEENKPDKCFMSKIRVIQDCQWFYKEDPVVSITKMMIQHLTFLRRMLSPHECLL

SEQ ID NO: 215529 - protein, 82 aa, Glycine max
  Coding DNA Sequence Number=SeqID_98751
MRDKEQHAMQIHKRTKDRPRAIHYSHQSKHFNHGWRWHLLEWDERNARINDTKVHKKLEDAAANGILVSPYVMAFDFWGKMG

SEQ ID NO: 215530 - protein, 173 aa, Glycine max
  Coding DNA Sequence Number=SeqID_98752
  Homolog annotation: Hit_ID=Q8TGM5; Match level="QueryCoverage=23%, HitCoverage=61%, E-value=7e-08, Identity=70%"; Hit description =Uncharacterized protein ART3
RVAPPDLRSRWERACTQRVVDGSELTGSHVIGLERGSSTIYHGEVGMNPDFNQPRGGRALGLMASGATCVQRLDGSRDSAIHTKYRISLRSSSMQEPRYPLPRVIDEEAGRTGRRGHPLPPDGSVDFSQRRGQRTAHVAAIRTLHRTIQSVGATGGVYKGQGRSQRELMTRAY

SEQ ID NO: 215531 - protein, 151 aa, Glycine max
  Coding DNA Sequence Number=SeqID_98753
MTTVVTTTITTATNDGDNNDHVGGDNGSHDDGGGGSNNESNHIGGATVDNHGDDYGGGHDSCDENGHDNDGGHGNDRFEIFGDHVGGDDNGHDDNHDDGDSSNGGDDGGDDDGHDNDHDDGDNDNNDDHVGGDEGDHDGDSGGCDSNLNVN

SEQ ID NO: 215532 - protein, 82 aa, Glycine max
  Coding DNA Sequence Number=SeqID_98754
MIGILLRQVCERGIPMCMDCSSHSLFRDLGNRNLNQKVGCRVQNAMSTLEPTIRLPASVPDRTSSIKRKKENRVREMMCKNK

SEQ ID NO: 215533 - protein, 347 aa, Glycine max
  Coding DNA Sequence Number=SeqID_98755
  Gene Ontology: Mol. function=transcription regulator activity; Cellular component=nucleus; Biological process=regulation of transcription
  Homolog annotation: Hit_ID=O81348; Match level="QueryCoverage=97%, HitCoverage=92%, E-value=2e-42, Identity=36%"; Hit description =Symbiotic ammonium transporter
  Pfam annotation: Domain name=HLH; Domain location=173-222; Score =48.6; E_value=2.1e-11; Accession=PF00010.16; Description=Helix-loop -helix DNA-binding domain
MEDPTLFHQYPMDNSVLFQLEDLDFESFSASPKNSSSPKRFNSESTQNSSLTQNPEQYSVTPPRPTKQNKTVSTTWSAYNTHDMMAPKASSSSSSKIISFENSNASSVTSQQLYNVDAASKVKKPKSETGYGENLDFAAAAASQSVYDNNSFLDHYDTREKKAAASLTRNPTQAQDHVISERKRREKLSQRFIALSAIIPGLKKMDKATVLEDAIKYVKQLQERVKTLEEQAVDKTVESAVFVKRSVVFAGDDSSDNDENSDQSLPKIEARISGKEVLIRIHSDKHSGGAAAILRELEKHHLTVQSSSFLPFGNNTFDITIVAKMNMDYCFTAKDLIRSLSRCLRQL

SEQ ID NO: 215534 - protein, 110 aa, Glycine max
  Coding DNA Sequence Number=SeqID_98756
  Subcellular localization annotation: CTP_CleavageSite=64; ConfidenceScore=5.21e-01
MFAHSIRGCRPLGRACGVLIPSPCVNTTPEPFNLKVRRSRLFRFFRRFPQINVGGDSARIPFVEHASRESRVALPPKDLVQECLIVNPEKEEDLALVQMTQAEKKTCPAL

SEQ ID NO: 215535 - protein, 214 aa, Glycine max
  Coding DNA Sequence Number=SeqID_98757
  Gene Ontology: Mol. function=RNA-directed DNA polymerase activity; Cellular component=exocyst; Biological process=RNA-dependent DNA replication
MRLSKVVGKLVNESQLTFVGGRNVLDSMVVVNECMHEVKRRKRSTLIFKENFEKVYDVVRWDFLYHMMRRMEFRGIVREVNKKNLMEGVEIGEENLEIYLQKFEDDPIVFLKPDLKSVLTLKAILISYEVTVGLRVNFHKSTIGGIGVCERDVQRFAVLLNCFTLEMPFVYLGIPLGASQKRIRTREPVLQKTKEENDAMEAKITLNWGASLSY

SEQ ID NO: 215536 - protein, 43 aa, Glycine max
  Coding DNA Sequence Number=SeqID_98758
MDFPCIGRCMRAKPPDWLLALSGLLGLSYLDALSEDVALSVTL

SEQ ID NO: 215537 - protein, 539 aa, Glycine max
  Coding DNA Sequence Number=SeqID_98759
  Gene Ontology: Mol. function=hydrolase activity, acting on glycosyl bonds; Cellular component=integral to membrane; Biological process =carbohydrate metabolic process
  Homolog annotation: Hit_ID=Q8GW72; Match level="QueryCoverage=86%, HitCoverage=89%, E-value=1e-170, Identity=61%"; Hit description =Alpha-L-fucosidase 1 precursor
  Pfam annotation: Domain name=Alpha_L_fucos; Domain location=34-436; Score=-179.8; E_value=0.0011; Accession=PF01120.8; Description=Alpha- L-fucosidase
  Pfam annotation: Domain name=F5_F8_type_C; Domain location=378-498; Score=10.0; E_value=0.016; Accession=PF00754.15; Description=F58 type C domain
  Pfam module annotation: Pfam domain module=Alpha_L_fucos::F5_F8_type _C; Domain location=34-436::378-498
  Subcellular localization annotation: CTP_CleavageSite=46; ConfidenceScore=5.04e-01
MKLNSKSLRLSCKSHNPGIKISTCTLPNFLIRILLLCLCCFLVPASCSRKPPPLPILPLPTTFQLQWQLDGMALFFHFGTNTFTDSEWGTGHANPTVFNPTKLNASQWIRVAKDSGFSRVILTVKHHDGFCLWPSDYTNYTVRSSNWRNGNGDVVAELAAAAKDAGVGLGFYLSPWDRHEACYGDTLQYNEFYLAQMTELLTSIQTRYGEVKDIFLDAAKEDETDMHYLFDSWFSLIHQLQPGAIVFSDLGPDTRWAGNEYGAAGSTCWSLYNKTGYEIGYIDNQYNSEGDQFGPDWLPATCDVSIRTGWFWHASEQPKSARSLLEIYYKSVGRNCQLLLNVPPNSSGLISDEDIQVLQEFAELKRSIFSHNLAINAVINASSIRGGIQETHFSPYNVLEEGIYTYWAPWENQSKWILYIDLQELVSFNVLQLQEPINMGQRVIEFHLEALSQDGVWMRVVNGTTIGYQRLLLFPKLKAQYLKLVMDKSRADPLISYFGIYMDPVTILSDISDKKSGACFNGSQVLQTTTNNSYPSATM

SEQ ID NO: 215538 - protein, 47 aa, Glycine max
  Coding DNA Sequence Number=SeqID_98760
MVDTRIDYREGGYNRSGRDYSDVNYDGDKDCGYSHGGSCFSRAGAVV

SEQ ID NO: 215539 - protein, 340 aa, Glycine max
  Coding DNA Sequence Number=SeqID_98761
  Homolog annotation: Hit_ID=Q2LME0; Match level="QueryCoverage=40%, HitCoverage=42%, E-value=4e-65, Identity=80%"; Hit description=MYB24
  Pfam annotation: Domain name=Myb_DNA-bind_2; Domain location=13-70; Score=-5.9; E_value=0.045; Accession=PF08914.1; Description=Rap1 Myb domain
  Pfam annotation: Domain name=Myb_DNA-binding; Domain location=14-62; Score=52.9; E_value=1.1e-12; Accession=PF00249.21; Description=Myb -like DNA-binding domain
  Pfam annotation: Domain name=Myb_DNA-binding; Domain location=68-113; Score=41.1; E_value=3.8e-09; Accession=PF00249.21; Description=Myb -like DNA-binding domain
  Pfam module annotation: Pfam domain module=Myb_DNA-bind_2::Myb_DNA -binding::Myb_DNA-binding; Domain location=13-70::14-62::68-113
MGRAPCCDKANVKRGPWSPEEDSKLKDYIEKHGTGGNWIALPQKAGLKRCGKSCRLRWLNYLRPNIKHGEFSDEEDRIICSLYANIGSRWSIIATQLPGRTDNDIKNYWNTKLKRKLMGLLPASHQRIAPFQQSSPQNLSSFPSHSHSSSLSSSIYSDYYNHNSNHYYMPAPTSSFTCLEPISVPSSNYTNTTTASTLNPFYQNQEPLASIISPMQYYPIKDSSMLVFGSETSCSSSDGSCSQVSLGREVKQEDMGFQNFMFGDHQNMNNINHDGGEEYVDQWTQKPNGHIFQTQQTAMDYDLEVIRNLISSNSNSSNSNNEYLSVDENKTEEKGVYYNY

SEQ ID NO: 215540 - protein, 329 aa, Glycine max
  Coding DNA Sequence Number=SeqID_98762
  Gene Ontology: Mol. function=protein binding; Cellular component =ribonucleoprotein complex; Biological process=nuclear mRNA splicing, via spliceosome
  Homolog annotation: Hit_ID=Q6EUK2; Match level="QueryCoverage=63%, HitCoverage=74%, E-value=7e-79, Identity=70%"; Hit description =Putative U2 snRNP protein A'
  Pfam annotation: Domain name=LRR_1; Domain location=159-179; Score =6.2; E_value=20; Accession=PF00560.23; Description=Leucine Rich Repeat
  Pfam annotation: Domain name=LRR_1; Domain location=181-202; Score =1.9; E_value=1.3e+02; Accession=PF00560.23; Description=Leucine Rich Repeat
  Pfam annotation: Domain name=LRR_1; Domain location=205-228; Score =8.4; E_value=7.7; Accession=PF00560.23; Description=Leucine Rich Repeat
  Pfam annotation: Domain name=LRR_1; Domain location=230-255; Score =3.0; E_value=79; Accession=PF00560.23; Description=Leucine Rich Repeat
  Pfam module annotation: Pfam domain module=LRR_1::LRR_1::LRR_1::LRR _1; Domain location=159-179::181-202::205-228::230-255
MDKEIPAVNWTLVGPTLLISPSSQSHLSKLLPAPPKDSNKQNTILPHLPLTSPHHGSMQIPPSNTTDHSRQLLARKKTLMEKKTKSVILFHDLSTGLNPHFPPLTGKQQNHLWVEVMVRLTADLIWKSPHFFNTIKERELDLRGNKIAVIENLGATEDQFDTIDLSDNEIVKLENVPYLNRLGTMLINNNRITRINPNIGEFLPNLHTLVLTNNRIVNLVEIDPLASLPKLHFLSLLDNNITKKPNYRLYVINNLKSLRVLDFKKVKNKERLEAKNLFASKEVIEEIQRTPAKTFSTGETPNVSEAIEEQQTPKVVAPTPEQIIAIKVQ

SEQ ID NO: 215541 - protein, 87 aa, Glycine max
  Coding DNA Sequence Number=SeqID_98763
MVGFTPIPTRHKTPMSAPKPLLILARKVSRLRKDKGLRGIHNGIIGGYHEWLKVRTRGLDWLSKLKIINEENFKAPEEDEEVRALKT

SEQ ID NO: 215542 - protein, 103 aa, Glycine max
  Coding DNA Sequence Number=SeqID_98764
ALKSGQLPADLISLSDNIMLDNVDEKHEDMIHDDRSQADGKSNDTQEQRNTDSASMEQVYKCVFDVCIYSSLALFYVQLNEAQIRVKRFSNSPSTVDFFNVRF

SEQ ID NO: 215543 - protein, 184 aa, Glycine max
  Coding DNA Sequence Number=SeqID_98765
MKADVEAMKDQMAAMMEAMLSMKKIMESNAAVVTPTSVATQVDPTHPSGLNQLNPPISDMVGQGGEAFGNTGGPYVVKSKNSFPSYDLPPNYAPPNAVPVLDENANNSTPIPIEGQQPQSDHAHAHLGYATKGQAFCGVPLPNTLWGPQYHPQPQPLHSVAGRVPPARVKREKLDHIEERLRAI

SEQ ID NO: 215544 - protein, 56 aa, Glycine max
  Coding DNA Sequence Number=SeqID_98766
  Subcellular localization annotation: CTP_CleavageSite=45; ConfidenceScore=5.25e-01
MCFVKKIQVEVLPQRFRKRFCGNSSSFFTVLRSFFIILQSSTIFFSSALTSFLPFI

SEQ ID NO: 215545 - protein, 264 aa, Glycine max
  Coding DNA Sequence Number=SeqID_98767
  Gene Ontology: Mol. function=glutamate N-acetyltransferase activity; Biological process=peptidoglycan metabolic process
  Homolog annotation: Hit_ID=Q7WP92; Match level="QueryCoverage=98%, HitCoverage=33%, E-value=2e-79, Identity=56%"; Hit description =Hypothetical protein vrgS
  Pfam annotation: Domain name=DUF586; Domain location=137-215; Score =185.4; E_value=1.4e-52; Accession=PF04524.3; Description=Protein of unknown function, DUF586
MTSAKPNAWMLQARQNPVSPVPGTVDVYDWPGHFVDHSHGEFYTRIRQEVWQVAHHSVSGTGTATGIAPGYRFGIVNAPHFSDNGEYLVTSARYDFEENGYASGGGGARHNIAFTVLPSSVTYRAEPATAWPKTHGPQTAKVVGPAGESIWTDRYGRVKVKFHWDRLAKGDDTSSCWVRVSSAWAGQGYGSVQIPRVGDEVVVDFINGDPDRPIVTGRVYNDGNMPPWALPAAATQMGFLSRSKDGTADTANALRFEDKAGEEQ

SEQ ID NO: 215546 - protein, 68 aa, Glycine max; identical to SEQ ID NO: 213612
  Coding DNA Sequence Number=SeqID_98768

SEQ ID NO: 215547 - protein, 210 aa, Glycine max
  Coding DNA Sequence Number=SeqID_98769
  Pfam annotation: Domain name=B3; Domain location=112-192; Score=8.6; E_value=0.008; Accession=PF02362.12; Description=B3 DNA binding domain
MGHELEETTGIKDQARLQHSVMIVVEVDNGKGKLRAYFGDEIMFIINEYHTYQSCYVYGPFYPDKSISNASYSMPDSFQNHSLKDTHSLGENVTSKAPIRRSSIGVIFIYTFFVAILAFVKKEHLYHFPDEVPILKSDESRTWRILWCNNQCKFGDGWCQLCKTGNFNIGDVLIFTKEPGSHVIHVSRGKAPFIEQLRNGENSYFIMFFI

SEQ ID NO: 215548 - protein, 211 aa, Glycine max
  Coding DNA Sequence Number=SeqID_98770
  Gene Ontology: Mol. function=RNA-directed DNA polymerase activity; Biological process=RNA-dependent DNA replication
MTSGNSVGTLDTGADGRHEETMEQMEGIRRENAKARRESTEMLISGGTDLVKCKLFVGTLTRFALDWFSGLLNNSIAHFNDFLRLFVAQFAGNKESPATTTDLFDVRQHPGESLNEYLTWFDGEVIWVIDWDERMIIAAFCKGLHAEPFRESLVRRQPDIVANVRSKVTCHIEAEEAMTRKKHLRKRRSGRLLSQVPGLMKGLLETSWKLE

SEQ ID NO: 215549 - protein, 74 aa, Glycine max
  Coding DNA Sequence Number=SeqID_98771
MATPRVFLSWNRFRESRVASCPIILKFKEFEKLTQFSLAIFSLSRPTLAILATTLALLSLSHAQWCRASLISAI

SEQ ID NO: 215550 - protein, 68 aa, Glycine max
  Coding DNA Sequence Number=SeqID_98772
MGQNTPNKIDDDGSKSHQGPFRNILKIGLLKEEATGQQAPPRRRQDDENQIRNTSIRLPNFPVKYEQE

SEQ ID NO: 215551 - protein, 318 aa, Glycine max
  Coding DNA Sequence Number=SeqID_98773
GGLERRNFHKCLTNLADSSIDLALVKEFYTNLYSLEGPSPKQVRNRGHLIRIDADSLNSFLETPVVLAEGESLPTYLRYCRIPTDIREIEGHPGKILRKDLTTLAQLDMNVGALISGQITSMAQSNSSRLGFPTLITALCRTRGVASDSLVFERLSPGARRPRAKLVEASSTSTAPHLASTSAAPHLASTSAAPPPARIATAPSTLPPADSQCFEAMLRSIHKGQIILLQSLQLVAPPDSIPTVEQFNEWVGWPGTQPPPQWDDEDPAAQVPHQPSDKSSESSTPEPLIRKRRVVVTEILILRTDVVQDVTTSRFRTC

SEQ ID NO: 215552 - protein, 142 aa, Glycine max
  Coding DNA Sequence Number=SeqID_98774
  Gene Ontology: Mol. function=phosphatidate cytidylyltransferase activity; Cellular component=membrane; Biological process =phospholipid biosynthetic process
  Homolog annotation: Hit_ID=Q5KLD6; Match level="QueryCoverage=76%, HitCoverage=10%, E-value=7e-20, Identity=43%"; Hit description =Dolichol kinase, putative
MAVSMFLPALIFQPKFLDLAFGAALAIFLMLEIIRVWRIWPLGQPINQFMNAFTDHRDSDLLIVSHFSLLLGCALPIWMSTGYNDRPLAPFAGILSLGIGDTMSTIRARTWINLEILYCKSDKFLNKEVFTPLVLGSHDDFS

SEQ ID NO: 215553 - protein, 615 aa, Glycine max
  Coding DNA Sequence Number=SeqID_98775
  Gene Ontology: Mol. function=nucleoside-triphosphatase activity; Cellular component=membrane; Biological process=transport
  Homolog annotation: Hit_ID=Q84ZB2; Match level="QueryCoverage=94%, HitCoverage=94%, E-value=0.0, Identity=82%"; Hit description =Putative iron inhibited ABC transporter 2
  Pfam annotation: Domain name=ABC_tran; Domain location=114-305; Score= 136.3; E_value=8.3e-38; Accession=PF00005.17; Description=ABC transporter
  Pfam annotation: Domain name=ABC_tran; Domain location=426-591; Score= 145.5; E_value=1.4e-40; Accession=PF00005.17; Description=ABC transporter
  Pfam module annotation: Pfam domain module=ABC_tran::ABC_tran; Domain location=114-305::426-591
  Subcellular localization annotation: CTP_CleavageSite=26; ConfidenceScore=5.04e-01
MVSDASKKKAAQKKAAAAAKRGGKAAAAAASSKTTSSEKLADGIRDIQISDRTCTGVLCSHPLSRDIRLIAHAFTVISIVLTCLFMPSSQIESMSVTFHGHDLIVDSELELNYGRRYGLLGLNGCGKSTLLTAIGCRELPIPDHMDIYHLTREIEASDMSALEAVISCDEERLSLEKEAEALAAQDDGGGEALERIYERLEAIDASTAEKRAAENLFGLGFNKQMQAKKTRDFSGGWRMRIALARALFMNPTILLLDEPTNHLDLEACVWLEENLKKFDRILVVVSHSQDFLNGVCTNIIHMQNKKLKLYTGNYDQYVQTRSELEENQMKQYKWEQEQIASMKEYIARFGHGSAKLARQAQSKEKTLAKMERGGLAEKVVRDKVLVFRFVDVGKLPPPVLQFVEVTFGYTPDNLIYKKLDFGVDLDSRIALVGPNGAGKSTLLKLMTGDLEPLDGMVRRHNHLRIAQFHQHLAEKLDLEISALQFMIKEYPGNEEERMRAAIGKFGLSGKAQVMPMKNLSDGQRSRVIFAWLAYRQPHLLLLDEPTNHLDIETIDSLAEALNEWDGGMVLVSHDFRLINQVAHEIWVCADQAVTRWEGDIMDFKEHLRSKAGLSD

SEQ ID NO: 215554 - protein, 268 aa, Glycine max
  Coding DNA Sequence Number=SeqID_98776
  Gene Ontology: Mol. function=phosphatidate cytidylyltransferase activity; Cellular component=membrane; Biological process =phospholipid biosynthetic process
  Subcellular localization annotation: CTP_CleavageSite=85; ConfidenceScore=5.09e-01
MTTSFLNGERAVVLFFICRILYSLPFSLLFHGLALSLLSLSSFFLEISFDSSNSPSLFRTRPGASSGILLGAVTLPSLFLSKLVQLSRGFSLAQLQLEEIQYLTLQYWATSASACSVIFLLAFARRRAPLSPFHWGVRFSLCSIFFQALVSVAALSTTSQIGLHPALKLMWAFCHGLASVKLIQLFLRTFPSCASIGETFLVTSGIVLYFGDMLLLTIKKLHELLMSSELVTAEYEISRRACAWSSAISNSFEIYSPNMGVVYKYNFC

SEQ ID NO: 215555 - protein, 362 aa, Glycine max
  Coding DNA Sequence Number=SeqID_98777
  Gene Ontology: Mol. function=nucleoside-triphosphatase activity; Cellular component=integral to membrane; Biological process=transport
  Homolog annotation: Hit_ID=Q9ZUU9; Match level="QueryCoverage=91%, HitCoverage=44%, E-value=1e-141, Identity=78%"; Hit description =White-brown complex homolog protein 3
  Pfam annotation: Domain name=ABC_tran; Domain location=136-349; Score= 93.1; E_value=8.4e-25; Accession=PF00005.17; Description=ABC transporter
  Subcellular localization annotation: CTP_CleavageSite=59; ConfidenceScore=5.36e-01
MEEIQSQSDNYRSSSSSASSPASRVPSSNFFYLRKPGSLRQPISFEDSPEWEDTDIDVRVEEGGDSINVATTPASPSLSKLNSGSLPSPRLPEGAVIPRKIAGASVAWKDLTITIKGKRKYSDKVIKSSTGYALPGTMTVIMGPAKSGKSTLLRAIAGRLHPSARMYGEVFVNGAKSQMPYGSYCYCIVEFLGTAIATPSAIVADMGVVGYVERETTLIGSLTVREFLYYSALLQLPGFFCQKKSVVEDAIHAMSLGDHANKLIGGHCYMKGLPSGERRLVSIARELVMRPHILFIDEPLYHLDSVSALLMMVTLKRLASTGYTLIVTIYQSSTEVFGLFDRICLLSNGNTLFFGETLACLQ

SEQ ID NO: 215556 - protein, 395 aa, Glycine max
  Coding DNA Sequence Number=SeqID_98778
  Gene Ontology: Mol. function=DNA binding; Cellular component =membrane; Biological process=DNA integration
  Homolog annotation: Hit_ID=Q1SS72; Match level="QueryCoverage=90%, HitCoverage=25%, E-value=3e-79, Identity=39%"; Hit description =Integrase, catalytic region
  Pfam annotation: Domain name=zf-CCHC; Domain location=246-263; Score =9.1; E_value=0.031; Accession=PF00098.13; Description=Zinc knuckle
  Pfam annotation: Domain name=zf-CCHC; Domain location=282-299; Score =0.7; E_value=0.76; Accession=PF00098.13; Description=Zinc knuckle
  Pfam module annotation: Pfam domain module=Retrotrans_gag::zf -CCHC::zf-CCHC; Domain location=77-192::246-263::282-299
MNEATYNNVESYLYLHPSENPATALVSPVLESTNYHSWSRSMITALSAKNKLEFIDGSAPEPLKTDRMYGAWRRCNNMVVSWIVHSVATSIRQSVLWMDKAEDIWRDLRSRYSQGDLLRISDLQQEASTLKQGALTITEYFTRLRVIWDEIESFRPDPVCTCNIRCSCSVSAIIGQRKLEDRAMQFLRGLNEQYTNIRSHVLLMDPIPPISKIFSYVAQQERQLLGNSSPNLTFESKEISINAARSICEFCGRAGHTENVCYKKHGMPLNHEARNKTYGGRKSCTHSGKMGHTVDVCYQKHGYPPGYKPYSGRTTVNNVVTMNDKSMDDQTQHHEAQDSVRFSPEQHKALLALIQRPLTGSTASEQTKQVASISSCTTDRLPNPGHEHSYEDWYS

SEQ ID NO: 215557 - protein, 258 aa, Glycine max
  Coding DNA Sequence Number=SeqID_98779
  Gene Ontology: Mol. function=DNA binding; Cellular component=beta -galactosidase complex; Biological process=DNA integration
  Homolog annotation: Hit_ID=Q1T2A5; Match level="QueryCoverage=99%, HitCoverage=27%, E-value=1e-96, Identity=66%"; Hit description =Integrase, catalytic region
EPSSYAKASQHDCWIKAMQAELDALQSNETWRLTPLPPHKTAIGCRWIYKIKHRADGSIERYKARLVAKGYTQMEGLDYLDTFSPVAKLTTVRFLLAIAAMNNWHLRQLDVNNAFLHGELDEEVYMQVPPGLTIQNPNLVCRLQRSLYGLKQASRQWFLKLSSLLTTHGFQKSQSDHSLFLRFTGSITTILLVYVDDIILTGNSSSEIQEIITILDQTFKIKDLGNLKYFLGLEVARSSNGIHLSQRKYTLDILSDSG

SEQ ID NO: 215558 - protein, 43 aa, Glycine max
  Coding DNA Sequence Number=SeqID_98780
MEQRKRIHVLEELMDMVINAGAGYRVSDITESMVSIKRTSTIK

SEQ ID NO: 215559 - protein, 183 aa, Glycine max
  Coding DNA Sequence Number=SeqID_98781
MSEIKEVQEQMKADKKAMKDQMTSMIKVMLSMRRMMEDNVATFATSSTGAKADPTHPSGLKNPPVSDMVGQGGEALGSTGGPHFVQVQNKHSFPPYGLPPNYTPLDVTHAPNENFDNSAPTPIESQQPQSDHAHVSEPMGETHEAPRDHNLVNFKPHLGCAIEGQAFGGIPLPNTLGGPQYRP

SEQ ID NO: 215560 - protein, 65 aa, Glycine max
  Coding DNA Sequence Number=SeqID_98782
MDGPRPILDPIVDWHVILFSIPHFYILEHAMAPRKLLSKRARKDATEEGSSAALQADIEFDGHRF

SEQ ID NO: 215561 - protein, 142 aa, Glycine max
  Coding DNA Sequence Number=SeqID_98783
  Gene Ontology: Mol. function=chitin binding; Cellular component =extracellular region; Biological process=chitin metabolic process
  Homolog annotation: Hit_ID=UPI0000612705; Match level="QueryCoverage =85%, HitCoverage=92%, E-value=2e-13, Identity=29%"; Hit description =UPI0000612705 related cluster
GLHALAFKGLHVLTFRGLDILAFKGLDVLAFKGLHVLTFRGLHVLTFRGLHTLTVRGLHALAFIGLHALAFIGLHVLAFRGLHNLTFRGLHVLAFKGLHICAFRELKKEAITQLLCIPGQDFAQATTKRRVQIMRTNMTTLT

SEQ ID NO: 215562 - protein, 52 aa, Glycine max
  Coding DNA Sequence Number=SeqID_98784
MTAEINQSKTMTRSGLAAHCLFPTCRVTTDRSSSLPGAGQAENVAARKPSIL

SEQ ID NO: 215563 - protein, 117 aa, Glycine max
  Coding DNA Sequence Number=SeqID_98785
MAFTALLLHRASYLATDHSSHRGASASPCKQCNDASRRENNMKEMEGGLLSYQKVISSTAPASQVTYPTYLIVLFFVLCHKCLQIIVMTVMVSRKIRGMVRKRRSEWWEIEREQSQG

SEQ ID NO: 215564 - protein, 111 aa, Glycine max
  Coding DNA Sequence Number=SeqID_98786
MTRWWSISFHCPRSVSLTYLRHYHCPWPPKLSLAKPPSSHAIVLNPPRRVSQSHLVVLWSQSHPLHCHRRALMQSYPPRALDRRLQEDWARDARESPKVLMSLRVDFGSMG

SEQ ID NO: 215565 - protein, 272 aa, Glycine max
  Coding DNA Sequence Number=SeqID_98787
  Gene Ontology: Mol. function=protein serine/threonine kinase activity; Cellular component=cytoplasm; Biological process=protein amino acid phosphorylation
  Homolog annotation: Hit_ID=Q5QLC6; Match level="QueryCoverage=89%, HitCoverage=32%, E-value=1e-104, Identity=77%"; Hit description =Putative dual-specificity tyrosine-(Y)-phosphorylation regulated kinase TbPK4
  Pfam annotation: Domain name=Pkinase; Domain location=39-271; Score =80.8; E_value=4.3e-21; Accession=PF00069.15; Description=Protein kinase domain
  Pfam annotation: Domain name=Pkinase_Tyr; Domain location=24-272; Score=-92.6; E_value=8.7e-07; Accession=PF07714.7; Description =Protein tyrosine kinase
  Pfam module annotation: Pfam domain module=Pkinase::Pkinase_Tyr; Domain location=39-271::24-272
MILYPELSFLPNIPVNAENKELPIVLNTVLAGRHYVTEYLCSAAFSRVVQAHDLQTGIDVCLKIIKNDKYFFDQSLDEIKLLKLVNKHDPPDLHHFLRLYDYFYHQEHLFIVTELLQANLYEFQKFKQESGGEEYFTLNKLQLITRQCLEALQYLHSLGIVHCDLKPENILIKSYRRCQIKVIDLAGSSCFQTDNLCLYVQSRSYRAPEVMLGLQYDEKIDIWSLGCILAELCSGEFNQVFVLVLFPNDAVVMILARMIGMLVLLIWRCSIL

SEQ ID NO: 215566 - protein, 360 aa, Glycine max
  Coding DNA Sequence Number=SeqID_98788
  Gene Ontology: Mol. function=DNA binding; Cellular component=nuclear pore; Biological process=DNA integration
  Homolog annotation: Hit_ID=Q1RSI0; Match level="QueryCoverage=97%, HitCoverage=40%, E-value=3e-95, Identity=46%"; Hit description=IMP dehydrogenase/GMP reductase
MEGLDFPDTFSPIAKLTTVRFLLALAVLHGWHLRQLNVKNAFLHGELNEEVYKQLPPGLLVDNPHQGMTSKLFVASPPLWIKLSKSKILYTLDILSDSGMLGSRPITTPMDYATRLQATMGDPLFVEASSSYRRLVDRLIYLTNTRPDIAHVVQQLSQYMAHPTTSHSQDASRVLHYLKGTPGSGIFFSATGSLQLKAFSDSNWAGCRDTRRSITGFSVYLGNSIISWRSKKQPTVSRSSSKAEYRALASTTCELQWLTYLLQDLCVSFVQPANLYCDNQSAIQIASNQVFHKRTKHIDLDCHIVREKVQSGLLKLLPASSLMQLADFFTEPLPPTMFQLLVSKLGMLNIHSQLEGGSCN

SEQ ID NO: 215567 - protein, 159 aa, Glycine max
  Coding DNA Sequence Number=SeqID_98789
MKWIPDGGRGGSSCGSEKPVIIVKIGRGMFVSGRAAQGRGWFIFNVVPHVEMLKINRGDGALWVSDDSLNSGGEENKFTIGRRNKLGYGNEIKEGKNLPVIEAGSIEHEETEAICLTLDEVEVEFPWDGCWIKASNALYCSVGKPVSWGKAMLPIAYIN

SEQ ID NO: 215568 - protein, 117 aa, Glycine max
  Coding DNA Sequence Number=SeqID_98790
MAISSVERHLKDTLRVDDEEGLEGGGDGGGVNGENNGSLTVGETHNPICRKVWGSGRRRNSSIGKETKTHNPICQSFELCEVVINGAALLKLEQSSLRVVVEGRHKTGLQFLEHCWP

SEQ ID NO: 215569 - protein, 77 aa, Glycine max
  Coding DNA Sequence Number=SeqID_98791
MVELGEKRGDDWGWNLFLGGDGLDEGSGRVKGYIDAQGNGLPQVAKGVALNGDVDLRVGGVAVEDATATNHEAKCNR

SEQ ID NO: 215570 - protein, 102 aa, Glycine max
  Coding DNA Sequence Number=SeqID_98792
  Homolog annotation: Hit_ID=P50165; Match level="QueryCoverage=43%, HitCoverage=16%, E-value=2e-11, Identity=77%"; Hit description =Tropinone reductase homolog
MGETKLSLKDKRWSLRGMTALVTGGTRGIGHAIVEELAEFGAVVHICALLRSNNWSDMPLPCQTTTLTKPSPTALRRPLIASPKAKKLLHKTMPHSLHPKQQ

SEQ ID NO: 215571 - protein, 108 aa, Glycine max
  Coding DNA Sequence Number=SeqID_98793
MSRKKEIVSPIGEFGLASTRGVECSGLATCTGDLTMQGTSQFDWRVALGGISFSGLQARVTKEQGAVKATAAGKIAGFSGDLMLEEIAGFSGDLRSINPSLPPKRAFT

SEQ ID NO: 215572 - protein, 106 aa, Glycine max
  Coding DNA Sequence Number=SeqID_98794
  Gene Ontology: Mol. function=phosphoinositide phospholipase C activity; Biological process=intracellular signaling cascade
  Homolog annotation: Hit_ID=Q69L69; Match level="QueryCoverage=71%, HitCoverage=10%, E-value=1e-09, Identity=39%"; Hit description =Calcineurin-like phosphoesterase-like protein
FLWEPYTTTVMSALPPICLIGSVAWCAVVSLICFHVVEWYQPDRVLRQFGMQQPIPGCPSQLVNIHGITLKGKQDENWDNCSPQLSVNGTIEMSLGSTFILDKRAY

SEQ ID NO: 215573 - protein, 131 aa, Glycine max
  Coding DNA Sequence Number=SeqID_98795
MVSPQGRNTWPVDDLVPYVEKITILSEEQERITEPVSHGLPSERQFPAQEFHILQSSVETQGIGRRREAVEAEEYSQQMVDRGHGMYYTPPTFSQYPFEGHHTDTFASEHSFDGVVETHPHFSWPTMTPSQ

SEQ ID NO: 215574 - protein, 334 aa, Glycine max
  Coding DNA Sequence Number=SeqID_98796
EIPSRARTSPAPETDAVHVEEQGEGQGIGSISPYGSSQKSSSEENFFDEEAIQEAEAGGSDIYPASSTSKLSASIGIAEDTFIKMQDEDPAAALRLLLNTSQANTSSEKIPGASSSSDADITSSVRQDCLLLKLSMEYAREDVLKSIEENPSAAFGHLNFLKKLHNPLTSDEILGKVIQIEAIIDQFASTVQKKRENGARLDAQKQAHILLLEKARAAQHEVERLTKEAKEGSSEIKACDDNISSWEATITDLLSQVDDLRQKIVTEQAKRKELQEKAANSIQKLVAKKGKEGLKAFSASQAVADEARVMESADQVLTKEMATLKKLYEDLVMH

SEQ ID NO: 215575 - protein, 142 aa, Glycine max
  Coding DNA Sequence Number=SeqID_98797
MWEKRLFKPDDLASATGYISDLASSTGYFHVISPLHLNPKKTLPKADALAVQIANTSGYSPHGQIANMTGETIATCRCQPKLANGAGDFLLPCMHSRTKQTHAGISLKTTPFEEKVWKSSPFRAICPYMATFPSHFTKSVKF

SEQ ID NO: 215576 - protein, 75 aa, Glycine max
  Coding DNA Sequence Number=SeqID_98798
MVVNEPTYNNFNNRGDIGGDNSDSSSDGGGSGYNYIGGGCDDDDIDSGASNSDNDCDVSNNSGDNNDGSGVGGRG

SEQ ID NO: 215577 - protein, 70 aa, Glycine max
  Coding DNA Sequence Number=SeqID_98799
MSRNLMDYAIIPSLASGMLRNFADCTLTLPFNSRHYLEVVKRGSHPNKQMIPGRNQGMTVAKHCSQQNTN

SEQ ID NO: 215578 - protein, 337 aa, Glycine max
  Coding DNA Sequence Number=SeqID_98800
  Gene Ontology: Mol. function=transcription factor activity; Biological process=regulation of transcription, DNA-dependent
  Homolog annotation: Hit_ID=Q98JI3; Match level="QueryCoverage=60%, HitCoverage=69%, E-value=9e-47, Identity=42%"; Hit description =Probable transcriptional regulator
  Pfam annotation: Domain name=HTH_1; Domain location=6-65; Score=68.3; E_value=2.4e-17; Accession=PF00126.17; Description=Bacterial regulatory helix-turn-helix protein, lysR family
  Pfam annotation: Domain name=LysR_substrate; Domain location=89-296; Score=179.3; E_value=9.6e-51; Accession=PF03466.10; Description=LysR substrate binding domain
  Pfam module annotation: Pfam domain module=HTH_1::LysR_substrate; Domain location=6-65::89-296
MHDDDYRQREAFLAVVRAGSFSAGARDLGRDVSVVSRRVAALEKRLGIRLLERTTRRIRPTEEGLRYRQKIELADELLREAEEQARDLAARPAGTIRLTVPASFGRKWVVQALPFFLKAYPDIRIVLHCSDRYVDLLGDNFDMAIRIGVLKDSRLIARKLANTSRILCVAPDYLERHSPVTHPQDLRKHDCLGFTPMHSWPEWRLEKDGQQIAVPVKTRYESDEMDGLILAAQSGMGILLAANWLVQKELAEGSLVPVLSDWQATGEDGVWLMKPSSQLQSAKISALTDWLTSWFSTPRCLCSPAVDIPRNNVGAPGDNNVFLHADAAPLRHGSPAG

SEQ ID NO: 215579 - protein, 94 aa, Glycine max
  Coding DNA Sequence Number=SeqID_98801
MSYSFFLDETVFIIIVKSVFKHLYKRIHTEQIILRDVKGVCPYIEPCDSKTQKSNLGIALVGVGCEQNKVDVRVDNKLRKTSEIVLGLSGAYID

SEQ ID NO: 215580 - protein, 165 aa, Glycine max
  Coding DNA Sequence Number=SeqID_98802
  Gene Ontology: Mol. function=phosphoinositide phospholipase C activity; Biological process=intracellular signaling cascade
  Homolog annotation: Hit_ID=Q2HRX8; Match level="QueryCoverage=68%, HitCoverage=16%, E-value=4e-20, Identity=43%"; Hit description=IMP dehydrogenase/GMP reductase
  Pfam annotation: Domain name=DUF1723; Domain location=108-157; Score =54.8; E_value=2.8e-13; Accession=PF08330.1; Description=Protein of unknown function (DUF1723)
MPTTSTHRQQEVAPVAEDDLVLTKDVHAHAEEAIDDAEGFPGGPRDLSVLTDYGDHVAVIVWNDEERPELKLSSHGRKVLKFGRPAPEIEGLVAITGLSPLIACSVDTGDRGLISTFVERWHKETSSFHLPVGELTITLDDVVSLLHLPIIGAFHSFEPLHVDEA

SEQ ID NO: 215581 - protein, 119 aa, Glycine max
  Coding DNA Sequence Number=SeqID_98803
  Homolog annotation: Hit_ID=Q1SJY4; Match level="QueryCoverage=51%, HitCoverage=13%, E-value=7e-07, Identity=39%"; Hit description=Zinc finger, CCHC-type
MFLLFSPLLVGVGEEEAKGLILGSAQVSIPSPNLALSFSCTSRGKGGTRHDGCSLNFLVSMLSRNQTWVSACTTTKEMWDLIQVTHEGTLNVRRTRRNSLIQKYETFQMQQGETIGDVC

SEQ ID NO: 215582 - protein, 279 aa, Glycine max
  Coding DNA Sequence Number=SeqID_98804
  Gene Ontology: Mol. function=phosphoenolpyruvate carboxylase activity; Biological process=carbon utilization by fixation of carbon dioxide
  Homolog annotation: Hit_ID=Q02909; Match level="QueryCoverage=99%, HitCoverage=28%, E-value=1e-132, Identity=87%"; Hit description =Phosphoenolpyruvate carboxylase, housekeeping isozyme
MWRCNDELRVRADELNRSSKKNSVAKHYIEFWKAIPPNEPYRVLLGEVRNRLYQTRERSRHLLAHGYSDIPEEETFTNVEETCMADDVSSNIGAFSVLSLCACGDRAIADGSLLDFLRQVSTFGLSLVRLDIRQESDRHTDVLDAITKHLEIGSYQEWSEEKRQQWLLSELSGKRPLFGPDLPQTEEIRDVLETFHVIAELPLDNFGAYIISMATAPSDVLAVELLQRECHVKHPLRVVPLFEKLADLEAAPDALARLFSVDWYQKQDQWEAGSDDRLF

SEQ ID NO: 215583 - protein, 140 aa, Glycine max
  Coding DNA Sequence Number=SeqID_98805
  Pfam annotation: Domain name=zf-CCHC; Domain location=77-94; Score =26.0; E_value=5.1e-05; Accession=PF00098.13; Description=Zinc knuckle
MELQRLNQNEETDKKKRSIALKASSSMQEENEEEESKDEEDFSLSVKKFQKFVKKRRIERLQNFNNGRISQENSQILRCYKCIQLGHIKANCPSNEEWPEKSDKKRYEERRTKKAYIAWDDNDSSDGSEKEINVLTKDYE

SEQ ID NO: 215584 - protein, 190 aa, Glycine max
  Coding DNA Sequence Number=SeqID_98806
  Gene Ontology: Mol. function=sequence-specific DNA binding; Cellular component=fimbrium; Biological process=cell adhesion
  Homolog annotation: Hit_ID=Q7N8F6; Match level="QueryCoverage=78%, HitCoverage=82%, E-value=8e-43, Identity=56%"; Hit description=MrfB protein
  Pfam annotation: Domain name=Fimbrial; Domain location=43-190; Score =63.7; E_value=6.1e-16; Accession=PF00419.10; Description=Fimbrial protein
MPGESPGQRNVAMFLPRNRAGAVLLASLAFAPGHATSAAQGWGKVNMHGAIIDTACAIAAGSRDQTIDMDTIPLGQIIRDGQGMTKPFSIELVNCILERPENKPDWKFFQVTFDGYAEGALFGVQGDARGVALEIKDSSGTAVIPGKPLPMEGIIPGNRVLNYSMTLMPNHQPLKVGAYFSTVRFKLDYF

SEQ ID NO: 215585 - protein, 327 aa, Glycine max
  Coding DNA Sequence Number=SeqID_98807
  Gene Ontology: Mol. function=protein serine/threonine kinase activity; Cellular component=cytoplasm; Biological process=protein amino acid phosphorylation
  Homolog annotation: Hit_ID=Q8LK24; Match level="QueryCoverage=88%, HitCoverage=66%, E-value=1e-152, Identity=92%"; Hit description=SOS2- like protein kinase
  Pfam annotation: Domain name=NAF; Domain location=168-228; Score =104.5; E_value=3.1e-28; Accession=PF03822.5; Description=NAF domain
  Pfam annotation: Domain name=Pkinase; Domain location=1-139; Score =21.7; E_value=7.4e-10; Accession=PF00069.15; Description=Protein kinase domain
  Pfam annotation: Domain name=Pkinase_Tyr; Domain location=1-139; Score=-165.6; E_value=0.026; Accession=PF07714.7; Description =Protein tyrosine kinase
  Pfam module annotation: Pfam domain module=NAF::Pkinase::Pkinase_Tyr; Domain location=168-228::1-139::1-139
RGVFHRDLKPENLLLDDDGNLKVTDFGLSTFSEHLRHDGLLHTTCGTPAYVAPEVIGKRGYDGAKADIWSCGVILYVLLAGFLPFQDENLVALYKKIYRGDFKCPPWFSSEARRLITKLLDPNPNTRITISKIMDSSWFKKPVPKNLVGKKREELNLEEKIKHQEQEVSTTMNAFHIISLSEGFDLSPLFEEKKREEKELRFATTRPASSVISRLEDLAKAVKFDVKKSETKVRLQGQENGRKGKLAIAADLYAVTPSFLVVEVKKDNGDTLEYNQFCSKELRPALKDIVKGGIVEKANAVVVNRNGHRGVVVDDSGTCAACCIARG

SEQ ID NO: 215586 - protein, 148 aa, Glycine max
  Coding DNA Sequence Number=SeqID_98808
  Gene Ontology: Mol. function=DNA binding
MAEMGKVDHQEERLKAIEGGKDYAFANLEELFLVPNIITPPKFKVLDFDKYKGTTCPKNHLKMYCWKMGAYATDEEMLIHFFQKSLTRVAVTWYTSLEPSQVHSWNDLMVAFIRIRPKVERPGSPSGTPNDKKGDDNNDSRHINNVLL

SEQ ID NO: 215587 - protein, 41 aa, Glycine max
  Coding DNA Sequence Number=SeqID_98809
MKIMLVATTVIMATITMVVTVVLVETIKREFYQREERSILR

SEQ ID NO: 215588 - protein, 164 aa, Glycine max
  Coding DNA Sequence Number=SeqID_98810
  Gene Ontology: Mol. function=oxidoreductase activity; Cellular component=vacuole; Biological process=response to oxidative stress
  Homolog annotation: Hit_ID=Q43854; Match level="QueryCoverage=76%, HitCoverage=35%, E-value=9e-59, Identity=87%"; Hit description =Peroxidase precursor
  Pfam annotation: Domain name=peroxidase; Domain location=56-164; Score=7.0; E_value=3.7e-09; Accession=PF00141.13; Description =Peroxidase
MASISCMSAILSFLLISIFLSVYNIEVCEAQARPPTAKGLSYTFYDKSCPKLKSIVRSELKKVFNKDIAQAAGLLRLHFHDCFVQGCDGSVLLDGSASGPGEKEAPPNLTLRPEAFKIIENLRGLLEKSCGRVVSCSDITALTARDAVFLVSTIIWIIAYEMPV

SEQ ID NO: 215589 - protein, 128 aa, Glycine max
  Coding DNA Sequence Number=SeqID_98811
  Gene Ontology: Mol. function=oxidoreductase activity; Cellular component=vacuole; Biological process=response to oxidative stress
  Homolog annotation: Hit_ID=Q43854; Match level="QueryCoverage=65%, HitCoverage=23%, E-value=9e-33, Identity=82%"; Hit description =Peroxidase precursor
MVPYHKKKPSAGNKKQGLINYSSSPQHIYTTNIHYHACIDPVTLHFYQSFHHIFHHRSQEGLVIGISNGAIGTNLPLFPGEHIKLTHLEHSEHKLLKEEVLVDGKVGDNALSPFISVQVLVGGEEALA

SEQ ID NO: 215590 - protein, 129 aa, Glycine max
  Coding DNA Sequence Number=SeqID_98812
  Homolog annotation: Hit_ID=O64580; Match level="QueryCoverage=53%, HitCoverage=58%, E-value=3e-08, Identity=48%"; Hit description =Expressed protein
MTLMILKAQKGTIQHHTWGATTQDHDVDRSKRRFSFSNLVDLVMEKSKSFPEYSCSYTEFGFSERSNSYNFNGPNQKGNGFSASSDPELKRKKRIKAYNVLTVEGKLKTSVRNSFKWIKNKFSDIRYGV

SEQ ID NO: 215591 - protein, 250 aa, Glycine max
  Coding DNA Sequence Number=SeqID_98813
  Gene Ontology: Mol. function=metalloendopeptidase activity; Cellular component=prefoldin complex; Biological process=cell wall catabolic process
  Homolog annotation: Hit_ID=Q2AHN3; Match level="QueryCoverage=85%, HitCoverage=85%, E-value=2e-36, Identity=38%"; Hit description =Peptidoglycan-binding LysM:Peptidase M23B precursor
  Pfam annotation: Domain name=LysM; Domain location=23-66; Score=57.3; E_value=5.1e-14; Accession=PF01476.10; Description=LysM domain
  Pfam annotation: Domain name=Peptidase_M23; Domain location=153-232; Score=108.8; E_value=1.6e-29; Accession=PF01551.12; Description =Peptidase family M23
  Pfam module annotation: Pfam domain module=LysM::Peptidase_M23; Domain location=23-66::153-232
MRKILALALISIVATIFPFYINYQVQKGDTLYSISKGFGIPIPILLDWNTGLAPSNLRAGSSIKVPVVPGIMFKSTKSISLSELAKYFFIDPEEIVTVNPSIGSTIPANKEVFVPLGKTNTSFAQISDFIWSVYGRITSEFGWRIHPIYGKNLFHTGVDISVPTGWMSGYGNLIIIDHGSFETYYAHLSKINVYVGLQVEKGDFIARSGSTGTSTGPHLHFEVRKYGEANDPVAYLPRTTTYVMRRVISE

SEQ ID NO: 215592 - protein, 65 aa, Glycine max
  Coding DNA Sequence Number=SeqID_98814
VNSRGDGGASVARCRPSSGCYGVSPCACLGTQYFLMKARLAGGLMPLPEARSLQTIDDIQNQLSE

SEQ ID NO: 215593 - protein, 131 aa, Glycine max
  Coding DNA Sequence Number=SeqID_98815
MVENVSWFDRLIVKVITGHNPGTSTWVVVIENKRGYISCGLILVEGTFTRLFKENKGGYIPCGSLLVKDFTRLKRNLKDSRSLGDWMLAVGVSLSEACALSENHALSEALSPLSKLGESGGESEKHLRTQR

SEQ ID NO: 215594 - protein, 82 aa, Glycine max
  Coding DNA Sequence Number=SeqID_98816
MNKITNSLGLARLTRLAQAYSANRVEWLSERTCLATKEDKKTRRVCPKQTNSLSAACRLSEFIPTENKNWKFKYSLSPSVVA

SEQ ID NO: 215595 - protein, 94 aa, Glycine max
  Coding DNA Sequence Number=SeqID_98817
YGPLSVHGVPVTPNKVIRPPINRDFIKKYCAPRQAQGEAPRQPGDGYQLAADAPPPPLESTSAHLQRLEHCLRYMADQQAPNHRDRYEQVAKML

SEQ ID NO: 215596 - protein, 76 aa, Glycine max
  Coding DNA Sequence Number=SeqID_98818
  Subcellular localization annotation: CTP_CleavageSite=69; ConfidenceScore=5.07e-01
MTSPATGTIPGGGIIPTLDGRILHNSNNSLIFKMLLAQADHTFLHQSSSNNSNSPRNRKQQPSLEELVRQMTMQNM

SEQ ID NO: 215597 - protein, 81 aa, Glycine max
  Coding DNA Sequence Number=SeqID_98819
MDKVDIFVPHPLTNACLLIQLSPECGCKPLVCLLKRPALLSVDFQDCSIRDYSSCTLVGRSELSRIGCWANGLSYLKKKGG

SEQ ID NO: 215598 - protein, 133 aa, Glycine max
  Coding DNA Sequence Number=SeqID_98820
MASDSTGTSTSHGAKRKAVMIDVIDTQFDKLNTGLDKMAEAIGSGSVYAKKLSNAAKKQKRNELLRRTNAFQYSEGDIWELSEGVGFTYQPLKEQCFDYLCNNQSQTRRLFGMPSHLQYNHLIKLMRDAGLIA

SEQ ID NO: 215599 - protein, 105 aa, Glycine max
  Coding DNA Sequence Number=SeqID_98821
INLALVKEFYANLYSSKGPSPKKARVRGHLVKIDADSLNIFLETPVVLAEGFILNVEGHPGRILRKDLTTLAKDPTTPVLTMDTSPPDTPVLHLTDEEDVQTQDT

SEQ ID NO: 215600 - protein, 288 aa, Glycine max
  Coding DNA Sequence Number=SeqID_98822
  Gene Ontology: Mol. function=transcription factor activity; Cellular component=nucleus; Biological process=regulation of transcription, DNA-dependent
  Homolog annotation: Hit_ID=Q2VEU3; Match level="QueryCoverage=33%, HitCoverage=46%, E-value=4e-31, Identity=67%"; Hit description =Dehydration-responsive element binding protein 3
  Pfam annotation: Domain name=AP2; Domain location=37-101; Score =111.0; E_value=3.5e-30; Accession=PF00847.10; Description=AP2 domain
  Subcellular localization annotation: CTP_CleavageSite=31; ConfidenceScore=5.04e-01
MDMENNNHAMAAGASSDSNTTTDHPTPKSSSCVNDNNKLYKGVRKRKWGKWVSEIRLPNSRERIWLGSYDSPEKAARAFDAALYCLRGRHANFNFPNTPCNMDTTNAPHQSLTPQEIQEVAANFANQAPLLQKPQEPLEYKCEMKVTQQKTPQLSGGGGNSSSFGSKSSCKSDSKQDSTGTSTNTTCTPTTTASSCSTTMYECDGTVQVDHGDMDWTFLNVFDYSNEVFPVVGSDYDLHNSELHKMHSGSGELLYSTPFDQGYEQLIEADHDDDDPFSHQSFLWNWNF

SEQ ID NO: 215601 - protein, 196 aa, Glycine max
  Coding DNA Sequence Number=SeqID_98823
MTQELIRGDTLRLSAPFARQTQLCPMASRDQVWSFCTQDTRRYLTVICTPLLGRHSCVRWQAETKFGHSAPKIRGDTLRLSAPPLLGRHSCVRWQAETKFGHSAPKIRGDTLRYAEIPYGYLHPFARQTQLCPMASRDQVWSFCTQDTRRYLTVIRTLLSSRGGGPDDKQRPSLVILHPRYAEIPYGYSHPFSCYL

SEQ ID NO: 215602 - protein, 57 aa, Glycine max
  Coding DNA Sequence Number=SeqID_98824
MKQVPRRFAPNVMEADKSEIERLKDEVEFRWEKEHQEPFDDMKRYLANPLILVPRVK

SEQ ID NO: 215603 - protein, 39 aa, Glycine max
  Coding DNA Sequence Number=SeqID_98825
MIAEAAITSTNSGMASWKLGVLPEESKESAQRALQDEAQ

SEQ ID NO: 215604 - protein, 329 aa, Glycine max
  Coding DNA Sequence Number=SeqID_98826
  Gene Ontology: Mol. function=hydrolase activity; Cellular component =nucleus; Biological process=metabolic process
  Homolog annotation: Hit_ID=Q0ZPW1; Match level="QueryCoverage=96%, HitCoverage=95%, E-value=8e-88, Identity=52%"; Hit description=CXE carboxylesterase
  Pfam annotation: Domain name=Abhydrolase_3; Domain location=85-305; Score=239.6; E_value=6.6e-69; Accession=PF07859.3; Description =alphabeta hydrolase fold
MAFPPHVVEDCMGLLTLLSDGTVLRSNINFQEQPQPTQHDNLVQFKDFLFHKKFNLHLRLYKPKFDDNINNDDDKNNNNKSLPVVMFLHGGGFCFGSRVWPHIHSCCVRLATSLHAAVVTPDYRLAPEHRLPAAVDDGVEALRWLQRQGHHGGDEWVTRGVDFDRAFILGDSSGGNIAHHLAVQLGPGSREMDPVRVRGYVLLGPFFSGVVRTRSEVGPPEQMLTLELLDRLSIPIGETRDHPLANPFGANSPNLGHVKLDPILVIVGGNELLKDRAVDYATRLKELGKNIEYIEFKGKEHGFLTHDSHSEAAEEVVQIIKRFMLENSH

SEQ ID NO: 215605 - protein, 173 aa, Glycine max
  Coding DNA Sequence Number=SeqID_98827
  Gene Ontology: Mol. function=DNA binding; Cellular component=nucleus; Biological process=regulation of transcription
  Homolog annotation: Hit_ID=Q1SZA2; Match level="QueryCoverage=51%, HitCoverage=27%, E-value=4e-39, Identity=78%"; Hit description=No apical meristem (NAM) protein
  Pfam annotation: Domain name=NAM; Domain location=2-111; Score=118.3; E_value=2.2e-32; Accession=PF02365.6; Description=No apical meristem (NAM) protein
MVYSLLKQHQNLQPPVAISKSMVFINKDIRAYQSREDEWYFFTPRDKKYPNGVRPNKAAASGYWKAIGTDKPIFTSCGMKSITVKKALVFYKGRPPKGSKTDWIMHEYRLHDSTISNSKQEGDLQRRYNIDKKNYFQQPYNKESRSVPSMEKNKARTRTFNGEQQSTKNNLRW

SEQ ID NO: 215606 - protein, 58 aa, Glycine max
  Coding DNA Sequence Number=SeqID_98828
MEGFTMVTARMVPERGVVGDCKGRRAIEKEGKKIIYDLMWTLSWLCGCLRIVERRTTS

SEQ ID NO: 215607 - protein, 166 aa, Glycine max
  Coding DNA Sequence Number=SeqID_98829
  Gene Ontology: Mol. function=sequence-specific DNA binding; Cellular component=nucleus; Biological process=regulation of transcription, DNA-dependent
  Homolog annotation: Hit_ID=Q9M7S0; Match level="QueryCoverage=77%, HitCoverage=16%, E-value=9e-68, Identity=92%"; Hit description =Homeodomain protein
  Pfam annotation: Domain name=POX; Domain location=1-64; Score=59.1; E_ value=1.5e-14; Accession=PF07526.2; Description=Associated with HOX
MNSSNYNDTNMHVDRRYSHYCEQMHMVVNAFDMVMGFGAAVPYTALAQKAMSRHFRCLKDAITAQLKHSCEVLGEKDGAGNSGLTKGETPRLKMLEQSLRQQRAFHQMGMMEQEAWRPQRGLPERSVNILRAWLFEHFLHPFRTYESGKRQLMIARLWKERDSETQ

SEQ ID NO: 215608 - protein, 213 aa, Glycine max
  Coding DNA Sequence Number=SeqID_98830
  Gene Ontology: Mol. function=sequence-specific DNA binding; Cellular component=nucleus; Biological process=regulation of transcription, DNA-dependent
  Homolog annotation: Hit_ID=Q9M7S0; Match level="QueryCoverage=73%, HitCoverage=17%, E-value=3e-31, Identity=50%"; Hit description =Homeodomain protein
MGIATPSSSLPSILSHSKTHQQQIHHSNSMSQDYHHHHHQGIFSFPNGFERSAATTMTHQDPHHHHHHHHQQQQIRRDKVRVQGFEPPPQQTLLPIEEDESGSLPVYETAGMLSEMFNFPPGAAELLEQQQQQQQQQPMAMTTTFRASPSARAVGSGGSEWYGNRQGMLSGLGPLGDSKNHHHHHGSVNSRDSSSSSIVQNQHHHHHNHQHHQ

SEQ ID NO: 215609 - protein, 54 aa, Glycine max
  Coding DNA Sequence Number=SeqID_98831
  Gene Ontology: Mol. function=lyase activity
  Homolog annotation: Hit_ID=Q1SGJ9; Match level="QueryCoverage=69%, HitCoverage=10%, E-value=1e-12, Identity=81%"; Hit description =Pectolytic enzyme, Pectin lyase fold
MDLGFIIVNLKLLEWGQNKVMFLGHDDGYARDKDIKVTVVHNYFGPNCHQCMPR

SEQ ID NO: 215610 - protein, 169 aa, Glycine max
  Coding DNA Sequence Number=SeqID_98832
MVERYKKGMWWRESYQVVQSLYLKGGRRWGGFFERQILYAFSPLQTTRCTDKRYGFVGGEVWRFFMLEGELKETLVGELNAISPKFWGVMGGAGSRNVPFAGERGRGSRVRFPKEERCMESPPTFICGKRWEKRRKPVKMKILSSGVVFTLEEGINTSYVCLEGQQPIF

SEQ ID NO: 215611 - protein, 377 aa, Glycine max
  Coding DNA Sequence Number=SeqID_98833
  Gene Ontology: Mol. function=nucleic acid binding; Biological process= DNA integration
  Homolog annotation: Hit_ID=Q1SEJ7; Match level="QueryCoverage=68%, HitCoverage=22%, E-value=8e-71, Identity=50%"; Hit description =Integrase, catalytic region; Zinc finger, CCHC-type; Peptidase aspartic, catalytic
  Pfam annotation: Domain name=zf-CCHC; Domain location=250-267; Score =17.8; E_value=0.0012; Accession=PF00098.13; Description=Zinc knuckle
  Subcellular localization annotation: CTP_CleavageSite=52; ConfidenceScore=5.07e-01
MGVLDYDMKGVVLCLKGGPQLGRVKGSRSAGKGGHSHVGFVVQRGSVVFAICREKGATPSKVALGLVFSLLLVPVFGGLLFWFVLVGFVVVVSGKRLLDHLDGSSICSPEGRSCIAKDMWAYLKRIYNQNNAAKRSQLELDIANYEQGLMSIQDYYSGFLNLWAEHSAILHANVPKESLPAIHKIYEVSKHDQFLMKLRLEFEVSCPTLLNRSPVPSLDVCVGELLRQEQCLLTQVVLLMRFLLHIRLKKYCNYCKQRGHIITKCPSGPAQCLMHAFHATVGSAGSTSQPTRLVGSHILTLEKVQQIVLSALSTLGIQGKPTGTSTTWLVDSGASNHMTGSLDHLYNAHAYDGTQNIHIVHGNTTSIFVVRDINSIL

SEQ ID NO: 215612 - protein, 169 aa, Glycine max
  Coding DNA Sequence Number=SeqID_98834
  Gene Ontology: Mol. function=nucleic acid binding; Biological process= DNA integration
  Homolog annotation: Hit_ID=Q1SEJ7; Match level="QueryCoverage=81%, HitCoverage=27%, E-value=3e-21, Identity=54%"; Hit description =Integrase, catalytic region; Zinc finger, CCHC-type; Peptidase aspartic, catalytic
MDVKNAFLHGDLVEDIYMTPPPGLFSSYVDIGIVLLIYVDDMIITGSDHATIQRLKQQLQASFNMKDLGFLKHLLGLEVYTNSRVEIGFPQITTTPLYDDNTSAIQIVTNPIFHERTKHIEVDCHSIQEALDTHLADILTKVIPLPQHQFLSNKLMVLDQPHQFEGRCQ

SEQ ID NO: 215613 - protein, 72 aa, Glycine max
  Coding DNA Sequence Number=SeqID_98835
  Homolog annotation: Hit_ID=Q1SQK2; Match level="QueryCoverage=53%, HitCoverage=5%, E-value=1e-07, Identity=64%"; Hit description =Translation initiation factor eIF-3b
MANVMVMKEIEDTALRLGVDLSTLDLDAIRIPPDEDCSIVRYQLLRPFQVLEAKFAKEKTHGYKLDRAHILP

SEQ ID NO: 215614 - protein, 76 aa, Glycine max
  Coding DNA Sequence Number=SeqID_98836
MPLFWEAWVEKVVETPYMTPTTSPLFFTPQFTTPISPYNQCGFNPLFETSTDAEFNRLKSSPPPNIQVLTRSRREA

SEQ ID NO: 215615 - protein, 73 aa, Glycine max
  Coding DNA Sequence Number=SeqID_98837
MRQSQWQCRFWQTRWRFVVVGIHGSGAPWWKGSFLHSDLDLESKDKDKGSQMAATVKPHKERECEICSFGGKI

SEQ ID NO: 215616 - protein, 36 aa, Glycine max
  Coding DNA Sequence Number=SeqID_98838
MDYNVACSGLGSSQQDNKGSLIFLEFLEKVFEQNTF

SEQ ID NO: 215617 - protein, 142 aa, Glycine max
  Coding DNA Sequence Number=SeqID_98839
MPEEKGPCLRISGRFDRSIFTSQEAYDRYSDIVIGRKILHERNVMIYHTEFDEFKKWNWHKELTNFMDGSIDVAILKEFYANFYFPKDKSPKQARVKGHLIKFDEDALNTFLKMIVIIEERESLPAYSRFCRLRPNPQELAA

SEQ ID NO: 215618 - protein, 57 aa, Glycine max
  Coding DNA Sequence Number=SeqID_98840
MKFRSCEKVAKFSIAKSSSWAKRISIIKSEISALSAAGAFSQGKLETSAKPNFTYSR

SEQ ID NO: 215619 - protein, 213 aa, Glycine max
  Coding DNA Sequence Number=SeqID_98841
  Gene Ontology: Mol. function=RNA-directed DNA polymerase activity; Biological process=RNA-dependent DNA replication
MRLWRKQKGGRSVSYSRCILIKRMTGCLGSFYFICCKGWVLMPSGLKVVCKKLIAIRRRFLWGEGGDQEHNKVVWVSWEDICSSKESDGLGVKILLCLMRHFWKNGGGNFSTKTKGLWVKRGLLGGGNSSRESFWWKDLKRVCGSLNGERWFDKDSEWKLDDGGKMKFWVDDWVNGQNLASLFHRLFLLSDNKYASVRHMGRWCNDVRLWEIT

SEQ ID NO: 215620 - protein, 291 aa, Glycine max
  Coding DNA Sequence Number=SeqID_98842
MGEVDEVQDRIKADLEAIKEKMATMMEAMMSMKKIMEVNATAIAATSAIAEVDLTPPSSLNQINHAISDMVGQTGKELGSTGGPHFVQVQNKNSFPPYDLAPNFAPPNVARTPDKNVNNFTPILIENQKPQSDHAFVPQHMGETHEIPHHNLADFKPHLKYALRFFHNHNPCFLWQEESLLLWQRREATELLKKGARVFQKVRPKVEGYGNSSSAPKRELITMIVDALSVSYYEKMVDYIPSRFGDLVFAGERIEVGLRRGKFDCLALTNKKPGANGEKENEEGTHVEGWF

SEQ ID NO: 215621 - protein, 464 aa, Glycine max
  Coding DNA Sequence Number=SeqID_98843
  Gene Ontology: Mol. function=protein kinase activity; Cellular component=integral to membrane; Biological process=protein amino acid phosphorylation
  Homolog annotation: Hit_ID=Q2R2M3; Match level="QueryCoverage=98%, HitCoverage=79%, E-value=4e-64, Identity=32%"; Hit description =Protein kinase domain containing protein, expressed
  Pfam annotation: Domain name=LysM; Domain location=11-56; Score=27.0; E_value=6.9e-05; Accession=PF01476.10; Description=LysM domain
  Pfam annotation: Domain name=Pkinase; Domain location=201-446; Score=- 39.2; E_value=3.2e-06; Accession=PF00069.15; Description=Protein kinase domain
  Pfam annotation: Domain name=Pkinase_Tyr; Domain location=235-446; Score=-55.8; E_value=4.8e-09; Accession=PF07714.7; Description =Protein tyrosine kinase
  Pfam module annotation: Pfam domain module=LysM::Pkinase::Pkinase _Tyr; Domain location=11-56::201-446::235-446
NNQYYQFNTSYEVERGDSYFVIANNTFEGLSTCQALQDQNNIPEGDLMPGNDLNVPLRCACPSKNQTEQGVKYLLSYPVASNDIVWLIGERFGVSIIHPFTTLLIPLHEEPSSNQTSEPSPPPPPSSSSSSSGSSSKTWVHAVVGVVGGIALISLVLCAIIFRRLYLKVNKKKDDSVIVSDSFVAVAIEKPQEKKLEEESENLAEIISGIGQSFKVYRYKELRSATNGFSPTCCIKGSVYRGFINGDLAAIRKIDGDVSKEIELLTKVNRSNVIRLSGVCFNEGYWYLYYEYAANGNLSDWINIKGKFISWTQRIQIALDVATGLDYLHSFTSPPHRVHGSRVFGIYGLVSTKLDVYAFGVLMLEMLNGKDVADVYAEGNIVNLVDVLSAMLDEEGEDLRLSESIDPSLQGNYPMELAVFVSRMIRTCIKKDPANRPDMHEIVSSLSKALDSSLRWETSMERKF

SEQ ID NO: 215622 - protein, 540 aa, Glycine max
  Coding DNA Sequence Number=SeqID_98844
  Gene Ontology: Mol. function=zinc ion binding
  Homolog annotation: Hit_ID=Q5SMM0; Match level="QueryCoverage=99%, HitCoverage=100%, E-value=0.0, Identity=58%"; Hit description=LIM domain containing protein-like
  Pfam annotation: Domain name=LIM; Domain location=168-225; Score =25.9; E_value=5.1e-06; Accession=PF00412.12; Description=LIM domain
  Pfam annotation: Domain name=UIM; Domain location=126-143; Score =11.8; E_value=0.73; Accession=PF02809.10; Description=Ubiquitin interaction motif
  Pfam annotation: Domain name=UIM; Domain location=42-59; Score=16.7; E_value=0.081; Accession=PF02809.10; Description=Ubiquitin interaction motif
  Pfam module annotation: Pfam domain module=LIM::UIM::UIM; Domain location=168-225::126-143::42-59
MGWFTKLLKGSNRKSSGGRYHGKYEDDRISENHDCSADDLMDIEKEEIDRAIALSLSEADQKGKKYLKRPYVLPHKTPEDDSESEDDELCPLSDEEAECVEVQQDEDDHHAKIQQDEDKHLDEVQLEEDEQLARAIQESLSISSPPRSDSDSLFQPFAHLFPPVYRICAGCNSEIGHGRFLSCMGGYWHPECFCCHACKLPITDYEFSMSGNRRYHKSCYKELHHPRCDVCKKFIPPNSAGLIEYRAHPFWRQKYCPSHEGDGTPRCCSCQRMESVDTKYLLLDDGRKLCLECLDSAIMDTHECQPLYVEIQEFYEGLHMKIEQQVPMLLVERQALNEAMEGEKNGHHHLPETRGLCLSEEQTIPTILRRPRIGAGYQLIDMITEPFRLVRRCEVTAILVLYGLPRLLTGSILAHEMMHAWLRLKGYGNLRPEVEEGICQVLAHMWLESEIIPGTGDEGASSSSSSSSSSSSSSPSSSSSSKKGKRSDFEKKLGKYFKHQIESDSSAAYGDGFREGNQAVAKYGLRRTLDHIRLTGSFPY

SEQ ID NO: 215623 - protein, 56 aa, Glycine max
  Coding DNA Sequence Number=SeqID_98845
MAVETRCGSDKVLRDEREQDKEGVQKGNKCRSQSMVFCGIWGRKRYLVKGIGDGEI

SEQ ID NO: 215624 - protein, 87 aa, Glycine max
  Coding DNA Sequence Number=SeqID_98846
MFFKSHFGNGHRSVYLILEPLCKLRETYHPKSWWLSFQKKKEREAWCLVCERVSQELQVNGPFSHFEHVELWNQGKGEFFQILGIYV

SEQ ID NO: 215625 - protein, 66 aa, Glycine max
  Coding DNA Sequence Number=SeqID_98847
MVGYMPSSFPDLKVVGERIEAGLRKGKFNYVASMNPSNGGLGRNDKRKNEGEPHVVAPVLAWPNFH

SEQ ID NO: 215626 - protein, 113 aa, Glycine max
  Coding DNA Sequence Number=SeqID_98848
MQSRRNHHGGWQAAPSTIGAGPNDARPPRGWRQHDDGDGPSTKGLRANGDGSAPTLPRDNDKWWWQHGQRHRLSDGQGGVTMEGDMGVIVGAKEMRYKQGVILNRLPVGGIHE

SEQ ID NO: 215627 - protein, 108 aa, Glycine max
  Coding DNA Sequence Number=SeqID_98849
MCAKKRIMSDIEQVQEQMKADMEAMKEQMTTMLEAMMSMRKMMEVNVATIVAASTTTGRDLIHLPDFNQEGRPILDVVGQGGKAAKNAYRPYYAQVQSKSSFSPYGLL

SEQ ID NO: 215628 - protein, 227 aa, Glycine max
  Coding DNA Sequence Number=SeqID_98850
MASRKRKAPSTPTQVRFDRSRFTSQEAWEKYTDIVVPHKLLPERNVVVYYTVFDEFKGELERCHWDEELTDFVDDNIDVAIVKEFYANLSDPEDISPKQDTLNTFLKTPVVVEEGETLCAYSRFALLRPDPQELAVKLCIPWRGFKLNADGYPLKILRKNMTTLAQTWSVLSFSNLIPTSYTSDVTLDRAKLIYGIIMKMDMNLGYLISHQISLIAQHDNPDLDIVP

SEQ ID NO: 215629 - protein, 68 aa, Glycine max
  Coding DNA Sequence Number=SeqID_98851
IPVRCYCLATVFKRREYGSEASVLTLGQNRLRQRSEVETRSKAETNQGTYGRTQGEARVMTNRSSSFA

SEQ ID NO: 215630 - protein, 241 aa, Glycine max
  Coding DNA Sequence Number=SeqID_98852
MTEIQHITTYFFSHFPEGHHEMQLREIFSKWGNVTKVFIAQKRNQRGSKYGFLRFKGVHNAKSQSTGRRTGIVGVRTWQECNRIRKWMLEKEKPIGIGVLEGKKWEPDVVPRHIYMWERIRGFPLHICNEVCFEGIFAKLSNLVKVDDETSSLSILEFARLLDLKDEDSLAVRMDGMDDNFLASDWEEKDRDSTTEDDTNRFYTRCVDKGTNSMVDKDKVAFCQGNHEKVNLEISDRPTIG

SEQ ID NO: 215631 - protein, 326 aa, Glycine max
  Coding DNA Sequence Number=SeqID_98853
MATMLPRSQRVEFFLTRLHMQREILNFPPLRSMPRVGILGEKAIIGGEVGLGFDRGVLLVHSNVEKEFGQSNGPGTGMAVRGNWCRSANQSNPNKGKGCRATTKANQLGYLMVEVAMQDRWEGWQLRKDGLSEVAAFEEGCSRGTGERMSSHLDRKCGKKIGQLRDMSLSVGKVHHGPNAVMENKFMELKKRDKKLYLKREKGICVLLSVGDSNYGWETSPATNLARGLLCIMGIKRKWKDEAFCRVIINVYSQYCIEGKRTLLNLLRQERGRLMNDLWCVTKDFNVVRPDVGGAIGSKKNFTWLRSGLASLIGSFSPCLGWILCQ

SEQ ID NO: 215632 - protein, 322 aa, Glycine max
  Coding DNA Sequence Number=SeqID_98854
  Gene Ontology: Mol. function=DNA binding; Cellular component=nucleus; Biological process=regulation of transcription
  Homolog annotation: Hit_ID=Q6H666; Match level="QueryCoverage=99%, HitCoverage=96%, E-value=7e-71, Identity=42%"; Hit description =Putative OsNAC7 protein
  Pfam annotation: Domain name=NAM; Domain location=1-124; Score=282.0; E_value=1.1e-81; Accession=PF02365.6; Description=No apical meristem (NAM) protein
FHPTDEELVDYYLRKKITSRRIDLDVIKDVDLYKIEPWDLQELCRIGAEEKNEWYFFSHKDKKYPTGTRTNRATAAGFWKATGRDKAIYSKHDLIGMRKTLVFYKGRAPNGQKSDWIMHEYRLETDDNGAPQAIFKKRLTTMRKLSEHDSPCWYDDQVSFMQDLDSPKQSSQPNFPYQQFQYPCKKELDFSYHLPLQLPLENQKLFQSAASNSMTPYGIEENPNAMQPASIMQQVQQQNFQVFGNNSNDQQVADWRALDKYVASQLSQEDASKDHNSYSNADNIFQVKNNSTIEQLRDLDKEEKMAENASTSTSSCPIDMWK

SEQ ID NO: 215633 - protein, 343 aa, Glycine max
  Coding DNA Sequence Number=SeqID_98855
  Gene Ontology: Mol. function=RNA-directed DNA polymerase activity; Biological process=RNA-dependent DNA replication
  Homolog annotation: Hit_ID=Q1S7B8; Match level="QueryCoverage=80%, HitCoverage=48%, E-value=2e-21, Identity=25%"; Hit description=RNA -directed DNA polymerase
MKVMCDFHTHGLFPRGSNASFLMLIPKKDIIQDFGDYRPISLIGYLYKIVAKWKRLNRAFARGRSMIDSMVIANEVIHEAKRTKTPTFVFKEEFKKAYNTERWDFLYWMLGNATDQFQVHKGLWGVKLGRKGLHITIRQFFDDTLVFLQPTLESVMMLKGVLRCNPTVCQSSDLYDCRVTVHLSWCTNRDALWVKVLSVMCGELRGSLIDEQHLKGSLWWRDVTKVTLASSVDNWIVGWGLMEMAPNIEKILSITPSREGVDPWLWRGGVEEGYSAQVLLDRYLARDTLVYMAASKCNRVSWEAGKCIGGTPTPTRIWEGVDCIVGFFAFSGIEDFGWMLMML

SEQ ID NO: 215634 - protein, 85 aa, Glycine max
  Coding DNA Sequence Number=SeqID_98856
MRPSTLITTIGALRYLNQNEQHYTTLCYPLFYFWKLCQNCSGHKYWNIALQVRSGRHGAIHITIDIKHSKVYKVSTTYLNQNETL

SEQ ID NO: 215635 - protein, 157 aa, Glycine max
  Coding DNA Sequence Number=SeqID_98857
MDWIVVGDGKIDDGYSDGPVAYRPGVWRGPQPKASTSTAKPTPLGGVQEWDLIRSSSTKMAEHCGGHRNMMERIATPMPEAWWSTISNQGDLVYRSEGLQVSCGVWREKLAGGDGGGLGDGRAEVKEARRSKTDSSLRLRLYESEYSFKKLTGGTCS

SEQ ID NO: 215636 - protein, 127 aa, Glycine max
  Coding DNA Sequence Number=SeqID_98858
MALWWWGWNWVKGVCGGIWGSQGNRDLGILVLAVHDATITGNGSIGVACRPRNLAMRICTKLCVLPPSTRIVSLWWWTVPYTRNVSGAGMPDIAFRLRWGRGSSDGKREEGAREGVGALRGPSEWEK

SEQ ID NO: 215637 - protein, 72 aa, Glycine max
  Coding DNA Sequence Number=SeqID_98859
IDSKGTRLPPSSASLTSLAGRLMTCRWWRCVYCPLPAILMLLWCLALRLPGGAVPLDESSISRGPDALAGGD

SEQ ID NO: 215638 - protein, 144 aa, Glycine max
  Coding DNA Sequence Number=SeqID_98860
  Gene Ontology: Mol. function=protein binding; Cellular component =membrane; Biological process=defense response
  Homolog annotation: Hit_ID=Q1SW22; Match level="QueryCoverage=80%, HitCoverage=12%, E-value=5e-25, Identity=51%"; Hit description =Disease resistance protein; AAA ATPase
MDPLFIDEDDVVGLDGPRDTLKNWLTKGREKRTVISVVGIPGVGKTTLAKQVYDQVRNNFECHALITVSQSYSAEGLLRRLLDELCKVKKEDPPKDVSNMESLTEEVRNRLRNKRHFSIVPMEIVQKNLKIYLFTLLESVKVYL

SEQ ID NO: 215639 - protein, 1040 aa, Glycine max
  Coding DNA Sequence Number=SeqID_98861
  Gene Ontology: Mol. function=protein serine/threonine kinase activity; Cellular component=integral to membrane; Biological process=protein amino acid phosphorylation
  Homolog annotation: Hit_ID=Q9SHI2; Match level="QueryCoverage=97%, HitCoverage=89%, E-value=0.0, Identity=64%"; Hit description=Similar to leucine-rich receptor-like protein kinase
  Pfam annotation: Domain name=LRRNT_2; Domain location=30-70; Score =53.5; E_value=7.1e-13; Accession=PF08263.3; Description=Leucine rich repeat N-terminal domain
  Pfam annotation: Domain name=LRR_1; Domain location=121-143; Score =1.9; E_value=1.2e+02; Accession=PF00560.23; Description=Leucine Rich Repeat
  Pfam annotation: Domain name=LRR_1; Domain location=145-167; Score =8.1; E_value=8.7; Accession=PF00560.23; Description=Leucine Rich Repeat
  Pfam annotation: Domain name=LRR_1; Domain location=169-191; Score =16.4; E_value=0.1; Accession=PF00560.23; Description=Leucine Rich Repeat
  Pfam annotation: Domain name=LRR_1; Domain location=217-239; Score =14.5; E_value=0.38; Accession=PF00560.23; Description=Leucine Rich Repeat
  Pfam annotation: Domain name=LRR_1; Domain location=241-263; Score =9.3; E_value=5.2; Accession=PF00560.23; Description=Leucine Rich Repeat
  Pfam annotation: Domain name=LRR_1; Domain location=265-287; Score =10.8; E_value=2.7; Accession=PF00560.23; Description=Leucine Rich Repeat
  Pfam annotation: Domain name=LRR_1; Domain location=289-311; Score =10.6; E_value=2.9; Accession=PF00560.23; Description=Leucine Rich Repeat
  Pfam annotation: Domain name=LRR_1; Domain location=313-335; Score =8.1; E_value=8.7; Accession=PF00560.23; Description=Leucine Rich Repeat
  Pfam annotation: Domain name=LRR_1; Domain location=337-359; Score =11.9; E_value=1.7; Accession=PF00560.23; Description=Leucine Rich Repeat
  Pfam annotation: Domain name=LRR_1; Domain location=361-383; Score =15.7; E_value=0.17; Accession=PF00560.23; Description=Leucine Rich Repeat
  Pfam annotation: Domain name=LRR_1; Domain location=385-407; Score =6.7; E_value=16; Accession=PF00560.23; Description=Leucine Rich Repeat
  Pfam annotation: Domain name=LRR_1; Domain location=409-428; Score =12.6; E_value=1.2; Accession=PF00560.23; Description=Leucine Rich Repeat
  Pfam annotation: Domain name=LRR_1; Domain location=433-455; Score =11.6; E_value=1.9; Accession=PF00560.23; Description=Leucine Rich Repeat
  Pfam annotation: Domain name=LRR_1; Domain location=457-479; Score =11.7; E_value=1.8; Accession=PF00560.23; Description=Leucine Rich Repeat
  Pfam annotation: Domain name=LRR_1; Domain location=481-503; Score =11.6; E_value=1.9; Accession=PF00560.23; Description=Leucine Rich Repeat
  Pfam annotation: Domain name=LRR_1; Domain location=505-527; Score =12.8; E_value=1.1; Accession=PF00560.23; Description=Leucine Rich Repeat
  Pfam annotation: Domain name=LRR_1; Domain location=529-551; Score =11.5; E_value=2; Accession=PF00560.23; Description=Leucine Rich Repeat
  Pfam annotation: Domain name=LRR_1; Domain location=553-575; Score =17.6; E_value=0.046; Accession=PF00560.23; Description=Leucine Rich Repeat
  Pfam annotation: Domain name=LRR_1; Domain location=577-599; Score =16.4; E_value=0.1; Accession=PF00560.23; Description=Leucine Rich Repeat
  Pfam annotation: Domain name=LRR_1; Domain location=601-623; Score =13.6; E_value=0.74; Accession=PF00560.23; Description=Leucine Rich Repeat
  Pfam annotation: Domain name=LRR_1; Domain location=626-648; Score =1.3; E_value=1.6e+02; Accession=PF00560.23; Description=Leucine Rich Repeat
  Pfam annotation: Domain name=LRR_1; Domain location=650-672; Score =15.7; E_value=0.17; Accession=PF00560.23; Description=Leucine Rich Repeat
  Pfam annotation: Domain name=LRR_1; Domain location=73-95; Score=0.5; E_value=2.3e+02; Accession=PF00560.23; Description=Leucine Rich Repeat
  Pfam annotation: Domain name=LRR_1; Domain location=97-119; Score =14.7; E_value=0.33; Accession=PF00560.23; Description=Leucine Rich Repeat
  Pfam annotation: Domain name=Pkinase; Domain location=806-1032; Score= 82.6; E_value=1.2e-21; Accession=PF00069.15; Description=Protein kinase domain
  Pfam annotation: Domain name=Pkinase_Tyr; Domain location=806-1024; Score=43.1; E_value=4.1e-15; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR_1::LRR_ 1::LRR_1::...
  Pfam module annotation: Pfam domain module=Pkinase::Pkinase_Tyr; Domain location=30-70::121-143::145-167::169-191::217-239::241 -263::265-287::289-311::313-335::337-359::361-383::385-407::409 -428::433-455::457-479::...
  Pfam module annotation: Domain location=481-503::505-527::529 -551::553-575::577-599::601-623::626-648::650-672::73-95::97-119::806- 1032::806-1024
MALECSSFHFLNGVYMVLFFCLGIVLVNSVNEEGLSLLRFKASLLDPNNNLYNWDSSDLTPCNWTGVYCTGSVVTSVKLYQLNLSGTLAPAICNLPKLLELNLSKNFISGPIPDGFVDCGGLEVLDLCTNRLHGPLLNPIWKITTLRKLYLCENYMYGEVPAELGNLVSLEELVIYSNNLTGRIPSSIGKLKQLKVIRSGLNALSGPIPAEISECQSLEILGLAQNQLEGSIPRELEKLQNLTNILLWQNYFSGEIPPEIGNISSLELLALHQNSLSGGVPKELGKLSQLKRLYMYTNMLNGTIPPELGNCTKAIEIDLSENHLIGTIPKELGMISNLSLLHLFENNLQGHIPRELGQLRVLRNLDLSLNNLTGTIPLEFQNLTYMEDLQLFDNQLEGVIPPHLGAIRNLTILDISANNLVGMIPINLCGYQKLQFLSLGSNRLFGNIPYSLKTCKSLVQLMLGDNLLTGSLPVELYELHNLTALELYQNQFSGIINPGIGQLRNLERLGLSANYFEGYLPPEIGNLTQLVTFNVSSNRFSGSIAHELGNCVRLQRLDLSRNHFTGMLPNQIGNLVNLELLKVSDNMLSGEIPGTLGNLIRLTDLELGGNQFSGSISLHLGKLGALQIALNLSHNKLSGLIPDSLGNLQMLESLYLNDNELVGEIPSSIGNLLSLVICNVSNNKLVGTVPDTTTFRKMDFTNFAGNNGLCRVGTNHCHPSLSPSHAAKHSWIRNGSSREKIVSIVSGVVGLVSLIFIVCICFAMRRGSRAAFVSLERQIETHVLDNYYFPKEGFTYQDLLEATGNFSEAAVLGRGACGTVYKAAMSDGEVIAVKKLNSRGEGANNVDRSFLAEISTLGKIRHRNIVKLYGFCYHEDSNLLLYEYMENGSLGEQLHSSVTTCALDWGSRYKVALGAAEGLCYLHYDCKPQIIHRDIKSNNILLDEMFQAHVGDFGLAKLIDFSYSKSMSAVAGSYGYIAPEYAYTMKVTEKCSFGVVLLELVTGRSPVQPLEQGGDLVTCVRRAIQASESPLDEDDGISSK

SEQ ID NO: 215640 - protein, 105 aa, Glycine max
  Coding DNA Sequence Number=SeqID_98862
ERLRSIGKASGGTIGILEDLQMCESTSSRSRYKLHVVVVTPTYIFPNDAPIALRSYLVSPQWFFFDMFHFEDSPCCCCCTMLKRHVKRIRPHVGDLHGVESTYMA

SEQ ID NO: 215641 - protein, 592 aa, Glycine max
  Coding DNA Sequence Number=SeqID_98863
  Gene Ontology: Mol. function=oxidoreductase activity; Cellular component=anchored to membrane; Biological process=lignin catabolic process
  Homolog annotation: Hit_ID=Q8VXX5; Match level="QueryCoverage=97%, HitCoverage=98%, E-value=0.0, Identity=66%"; Hit description =Monocopper oxidase-like protein SKS1 precursor
  Pfam annotation: Domain name=Cu-oxidase; Domain location=159-314; Score=214.6; E_value=2.2e-61; Accession=PF00394.12; Description =Multicopper oxidase
  Pfam annotation: Domain name=Cu-oxidase_2; Domain location=397-536; Score=136.6; E_value=6.9e-38; Accession=PF07731.4; Description =Multicopper oxidase
  Pfam annotation: Domain name=Cu-oxidase_3; Domain location=33-149; Score=192.3; E_value=1.1e-54; Accession=PF07732.5; Description =Multicopper oxidase
  Pfam module annotation: Pfam domain module=Cu-oxidase::Cu-oxidase _2::Cu-oxidase_3; Domain location=159-314::397-536::33-149
MKMVLSGFSVLLHIVLLSRLCFAGDPTVFTELRVSYTTVSPLGVPQQVIAINKKFPGPVINVTTNNHVIVNVYNELDEGLLLSWSGVQMRRNSWQDGVLGTNCPIPPNWNWTYQFQVKDQIGSFFYFPSLGFQRASGGFGPFVINNREIIQIPFARPDGEIFIMIGDWYTQNHTALRATLDGGKNLGIPDGVLINGKGPFQYNTTLVPGGINYETITVDPGKTYRIRVHNVGISTSLNFRIQNHNLLLVETEGHYTTQTNFTSFDIHAGQSYSFLLSTDQNASTDYYIVASARFVNESLWEKVTGVAILHYSNSKGPATGPLPPPPSDFYDKTASMNQARSVRQNTSASGARPNPQGSFHYGSINITDTYVFKVTSLVPINGTNRATINGISFLKPEVPFRLADKHQLRGTYKLDFPSKPMNRTPVIDRSMINATYKGFIEIILQNNDSSIQNFHLDGYSFFVVGMDYGDWSENSRGSYNKWDAISRCTTQVFPGGWTAILISLDNVGSWNMRAENLDRWYLGQETYLKIVNPEENGDTEMAAPDNVLYCGPLKSLQKTHSTFSAASTLGHSLDLFTVLLGLFAMIFLFLAR

SEQ ID NO: 215642 - protein, 139 aa, Glycine max
  Coding DNA Sequence Number=SeqID_98864
MVTTKCVVDMGKGNLEMKRLVLRWRKLSKKLTLLGGHLNSMLLEEDEAKPIVNLTDYSSIFLGPKQAKTRATPDIPPALPPTPLPRPIPTDGELPPFLPPIAGHDTRGILSQIAWPGVQLPFVRQDISDAHRAWDPGPT

SEQ ID NO: 215643 - protein, 262 aa, Glycine max
  Coding DNA Sequence Number=SeqID_98865
SRPKDADISRKGADDHIGLCVSSDLGSPNNESEDAHSSRKSADYHIGLYVSLDLGCPNDEVLITVRLGISEFCGADNRKVSMHASELLGYRIAKGRDADSCKVSLYATRLLGRWIANGETKWFRAKDADVFEKGADDHIGLCTSSDLGSRNDKATYNNNHIGLYVSSDLGSPNNVSQPEDADIFGKGADDHIGLYVSLDLGCPNDEAADDHIGLSVSSDLGSPNDEVRRKYSRPEAIDISRKRADDHIGLCVSSDSGSPNDE

SEQ ID NO: 215644 - protein, 128 aa, Glycine max
  Coding DNA Sequence Number=SeqID_98866
  Gene Ontology: Mol. function=DNA binding; Cellular component =mitochondrion; Biological process=DNA integration
  Homolog annotation: Hit_ID=Q1S326; Match level="QueryCoverage=59%, HitCoverage=21%, E-value=5e-17, Identity=54%"; Hit description =Putative receptor kinase-related
MARKRQKCDPGDNRESIPIIKVIYLSVAFGYQACLKVMNFTIQTNPSSIDPFTTNFLLSMGKINQLSCTIVFKSLDFNNHSMSQSRGQWMVKDMKQMDLHEILDWCFVSCPCIYVMEGDVDDSGGLLI

SEQ ID NO: 215645 - protein, 331 aa, Glycine max
  Coding DNA Sequence Number=SeqID_98867
  Gene Ontology: Mol. function=transition metal ion binding; Cellular component=nucleus; Biological process=proteolysis
  Homolog annotation: Hit_ID=Q852J6; Match level="QueryCoverage=84%, HitCoverage=51%, E-value=3e-39, Identity=29%"; Hit description =Putative TNP-like transposable element
VRHCINDMHVEKNVYDSVIEMLLNIQVKTKDGLNTHQDLAKMCICEQLHPMSDGYSSNIKNLVQLKDLKLVGLKFLDCHVLMQQLNVIDPVKLDELENEAAIILCQLEIIYVERYIAEEAIEFCLEYIEKAKPLGLLESRHDERMGGKGSRGLHVITPSLEELQHAHLYILNSSNGVMPYIVHLEALVKESNPRIGVSLSVESQHFATVHDDNPRLASIPYFGVIEEIWELNYVKFIVCVFKCKWVDSNIGVRTDNFGFTLVDLKKLAYRNEPFIMGKPIGVNVEDDDSTIDTCVSSFSTQMPPNINEEEEVDDVHANYNDHDEGELINNI

SEQ ID NO: 215646 - protein, 131 aa, Glycine max
  Coding DNA Sequence Number=SeqID_98868
  Gene Ontology: Mol. function=RNA-directed DNA polymerase activity; Biological process=DNA integration
MTKNGLKLFQYPRLRKGNYDNWCHRMKALLGSQDALEVMEKGLDESMFKIVSNASRSKEAWEILKISLEGVGKVKKVRLKTLCGVFESCMKEFESILDFGNRVIMVVNQMNRYGGEYGRYSCCREGPSFSN

SEQ ID NO: 215647 - protein, 175 aa, Glycine max
  Coding DNA Sequence Number=SeqID_98869
  Gene Ontology: Mol. function=nucleic acid binding; Biological process= DNA integration
MWTWPKKGMPHINHPNQLSKSCLFGKHARRSFPKEVESRAKVPLQLVHTDVCGPIDPSSFCKNKYLFLFIDDFNFGSIAYAHVPDQGRSKLDYKSVKQVFIGYDAISKGYKLYNPCNEKIIVNKDVKFDEEKIWNWEKEETYDLFPYFEENVEEVAAPNEFSTPPPLPTQFIHEA

SEQ ID NO: 215648 - protein, 64 aa, Glycine max
  Coding DNA Sequence Number=SeqID_98870
MTCTHSNVAYAQGYTDASFALDKDDNKSISRYVFTLNSGAVYGNENVAIPFTKALGIKEFDKHK

SEQ ID NO: 215649 - protein, 254 aa, Glycine max
  Coding DNA Sequence Number=SeqID_98871
  Homolog annotation: Hit_ID=Q1SJY6; Match level="QueryCoverage=54%, HitCoverage=17%, E-value=8e-07, Identity=21%"; Hit description =Glucoamylase s1/s2
MKLPFYPELVRAFYSNLEIQEDSLISEVYGIKMVIDQSLFFELTQLSSDGVPFEGTLDDDWKFNFSISDAHLLVCTNQVDMTGRLLVGSLAFECHIMHYLIVRILLPRSSNLGQVSEKDLIIMWVFLTSRQIDWAHLLFVKVKRSFYIGANVVSSFGYRKERDGSWVKKDAPTQATEDRSPSPPPQRDDSSSLMQSVLDKLDGLHTFVGEHFDSLDNRIDAIDARFAGMDTRITQLEEDMSNVRQCFDLPPPFS

SEQ ID NO: 215650 - protein, 325 aa, Glycine max
  Coding DNA Sequence Number=SeqID_98872
MGVEGGHGLLDMPFTMEVNHGGYLVCDPILKYARGDRTLLSHKDIDNWSFFEFFWIPKKDVKIKGDFKLWWKGDDVELKELALDSHTIEEGVCAGICEVEVMGKEVAVSSDGLFDVGNTKNSKEERTAADDDGFDEEEPFVNINLRKKGKAQAHSDIGSNGVNKHAKKGDHEISEGYESKELHICELEFDEEDIVDDVRFRSSIDISLVVAWKARMIARGIKDGDVIRQYTYLKTYGDELKHACEGNNYNLILRRPQGLLLHRFGSFYGLVQTQGAKGASEENRFSLRHLYQNFKKKLGRGTLLRDVTMGEAKATYVQAWDDKMA

SEQ ID NO: 215651 - protein, 91 aa, Glycine max
  Coding DNA Sequence Number=SeqID_98873
MMQSYPPRALDRRLQEDWAKDAREGPRVLMSLRRVSIAKHGFNALSVKKESGRAPEPKQRAKREISSLSESSVSCQAQRNIGTKPKSTYSR

SEQ ID NO: 215652 - protein, 92 aa, Glycine max
  Coding DNA Sequence Number=SeqID_98874
RAQLAQASQVASSRSNSLLEEYSGGPKTHGPNLEFLTRVEAYPWWVRALCLVPTCDCPPNRHPYVEYDYEVLRGLVAVLEPRQELCESRIEE

SEQ ID NO: 215653 - protein, 214 aa, Glycine max
  Coding DNA Sequence Number=SeqID_98875
MKTGTMMIRGLRRRPLESEKLPLRAAQDNRLPPKPPKLQQPSKSTTSKPLKIDISKGLDDFDKDVPVSSSFKATSAATPKQKVDKIVDLSSSQDPSQSDDNGATSIPEPIIEKNAIEVDSTLDDLLNIETEHNPLTVEEQVRIEAVIDTSAPMLVVETSRGGSGGGGRGVFRRGGGGTAAGTTHHHHGGSNNGTLCFYHFPLLFLSIAIGISLM

SEQ ID NO: 215654 - protein, 186 aa, Glycine max
  Coding DNA Sequence Number=SeqID_98876
  Homolog annotation: Hit_ID=Q1SFC5; Match level="QueryCoverage=63%, HitCoverage=17%, E-value=4e-10, Identity=29%"; Hit description =Asp/Glu racemase
  Pfam annotation: Domain name=DUF1723; Domain location=21-70; Score =26.1; E_value=0.00013; Accession=PF08330.1; Description=Protein of unknown function (DUF1723)
METFFNWLARVEAKKSQHWKNIDMPMLMALFLFCNRSLHALELPYGPVSLTLLDIVAIIGLKPLGKTYALGLFKDQIERAEIDIDFSDKSCGDFIEKNVRNTKQISNVEYIAFFMYWVSSHLSCTRSLQIPMYSYNLAQALHFGDNICLRKFFLASIYKFMEEAVEILDTPGKMKPIAGPLWIMCR

SEQ ID NO: 215655 - protein, 140 aa, Glycine max
  Coding DNA Sequence Number=SeqID_98877
MEIGMAIRHKFIGYFRSYLQGVGFIPIKWILISIDIYLKFCSYGYNRGIIVRNLTHTFIMYIVQLRVSPGAVIKLRLEKDGLESVYCVKSLVCYGFYYEVVYEDILGCIPSFCLLSLLQTERFGFAQDITQLDVSMEIQG

SEQ ID NO: 215656 - protein, 112 aa, Glycine max
  Coding DNA Sequence Number=SeqID_98878
  Gene Ontology: Mol. function=unfolded protein binding; Cellular component=mitochondrion; Biological process=protein folding
  Homolog annotation: Hit_ID=P37900; Match level="QueryCoverage=75%, HitCoverage=12%, E-value=2e-30, Identity=75%"; Hit description=Heat shock 70 kDa protein, mitochondrial precursor
MIPRSNTEDGGTPAKPQVVPNPPNTLLDTKWSIGKCFDDAQTQKEMKMVPFRIVKAPNGDAWVEANGQQYFPGHIGAFVLTKMKEIVEAYLGKVVEPGELSWNSLWDPKGLG

SEQ ID NO: 215657 - protein, 75 aa, Glycine max
  Coding DNA Sequence Number=SeqID_98879
MVIWAYCGEHKGHAYEKGVRDPCVETVVVLFSTSRCPHVVKGNNSGRQSGGRHTMIVYVDIDSDSTAATSDDVVE

SEQ ID NO: 215658 - protein, 223 aa, Glycine max
  Coding DNA Sequence Number=SeqID_98880
  Gene Ontology: Mol. function=nutrient reservoir activity; Cellular component=apoplast; Biological process=auxin mediated signaling pathway
  Homolog annotation: Hit_ID=Q84XR7; Match level="QueryCoverage=93%, HitCoverage=94%, E-value=6e-58, Identity=56%"; Hit description =Germin-like protein 1
  Pfam annotation: Domain name=Cupin_1; Domain location=81-215; Score =37.2; E_value=5.5e-08; Accession=PF00190.13; Description=Cupin
  Pfam annotation: Domain name=Cupin_2; Domain location=112-179; Score =8.2; E_value=0.041; Accession=PF07883.2; Description=Cupin domain
  Pfam module annotation: Pfam domain module=Cupin_1::Cupin_2; Domain location=81-215::112-179
MSKYSSTLKLLYLVILSAFAIVQVTMASDPDILIDYKLREWVIILSSFILLDVLLSSTAVLLSEYNNPDRKFFTFTGFHVLVGQNPSPSTFKVSKASMVEFPALNGQSVSYAVLQFPGGNVNPPHTHPRSSEVGFVDTTTNKLCTQSLQIGDVLVFPSGLAHFQHNVDAKNPALAISAFGSANAGTVSLPNTFFNTSIDDTVLALAFKTDVATIRNLKKGLAS

SEQ ID NO: 215659 - protein, 275 aa, Glycine max
  Coding DNA Sequence Number=SeqID_98881
  Gene Ontology: Mol. function=nutrient reservoir activity; Cellular component=apoplast; Biological process=auxin mediated signaling pathway
  Homolog annotation: Hit_ID=Q84XR7; Match level="QueryCoverage=65%, HitCoverage=87%, E-value=1e-73, Identity=76%"; Hit description =Germin-like protein 1
  Pfam annotation: Domain name=Cupin_1; Domain location=125-267; Score =94.7; E_value=2.8e-25; Accession=PF00190.13; Description=Cupin
  Pfam annotation: Domain name=Cupin_2; Domain location=155-231; Score =39.4; E_value=1.2e-08; Accession=PF07883.2; Description=Cupin domain
  Pfam module annotation: Pfam domain module=Cupin_1::Cupin_2; Domain location=125-267::155-231
MAFKWAVQVSLQIFLARATLVESSNGILNNKLLVTIGNKAGHYIPMVSCMYFVISNNLGYRPNGLQQRMSNSTTLKVVSVVISAFAIVQMALAGDPDILSDFIGPINGMIPDGNFFTYTGFRVLVGQNSPPSTFKVLKATMAEFPALNGQSVSYAVLQFPANTINPPHTHPRSAELLFVAQGSLQVGFVDTTNKLFTQSLQAGDMFVFPKGLVHFQHNADASKPALAISSFASANSGTVSLPNTLFNTSIDDTVLALSFKTNVATIQTLKKGFAP

SEQ ID NO: 215660 - protein, 141 aa, Glycine max
  Coding DNA Sequence Number=SeqID_98882
  Pfam annotation: Domain name=GRP; Domain location=6-118; Score=-24.8; E_value=0.026; Accession=PF07172.2; Description=Glycine rich protein family
MEHIWKHVMLVCIVLLFHHHLLPVTAEHQRNSSHTDKARTTAITSSTKIIVAVNRRGGGGGGHAGGSGGRGGFGGGHARSMGMFNSRGGGHASSMGMHGSTIPLYGAAVGGSAHQRNNNNNHHDVHPPSVKTGKFKDEKII

SEQ ID NO: 215661 - protein, 242 aa, Glycine max
  Coding DNA Sequence Number=SeqID_98883
  Gene Ontology: Mol. function=transporter activity; Cellular component= membrane; Biological process=oligopeptide transport
  Homolog annotation: Hit_ID=Q2HUR9; Match level="QueryCoverage=98%, HitCoverage=65%, E-value=2e-45, Identity=71%"; Hit description=TGF -beta receptor, type I/II extracellular region; Major facilitator superfamily MFS_1
MEEKINKEHQVCTSDGAIDSHGHPAVRKKTGDCVAAILILVNQGLATLAFFGVGVNLVLFLTRVMGQDNAEAANSVSKWTGTVYHFSLLGAFLSDSYWGRMMMDYGLCGSGLQLARSAALALILFLCGTRRYRYFKPNGNPLPRFCQVFVAATRKWKAKVLQDDKLYEVDEFSTNEGRKMFHTEGFRFLDKAAFITSKNFKQMEESKCSPWYLSIVTQQGDVMDTEFQGSTFLPQACPPLTF

SEQ ID NO: 215662 - protein, 110 aa, Glycine max
  Coding DNA Sequence Number=SeqID_98884
MEKKKKKKGFGLGCRASVHNALAKRRLGLRLTEIEVLVRVLRRVAVDLEISYETVLWHYRERENCGFAIPSPFCGEVSPMRCPTRLLLAFLLEVSRLHIFMPFCLEWREQ

SEQ ID NO: 215663 - protein, 70 aa, Glycine max
  Coding DNA Sequence Number=SeqID_98885
MEDKRTAITNNQARKKIHPLIRSLSIGGEGGIVGLVVFGGALAIAGFMEVASFASNKNKAKDTHDDHQQK

SEQ ID NO: 215664 - protein, 37 aa, Glycine max
  Coding DNA Sequence Number=SeqID_98886
MTNHQKSASNNLIRGANILVDPNGEIKLTDFGMAKHL

SEQ ID NO: 215665 - protein, 83 aa, Glycine max
  Coding DNA Sequence Number=SeqID_98887
  Subcellular localization annotation: CTP_CleavageSite=50; ConfidenceScore=5.18e-01
MEANTFLPPATKSQAKYSDDKEIKNGKTNTKWLSVPSQEASFGKASSFAGASMVSSSTAAALIILENLRGFEREKERCGVTQD

SEQ ID NO: 215666 - protein, 248 aa, Glycine max
  Coding DNA Sequence Number=SeqID_98888
  Gene Ontology: Mol. function=DNA binding; Cellular component=nucleus; Biological process=regulation of transcription
  Homolog annotation: Hit_ID=Q9SXQ0; Match level="QueryCoverage=75%, HitCoverage=81%, E-value=3e-65, Identity=65%"; Hit description=NAC -domain protein
  Pfam annotation: Domain name=NAM; Domain location=5-141; Score=160.7; E_value=3.7e-45; Accession=PF02365.6; Description=No apical meristem (NAM) protein
MEEDYPPGFRFFPTEEELVGFYLHNKLEGQRNAIAIAIDRVIPVIDINGVEPWNLPTLAGELCRGDTEQWFFFSPGQERETRGGRPSRTTACGYWKATGSPCYVYSSHNKVIGVKKSMVFYKGKAPMGTKTKWKMNEYRAIHVPSQSTPATLHLTCEFSLCRVYVISGSFRAFDRRPLEKEGAESRVHRIENNFGGARAHQTCPHSQMLEAGESSITKWDVNNNNNNNNGFQLQEPVWELEWEHFNWL

SEQ ID NO: 215667 - protein, 113 aa, Glycine max
  Coding DNA Sequence Number=SeqID_98889
  Gene Ontology: Cellular component=integral to membrane; Biological process=vesicle-mediated transport
  Homolog annotation: Hit_ID=Q9FMR5; Match level="QueryCoverage=63%, HitCoverage=33%, E-value=1e-27, Identity=86%"; Hit description =Vesicle-associated membrane protein 714
MQKFSSKLRMSLTRDYDYEGGGEEEEEELTSEGVVGHTDVGDAIRSEYVEDVAILREAEPGVGLRRKLLEDAAGDGAGVAGDGAELRQDDRASGHQSVEDRHRQKIRENVLCL

SEQ ID NO: 215668 - protein, 914 aa, Glycine max
  Coding DNA Sequence Number=SeqID_98890
  Gene Ontology: Mol. function=nucleic acid binding; Cellular component= intracellular; Biological process=DNA integration
  Homolog annotation: Hit_ID=Q1RWN2; Match level="QueryCoverage=99%, HitCoverage=79%, E-value=0.0, Identity=54%"; Hit description =Peptidase S8 and S53, subtilisin, kexin, sedolisin; Integrase, catalytic region; Zinc finger, CCHC-type
  Pfam annotation: Domain name=rve; Domain location=396-559; Score =157.8; E_value=2.8e-44; Accession=PF00665.16; Description=Integrase core domain
  Pfam annotation: Domain name=zf-CCHC; Domain location=211-228; Score =25.5; E_value=6e-05; Accession=PF00098.13; Description=Zinc knuckle
  Pfam module annotation: Pfam domain module=RVT_2::rve::zf-CCHC; Domain location=708-914::396-559::211-228
MVDGNYVQPAIPRFDGHYDHWTMLMENLLRSKEYWSLVENGITTAPTGATQEQLKSEEDSKLKDLKAKNYLFQAIDRSIMETILNKNTAKEIWDSMKHKYQGFTKNFAIVNKMKSHGEKVEQLTIVEKILRSMTARFDYVVCSIEESNNVITMTIDQLQSSLMVHEQRMKGHKEEEQVLKITNAGRTGGRGRGRGRGGRGRGRQFFNREHVECFKCHKLGHFQYECPMWEKNANYAEFDDEEEINHMCGIKDWFLDFDDKFKELVKLGDNSRMAVKRKGNIKLKIEGITQVIINVFYIPELKNNLLSIGQLQQWNLTIVFKQDMLIVPSCLQMESEGSTHLWHCRYGHLSIKGLKILAQKEMVRGLPKLQESCQVCIDCMVGKQHKEAIPKESSWRASQRLELIHSDICGPINLESNSNKRYFITFIDDYSRKSWVYFMSEKSTTLDIFKKFKIMVEKDSGNSICCLRTDRGGEFNSCEFNSFCRNNGIKRKLIATYTSQQNGVAKRKNRTIMNMVRSMLSEKRVPKQFWPEAVKWTIYVLNRSHTLAVKNVTPEEAWNDTKPLVKYFRVFGCIAYAHVPDAQRKKLDDKSIKCVHLGVSEESKAYKLYDPITKKVIVKCKDDNESSEGENVEIEATQNTDNENAKSKDQNPQATDSPNPAQGRNRRQPAWTEDYVTIDDLQNLAIFSIAEDPKTYEEALQNNVWRKAMDVEIDAIERNNTWELTNLLSGVNTIGVKWIYKTKCNEDGKVEKYKARLVAKDYTQQHGIDYKDVFAPVARWDTIRIILALAAVKGWNVFQLDVKSAFLHGELSETMYVDQLLGYQKMGEEDKVYKLKNALYGLKQALRAWYSKIESYFSKQGFVKCSHEHTLFVKTRNEGTLLIVSLYVDDLIFTGNDEEMFDVFKQLMKEEFDR

SEQ ID NO: 215669 - protein, 162 aa, Glycine max
  Coding DNA Sequence Number=SeqID_98891
MGNCIVLQENVVRVMKSDGKILEYKAPIKVHQVLNQFPGHAISKSLPVLHHLHPNTRLLKGQLYYLVPPPQPSPKKVNKKRVRFAEPDHDDDQVEDKGDEVVRIKLVLSKQELKDIVQKGGISVREVLSLVQGKGMDGDVDVCTRVNDGSHGWKPALETIPE

SEQ ID NO: 215670 - protein, 70 aa, Glycine max
  Coding DNA Sequence Number=SeqID_98892
MATRGDSACLASLSSGIGVSQLWFRFCQWRTGVDSLSLHRVITHSKNCLIVKQVNYHRMVHVPLLRLKIV

SEQ ID NO: 215671 - protein, 79 aa, Glycine max
  Coding DNA Sequence Number=SeqID_98893
LTIYVLMRAAGSSGTDRKTEHGKEHGSDLSSGMQMLLSMGFSYMQAIEAYSIFGDDVDSMVCYLLETGSSSRRKGKATE

SEQ ID NO: 215672 - protein, 52 aa, Glycine max
  Coding DNA Sequence Number=SeqID_98894
MELKIDGSNIGEDMRHSSEIIKGMQHHDNLMENWLKKGLSARWSMLPTRMHN

SEQ ID NO: 215673 - protein, 70 aa, Glycine max
  Coding DNA Sequence Number=SeqID_98895
  Subcellular localization annotation: CTP_CleavageSite=54; ConfidenceScore=5.38e-01
MKKVKKKIKLGMGTYSNAVLGDVNGLGGKRRGSGMMKSGSRRRRRRRRKTNEVVVMSESCSQMKSKALNH

SEQ ID NO: 215674 - protein, 70 aa, Glycine max
  Coding DNA Sequence Number=SeqID_98896
  Gene Ontology: Mol. function=1-(5-phosphoribosyl)-5-[(5 -phosphoribosylamino)methylideneamino]imidazole-4-carboxamide isomerase activity; Cellular component=chloroplast; Biological process=amino acid biosynthetic process
  Homolog annotation: Hit_ID=O82782; Match level="QueryCoverage=77%, HitCoverage=18%, E-value=6e-15, Identity=76%"; Hit description=1-(5 -phosphoribosyl)-5-[(5- phosphoribosylamino)methylideneamino] imidazole-4-carboxamide ...
  Homolog annotation: Hit description=isomerase, chloroplast precursor
MVFIARDGKKLRIDEELVACFGKYSPIPVTYAGGVTEMADLERIKTAGLDGVNVTVGSALDSICLQEVVA

SEQ ID NO: 215675 - protein, 190 aa, Glycine max
  Coding DNA Sequence Number=SeqID_98897
MGTSEFSHDTWKEKERELVFYLKGTNVEQWKHKSISMKSETIKPGKHQRGNNRGERETKSNKTKISKQQRGKRRREKRKQQHGADEKTQKRKKGLHAKGETEVATSNGGSLAARRRRAETIFVLVGWATFGRACPLVGLRPITRLLHPTVSGDGGGNGHRVAPESYPFVCPVRLRRGTLHFDSVSVLHSW

SEQ ID NO: 215676 - protein, 301 aa, Glycine max
  Coding DNA Sequence Number=SeqID_98898
  Homolog annotation: Hit_ID=Q9FMR8; Match level="QueryCoverage=90%, HitCoverage=90%, E-value=8e-63, Identity=47%"; Hit description =Arabidopsis thaliana genomic DNA, chromosome 5, P1 clone:MWD9
  Subcellular localization annotation: CTP_CleavageSite=44; ConfidenceScore=5.53e-01
MDTLSRIRFLPTCYSLQLPKISALSRFPNAFSKTTHQVSVLRVRASRPSVSNADEDVLQIFFKERELNGDFISRASDLLWRRDFRSSGDYDISELTNNTSQQTEQIIETDNDAGFLKLTRTQEWLTGDNSPPINTKVTAKLKRELLLLSVGIGLACSGYCLVILSVQVAISYAIGVLFSCLYLQLLYQHADNLSSEDVPQIFKKKKSKKIGIRSEDLEDFLERTIKGSGISLSSPRLVIPATIYGLWILFHQYFTNDIFDFQLVPAMFGMFVYKAAVLVQAYRDNERLRLVFPENEEGSSY

SEQ ID NO: 215677 - protein, 53 aa, Glycine max
  Coding DNA Sequence Number=SeqID_98899
MLIIRKNPMRPRSNLSLSLETALAISDVTRKRPGLEQKESRLFFCASCFEELG

SEQ ID NO: 215678 - protein, 91 aa, Glycine max
  Coding DNA Sequence Number=SeqID_98900
  Subcellular localization annotation: CTP_CleavageSite=46; ConfidenceScore=5.66e-01
MKRSNDDVAAPVSIANAARKTSSTRSAARNSSSPTTTHPIPSPPPTATETTETGTVIVTKTGTEIENACERERAHDRDREAKRHNKERERS

SEQ ID NO: 215679 - protein, 91 aa, Glycine max
  Coding DNA Sequence Number=SeqID_98901
KEEEDDDERHEKKNEIEMSDLDELDLAQRENLASVCLDCCLEFVIRIITLSNVKNSKESLFYLVEMKVTFNKTDIQTYLKLNMFGYGLYPS

SEQ ID NO: 215680 - protein, 40 aa, Glycine max
  Coding DNA Sequence Number=SeqID_98902
MDTVKSLQWTDLKNIPELQNKKVDEMNQYSTENQANKSRQ

SEQ ID NO: 215681 - protein, 68 aa, Glycine max
  Coding DNA Sequence Number=SeqID_98903
  Gene Ontology: Mol. function=RNA-directed DNA polymerase activity; Biological process=RNA-dependent DNA replication
  Homolog annotation: Hit_ID=Q8H6Q8; Match level="QueryCoverage=96%, HitCoverage=41%, E-value=2e-13, Identity=52%"; Hit description=CTV.20
TLADFRWYRDTFLTRVYTREDSQQPFWKEKFLAGLPRSLGDKVRDKIRSQSANGDIPYESLSYGQLIS

SEQ ID NO: 215682 - protein, 269 aa, Glycine max
  Coding DNA Sequence Number=SeqID_98904
  Gene Ontology: Mol. function=hydrolase activity, acting on carbon -nitrogen (but not peptide) bonds; Biological process=nitrogen compound metabolic process
  Homolog annotation: Hit_ID=Q3LRV4; Match level="QueryCoverage=99%, HitCoverage=66%, E-value=1e-120, Identity=79%"; Hit description =Nitrilase 4B
  Pfam annotation: Domain name=CN_hydrolase; Domain location=1-103; Score=27.1; E_value=7.5e-07; Accession=PF00795.12; Description =Carbon-nitrogen hydrolase
MAGKYKVHLVMGVIERDGYTLYCTVLFFDSQGHYLGKHRKIMPTALERVIWGFGDGSTIPVFETPVGKIGAAICWENRMPLLRTAMYAKGVLSLKFTHLAIAALSEYSSDYALSAGFALSAFRFLRVEIYCAPTADARDVWQASMTHIALEGGCFVLSANQFCRRRDYPPPPEYVFAGTEVDLTPDSVVCAGGSVIISPLGAVLAGPNYDGEALISADLDLGEIARAKFDFDVVGHYSRPEVLSLTVKDHPTNPVTFTSTSTKIEDKTK

SEQ ID NO: 215683 - protein, 673 aa, Glycine max
  Coding DNA Sequence Number=SeqID_98905
  Subcellular localization annotation: CTP_CleavageSite=70; ConfidenceScore=5.51e-01
YRFKRAILVGKKGGSSTPVPMWKTNTSSSPSVPTQRQQQQQQHHTKPLLHSSGSMLPSKDKELSVSARKLAATLWEINDLPPSRVKKEFEVDPMRGCKEKVRSREKKGVGLSRSGLLRPQMSDPSHSPASERMKGLEGGSCKRRVSRFSHQLLSGDYYLDALDAHSSANFIEGTTGSYSPTLEELEGFYQLVSKSFTMSLNCKLRGLELSNYNKWHLMHEVENQLRSKKNRGKGTGDVRNRLKEARSGLSTSKKLLKVLSQMCLREQQASSMPLVLALGSELDRVCHQIDQLIHEQCSNQNDIEYVMKHFAEEKAAWKRKERERIHHAIKHVAEELAVEKKLRRQTERLNKKIAKEMASVKASHLKASKEIEREKRAKEILEQICDELAKGIGEDRAQVEELKRESAKVREEVEKEREMLQLADVLREERVQMKLSEAKYQFEEKNAFLEKLRTELEDFMRTKDGQNEDVSPECKKIKDLESYFKNVCWGFQNAEKEDDSDVENDVGHEGDDDSDDSDLHSIELNMDDDSKGYKWSFACENVGQDKRFSIDKESIGRKSFSEKILWGSICFNKGTSSGRKRDFSINIQEVSDHFDPDRSIEFLSQATLQDDKDETQSNRSNKGLQDTVSCANSDKRNNLLLALQCAGGEAGENALALEGDNLKQEVAGKKSGC

SEQ ID NO: 215684 - protein, 1091 aa, Glycine max
  Coding DNA Sequence Number=SeqID_98906
  Gene Ontology: Mol. function=nucleic acid binding; Cellular component= beta-galactosidase complex; Biological process=DNA integration
  Pfam annotation: Domain name=rve; Domain location=376-536; Score =145.0; E_value=1.9e-40; Accession=PF00665.16; Description=Integrase core domain
  Pfam module annotation: Pfam domain module=RVT_2::rve; Domain location=734-989::376-536
MGAMDDSNPFLIQTSDNPSLSLVTHPLSGENYNSWKKAIKMALLGKNKFGFVDGSILEPPLEHFSHALWQRNNSIVASWLLNSLIKEIQVSILHCSTAQAIWNDLKERFEQRNGPLIFQLKHELANLQQDSMIPDISLFTRLVLFPEIDLSVHILVDLVILKISVSSYMLTAQQYSQLMSLLQAHTSNAATPDIESSNTGMILSASLTKFPQNCWIVDSVVSVIAVGIVHLSPSLTLYNVSFIPNFTFNLLLVSALLTNSAYSVCFSSNQFVIQEMPHCKKIGRGDLLHGLYVLNLMDTHSTCNVSDHNSCINFVSSTCIQAINWHNRFGHVSDSVLKILSDKISFALPNEFSTKSCYVCPIAKFRTLSFPSVNHVSAQPFDLIHCDIWGPYKHSTYANYQYFLTIVDDGSRFTWIFMLKHKYEASTVIMKFFAMVKTQFEASIKCLRSNNAQELALTNFLASQGTLHQFSCVERPQQNSVVERKHQHLLNVARSLFFQSKVPSTFWGECVVIATFLINRLPSPLLKQNTPYQVLYGSALDYSILRSFGCLAFVATLNSERNKFSPRAIPSVFVGYPQGIKGYRQYNLQTRKFYVSRDLVFHENIFPFQTLPNTFQEPDFLSDLAVSLPIPESMSSTIQPRIIETNISEPNISHATNNLPIQLSDSAVNTTISASYALPSPSLRRSIRTSNPPPYLLDYIRPQPRQKSHPIQDHYSLVHLNSPYKDFIAQWHQAMTAEIKALESNNTWTLVPLPIGKQCIGCKCVYKVKFKPDGTVDRHKARLVAKGYTQQAGIDFSDTFSPVAKLTSIRVLLAVAAAKNWPILQLDVDNAFLNGDLFEEVYMELPKGYTSVDKNLVCRLNKSIYGLRQASRQWFCKLSTTLIANGFSQSKNDYSLFTIGKGASLVVLLVYVDDILLAGPSATCVHSIQAKLQALFRLKILGSLQYFLGLEVAKSSKGVVLTQGKYALSLLEDIGFLGCKPSSLPMDPNLKLNMPSGDLLPNPSMYRRLLGRLMYLTISRPDITFAVNKLSQYIQHPRTPHLDVVYHLLQYIKGTPGQGLHFPASNSFNLFTYADADWGGCLDTHRSTSSS

SEQ ID NO: 215685 - protein, 67 aa, Glycine max
  Coding DNA Sequence Number=SeqID_98907
MKKKKVEAAGVSLSKAYALSDELEEFGRESAIHARAQHAISSLSESFVSSHAQLAKRKSTNSRLAGK

SEQ ID NO: 215686 - protein, 69 aa, Glycine max
  Coding DNA Sequence Number=SeqID_98908
MAMTSSRETIASVNRRGGGGHGGGHASSMGMHGGENGEHGNLPRPLGTNPVYAGAAAGSAHQRNNNHHH

SEQ ID NO: 215687 - protein, 117 aa, Glycine max
  Coding DNA Sequence Number=SeqID_98909
MCKKRLSCNFLYLLPVAETSETLAMSEFSDGEVRGESGGLPSATTSSGLPGATSSGGVPGATTSGSLSGASTSGGPKHVPLSYKISSLPIHFHTKTLKKGSTNTFSMLVVSFECASN

SEQ ID NO: 215688 - protein, 345 aa, Glycine max
  Coding DNA Sequence Number=SeqID_98910
  Gene Ontology: Mol. function=oxidoreductase activity; Cellular component=membrane; Biological process=metabolic process
  Homolog annotation: Hit_ID=Q8H0D9; Match level="QueryCoverage=75%, HitCoverage=95%, E-value=1e-111, Identity=78%"; Hit description =Alcohol dehydroge
  Pfam annotation: Domain name=Epimerase; Domain location=19-252; Score= -57.2; E_value=0.021; Accession=PF01370.11; Description=NAD dependent epimerasedehydratase family
  Pfam annotation: Domain name=KR; Domain location=18-187; Score=-77.9; E_value=0.0077; Accession=PF08659.1; Description=KR domain
  Pfam annotation: Domain name=adh_short; Domain location=17-182; Score= 102.0; E_value=1.7e-27; Accession=PF00106.15; Description=short chain dehydrogenase
  Pfam module annotation: Pfam domain module=Epimerase::KR::adh_short; Domain location=19-252::18-187::17-182
MATVSAVSAPIRRLEGKVAIITGGASGIGEATARLFSKHGAHVVIADIQDDLGLSLCKHLESASYVHCDVTKEEDVENCVNTAVSKYGKLDIMLNNAGICDEIKTSILDNNKSDFESVISVNLVGPFLGTKHAARVMIAAKRGSIINTASVAGTLGGVATHAYTSSKHALIGLMKSTAVELGQFGIRVNCVSPYVVPTPLTKKHANIDEEGVREIYSNLKGVHLVPNDVAEAALYLAGDESKYVSGHNLVLDGGYTDTYKGAIGGVEELIVEVLREGKEAKVEDLEVVDVTQEEVLMGDVVAVAKTECEDKLLKVEMSEGNGVWEAVVAGNLKKSLSSPTKSMMM

SEQ ID NO: 215689 - protein, 325 aa, Glycine max
  Coding DNA Sequence Number=SeqID_98911
  Gene Ontology: Mol. function=oxidoreductase activity; Cellular component=membrane; Biological process=metabolic process
  Homolog annotation: Hit_ID=P93697; Match level="QueryCoverage=74%, HitCoverage=90%, E-value=1e-103, Identity=77%"; Hit description =CPRD12 protein
  Pfam annotation: Domain name=Epimerase; Domain location=10-243; Score= -57.8; E_value=0.023; Accession=PF01370.11; Description=NAD dependent epimerasedehydratase family
  Pfam annotation: Domain name=KR; Domain location=9-178; Score=-84.1; E_value=0.018; Accession=PF08659.1; Description=KR domain
  Pfam annotation: Domain name=adh_short; Domain location=8-173; Score =83.8; E_value=5.5e-22; Accession=PF00106.15; Description=short chain dehydrogenase
  Pfam module annotation: Pfam domain module=Epimerase::KR::adh_short; Domain location=10-243::9-178::8-173
MPCRLEGKVAIITGGASGIGEATARLFSKHGAHVVIADIQDDLGLSICKHLESASYVHCDVTNETDVENCVNTTVSKHGKLDIMFNNAGITGVNKTSILDNTKSEFEEVINVNLVGVFLGTKHAARVMIPARRGSIVNTASVCGSIGGVASHAYTSSKHAVVGLTKNTAVELGAFGVRVNCVSPYVVATPLAKNFFKLDDDGVQGIYSNLKGTDLVPNDVAEAALYLASDESKYVSGHNLVVDGGFTVVNKYYVTLILGTPTLHPDITDTKTWGHLLDDLKANTEYTGYTVASNVVQWFWEVVKAFNKEDMARLLQFVTGTSKVM

SEQ ID NO: 215690 - protein, 401 aa, Glycine max
  Coding DNA Sequence Number=SeqID_98912
  Gene Ontology: Mol. function=hydrolase activity, acting on glycosyl bonds; Cellular component=cellular_component; Biological process =carbohydrate metabolic process
  Homolog annotation: Hit_ID=Q9SLM8; Match level="QueryCoverage=95%, HitCoverage=97%, E-value=1e-129, Identity=57%"; Hit description =Putative polygalacturonase
  Pfam annotation: Domain name=Glyco_hydro_28; Domain location=57-392; Score=406.0; E_value=5.5e-119; Accession=PF00295.8; Description =Glycosyl hydrolases family 28
  Subcellular localization annotation: CTP_CleavageSite=57; ConfidenceScore=5.47e-01
MAHYTNHLMLLFLATISFFSSTFSKDASSINVLSFGAKPNGKFDSTTSFLKAWSNACKSKESATFYVPKGNFLIKQVTFEGPCSNNIKFRIDGTIVAPSDYRSHGNSGMWIMFRNLNGFSVQGGTFDGKGDSYWRCRKSGSSCPAGARSITFSSCNDVKVSGLTSLNSQAMHIAVDHCKNILFKNVKIDAPSTSPNTDGFNVILSTGVTVSQAIISTGDDCIALSQGNTNVWIEHITCGPGHGISIGSLGAYKNEAGVHNVTVTDSIFEGTQNGVRIKSWAQPSNGYASNIVFRNLTMKNANNPIIIDQNYCPGDKSCPHQSSGVKISKVSYEHIRGTSACPQAINLDCSKSNPCEGIKLQDIDLVYGEGSTTSTCNNVGGINSGVVIPKSCVSLHSLNEK

SEQ ID NO: 215691 - protein, 200 aa, Glycine max
  Coding DNA Sequence Number=SeqID_98913
  Gene Ontology: Mol. function=identical protein binding; Cellular component=cellulose and pectin-containing cell wall; Biological process=negative regulation of enzyme activity
  Homolog annotation: Hit_ID=O49607; Match level="QueryCoverage=71%, HitCoverage=22%, E-value=3e-52, Identity=56%"; Hit description =Subtilisin proteinase-like
ESGADELAVAVFGRETGAGFARAFPVAGNGAEVQIGEAAAFRPDTSVEDSDDDVGAVVGFGPEVALVAEAEELRGARGVELAAAVFEDGEDERDAGFFGKLGGVPMVVSGEHGGLGLGIHAEDEGLGNFITGNSGKQNEEENNERKGIQYLFTHFKDTGFGFFWGLGFFVVVLEERGMGAVVVPGRRWRNVMERGEGEDS

SEQ ID NO: 215692 - protein, 106 aa, Glycine max
  Coding DNA Sequence Number=SeqID_98914
MEIKPTGRLWTSIQKGTLNKGIWLGPDFNFTNKTEKQKWLLWLGLSWLSCTTGTSSSSSSSSREPFHSDRIHVTKHQRVKERMKQGTSQTGNPSREREKISLERKI

SEQ ID NO: 215693 - protein, 88 aa, Glycine max
  Coding DNA Sequence Number=SeqID_98915
MSSHARCMLVSSFVTGSRKLHITFLTTHMGHCAPKCAMDEGRHGGHERTDGLHVLAFIGLHALSFRGLHALTFRGLLFAFGKCTISPK

SEQ ID NO: 215694 - protein, 127 aa, Glycine max
  Coding DNA Sequence Number=SeqID_98916
MGAYTKDEMLLMHFFQESLTGDAATELVQKGAQVFQKVHPKVEGYGNSSSAPKRELITMIVDALSVSYYEKMVDYMPSRFADLVFAGERIEVGLRRGKFDCLALTNKKPGTNGEKENEEGTHVEGCC

SEQ ID NO: 215695 - protein, 79 aa, Glycine max
  Coding DNA Sequence Number=SeqID_98917
MTFFSSEGALFYPCVRIVVKILKLNHARFCTGPFSQAELTRDMVVIEIAFEPDTPFGIIFRIGVGGLTGGGLNAIDIGG

SEQ ID NO: 215696 - protein, 68 aa, Glycine max
  Coding DNA Sequence Number=SeqID_98918
MAVAVEIVKRVSMVGEEHMIMEALTSMVFWILFVLLLCGYDCMFCNQDVAIKVLKHEDLNENILKEFA

SEQ ID NO: 215697 - protein, 63 aa, Glycine max
  Coding DNA Sequence Number=SeqID_98919
MLEVQSSARPPFSFLYVLEPPMYMYPPQQKENRGQALHGLTQFGQVKVSLVQEETMMKMSTNT

SEQ ID NO: 215698 - protein, 128 aa, Glycine max
  Coding DNA Sequence Number=SeqID_98920
  Homolog annotation: Hit_ID=Q9LTV5; Match level="QueryCoverage=34%, HitCoverage=2%, E-value=2e-13, Identity=80%"; Hit description =Helicase-like protein
MYVGVSLYVSLSLHMQRASKGMLDQATRGEKKMKEEEQQLRKVALNISKDVKKFWTKIEELATCYFQKPSLCGAGNVVETGCGVKETKKWASTSNCSGHAEESIALDIAKKGSNGWIQFKEREAAYKF

SEQ ID NO: 215699 - protein, 39 aa, Glycine max
  Coding DNA Sequence Number=SeqID_98921
METPQYDPKYTSKYPDSEVDGSDDEFDSGNDRTCSCAIM

SEQ ID NO: 215700 - protein, 408 aa, Glycine max
  Coding DNA Sequence Number=SeqID_98922
  Gene Ontology: Mol. function=transcription factor activity; Cellular component=transcription factor complex; Biological process =regulation of progression through cell cycle
  Homolog annotation: Hit_ID=Q9FNS0; Match level="QueryCoverage=93%, HitCoverage=83%, E-value=1e-144, Identity=69%"; Hit description =Transcription factor
  Pfam annotation: Domain name=E2F_TDP; Domain location=89-154; Score =137.9; E_value=2.8e-38; Accession=PF02319.11; Description =Transcription factor E2Fdimerisation partner (TDP)
MDSNDYIFTFQLLKRKSEVADFEADSGDRMTAGFTEAANSPFQTPVSGKTGKGGKSSRLTKGNRVGTQTPGSNIGSPAGSNLTPAGPCRYDSSLGLLTKKFINLIKQAEDGILDLNKAADTLEVQKRRIYDITNVLEGIGLIEKKLKNRIQWKGLDVSRPGEADDSFASLQAEVENLTMKERQLDEQIREMQERLRDLSEDENNDKLLFVTEEDIKNLPCFQNETLIAIKAPHGTTLEVPDPDEAVDYLQRRYRIVLRSTMGPIDLYLVSQFEEKFEEINGADVAPKLPSSPDVTKQQSTVVPEDRGKHIEVQGQAAPGPSSDFTPSQDFVSGIMKIVPSDVASEADYWLLSDADVSITDMWRTEPGVEWNELEPLQEDYCMTDENTTTPSHPSNVGEVSSASKPTGG

SEQ ID NO: 215701 - protein, 656 aa, Glycine max
  Coding DNA Sequence Number=SeqID_98923
  Gene Ontology: Mol. function=exonuclease activity; Cellular component= intracellular; Biological process=DNA integration
  Homolog annotation: Hit_ID=Q5N739; Match level="QueryCoverage=99%, HitCoverage=63%, E-value=2e-78, Identity=32%"; Hit description =Putative 5'-3' exoribonuclease
MWDFTSHLYTLGAIDLLMNVYKKEFNKLGGYLVDMSRIGEEHAAFLKLSRVEKFILAVGAYEEKIFKKRSETRERYLRRLIRDNEDAKREEVNAACYSDLDDENTSDCTLLIKKAPDSKTLSVLVNNVSATHAEIEQNTKDLKNELKRCIREKCDLFKSGDFLIDKIKLGTPGFKERYFKAKFSVEGPTDIECKRKEIACTSRVSFASQLSMVVVLDCNLIGGPEVHGRFYPFHYGPFASDLKGMGQVRVKFEKGVPFLPLDQLLSVLPPASSHALPKAYSQLMLDEQSRIFDFYPQDFEVDTEGKRFMWQGICILSWIDDKRLVAETRELKNELSENEAIRNSVKADSLLVRSASKLAEKFGSLSLDTNLPCKLETRMSDGIGGILSLCDEFVEKPCLDISDNKKEDSVLCVYYELPAGSNHIPGLLSDVKLPEKTIFESDIMETELWHERQKYYSRFERVQNQDNWRSENTSNTSRFASNAISQHTRIFSSNTPLFTFQGAGVGWGSGRGKRIDAMASESVPNNTKPQHFVDNFRQLRISESNNHFLRPGGGSSLFRPHNKGHMNQSRNAPYHQGSPSNNGYINQPRNAPYHQGSQYNNGYMNQSKTAPNHQGSQYVTVPNFGRGQGRGASSNSSLRPQWSGGKAYQVKDQDRW

SEQ ID NO: 215702 - protein, 160 aa, Glycine max
  Coding DNA Sequence Number=SeqID_98924
  Gene Ontology: Mol. function=DNA binding; Cellular component =chromatin; Biological process=DNA integration
  Homolog annotation: Hit_ID=Q1SXA8; Match level="QueryCoverage=77%, HitCoverage=8%, E-value=6e-42, Identity=68%"; Hit description=Zinc finger, CCHC-type; Polynucleotidyl transferase, Ribonuclease H fold
MEEAIHVRFNDNKPNTTMLELDESIAKMTIDDIIKSTAASKLPKGKFVVGAKWVFRNKLDETGKVVRNKARLIAKGYSQQEGINYTKTFAPNARLEAIRILLSFDAHHGMMYQMDVKKAFLNGLIKEEVYVGQIPGFESSIYPHHVFKLNKALYGLKEAP

SEQ ID NO: 215703 - protein, 82 aa, Glycine max
  Coding DNA Sequence Number=SeqID_98925
  Subcellular localization annotation: CTP_CleavageSite=43; ConfidenceScore=5.57e-01
MVLKIVNDNKLPSPIVSSPSIPLYVTQRSFSFMLVRRQATTVCGGHRWSWVVEKEMLVFGWRLERRRVKNCVFHAEGRIYNL

SEQ ID NO: 215704 - protein, 481 aa, Glycine max
  Coding DNA Sequence Number=SeqID_98926
MADATRNRVLEREIEDRIENHLSSEDILLHFHASTAAGHSGRNATLQRLKSVVYWKGVIFVVVDRLSKVAHFMALSHPYFAADVAQSFLDHDLMAFQGVQIHPLNGLSGYLYLNGGITPPFTALFELLLMKWCMDSRLLNRCAVAYKIKLPSGSSIHDVFHVSQLKKHVGEAVTSSSLPILVEGDPLTKEPEAILDRMTIKRRSQAVTKGGVNMALAQPFSLAKIINVMFHMGAFKAQGEDSLQLVFYQSQWAKVIIACITSPTIKVLWNGDKLDECTLAWGIRQGDPISPYLFVMCLERLYQLIRDEFRTKRWWAIMLTRKCSLLSHLAFMDDLVPFSERKDEGVFLEECGGAEFERSSHGGAGECSTAGGLLVEESKPSKAFYSLLDEGMQLMLHDMVNDASWKKEELEEKLLQDIFLRLFACIPPSIVAIEDVLMWNSLQDDNMSVASTYKTREGASVSKKAILTNNTMRARGISDSD

SEQ ID NO: 215705 - protein, 76 aa, Glycine max
  Coding DNA Sequence Number=SeqID_98927
MDRLHCMGKKEKSKRPVLSFTKGQSPKSGKKVILKALARNKGVGALTIGNKDLENESNKSENVTGIEVGNSKCNNG

SEQ ID NO: 215706 - protein, 973 aa, Glycine max
  Coding DNA Sequence Number=SeqID_98928
  Gene Ontology: Mol. function=cellulose synthase (UDP-forming) activity; Cellular component=membrane; Biological process=cellulose biosynthetic process
  Homolog annotation: Hit_ID=Q2IB41; Match level="QueryCoverage=99%, HitCoverage=100%, E-value=0.0, Identity=61%"; Hit description =Cellulose synthase 3
  Pfam annotation: Domain name=Cellulose_synt; Domain location=191-968; Score=1566.2; E_value=0; Accession=PF03552.5; Description=Cellulose synthase
  Pfam annotation: Domain name=PHD; Domain location=36-85; Score=6.9; E_ value=0.012; Accession=PF00628.19; Description=PHD-finger
  Pfam module annotation: Pfam domain module=Cellulose_synt::PHD; Domain location=191-968::36-85
MEACTGLFAGTPNSNELVVIQGHDEPKPVKNLDGQLCEICGDSVGLTVDGDLFVACEECGFPVCRPCYEYERREGTQVCPQCHTRYKRIKGSPRVLGDEDEDDVDDIEHEFKHEEMLQGNMTHGDSEGNSKSKPVGLAKVNGELPVSSHSVGEPGAKLDDKEKVDEWMLHQGNLWPETDASVDPEKAMKEPLSRKVPIPSGRLSPYRMMVVARLLLLLLFFQYRIFHPVPDAIGLWFISVTCEIWLALSWMIDQLPKWFPIDRETYLDRLSIRFEPENKPNMLSPIDIIVTTVDPIKEPPLVTANTVLSILALDYPADKISCYVSDDGASMLTFEALQETAEFSRKWVPFCKTFSVEPRAPEKYFSEKIDFLKDKLQSTYVKERRTMKREYEEFKVRINALVAKSMRVPPEGWTMKDETPWPGNNSKDHPSMIQVLLPHNVGNELPCLVYTSREKRPAFQHHNKAGAINAMLRVSAVLSNAPFVLNLDCNHYVNNSKVVREAMCFFMDIQLGNGIAFVQFPLRFDSLDRNDRYANKNTVLFDINLRCLDGIQGPAYIGSACIFRRKALTGFDSPKTSKRPSMVQVHSKQDENGEEASITGEDKELLKSEMNDENKFGKSILFMNSALAEEGGVDPSSSQEALLKEAIHVMSSRYEDRTLWGYEVGLSYGSIAADTLTSLKMHCGGWRSVYCMPKRDPFRGTAPINLTDRLNQVLRWAVGSLQILFSSHCPLLYGGRLKGLQRIAYINSTVYPFSSIPLLIYCIIPAICLLTDKFITPSVGTFASLIFIALFISIFASAILELRWSGVSLEEWWRSQQFWVIGSVSANLFALLQGIMRALPLGRVNTNFSIVSKAPDDVEFRELYAIRWTALLIPPTTIIIINLIGIVAGFTDAINSGEHSWGALLGKLFFSLWVVIHLYPFLKGLMGRQNRTPTLIVIWSVLLASIFSLVWVRVDPFVLKTKGPDVKQCGISC

SEQ ID NO: 215707 - protein, 198 aa, Glycine max
  Coding DNA Sequence Number=SeqID_98929
MLGFAYIPSYSHELRLLVKVLPLLRYEGGISISCFNFKKFQAHKVGGVVEELRSGVGDEEGCVREGHSLHAFTLRRCACFIPRRNAAVAVVRSASSSCFPWFVSSLRTCVCAPLTLRGRSFSTLFNLRDLLDPTVHFFDFLAETLRFADLGLECRDFDGGGTWVTFVGWWIGGGGRSFRQAFSRRCAFFEFKFEINGL

SEQ ID NO: 215708 - protein, 165 aa, Glycine max
  Coding DNA Sequence Number=SeqID_98930
  Gene Ontology: Cellular component=cellulose and pectin-containing cell wall
  Homolog annotation: Hit_ID=Q9SJ54; Match level="QueryCoverage=63%, HitCoverage=49%, E-value=5e-25, Identity=51%"; Hit description =Putative harpin-induced protein
MVPPRDPRPDLPLDPPVDLNVDHYGAGGALVLLQRGQHKRRDGDDIAEEKRRPDGEVAVALVGVGERGGEGDLLAPVGGVDAERVVVDADARVGVVGGEGDLHGEGEGVGCGGGEVEGVEGGVLEGEVGLCGAEDDPDEEDDEEDEDDEGRDGAEDEAEEVAALG

SEQ ID NO: 215709 - protein, 921 aa, Glycine max
  Coding DNA Sequence Number=SeqID_98931
  Gene Ontology: Mol. function=protein serine/threonine kinase activity; Cellular component=integral to membrane; Biological process=protein amino acid phosphorylation
  Homolog annotation: Hit_ID=Q84RP6; Match level="QueryCoverage=99%, HitCoverage=82%, E-value=0.0, Identity=46%"; Hit description=LRR receptor-like kinase 1
  Pfam annotation: Domain name=LRRNT_2; Domain location=24-66; Score =41.4; E_value=3.1e-09; Accession=PF08263.3; Description=Leucine rich repeat N-terminal domain
  Pfam annotation: Domain name=LRR_1; Domain location=119-141; Score =15.5; E_value=0.2; Accession=PF00560.23; Description=Leucine Rich Repeat
  Pfam annotation: Domain name=LRR_1; Domain location=143-165; Score =15.1; E_value=0.25; Accession=PF00560.23; Description=Leucine Rich Repeat
  Pfam annotation: Domain name=LRR_1; Domain location=167-189; Score =12.8; E_value=1.1; Accession=PF00560.23; Description=Leucine Rich Repeat
  Pfam annotation: Domain name=LRR_1; Domain location=191-214; Score =7.7; E_value=10; Accession=PF00560.23; Description=Leucine Rich Repeat
  Pfam annotation: Domain name=LRR_1; Domain location=216-238; Score =7.5; E_value=11; Accession=PF00560.23; Description=Leucine Rich Repeat
  Pfam annotation: Domain name=LRR_1; Domain location=240-262; Score =8.6; E_value=7; Accession=PF00560.23; Description=Leucine Rich Repeat
  Pfam annotation: Domain name=LRR_1; Domain location=264-286; Score =13.6; E_value=0.72; Accession=PF00560.23; Description=Leucine Rich Repeat
  Pfam annotation: Domain name=LRR_1; Domain location=288-310; Score =12.0; E_value=1.6; Accession=PF00560.23; Description=Leucine Rich Repeat
  Pfam annotation: Domain name=LRR_1; Domain location=312-334; Score =9.0; E_value=6; Accession=PF00560.23; Description=Leucine Rich Repeat
  Pfam annotation: Domain name=LRR_1; Domain location=336-358; Score =10.6; E_value=3; Accession=PF00560.23; Description=Leucine Rich Repeat
  Pfam annotation: Domain name=LRR_1; Domain location=360-382; Score =15.9; E_value=0.14; Accession=PF00560.23; Description=Leucine Rich Repeat
  Pfam annotation: Domain name=LRR_1; Domain location=384-406; Score =4.6; E_value=40; Accession=PF00560.23; Description=Leucine Rich Repeat
  Pfam annotation: Domain name=LRR_1; Domain location=408-430; Score =15.2; E_value=0.23; Accession=PF00560.23; Description=Leucine Rich Repeat
  Pfam annotation: Domain name=LRR_1; Domain location=432-454; Score =9.3; E_value=5.2; Accession=PF00560.23; Description=Leucine Rich Repeat
  Pfam annotation: Domain name=LRR_1; Domain location=456-478; Score =14.2; E_value=0.48; Accession=PF00560.23; Description=Leucine Rich Repeat
  Pfam annotation: Domain name=LRR_1; Domain location=480-502; Score =17.4; E_value=0.05; Accession=PF00560.23; Description=Leucine Rich Repeat
  Pfam annotation: Domain name=LRR_1; Domain location=504-526; Score =16.1; E_value=0.12; Accession=PF00560.23; Description=Leucine Rich Repeat
  Pfam annotation: Domain name=LRR_1; Domain location=528-550; Score =17.6; E_value=0.046; Accession=PF00560.23; Description=Leucine Rich Repeat
  Pfam annotation: Domain name=LRR_1; Domain location=552-574; Score =14.6; E_value=0.37; Accession=PF00560.23; Description=Leucine Rich Repeat
  Pfam annotation: Domain name=LRR_1; Domain location=576-598; Score =16.9; E_value=0.076; Accession=PF00560.23; Description=Leucine Rich Repeat
  Pfam annotation: Domain name=LRR_1; Domain location=625-646; Score =14.6; E_value=0.36; Accession=PF00560.23; Description=Leucine Rich Repeat
  Pfam annotation: Domain name=LRR_1; Domain location=648-669; Score =10.8; E_value=2.8; Accession=PF00560.23; Description=Leucine Rich Repeat
  Pfam annotation: Domain name=LRR_1; Domain location=94-116; Score =13.4; E_value=0.83; Accession=PF00560.23; Description=Leucine Rich Repeat
  Pfam annotation: Domain name=Pkinase; Domain location=759-919; Score=- 36.4; E_value=2.1e-06; Accession=PF00069.15; Description=Protein kinase domain
  Pfam annotation: Domain name=Pkinase_Tyr; Domain location=759-920; Score=-69.8; E_value=3.5e-08; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR_1::LRR_ 1::...
  Pfam module annotation: Pfam domain module=Pkinase::Pkinase_Tyr; Domain location=24-66::119-141::143-165::167-189::191-214::216 -238::240-262::264-286::288-310::312-334::336-358::360-382::384 -406::408-430::432-454::...
  Pfam module annotation: Domain location=456-478::480-502::504 -526::528-550::552-574::576-598::625-646::648-669::94-116::759 -919::759-920
  Subcellular localization annotation: CTP_CleavageSite=45; ConfidenceScore=5.00e-01
MSSNALTLFILFLNISLIPATSALNQEGLSLLSWLSTFNSSDSATAFSSWDPTHQSPCRWDYIKCSKEGFVSEIIIESIDLHTTFPTQLLSFGNLTTLVISNANLTGEIPGLVGNLSSSVVTLDLSFNALSGTIPSEIGNLYKLQWLYLNSNSLQGGIPSQIGNCSKLRQLELFDNQLSGLIPGEIGQLRDLETLRAGGNPGIHGEIPMQISNCKALVYLGLADTGISGEIPPTIGELKSLKTLQIYTAHLTGNIPPEIQNCSALEELFLYENQLSGNIPSELGSMKSLRKVLLWQNNFTGTIPESLGNCTSLRVIDFSMNSLVGELPVTLSSLILLEEFLLSNNNISGGIPSYIGNFTSLKQLELDNNRFSGEIPPFLGQLKELTLFYAWQNQLHGSIPTELSNCEKLQAIDLSHNFLMGSIPSSLFHLENLTQLLLLSNRLSGPIPPDIGSCTSLVRLRLGSNNFTGQIPPEIGFLRSLSFLELSDNSLTGDIPFEIGNCAKLEMLDLHSNELQGAIPSSLEFLVSLNVLDLSANRITGSIPENLGKLASLNKLILSGNQITDLIPQSLGFCKALQLLDISNNKISGSVPDEIGHLQELDILLNLSWNSLSGLIPETFSNLSKLSNLDLSHNKLSGSLRILGTLDNLFSLNVSYNSFSGSLPDTKFFRDLPPAAFVGNPDLCITKCPVSGHHRGIKSIRNIIIYTFLGVIFTSGFVTFGVMLALKIQGGTNFDSEMQWAFTPFQKLNFSINDIIHKLSDSNIVGKGCSGVVYRVETPMNQVVAVKKLWPPKHDETPERDLFAAEVHTLGSIRHKNIVRLLGCYNNGRTRLLLFDYICNGSFSGLLHENSLFLDWDARYKIILGAAHGLEYLHHDCIPPIIHRDIKAGNILVGPQFEAFLADFGLAKLVGSSDYSGGFCN

SEQ ID NO: 215710 - protein, 117 aa, Glycine max
  Coding DNA Sequence Number=SeqID_98932
  Subcellular localization annotation: CTP_CleavageSite=40; ConfidenceScore=5.33e-01
MQPFPTPLNGVHQPLNLSRESSNLSVRVPLHVASVPHRTRSSQRKERDDYSKRNEGSGRNGSTRRDEHHNGQPGLSVELGRRAAYKRSDPIVLGHKKLCVEVVDATTTYRGDEGPLQ

SEQ ID NO: 215711 - protein, 261 aa, Glycine max
  Coding DNA Sequence Number=SeqID_98933
  Gene Ontology: Mol. function=RNA-directed DNA polymerase activity; Biological process=RNA-dependent DNA replication
MFTDGLQPHSKKLLDASTSGRIKLKILDEAMELIENMAANDHTILRDRTHTPSKKRCTLCGGAHEVGLCVVQEEASMEVNYMANQNCQGYHQGGNFSQNQGQGWKFHLGNNFNKDKGGPSNQPLDQGPNLYERTTKLVKTLTQFMQVFISNHKTTKSAIKNLEVQVGQLAKQLAEKSNGNFVANTEKNHKEKSKVVLTIRKRMDGLVSDNLVEGVVKDMGDARKVSVAVEWRRRKGDWRHHFKEKMSQEQAHHHRKPWIRA

SEQ ID NO: 215712 - protein, 189 aa, Glycine max
  Coding DNA Sequence Number=SeqID_98934
  Gene Ontology: Mol. function=nucleic acid binding; Biological process= RNA-dependent DNA replication
  Homolog annotation: Hit_ID=Q53KJ4; Match level="QueryCoverage=59%, HitCoverage=16%, E-value=1e-16, Identity=40%"; Hit description =Transposable element protein, putative
MSSLKKETKARKKARGASPSPKSTIPLLILEKSAVPIPPLIFEEPHMVEEGPSKVTLENYSSSTMPQYFTSIVRLNVQAINISYRYSLIQLIQGNLFHGLANEDPYARLATYIEICNTVKIARVLEDAIRLNLFPFSLFDEAKKWMHSFKGNSLRTWDEVVEKFLKKYFPKSKTTEGKTGILSFHQFLE

SEQ ID NO: 215713 - protein, 289 aa, Glycine max
  Coding DNA Sequence Number=SeqID_98935
  Gene Ontology: Mol. function=RNA-directed DNA polymerase activity; Cellular component=intracellular; Biological process=RNA-dependent DNA replication
MTMIKNDMNELIPIRTMTGLRMCIDYCLLNKATRKDHFPLFFMDQMLERLANQAFYCFLDGYSRYNQILVNLEDQEKTTFTCPFRVFAYWRMPFGLCNAPTTFQRCMNAIFSNMVEKCIEIFMDDFFVFGDSFVSCLNNLEKVLERCIKKNLGLYWRKLHFMVIEGSKIIMHTDHFAIKYLLIEVNSKPRLIRWVLLLQEFNLEIQDKKGCDNLVAYHLLRLVNEEVTKKEKEIEEEFPDKTLMEISFKEKDYPWFTDMANFKATGQPPEGMKFHEKKVLLRSHQVCLG

SEQ ID NO: 215714 - protein, 1018 aa, Glycine max
  Coding DNA Sequence Number=SeqID_98936
  Gene Ontology: Mol. function=protein serine/threonine kinase activity; Biological process=protein amino acid phosphorylation
  Homolog annotation: Hit_ID=Q2HSJ8; Match level="QueryCoverage=98%, HitCoverage=93%, E-value=0.0, Identity=53%"; Hit description=Protein kinase
  Pfam annotation: Domain name=Pkinase; Domain location=1-207; Score =166.0; E_value=9.7e-47; Accession=PF00069.15; Description=Protein kinase domain
  Pfam annotation: Domain name=Pkinase_Tyr; Domain location=1-207; Score=-6.5; E_value=4.5e-12; Accession=PF07714.7; Description =Protein tyrosine kinase
  Pfam module annotation: Pfam domain module=Pkinase::Pkinase_Tyr; Domain location=1-207::1-207
MALIARIQHPYIVEFKEAWVEKGCYVCIVTGYCEGGDMAELMKKLNGAYFPEEKLCKWFTQLLLAVEYLHSNFVLHRDLKCSNIFLTKDRDVRLGDFGLAKTLKADDLASSVVGTPNYMCPELLADIPYGFKSDIWSLGCCIYEMAAHRPAFKAFDMAGLISKINRSSIGPLPPCYSPSLKTLIKGMLRKNPEHRPTASEVLKHPYLQPYLDQYRPSFSPPTSCSPEKPISAVNNHPKNMAESQNSNSSSSDKDSLMSNEKKIAPAGPKCYNKAIETDQISIDDDGSEDESGSSNANAKTAEQEVMKPSNNEHHSNVESKQPKTIRNIMMALKEGKVREATSPMRGNRIKPGGISTQKINTETLSKLPKPTFIAPSMKPNLESPAALARASPDPAKRMMGSHYPKHQILMTEASPKVKARHDLTPPSALAKQVEGDGFSPKPRQRTPPSSLRRPSFSGRMRLAGIDVPNAANDTGKLGSNKIIQEPEMSPCQLANGNVPHISRQVTREPQKAFERSSKGMQTDSSNSASSSVSIKGCELADDAKTFIDMREQMLPNHEKVNHIVGVETCPDRSPPTTCAHCKMAEKVPKETCEVTMNFQNTISSNEKVSSSLTQDHRVEDSKVTLASECDLVINQTTISTTTSCDKRSVDPSAGATKEIKEFQDITKEILLTKSPKEIKDFQYISKEMPMIKSPKQAPPSSGEKSVHVEVSPVSEPDIVSQPALGCKSPGDDKFTVRERLSPAAETVPVVATTKLSSQKPAAETVPVVTTNKLSSQKVLHEKVTLLQNPAQERHDTGHLPPAFDDVIHVIRHSSYRVGSEQPVKESVEMGVQNVDVGKFINVVRDDLEMRNITSPLTTHKSSTCSDAASLKSDISDQLQMKNLNTPPILKSSSFSDASSMKSSISDHPGLKEQDVSNPSPIVSEPDSAELSKCNTPMNEEKPPAAKETLDVKSFRQRAEALEELLELSAELLQQNRLEELQVVLKPFGKDKVSPRETAIWLAKSLKGMMSEESGGHSS

SEQ ID NO: 215715 - protein, 65 aa, Glycine max
  Coding DNA Sequence Number=SeqID_98937
MKRTLSRYNKCLGSTDAAVAEIKTENEFHLWVKARKGRNGLSLWYKKSKTGNIQANELQLNNLPM

SEQ ID NO: 215716 - protein, 95 aa, Glycine max
  Coding DNA Sequence Number=SeqID_98938
  Gene Ontology: Mol. function=sequence-specific DNA binding; Cellular component=nucleus; Biological process=regulation of transcription, DNA-dependent
  Homolog annotation: Hit_ID=Q67BK3; Match level="QueryCoverage=75%, HitCoverage=30%, E-value=3e-25, Identity=84%"; Hit description=AGL15
  Pfam annotation: Domain name=SRF-TF; Domain location=9-59; Score =103.7; E_value=5.5e-28; Accession=PF00319.9; Description=SRF-type transcription factor (DNA-binding and dimerisation domain)
MGRGKIEIKRIDNASSRQVTFSKRRTGLFKKAQELSILCEAEVAVIVFSNTGKLFELSSSGCVPRFSNALACPLTFIYMPFAPTLMLHFQNLLSV

SEQ ID NO: 215717 - protein, 65 aa, Glycine max
  Coding DNA Sequence Number=SeqID_98939
MGAKYLEAVRQRLHAIKQWSSGEIRGSKDKTLISFERNTIWPVNLPASRTCKNFENDQYRRPTSS

SEQ ID NO: 215718 - protein, 71 aa, Glycine max
  Coding DNA Sequence Number=SeqID_98940
MELTRDAHVGPRIYTEPYELTMILNYNRKEQWNRVKEKQPNRALSFFLYVDRASFSGQAHAMHIIIISTRK

SEQ ID NO: 215719 - protein, 167 aa, Glycine max
  Coding DNA Sequence Number=SeqID_98941
  Gene Ontology: Mol. function=oxidoreductase activity
  Homolog annotation: Hit_ID=Q9SU40; Match level="QueryCoverage=45%, HitCoverage=13%, E-value=1e-28, Identity=70%"; Hit description =Putative monocopper oxidase precursor
  Pfam annotation: Domain name=Cu-oxidase_2; Domain location=1-116; Score=30.2; E_value=5.9e-07; Accession=PF07731.4; Description =Multicopper oxidase
MRGPTKPLIGSPRTETSVVNGTYKGFMEIMLQNNDTKMHTYHMSGYAFVVVRMDFGDWSENSRGTYNKWDGIARTTTQSYGEVSRSFAIRWKDELEPTWHLLHSSGNMHFVTYNQVLMSPILLARWMELREFYELTGNHQVTLTHYGQSVFLLTIFKSSFEPKAFPK

SEQ ID NO: 215720 - protein, 304 aa, Glycine max
  Coding DNA Sequence Number=SeqID_98942
  Gene Ontology: Mol. function=nucleic acid binding
MADGRRPELLTLLHSHVCIVSAIGILKEDFRYGDQPLRLWWKGSDDEYKEITIDSHALELSNYVIANSCEVELFVECGGCNEGLWMTFFSCNFEDNSDELVKAVQLDDSKEENAIGLDDDFDLPIPEIGRLENKRIKRSTIKKRPVDKACGGKKATGGGKKAPGRGKKVEHNYVNVSGSLFVTPTLPEDDIEDWYVSEQLCSDDSDEEKLGLEFGSLKEFKETILEYNVLNGREIRFNFNDKRQAREKFVEIETKERWRWFLNLLLEDIVDVETNIWVFISDQQKGLQQAFLEFPKQIEHRFFL

SEQ ID NO: 215721 - protein, 366 aa, Glycine max
  Coding DNA Sequence Number=SeqID_98943
  Gene Ontology: Mol. function=oxidoreductase activity; Cellular component=mitochondrial outer membrane; Biological process=electron transport
  Homolog annotation: Hit_ID=Q60D44; Match level="QueryCoverage=93%, HitCoverage=93%, E-value=1e-118, Identity=59%"; Hit description =Putative pyridine nucleotide-disulphide oxidoreductase, identical
  Pfam annotation: Domain name=Pyr_redox; Domain location=132-226; Score=41.8; E_value=2.4e-09; Accession=PF00070.17; Description =Pyridine nucleotide-disulphide oxidor
  Pfam annotation: Domain name=Pyr_redox; Domain location=9-104; Score =5.1; E_value=0.0058; Accession=PF00070.17; Description=Pyridine nucleotide-disulphide oxidor
  Pfam annotation: Domain name=Pyr_redox_2; Domain location=9-274; Score=22.9; E_value=9.9e-06; Accession=PF07992.4; Description =Pyridine nucleotide-disulphide oxidor
  Pfam module annotation: Pfam domain module=Pyr_redox::Pyr_redox::Pyr _redox_2; Domain location=132-226::9-104::9-274
MEKHDGKKRVVIIGGGVAGSLVAKSLQFHAHVTLVDPKEYFEITWASLRSMVEPSFAERSVINHRDYLTNGNIVTSNAVNVTETEVLTSDGDRIHYDYLVIATGHADDVPQSRRERLNQFKEDNQKIKSAHSILIVGGGPTGVELAGEITVDFPDKKVTIVHKGPRLLDFVGTKAADKTLKWLESRNVVVKLEQSIDLNELTYEQKTYRTSNGETIEADCYFLCLGKPLASAWLEETVLKNDLDDLGRIKVDGKLRVVGRTNIFAIGDITDVPEIKQGFAAQQHAIVVSKNLKAMIDGGRECSQCRMDTYKPQLAMAVVSLGRKDAVAQIPFLTISGRIPGLIKSGDLFVGRTRKQMGLNPDTSQA

SEQ ID NO: 215722 - protein, 345 aa, Glycine max
  Coding DNA Sequence Number=SeqID_98944
  Gene Ontology: Mol. function=oxidoreductase activity; Cellular component=mitochondrial outer membrane; Biological process=electron transport
  Homolog annotation: Hit_ID=Q60D44; Match level="QueryCoverage=98%, HitCoverage=96%, E-value=1e-107, Identity=56%"; Hit description =Putative pyridine nucleotide-disulphide oxidoreductase, identical
  Pfam annotation: Domain name=Pyr_redox; Domain location=123-211; Score=15.3; E_value=0.00084; Accession=PF00070.17; Description =Pyridine nucleotide-disulphide oxidor
  Pfam annotation: Domain name=Pyr_redox; Domain location=5-105; Score =1.3; E_value=0.012; Accession=PF00070.17; Description=Pyridine nucleotide-disulphide oxidor
  Pfam annotation: Domain name=Pyr_redox_2; Domain location=5-259; Score=42.5; E_value=1.4e-09; Accession=PF07992.4; Description =Pyridine nucleotide-disulphide oxidor
  Pfam module annotation: Pfam domain module=Pyr_redox::Pyr_redox::Pyr _redox_2; Domain location=123-211::5-105::5-259
MAEKKVVILGGGVAGANLAKTIQHQANVTLIDPVVEHRKEYFEIPWASLRGLVEPTFAERIVINHREYFKKGDLVVSSAVNITETAVVTADGQQIAYDYLVIATGHTEPIPKTRRERLDQYKGGPTGVELAAEIAVDFPDKKVTIVHKGTRLLEYIGTKASSKALKWLKSKKVDVKLEQSVDLSSSSEASKTYQTSNGETIEADLHFLCIGKPLGSTWIRETLLNNDLDADGRIKVDKHLRVKGKSNIFAIGDITDVQEIKQGMYASAHAQVVAKNLKLLIEGGGKEHKLGTYKAQPPISMVSLGRKIAVAQFPFMTVLGRLPGMIKSGDLFVGKTRKELGVEPN

SEQ ID NO: 215723 - protein, 83 aa, Glycine max
  Coding DNA Sequence Number=SeqID_98945
MALEGNAFRRKVLDTDELMDYCGLFANLLIVPMALEGSAFRSKVLDTDELMDNCGLFAVMLATSNDFVAHFSLGFSNVEGKVT

SEQ ID NO: 215724 - protein, 82 aa, Glycine max
  Coding DNA Sequence Number=SeqID_98946
MVWFKDFLLTIQHHHHHLRSEKKDETFPYLRQLQLLALSMLQLLQLQGHLHTLSLIILPPLRDSNKPSSKMLPPSLKFLEPL

SEQ ID NO: 215725 - protein, 272 aa, Glycine max
  Coding DNA Sequence Number=SeqID_98947
  Homolog annotation: Hit_ID=Q2QTQ5; Match level="QueryCoverage=22%, HitCoverage=16%, E-value=3e-10, Identity=51%"; Hit description =Expressed protein
GWHDLFNGDKAGILPFFVDIVQGGEGGGHGVATDGAIPAPREYGGLEVPEPSWHEDRGHLSQHPPPRQSLLLVEEIKAHEESLVEEHDSRERDEEKEEKGEERTQQQWEKFSQVEIQQENILQVNTPPHQLIGKEERHIEYDKSLSVILSLNTNTSLAMVWKAFPGYMSFMESLAKSQTQVDVPSTCTTKDVSSNVLRQRSQAVKPLILCEWGYKRILRREKGDTKEFRRLVLCSFGKGRRETQKEFRRLVLDEFFLAKGEENEPMNSTSFQ

SEQ ID NO: 215726 - protein, 64 aa, Glycine max
  Coding DNA Sequence Number=SeqID_98948
MGTTTEGDAPSPRCHWPAMRGRLRGDGNAIAAEALPEARWRKQNKKKEEMQVNAKRVKKLNKTQ

SEQ ID NO: 215727 - protein, 315 aa, Glycine max
  Coding DNA Sequence Number=SeqID_98949
MKECALRHPYQTCAKMSDIEKVKADMEAMNEQMTTIMEEMMRMKKMIEVKTATVAAASTATEMDPIHPPSFNQSSFPPYGLPPNYTPPIVVYTLGENIGETNEAPQDHTLAGFGVYPGYTTEGHGFSGPNGCCHNLPYDGGVKGEKKGIRVRELFRHEEGISIPRARHKGWEMPLAPTYPQAKTQFGAVDAHPGELNLSLEVMSSLRRVGCLAMKPFHGPGEPDASMGKLGEMITMIMDTLLVFYYEKMVGYIPSSFTDLVFADEKIEAGLRKGKFNYVASANPGNGGPESCGERKKDGETHVVNVVPKFPTSPL

SEQ ID NO: 215728 - protein, 73 aa, Glycine max
  Coding DNA Sequence Number=SeqID_98950
MAKKTARTRRQREGDETYLGMVAKEKKQRLVTMLKCDEHDAQMQNRDLQGRRRLEEEEERVKASMEKKTARAS

SEQ ID NO: 215729 - protein, 66 aa, Glycine max
  Coding DNA Sequence Number=SeqID_98951
  Homolog annotation: Hit_ID=Q1SDP2; Match level="QueryCoverage=46%, HitCoverage=2%, E-value=3e-10, Identity=90%"; Hit description=RNA -binding region RNP-1 (RNA recognition motif); Aldehyde dehydrogenase
MGAGKLIVRKRRASLNDFDRFKIMLTKIKPCSNPDCLYLHEIGSQDDSFTKDEIISAYTRYFSNLK

SEQ ID NO: 215730 - protein, 50 aa, Glycine max
  Coding DNA Sequence Number=SeqID_98952
MDNLDNNGGGPARKEARLEVMLGKERRGRFGEGNLEVGARRIISRGSKGQ

SEQ ID NO: 215731 - protein, 222 aa, Glycine max
  Coding DNA Sequence Number=SeqID_98953
  Gene Ontology: Mol. function=phospholipase D activity; Biological process=lipid catabolic process
  Homolog annotation: Hit_ID=Q2HW42; Match level="QueryCoverage=44%, HitCoverage=9%, E-value=4e-34, Identity=85%"; Hit description =Phospholipase D/Transphosphatidylase; Pleckstrin-like
MYKIIGQSDWCVGLELAGVGFLVWFISREPLVSIADLTLFIYKELAVNVHYMECFGSFAPIRGLTEDRSQAQWFVDGQATFEAIATSIQDAKLEIFITGWWLCPELYLRRPFDSFSTSRLDSLLEEKANQGVQRTMLMPLNDPTDLCASLQGDLISQGSILGVEVNVSRKSYSTQLVVMEDENGNQNSAPPQNEGLLIPNIFTLTIPQVDGGSNLSIKVWWS

SEQ ID NO: 215732 - protein, 231 aa, Glycine max
  Coding DNA Sequence Number=SeqID_98954
  Gene Ontology: Mol. function=long-chain-fatty-acid-CoA ligase activity; Cellular component=mitochondrial inner membrane; Biological process=metabolic process
  Homolog annotation: Hit_ID=Q96537; Match level="QueryCoverage=98%, HitCoverage=34%, E-value=1e-98, Identity=74%"; Hit description=Acyl CoA synthetase
MCFLMTGTVGVPMTTIEARLESVPEMGYDALSNVPRGEICLRGNTLFSGYHKREDLTKEVMVDGWFHTGDIGEWQSNGAMKIIDRKKNIFKLSQGEYIAVENIENKYLQCPLIASIWVYGNSFESFLVAVVIPERTVIEDWAKEHNVTDDFKSLCDNLKARKYILDELNSTGQKHQLRGFELLKAIHLEPIPFDMERDLITPTFKLKRPQLLKYYKDRIDQLYKEAKGAMA

SEQ ID NO: 215733 - protein, 99 aa, Glycine max
  Coding DNA Sequence Number=SeqID_98955
MSTNAHYHTAHALNPILPLSEFIHLQSSNPCIHSKKDLTKSYLKTHQAKRYDEDMIKSKSKDSLEGLEGPMTRVRAKKVKEAIQQLLSILFEYKSKFQG

SEQ ID NO: 215734 - protein, 967 aa, Glycine max
  Coding DNA Sequence Number=SeqID_98956
  Gene Ontology: Mol. function=protein serine/threonine kinase activity; Cellular component=integral to membrane; Biological process=protein amino acid phosphorylation
  Homolog annotation: Hit_ID=Q2HSI2; Match level="QueryCoverage=99%, HitCoverage=100%, E-value=0.0, Identity=64%"; Hit description =Protein kinase
  Pfam annotation: Domain name=APH; Domain location=624-804; Score= -7.4; E_value=0.019; Accession=PF01636.13; Description=Phosphotransfer ase enzyme family
  Pfam annotation: Domain name=LRRNT_2; Domain location=25-66; Score =25.2; E_value=0.00024; Accession=PF08263.3; Description=Leucine rich repeat N-terminal domain
  Pfam annotation: Domain name=LRRNT_2; Domain location=327-367; Score =26.9; E_value=7e-05; Accession=PF08263.3; Description=Leucine rich repeat N-terminal domain
  Pfam annotation: Domain name=LRR_1; Domain location=116-138; Score =9.8; E_value=4.1; Accession=PF00560.23; Description=Leucine Rich Repeat
  Pfam annotation: Domain name=LRR_1; Domain location=140-166; Score =3.2; E_value=72; Accession=PF00560.23; Description=Leucine Rich Repeat
  Pfam annotation: Domain name=LRR_1; Domain location=168-190; Score =10.6; E_value=2.9; Accession=PF00560.23; Description=Leucine Rich Repeat
  Pfam annotation: Domain name=LRR_1; Domain location=192-214; Score =17.2; E_value=0.058; Accession=PF00560.23; Description=Leucine Rich Repeat
  Pfam annotation: Domain name=LRR_1; Domain location=241-263; Score =11.1; E_value=2.4; Accession=PF00560.23; Description=Leucine Rich Repeat
  Pfam annotation: Domain name=LRR_1; Domain location=265-287; Score =17.6; E_value=0.046; Accession=PF00560.23; Description=Leucine Rich Repeat
  Pfam annotation: Domain name=LRR_1; Domain location=288-309; Score =6.6; E_value=17; Accession=PF00560.23; Description=Leucine Rich Repeat
  Pfam annotation: Domain name=LRR_1; Domain location=371-393; Score =2.5; E_value=99; Accession=PF00560.23; Description=Leucine Rich Repeat
  Pfam annotation: Domain name=LRR_1; Domain location=395-417; Score =11.1; E_value=2.4; Accession=PF00560.23; Description=Leucine Rich Repeat
  Pfam annotation: Domain name=LRR_1; Domain location=419-440; Score =10.2; E_value=3.5; Accession=PF00560.23; Description=Leucine Rich Repeat
  Pfam annotation: Domain name=LRR_1; Domain location=93-114; Score =12.5; E_value=1.3; Accession=PF00560.23; Description=Leucine Rich Repeat
  Pfam annotation: Domain name=Pkinase; Domain location=622-898; Score =142.2; E_value=1.4e-39; Accession=PF00069.15; Description=Protein kinase domain
  Pfam annotation: Domain name=Pkinase_Tyr; Domain location=622-898; Score=137.5; E_value=3.6e-38; Accession=PF07714.7; Description =Protein tyrosine kinase
  Pfam module annotation: Pfam domain module=APH::LRRNT_2::LRRNT_2::LRR_ 1::LRR_1::LRR_1::LRR_1::LRR_1::LRR_1::LRR_1::LRR_1::LRR_1::LRR_1::LRR_ 1::Pkinase::Pkinase_Tyr; Domain location=624-804::25-66::327-367::116- 138::...
  Pfam module annotation: Domain location=140-166::168-190::192 -214::241-263::265-287::288-309::371-393::395-417::419-440::93 -114::622-898::622-898
MGMMKVSIFVFLTLMITMGCYGVTNPNDLRILNDFRKGLKNPELLKWPDNGNDPCGPPSWSYVYCSGGRVTQIQTKNLGLEGSLPPNFNQLYELQNLGLQRNNLSGRLPTFSGLSKLQYAFLDYNEFDSIPSDFFNGLNSIKVLSLEVNPLNATTGWYFPKDLENSVQLINLSLVNCNLVGTLPDFLGTLPSLTNLRLSGNRLTGAIPASFNRSSIQVLWLNDQEGGGMTGPIDVVASMTFLRQVWLHGNQFSGTIPQNIGNLTSLQELNLNSNQLVGLIPDSLANMDLQILVLNNNGFMGPIPKFKADKVSYDSNLFCQSKPGLECAPQVTALLDFLNNLNYPSGLASKWSGNDPCGESWFGLSCDQNSKVSIINLPRQQLNGTLSSSLAKLDSLLEIRLAENNITGKVPSKFTELKSLRLLDLRDNNVEPPLPNFHSGVKVIIEGNPRLGNQPVSSPSPTPFTSRPPSSAQPSPHDPSRSPSPPYSHMQPSPRQSPSSNSNQSSSVRLKPHRNGFKRFKTVAIVAGAAIFAFVALLVTSLLICCLKKEKASKVVVHTKDPSYPEKMIKFAVMDSTTGSLSTKTGISSLTNISGETESSHVIEDRNIAISIQDLRKVTNNFASENELGHGGFGTVYKGELENGKKIAVKRMECGAVSSRALEEFQAEIAVLSKVRHRHLVSLLGYSIEGNERILVYEYMPMGALSRHLFHWKNLKLEPLSLSQRLTIALDVARAMEYLHGLARQTFIHRDLKSSNILLGDDFHAKVSDFGLVKLAPDGQKSVATKLAGTFGYLAPEYAVMGKITTKVDVFSYGVVLMELLTGLMALDESRSEESRYLAEWFWQIKSSKETLMAAIDPALEASEEAFESISIVAELAGHCTSRDASHRPDMSHAVSVLSALVEKWRPVDEEFDYGSGIDFSQPLPQLLKDWKESEGKESSYTSAHSEGSIPARPTGFADSFTSADAR

SEQ ID NO: 215735 - protein, 103 aa, Glycine max
  Coding DNA Sequence Number=SeqID_98957
MSASVPDLHRSRTEQTHCEQTCLRLHGGAIIGGLLEDDPLRVGVRAAGESEEGGDTREIRRRMRPMNMVLFPFDAPSFILTFILIARPKLTFAPCETYEVHAR

SEQ ID NO: 215736 - protein, 113 aa, Glycine max
  Coding DNA Sequence Number=SeqID_98958
MPTNNGPRTKLGYENVYDRRVLPSVGPLCGIPPWYRFVILVGERDRLLNWDRLETSGLLCGDISGEVDHQWLGFALLNISGHPHDRHKLHWGCTIKGREIGRSSRDSPLPSGW

SEQ ID NO: 215737 - protein, 92 aa, Glycine max
  Coding DNA Sequence Number=SeqID_98959
  Gene Ontology: Mol. function=nucleotide binding; Cellular component =membrane; Biological process=intracellular protein transport
  Homolog annotation: Hit_ID=UPI00000482A1; Match level="QueryCoverage =92%, HitCoverage=7%, E-value=2e-11, Identity=41%"; Hit description =ATP binding / ubiquitin-protein ligase/ zinc ion binding
MMNIILKISQLAGRVEEKRRWSEGIHQTVEAKEGRFYCCGTYHILVTIQALPKVVSNDWDCQNRSRGKWELVRREVEVMFRQGYPVLVGTTR

SEQ ID NO: 215738 - protein, 87 aa, Glycine max
  Coding DNA Sequence Number=SeqID_98960
MSPVESTAVATYPLMGGRARLEGASSTKGKCAGVATNVYLRKTLENQKGSMNFKNKGLGVVYVRGWSTRAWLLLLRILEREEEFRPM

SEQ ID NO: 215739 - protein, 159 aa, Glycine max
  Coding DNA Sequence Number=SeqID_98961
  Gene Ontology: Mol. function=transcription factor activity; Cellular component=nucleus; Biological process=regulation of transcription, DNA-dependent
  Pfam annotation: Domain name=RVP_2; Domain location=28-133; Score= -59.0; E_value=0.04; Accession=PF08284.2; Description=Retroviral aspartyl protease
MAPSLPIPIEIQGDSSSLEIFLGANPQLSLNALVGMPTPETFQVYGLINHHRVTILVDEESTHNFIQSHVATFLDLPSSSTHHYMSWSVPIAIQGHKFTLDLYALSLSGADLILGVQWLKLLDPIMMDYNTLTMSFFHIGHPVTIHVDVPIYPSLALTQ

SEQ ID NO: 215740 - protein, 326 aa, Glycine max
  Coding DNA Sequence Number=SeqID_98962
  Gene Ontology: Mol. function=RNA-directed DNA polymerase activity; Cellular component=chromatin; Biological process=chromatin assembly or disassembly
CTWFAACPIGYMLVGCFANNTLFRKNHLVLKVILQLQVIPALSGGLLKVQSLGGYLNSLEVKYRYPLVVVPNEASAGRHENWMNFGGQQSSARMHKGVVRPFSQGEELEPLSGLIVNKSLEILFQNSIEHICLAARFRVCATMNPLRESSNHNQYGGITMGLGTKKLVKISNGVRVLKEDYSHCHPRSVHFQGEGNAYQKQPEHRDATKIDLFAKGQSGVGDFCVTSNESFVKFGETEEASKVCGGPLGAPKIELALRKLRENCFKERSEKFIHGGLKCGRGIAETERHDLELVMVLMGAKSNFGDVVLRHVNLVEPLSEVKLRKT

SEQ ID NO: 215741 - protein, 49 aa, Glycine max
  Coding DNA Sequence Number=SeqID_98963
MMQRSSTHATESKRMLRDEKLQRFGCKGLAPLLALSALPMISKHNDVGA

SEQ ID NO: 215742 - protein, 421 aa, Glycine max
  Coding DNA Sequence Number=SeqID_98964
  Gene Ontology: Mol. function=hydrogen ion transporting ATP synthase activity, rotational mechanism; Cellular component=proton -transporting two-sector ATPase complex; Biological process=ATP synthesis coupled proton transport
  Homolog annotation: Hit_ID=Q10MX4; Match level="QueryCoverage=82%, HitCoverage=78%, E-value=1e-119, Identity=55%"; Hit description =Expressed protein
  Pfam annotation: Domain name=DUF231; Domain location=250-421; Score =229.8; E_value=6e-66; Accession=PF03005.6; Description=Arabidopsis proteins of unknown function
MKPPRGKLPLPIIITTICVLLFIAVLYAERLSFLNSSSIFKSKTCPRKHNKSKSNDKKSEEVFANASWIDDRFDFDPEECNVANGKWVFNSSLKPLYSDTSCPYIDRQFSCVKNGRNDSDYLHWEWQPEDCTLPPFNPELALKKLQGKRLLFVGDSLQRNQWESFVCMVQGIIPEKKKSMKRGRVHSVFKAKEYNATIEFYWAPFLVESNTDIRIIGDPKKRIIKVDQITERAKNWTGVDILVFNTYVWWMSGLRLKALWGSFANGEEGFEELDTPVAYKLGLRTWANWVDSTIDPNKTRVFFTTMSPAHTKSADWGHKDGIKCFNETRPVKKKNHWGSGSNKDMMSVVAKVVKRMKVPVNVINITQISEYRIDAHSSVYTETGGKILSEEERANPLNADCIHWCLPGVPDTWNQIFLAML

SEQ ID NO: 215743 - protein, 94 aa, Glycine max
  Coding DNA Sequence Number=SeqID_98965
MEERWREREEQRRIREEARAEKRDALITALLNKLERQGICEWFTDQVIRKQPINFPTAFSAITGNNQNVNSKLTSKKKQKREEEVEMRRPTPSS

SEQ ID NO: 215744 - protein, 95 aa, Glycine max
  Coding DNA Sequence Number=SeqID_98966
MVAMRLTVTTTTVARSGDKNRKHQWRGVDDMRRGSENEEERGTPAVSISAGCTKQLPSLCRKHALVYTYGEYENMLPSWAVFMGIVLNIFPCFNL

SEQ ID NO: 215745 - protein, 481 aa, Glycine max
  Coding DNA Sequence Number=SeqID_98967
  Gene Ontology: Mol. function=malate transporter activity; Biological process=response to aluminum ion
  Homolog annotation: Hit_ID=Q14UU8; Match level="QueryCoverage=94%, HitCoverage=91%, E-value=1e-101, Identity=44%"; Hit description =Putative aluminum activated malate transporter
  Pfam annotation: Domain name=UPF0005; Domain location=36-420; Score =498.9; E_value=5.9e-147; Accession=PF01027.11; Description =Uncharacterised protein family UPF0005
MASPNTNQEKAGVLGRVLALPKVVKGKVLSICRLTKEIAQDDPRKVIHSLKVGLAISLVSLFYYYQPLYENFGLSAMWAVMTVVVVFEYTVGATLGKGLNRTIATLAAGALGVGAHYLASLSGATGEPILIGAFVFVQAAIASFIRFFPKVKARYDYGMLIFILTFSLISVSGFREVEVLEMAHKRLSTIFIGGSACVMISIFVCPVWAGEEFHYSIAHKLEILGYFLEAFVRVYFTMSKEGESEDNKGDSKDKSFLEGYKTVLNSKSVDDSLANFAKWEPGHGKFRFRHPWDLYLKVGALSRQCAYRMEALDAHINSDIQGSQEMRSTIQEQCSEMCLEASQAFKELGSSIRTMTMPSSSDTHVANAKAAVKSLKTLLQSSSWKETDLLSLIPAATVASLLIDIVEFTEKIADSVNNLATLTHFEVVDTDKSSTKAQQPSQSSPHCECVEPGPKTDSLQLVILIEDSALAVSDSEKSNRV

SEQ ID NO: 215746 - protein, 159 aa, Glycine max
  Coding DNA Sequence Number=SeqID_98968
MAWRSLAMVMSTVHPLKKAKGSTGDALMSRERSQCDAGQRCVIRHCKLTRGQCGGYQTGQIVGAGISKAMKKSQTRELSKSPKEEKHEVADAGLWKGRLTDSERKPAMLCVTLFTRTETQTLKEKKIVWRVMAAAAVTRKVIGKRERVAGRWAASRKVH

SEQ ID NO: 215747 - protein, 485 aa, Glycine max
  Coding DNA Sequence Number=SeqID_98969
  Gene Ontology: Mol. function=RNA-directed DNA polymerase activity; Biological process=RNA-dependent DNA replication
  Homolog annotation: Hit_ID=Q1S4Z4; Match level="QueryCoverage=94%, HitCoverage=68%, E-value=6e-43, Identity=27%"; Hit description=RNA -directed DNA polymerase
MDEFYVNGRFPKGTNALFLALIPKKALPDIIDERQTTFIEGGHMLHSVLVANEAVEEAKRGNKSCLVFKVDYEKAYNSVSCDVLVYMLRRMECCPKWITWIVGCLRSASILVFVNGNPSAEFFPQKGLRQGDPLAPLLFNIVAEGLTGLMREALHKKQFKGFMVGRNMVEISILTKNKLCKKSFPDDWDVNAVDEECSNIPKLQLVVCTFFLLRYSDGGKSKKITKKVVDNLVKLKRWFLWGGGLEQKKITCISWESACLSKEKEENGDGTGLIIKKNCGLECWTQNMEDGGTWMRRGGVLQNLFGGKTFVLSVMGLGRKASLNLDDEILLMVKYPRLYLISNEQNKYIQQMGSSAGGASEWILLWRRLLFEAEIVMGANFLEEIQDLTINVHQDKWVWMSDPNGIYTVCSAYKLLDKDSRDDNLDGAFKDIWKLKIPSKAAFFAWGLIWDRLSTKSNLCRRNVGKLGLAAGRMYEISTVRFLVP

SEQ ID NO: 215748 - protein, 53 aa, Glycine max
  Coding DNA Sequence Number=SeqID_98970
MWAVDIQFSQILEVLEQLYLYPFNLIKICSIFGAHWEMLKFYSIKLIHEFLKP

SEQ ID NO: 215749 - protein, 647 aa, Glycine max
  Coding DNA Sequence Number=SeqID_98971
  Gene Ontology: Mol. function=nucleic acid binding; Cellular component= intracellular; Biological process=RNA processing
  Homolog annotation: Hit_ID=Q6ETK6; Match level="QueryCoverage=88%, HitCoverage=60%, E-value=0.0, Identity=67%"; Hit description =Putative U2-associated SR140 protein
  Pfam annotation: Domain name=Surp; Domain location=14-59; Score=56.4; E_value=9.3e-14; Accession=PF01805.10; Description=Surp module
  Pfam annotation: Domain name=cwf21; Domain location=491-534; Score =53.2; E_value=8.6e-13; Accession=PF08312.2; Description=cwf21
  Pfam module annotation: Pfam domain module=Surp::cwf21; Domain location=14-59::491-534
MVTPPEDEHLRHVIDTMALHVLDGGCAFEQAIMERGRGNPLFNFLFILGSKEHTYYVWRLYSFAQGDTLQRWRTEPFIMITGSGRWIPPQLPMSKSPEHEKESGSTHAGGRSRRVEPDRTLTDAQRDEFEDMLRALTLERSQIKEAMGFSLDNADAAGEIVEVLTESLTLKETPIPTKIARLMLVSDILHNSSAPVRNASAYRTKFEATLPDIMESFNDLYRSIMGRITAEALKERVLKVLQVWADWFLFSDAYVNGLRATFLRPGNSGVIPFHSICGDAPEIEQNTTSKDMVVGGKTNQDAALAMGRGAAMKELMSLPLAELERRCRHNGLSLVGGREMMVARLLSLEEAEKQRGFELDEELKYAHNQVSSGKYSSNQRETSEEPDPVWNHYGDEDLQSQGRSSVPLSPTLPIAQPELKAFTKKEKNDPVLPASKWAWEGDESDDEQRRSGKNIGLSYSSSGSENVGDGLVKADESESAADTRFSAHADSGMNEEQRQKLRRLEVALIEYRESLEERGVKNLEEIEKKVQSHRKRLQVEYGLSDSGEDGHGHRRTSERRDWNDVSRKRHRSPSPSGSPLPKLYGKDRDREHHDLERDRDRQRDRSHDFDSERGRDRHREKSGSRERDDHDKDRSRDRDRDRRRRAK

SEQ ID NO: 215750 - protein, 67 aa, Glycine max
  Coding DNA Sequence Number=SeqID_98972
MGVGLGLLFTPSFLLSFPGVGGRNGRMRSNTDEEGHTTGKGIWYVVFFSIQKIKCWVEYILGFVKFK

SEQ ID NO: 215751 - protein, 130 aa, Glycine max
  Coding DNA Sequence Number=SeqID_98973
MPFTVYRDRARKTPSGLEEVQQGPRVLALITGLCWFYGVTTTPISPCRSVSMCVAQLIFDAIYCLRDCAYKTLSGPGEVQQGPGVSSSDYEPPSILRSARRPQQGHQAPINRAFIEKYCAPWQAQGEASQ

SEQ ID NO: 215752 - protein, 136 aa, Glycine max
  Coding DNA Sequence Number=SeqID_98974
MVERESCRENGREREKVAEKMVERGSCREEGEESKGRTKEGEGLVGEVKVLWNCDVLFSVCVWVGRCFSLFLRPLGKINGSEREEKGQILEKYLLQEPLSTVRVCRIVEQRRLWFEQCSSCLWTKLLFDMKFFMSL

SEQ ID NO: 215753 - protein, 601 aa, Glycine max
  Coding DNA Sequence Number=SeqID_98975
  Gene Ontology: Mol. function=RNA-directed DNA polymerase activity; Cellular component=chromatin; Biological process=chromatin assembly or disassembly
  Homolog annotation: Hit_ID=Q8S653; Match level="QueryCoverage=46%, HitCoverage=29%, E-value=5e-75, Identity=47%"; Hit description =Putative retroelement
  Subcellular localization annotation: CTP_CleavageSite=40; ConfidenceScore=5.31e-01
AFAKLSASMTSKFDELLNRMNQLETSRTNPHVPPMFASPSSATTTNSAYRLKLEWMYRNGQLSSWSTFLHAIHARFSSSAYEDPTRVLCKLTQRSTVSAYLSEFEALANRVIGLPAPFVLNCFVSRLSPAIRGEVQVMQPHSLAQAVSFARLHEEKLLDSRRPGVRSSPTTTSIPPSSRLWPPPSFNPSESSLLSSVAKPRSSTISFKRLTPTVLALRREQGLCFNCDEKYLRDHKCASSLFLFVTEEDEYAQEIDPEPLLPTLPPSSQDSSPAQISLHALSAGLFSEVASPKYFHAASDGGQWRGAAVQPDFAIPVASFGRHRALNAITVHDRFPIPAVDELLDELGGVVWFSKLDLMQGYHQILMKESDTSKTAFRTHHGQYEFRVMPFGLCNAPSSFQATMKRLFQPYLQKYIIVFFDDILIYSRNLEEHLNHLETAFQVLMDDYLGHIVSGNGVQPIPEKVQAIQRWPQPRTTRALRGFLGLMGFYHRLIKGYVAMATPLSQLLTKADFVWSPEAEHAFQTLKDAVTMALVLALLDFAKPFMVETDASGSDHRSLKELMNQAIQTPEQHRYLANLLGFDYAIKYRAGKSNVVADALS

SEQ ID NO: 215754 - protein, 106 aa, Glycine max
  Coding DNA Sequence Number=SeqID_98976
MIAAMLRGAGQVCEVGNPLKKGRFRGKKWRILPRLWKNQKALDEDMTKSKGKDPLEGLGGPMTRARARKSKEALQQVLSILFEYKPKFQGEKSKVVSCIMAQMEED

SEQ ID NO: 215755 - protein, 176 aa, Glycine max
  Coding DNA Sequence Number=SeqID_98977
  Gene Ontology: Mol. function=phosphoinositide binding; Cellular component=intracellular; Biological process=intracellular signaling cascade
  Homolog annotation: Hit_ID=Q2RAA5; Match level="QueryCoverage=99%, HitCoverage=17%, E-value=2e-51, Identity=54%"; Hit description=Phox domain-containing protein, putative, expressed
  Pfam annotation: Domain name=PXA; Domain location=53-173; Score= -41.8; E_value=0.089; Accession=PF02194.6; Description=PXA domain
MWMSLPMSILFVSCLCILLNKVEFHWKKNQLPLNDGHLTYSPPPPKWKKKINSPIVEAALNDFVDLILKDFVINMWYANITPDMEFPELVHDLIMHAIAEVSARVKEINLVDLLTRDIVDLIGDHIDLFRRNQAAIGVDVMLTLSSEERDGRLKFCLLNSKELHLALMSPKSEYKV

SEQ ID NO: 215756 - protein, 273 aa, Glycine max
  Coding DNA Sequence Number=SeqID_98978
  Gene Ontology: Mol. function=lyase activity; Cellular component =anchored to membrane; Biological process=cell wall modification
  Homolog annotation: Hit_ID=Q1SGJ9; Match level="QueryCoverage=98%, HitCoverage=74%, E-value=1e-139, Identity=85%"; Hit description =Pectolytic enzyme, Pectin lyase fold
  Pfam annotation: Domain name=Pec_lyase_C; Domain location=6-191; Score=241.5; E_value=1.8e-69; Accession=PF00544.9; Description =Pectate lyase
MHIRLEKPLLISSFTTIDGRGVNVHIVDNACLMIFKATNIIIHGLRIHHCRPQAPGMVMGPNGEVIPLGQVDGDAIRLVTASKIWIDHNTLYDCQDGLLDVTRGSTNVTISNNWFREQNKVMLLGHDDGYMRDKDMMVTVVYNYFGPNCHQRMPRIRHGYAHVANNLYMGWVQYAIGGSMEPSLKSESNLFIAPTSGRKEVTWRKSNGIGDSWEFHSVGDVFENGASFMETQGGQVPKPNYNPEQSFKVVDAKCVRSLTISSGVLRCSKTSIC

SEQ ID NO: 215757 - protein, 78 aa, Glycine max
  Coding DNA Sequence Number=SeqID_98979
MLQVQEAKNKLDVPKDAEEKLCDETKGHKLDITSDRDVQILDDTDRNHLEYTNTGPETAETRPKRTASRPSYLNDYEP

SEQ ID NO: 215758 - protein, 179 aa, Glycine max
  Coding DNA Sequence Number=SeqID_98980
MDDEAIKLSGSNRRPHSEITKNSKRGNAKANMETDNLDSVQEPKSETQLNTVPRKRGRNKTWEISQSRKACNCSSPYPSSEKPTSRKDKLHRMPKTVSETLVCMQKSENIAKAIQSRRTQNIGTDFLANDTSKVHEALASKPKADENTNAASVNNNYPDAGAISSAISSKTRSEKQVHK

SEQ ID NO: 215759 - protein, 1170 aa, Glycine max
  Coding DNA Sequence Number=SeqID_98981
  Gene Ontology: Mol. function=RNA-directed DNA polymerase activity; Cellular component=chromatin; Biological process=chromatin assembly or disassembly
  Pfam annotation: Domain name=RVP_2; Domain location=350-465; Score= -42.1; E_value=0.0019; Accession=PF08284.2; Description=Retroviral aspartyl protease
  Pfam annotation: Domain name=RnaseH; Domain location=817-938; Score= -29.4; E_value=0.032; Accession=PF00075.14; Description=RNase H
  Pfam annotation: Domain name=rve; Domain location=1052-1170; Score =8.7; E_value=0.0011; Accession=PF00665.16; Description=Integrase core domain
  Pfam module annotation: Pfam domain module=RVP_2::RVT_1::Retrotrans _gag::RnaseH::rve; Domain location=350-465::541-728::110-200::817 -938::1052-1170
MADHATRKTTTDRLEDAITRLSNSQTTLLDKHADLVDKYSELSGKVDTILDHLHLRSPAREHPGSSSHFHQRNSVKLDIPRFDGRDPMGWIFKISQLFEYQNTPEEERITVASFYLDGAALSWYQWMFRNGFITSWSGFLQALESRLAPSYYDDPKGALFKLTQRGTVNEYLTEFERLANRVIGLPPPFLLSYFVLGLAQDIRREVLALQPISLPQAMALAKLQEDKLRDRRQAPPRSHNTPSPSYVPTSRKAQSTYVQRTPDEMALRREKGLCYNCDEKWSSTHRCKGRILLFIADNPSLIQEEPIPEPSLPSIPEPTPASTLDFDTPSELNLPHVSLHAFSGLPSSETFRLVRVINHSSLTILIDSGSTHNFLQPRIAQFLHLKAQNTSPLHVLVGNGSVLDCNQVCPDTPLSLQGHHFTVTFHLLPISGAEAVLGIEWLRQFGPITTDCTTFSMKFTHMGQPIELHADVSTGPKPISTPQVKRLLQTGSASALFHLKLIHDPQPDPQLHLPHPIPAVEALLTQFQHLFQQPSSLPPPCSIVHHINLLPNTPPINVRPYRYPQFQKSEIKKQVSELLASGLVQPSMSPYSSPVLLVKKKDGTYRMCVDYRALNAATGFHQILMHGPDVEKTAFRTHQGHYEYRVMPFGLCNAPSTFQAAMNTLLTPFLRKFAAVFFDDILVYSRTLSLHLHHLELVFQTLRQGQYHLKKTKCLFAQKQVEYLGHIVSGKGVEPEPSKVEAMVKWPTPTSAKELRSFLGLTGFYRKFIKNYAMLAAPLTSLFTKDTFEWSLDAQSAFEQLKAAMTTAPVLALPDFEEPFVIETDASGAGMGMVLMQKGHPLAFFSKQFGPRMLHASTYVRELHAIVPAVRKWRQYLLGHPFTIFTDHKSLRELMSQVIQTPEQHYYLSKLLGFDYTIQYKVGSSNAVADALSRSPSFGEFLLLSVPNLDFMHDLRRTLHASSDFQDLLSKVRDHPENYPEYRIHQGLILFKNRIWLNDNNPSIPNLMLEFHATPLGGHLGDIKRFLKECHICQQTKSSTQRPTGLLQPLPPPTGIWEDISMDFITQLPPSHGYTVILVDVDRYSKGVHLGALPSNHSAFKVASLFIDIVCKHHGFLRSIVSDRDPIFLSSFWRELFRLSGTRLRMSTAYHPQSDRQTEVMNRVLEQYLR

SEQ ID NO: 215760 - protein, 79 aa, Glycine max
  Coding DNA Sequence Number=SeqID_98982
MHANVTNIPYKWTACRCFLKTFQIISRLVLVLKTCPKIIGILKNRVGNEQMSNHVTCVPFKEEALIKFQQRKITTIADC

SEQ ID NO: 215761 - protein, 59 aa, Glycine max
  Coding DNA Sequence Number=SeqID_98983
  Gene Ontology: Mol. function=oxidoreductase activity, acting on the CH-CH group of donors; Cellular component=glyoxysome; Biological process=electron transport
  Homolog annotation: Hit_ID=Q6J513; Match level="QueryCoverage=97%, HitCoverage=12%, E-value=1e-13, Identity=86%"; Hit description =Putative short-chain acyl-CoA oxidase
MEFWPISLWRRLKLGNLVAFCDLEPIYTYEGTYDINTLVTGREVTGFASFKPVAQRSRL

SEQ ID NO: 215762 - protein, 89 aa, Glycine max
  Coding DNA Sequence Number=SeqID_98984
MRLKVLMNYMTIEGGLTITVRKSEGDKGNHEVLEKASKRKIKHALNHVLVVLGSCLILMNSRSLHKLTQSMYDKTDVRPCGVEVLEAPN

SEQ ID NO: 215763 - protein, 72 aa, Glycine max
  Coding DNA Sequence Number=SeqID_98985
MKLLTVTVVDLYRFSWLRVEKGEAAGVSLSEAYALSKLHPLSEALGLLSAWRNPRRGSVIDARTQRSASSLR

SEQ ID NO: 215764 - protein, 74 aa, Glycine max
  Coding DNA Sequence Number=SeqID_98986
MRRVGRKTMRTLGLVCFLAAGDVIPTPTSCENCQVTPPPSGYPFYEAPPPPSQPPPPSSGYSIYGAPPPPSPHK

SEQ ID NO: 215765 - protein, 955 aa, Glycine max
  Coding DNA Sequence Number=SeqID_98987
  Gene Ontology: Mol. function=nucleic acid binding; Cellular component= intracellular; Biological process=DNA integration
  Homolog annotation: Hit_ID=Q1T010; Match level="QueryCoverage=99%, HitCoverage=99%, E-value=1e-176, Identity=35%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
  Pfam annotation: Domain name=rve; Domain location=377-502; Score =64.4; E_value=3.6e-16; Accession=PF00665.16; Description=Integrase core domain
  Pfam annotation: Domain name=zf-CCHC; Domain location=204-221; Score =31.2; E_value=3.6e-06; Accession=PF00098.13; Description=Zinc knuckle
  Pfam module annotation: Pfam domain module=RVT_2::rve::zf-CCHC; Domain location=640-811::377-502::204-221
MKGNLPILDEKNWDRWRIQMKAILGSQDVSDIVEQGLSALPDGATEEQKAAHKENKMKDCKAMVLFHQCVDEAHFQKISTATSSREAWKILERCNIGAEQLNKMEENERITIYLNRIISHTNAMKSKKVETLKVEELQGSLEAHEQRLMERSMARSGDQVLQATVSKKGGYGGRSSFRNQESSNKRGTSSKWRGGRKMVNSKNLKCFNCNKIGHFSTECTTPPAQNDNRGKHHKETHLAKEGIETNLKEKPFMLMMVTNHNPRDDERWYIDSGSSSHMTGHKNWFVNLDETKKSTVRFADYKSNLISLGQIDIHNGYLAIFEPVTEKLVIRTKMASNRTFQEMVLGLPAIQIPSKVCDSCLISKQPRNSFSNFTLSRANDLLHIVYSDVCGPFDAPSLGGSKYFVTFIDDLSRKIWIYSIQLKSEVFLVFKNFKALVEKQSGKCIKIFRTDGGGEFTSKEIEDFCKDQGIVHEVEAATTAVYVLNRCPTKKLDGKVPEEAWSRVKPSVRHFRIFGSLCYRHIPDQKRKKLDDKSEAMIFIGYNSTGSYKLYNPKKSEFEWEDENTIENVCDIINGTEEFQIDEARPQRQRNLPARLRDFEVYPDNAISKDGDLVQHMALLADTEPVSFEEAITSSVWRDAMLEEIKSIEKNNTWELVSLPAEKTPIVVKWIFKLKLKLDGTIAKHKARLVAKGFMQKEGLDYSEAPRAWNRRIDSFLAKTGFHKCSVEHGMYVKQLSQKAGDLYICLYVDDLLIKGEFEMTDLGVLSYFLGLEFHKHDCGLFMHHRKYLLEVLKKFKMLDCNPSKTPAEMSCKLDYKSLLVWRGTLDFGVLFPHHKEKDVVALSTCEAEYIAACSAACQACWLSSLLEELGVVTTDAIKLLVDNKSAIDLAKNPVSPGHSKHIETKFHFLRDQVTKRKIKLVLYKTKIQLANIFTKALKIDKFKELRMMMNILEL

SEQ ID NO: 215766 - protein, 162 aa, Glycine max
  Coding DNA Sequence Number=SeqID_98988
  Gene Ontology: Mol. function=chromatin binding; Cellular component =chromatin; Biological process=chromatin assembly or disassembly
  Homolog annotation: Hit_ID=Q1SAV4; Match level="QueryCoverage=97%, HitCoverage=49%, E-value=1e-28, Identity=38%"; Hit description =Integrase, catalytic region
MKVGTTPFENTFGRKPFNFPEYLAGTSKIDAVDELLYHRPETFTNFRKKLLIAQEKMKLVTDSKRRYVMFNVEKIGLVAYKLHLTEGAHIHHVFHCSLLKPFHGAPDKDTQLPLLETVVDNHPLVTPLAIVDSRRVLGSSSPKWEVLTQWDGLSPDDTSWED

SEQ ID NO: 215767 - protein, 106 aa, Glycine max
  Coding DNA Sequence Number=SeqID_98989
  Gene Ontology: Mol. function=RNA-directed DNA polymerase activity; Cellular component=chromatin; Biological process=one-carbon compound metabolic process
MWPENGIHGCLERRWGIAKPKGHHSKFKMTVMGAKGGLTDILFIHAYLVGPLEKSMQKHQDPSCFLTKRIGDENGLVLGLMIPFCRRSPASQFPASDSGGNDMGVH

SEQ ID NO: 215768 - protein, 298 aa, Glycine max
  Coding DNA Sequence Number=SeqID_98990
  Gene Ontology: Mol. function=RNA-directed DNA polymerase activity; Cellular component=chromatin; Biological process=chromatin assembly or disassembly
MAESTRSKASSDRLEDAIAKLTTHHLSMTETVQTMTLKLDKLIHNNGQFTSWSGFLQALQTRFAPSQYEDPTGALCKHTRCSTVSTYLSEFEDLANRIVGLPSPFLLSCFISGLTPEICREEEKLLDARSLSRACPHTLVAPPPRPLSSIVTPLLPAPVKTPTLVPLKRLTPDELASRRERADEEDATQDDPTQLEQPHDPPDATNPMQAQITIHSLSGTIGATIGPRYSDHTSTTHHAWKWLPPSLVVLGVQWLKTLGPIMTDYNTLSMKFFHEGHLVEFQGDTDLVSVLLTPPQLR

SEQ ID NO: 215769 - protein, 173 aa, Glycine max
  Coding DNA Sequence Number=SeqID_98991
  Homolog annotation: Hit_ID=Q1S563; Match level="QueryCoverage=97%, HitCoverage=94%, E-value=3e-54, Identity=62%"; Hit description =Leucine-rich repeat
MAFKKTLAQRLLNITKISNYRISSSEVRSPNPTKADIAPDPGDNRRFLHKRTAVFPPELRPPPPAGSLLQRLREMDISKSRIRLDGLAPPETDQLVAPEHVRKVIRAVQIETVKSKLRKVPQSCVSYSEFIRMCSENCSDQEQAMSVAKILDDSASVIIIGDVVFLRPEQTGK

SEQ ID NO: 215770 - protein, 238 aa, Glycine max
  Coding DNA Sequence Number=SeqID_98992
  Gene Ontology: Mol. function=RNA-directed DNA polymerase activity; Cellular component=chromatin; Biological process=chromatin assembly or disassembly
MTTLVLSLPDFVVPFTVEIDASGIGMGAVLLQNGHPVAFFSKSLKELHTQVIQTPEQQRYLARLMGYDYCIKYRSGSTNIVADALSRAPHSSSATLLVLSVPCLTFLDELKKHLLCNPRFIQLRRDIRAQLDAYSDYSVAQNLIMKGGSIWSPRGGFEGMSRNSSRHASIWACCLRLILPLLSHYYSSTSLENYMECLGVWCPIGIRVPEPLLAEAIPLEWYSPEDDLYISPPKRRLD

SEQ ID NO: 215771 - protein, 151 aa, Glycine max
  Coding DNA Sequence Number=SeqID_98993
  Gene Ontology: Cellular component=integral to membrane
  Homolog annotation: Hit_ID=Q1S566; Match level="QueryCoverage=73%, HitCoverage=59%, E-value=4e-38, Identity=48%"; Hit description =GNS1/SUR4 membrane protein
MAEEVELVSCGHVLRKANQVVDAWQNEDPRADPIAPALEEEVEEEDGDVAGNIAGEEHDLAAEDEGEARAAEADGGPEADSEEGAEHVEEAGEGGFGAPPEPPRVADLGGGREEDAGEDRGGDEGHGEAVDGGKGAERDLTAAEEERKREV

SEQ ID NO: 215772 - protein, 128 aa, Glycine max
  Coding DNA Sequence Number=SeqID_98994
MAPPGTILTVEQFIEKVAWPRTLPSLIREGGGPSAQVPQQVQDASSEATIPEPFVFEAGGTQELADPPSPVHEMPTYPSTPLLEIPKDPATPVLGLTTTPPTTPMLHFTDEEGTQDQDTQRDDQSQEF

SEQ ID NO: 215773 - protein, 115 aa, Glycine max
  Coding DNA Sequence Number=SeqID_98995
MDKARLVYGLVTHVDMNIGALISSQISAIAQSNSSRLGFPALIIALCRARGVTFGSLTYESLSPTINLAYIKKNCWNMDDLTVNFRGARKARARPAYAPSSSTPPAPPGLSAQDF

SEQ ID NO: 215774 - protein, 137 aa, Glycine max
  Coding DNA Sequence Number=SeqID_98996
MVSLASHYHERLTNTKGLPRWLLALSGLLGLSGPDALSEVYYSAWTESFVTIAIILNDVSSIGACRPRIFFINGFLCFLEDEWQRNGERKREMRRHFKEKMSLEEAHHHRRPWIRAWRKKEMNEGRGREEHEILCSK

SEQ ID NO: 215775 - protein, 209 aa, Glycine max
  Coding DNA Sequence Number=SeqID_98997
  Gene Ontology: Mol. function=phosphoinositide binding; Biological process=intracellular signaling cascade
  Homolog annotation: Hit_ID=Q2RAA5; Match level="QueryCoverage=71%, HitCoverage=17%, E-value=2e-15, Identity=33%"; Hit description=Phox domain-containing protein, putative, expressed
MEQHHKCWRLQLREELKFLCPRILRKCGHKLESSPDHDKEFSSETDHRVDEVKDFNKYKDSLKRFSSASLVGIQTHEGGSPRSEFHTAESEKHGEGFLGKSSFDMVFRREAHVVPKLQCRVLGAYFEKLGSTSFAVYSIVVTDGQEKTWFVRRVVLLQDLLSTTNIAKQHEVWDFLSVSSKVIAILSMVTHELGFSIMAPHAGAFGLKA

SEQ ID NO: 215776 - protein, 110 aa, Glycine max
  Coding DNA Sequence Number=SeqID_98998
MGNNQSIYGPIGISSNDYSQPLIDHGSESSNLDLDRKHNATMEAKVGKDVPATNFKLVPDNLEDVPPEVYSQLGLLSFLLCTTHLLIVIFGIKLLNVMLPTWQSWGLHLD

SEQ ID NO: 215777 - protein, 146 aa, Glycine max
  Coding DNA Sequence Number=SeqID_98999
MSCTDSLSALLHLSKRTASVHPLSEKGALTQKSLTCAKQSIRSLDWDSELCMSRVCKERKVQVPESFERFCCVKICRDQSLKQEPMHALLGSFNSGNWSDSKVLDSAGLSCRAFARNQGAISQLSMCVLMRSWLSLVLQEESADEA

SEQ ID NO: 215778 - protein, 190 aa, Glycine max
  Coding DNA Sequence Number=SeqID_99000
  Subcellular localization annotation: CTP_CleavageSite=40; ConfidenceScore=5.02e-01
MTNLWLSECCLAKPSVACAKRRPRGLSAKRRPRGLSAIPCGMHKAKPALLTKPLVEIKVLWEFDEFKVELERRNLHKRLTNLQDGSIDVVVVKEFYANLYTTEDQAPKQARVREHLIKIDADSLNEFLHIPVVLEEEESLPTNSRFCRLRSNPQEIEAKLYIPRKGFILNAEGQPWKLLRKDLTTLAQTW

SEQ ID NO: 215779 - protein, 138 aa, Glycine max
  Coding DNA Sequence Number=SeqID_99001
MVKEVTQAVGRREEEFVEVEAQEKSLVNEHDLKEEDKEKVQQWEQCSQVHTQQENNLQVNTFPHQLIVKEERHEDHEVPIILGQPCLSTASCVLDMGKGKLELSVETLELSVDQKISFDLFEAMKHPDDSEHVLKKKR

SEQ ID NO: 215780 - protein, 56 aa, Glycine max
  Coding DNA Sequence Number=SeqID_99002
AKLMARLRRSNVRLSETTPRAWHKVVIKAGNPSLEELDWAMEVIYPEMRVSMFMSI

SEQ ID NO: 215781 - protein, 190 aa, Glycine max
  Coding DNA Sequence Number=SeqID_99003
  Gene Ontology: Mol. function=nucleic acid binding; Biological process= DNA integration
  Homolog annotation: Hit_ID=Q1SDY9; Match level="QueryCoverage=54%, HitCoverage=19%, E-value=6e-27, Identity=55%"; Hit description =Peptidase S8 and S53, subtilisin, kexin, sedolisin; Zinc finger, CCHC- type
MRHHLKAYDLWEVVETAEPPTLEENPTIAHIRFHNEQVAKRAKAFSILHSTVDDDIFMRISNLDTTKEIWEKLQVEFFGNERTKKMKVLNHKREFEALKMNEAETESGCLLKSEVFSVFKKFKVLVETESGCLLKKLRTNNGEEYTSVEFNSSCDGLGVELQLIVNYSPQQNGVAEKNILVLEMARCMIF

SEQ ID NO: 215782 - protein, 106 aa, Glycine max
  Coding DNA Sequence Number=SeqID_99004
  Gene Ontology: Mol. function=phosphoinositide binding; Biological process=intracellular signaling cascade
  Homolog annotation: Hit_ID=Q2RAA5; Match level="QueryCoverage=99%, HitCoverage=8%, E-value=4e-18, Identity=45%"; Hit description=Phox domain-containing protein, putative, expressed
MEAVIDDWLLSEIHWLCKEETVAQGIQWVQDCLTTSFLQILWPGGTFFLRVQTPQVLIGSSACDQKPLPTINEFGGSIIAKSQSGSFEQQLEATRRASELKKLLFG

SEQ ID NO: 215783 - protein, 202 aa, Glycine max
  Coding DNA Sequence Number=SeqID_99005
  Gene Ontology: Mol. function=nucleic acid binding; Cellular component= chromatin; Biological process=DNA integration
  Homolog annotation: Hit_ID=Q0ZCC5; Match level="QueryCoverage=46%, HitCoverage=4%, E-value=5e-26, Identity=58%"; Hit description=CCHC -type integrase
MDTICILVALPAQMRWIIWHLDVKSAFLNGHLTKETYVVQPEDFVVKGSVNKVYNLHEALYGFKQAPKAWYSRIGAYFCSQGFRRRENDATLYVKKLLDDGSSMFSWNSKKQGIVAQSTIEAEYVAVAGAASQDIWLKKIMFDLGVEQFQETEIYCDSKSTIVIAENPNQHGKTKHIQVKFHVVHEAVKNCEIKLIHHCSDN

SEQ ID NO: 215784 - protein, 151 aa, Glycine max
  Coding DNA Sequence Number=SeqID_99006
MHALLGSFNSGNWSDSKVLDSAGLSCHAFTRNQGAINSLYTCSYSHLLLHTRRLFAEIAYQITQVPRVFDTQFLPFYTTCAIWCTCQKPNNGPHTEARIPIVEHVNIHDTREKGKVVASSRKQDLKSWKRATRNSNGGGDGKMLISCNGQR

SEQ ID NO: 215785 - protein, 468 aa, Glycine max
  Coding DNA Sequence Number=SeqID_99007
  Gene Ontology: Mol. function=catalytic activity; Cellular component =intracellular; Biological process=metabolic process
  Homolog annotation: Hit_ID=Q1SCU6; Match level="QueryCoverage=63%, HitCoverage=98%, E-value=9e-81, Identity=48%"; Hit description =Tetratricopeptide-like helical
  Pfam annotation: Domain name=PPR; Domain location=159-193; Score =37.9; E_value=3.5e-08; Accession=PF01535.11; Description=PPR repeat
  Pfam annotation: Domain name=PPR; Domain location=279-313; Score=7.4; E_value=0.98; Accession=PF01535.11; Description=PPR repeat
  Pfam annotation: Domain name=PPR; Domain location=315-349; Score=4.4; E_value=2.2; Accession=PF01535.11; Description=PPR repeat
  Pfam annotation: Domain name=PPR; Domain location=381-415; Score=8.2; E_value=0.81; Accession=PF01535.11; Description=PPR repeat
  Pfam module annotation: Pfam domain module=PPR::PPR::PPR::PPR; Domain location=159-193::279-313::315-349::381-415
MNFFGRPCKNYYFRSHSKSVSTYGVLESLSGMNGSIAKPIKYVLCTALSSCAKSLNWHLGIQIHAYMIRSGHEDNLFLSSALVDFYAKCFAIVDARKCSVCVGQNGALEHCSTLHASVIKRGYDTNNFVVSSLIDCYANSGQIDDAALLFDETNEKDIVVYNSMISGYSKNLYSEDTLKLFVEMRGKNLNPTDHTLCTILNACNSLAVLFQGRQVHSLVIKMGSEGNVFVASALNDMYSKGGNSDEAQCVLDQTSKKNNVLYHGLCSMWVRLELIPDHICFTAVLTACNHAGFLDKGVEYINKMTTNYGLSPDIDQYACLLDLYAGNGNLSKARDLMEEMPYDPNYVIWSSFFSSCKIYGDVELGREAADQLIKMKPGNAAPHLTLAHIYARKGLWNEVAEVRRLMQQRRIRKPAGWSWVEVDKQIHVFAVDDVTHQQSNEIYRELEYIYLGIIEASSYVVEDSNILA

SEQ ID NO: 215786 - protein, 41 aa, Glycine max
  Coding DNA Sequence Number=SeqID_99008
MKLYGGPGKLEPSLGEPRYIYFFQGLETEDIESYKAQRQGR

SEQ ID NO: 215787 - protein, 376 aa, Glycine max
  Coding DNA Sequence Number=SeqID_99009
  Gene Ontology: Mol. function=protein binding; Cellular component =peroxisomal membrane; Biological process=protein import into peroxisome matrix
  Homolog annotation: Hit_ID=Q6YT74; Match level="QueryCoverage=75%, HitCoverage=98%, E-value=1e-27, Identity=60%"; Hit description =Putative glycine-rich protein
MFDWNLDEIARWFTLYTPQGIGPTLEYRNYKTKVLPKPPQSHKPKPETYHRLYGVSPQFPWSLRHNPKPNFTCAHTFNEVLLFANSPPPKPWEQAGSSSGPAPFKPPSAGNTSDVVEASGTAKPGEIVSSSDRSAAVNRNTLGRPVPTRPWEQNYGNSTYGGYGSTMNYNSGYGSGMYGSSYGGLGGGMYGSSYGGGMYGNSMYRGGYGGMYGSSGMYGGGMYNSGLGGPMGGYGMGGGPYGEQDPNNPYGAPPSPPGFWISALRVMQGVVNFFGRISILIDQNTQAFHLFMTALLQLFDRSGMLYGELARFVLRLLGIKTKSKKVHPPGPNGQPLPGPGPGPGPHNPSGNVNYIEAPKAAPSGSWDNVWGNDANQ

SEQ ID NO: 215788 - protein, 40 aa, Glycine max
  Coding DNA Sequence Number=SeqID_99010
MAKVCEFPPPGNALDDNMLNVSSDRYWTEQPSWPMLSKSN

SEQ ID NO: 215789 - protein, 490 aa, Glycine max
  Coding DNA Sequence Number=SeqID_99011
  Gene Ontology: Mol. function=Rab GTPase activator activity; Cellular component=intracellular; Biological process=regulation of Rab GTPase activity
  Homolog annotation: Hit_ID=Q655M0; Match level="QueryCoverage=99%, HitCoverage=75%, E-value=1e-132, Identity=52%"; Hit description =Putative GTPase-activating protein
  Pfam annotation: Domain name=TBC; Domain location=319-490; Score= -56.6; E_value=0.0015; Accession=PF00566.9; Description=TBC domain
MELWKSWGSKFAESEFHRARHWGSLPFAVACKVFFMEQVNRMLKPDKWQAMSDSEGKVFGFRKALKLIVLGGVDPSIRPEVWEFLLGCYSLSSTAEYRRRLRAARSVGTGSLAYVVGSKLMDLRTSSKDGRKSQAKIEESTYNDNNVEVGKCYDRNIICTEGENSSHWESSNNGVDLVSLRVCTDNAACDSSGQRNSSSPKLGGEVEESDCVTECSFDFPPLSVTNLFEKSGKDKNSGTEHGDKLPAPGQSRFEVDSMRSFRINNNVDLVIESNCQQPLATLHPMDSEIGIASPDEEEPELLSENQVYEAQMVTQLKISDVPQPAMIRSPISQGWPISEERVSEWLWTLHRIVVDVVRTDSHLEFYEDTRNLARMSDILAVYAWVDPSTGYCQGMSDLLSPFVVIFEDNADAFWCFEMLLRRMRENFQMEGPTRVMKQLRALWHILELLDKEMFAHLSKIGAESLHFAFRMLLVLFRRELSFNEALSMWE

SEQ ID NO: 215790 - protein, 1097 aa, Glycine max
  Coding DNA Sequence Number=SeqID_99012
  Gene Ontology: Mol. function=zinc ion binding; Biological process =regulation of transcription
  Homolog annotation: Hit_ID=Q7X9C0; Match level="QueryCoverage=98%, HitCoverage=98%, E-value=0.0, Identity=69%"; Hit description=NIN -like protein 2
  Pfam annotation: Domain name=PB1; Domain location=997-1079; Score =72.9; E_value=1e-18; Accession=PF00564.15; Description=PB1 domain
  Pfam annotation: Domain name=RWP-RK; Domain location=712-763; Score =118.3; E_value=2.1e-32; Accession=PF02042.6; Description=RWP-RK domain
  Pfam module annotation: Pfam domain module=PB1::RWP-RK; Domain location=997-1079::712-763
MEYPFSPKDRVIGDWQSSGAQLEGSASLDGRMINSISEDMPNSFSELMNFDTYAGLCYSPSITDQILANELPSFAPLSYPLPDGFNPVQLNSGQCCMSGVGRNNNDTENSSLYGEKVVCQQMDTLLGFLNDTNEANNLNSKLKINVSSQHLNNSDTGNYMMSRPPGLSLDERMLRALSFFKESAGGGILAQVWVPIKDGDQFILSTSEQPYLLDQMLAGYREVSRTFTFSAEGKSGCSLGLPGRVFTSKVPEWTSNVGYYSMSEYLRFEHAINHKVCGSIAFPIFDLHSELPCCAVLELVTTNEKPDFDRELEIVCRALQACFYFSSVTSLSALFACLTTSHVESDDLDVLIKNYHEEFSTLADKVSYVFIGQYLVGLLPKTKEALSYQLEMPLSSVKDQILKDIIHHEIHLNNLFQCASDVEGSNDKCIYHGFLQLVNLRTAKPLRCLPQCLSNNKKATLTEIVDVLRSVCHAHRLPLGLTWIPCCFTECSRGEASSIRIEGGHSTSRGKNILCLEESACYITDRAMGGFVRACMEHRLEEGKGIAGKALQSNHPFFYPDVKTYDISEYPLVHHARKYNLNAAVAIRLRSTYTNDDDYILEFFLPVNMKGSSEQQLLLDNLSGTMQRICSSLRTVSETELSGMESLAVGLGKKNAPSFFPLSSRNSEIPLINGDCDSVQKATNLRDNEIESSPNQERNGSKRQVQKNRSTSEKNVSLSVLQQYFSGSLKDAAKNIGVCPTTLKRICRQHGIPRWPSRKINKVNRSLKKIQTVLDSVQGVEGGLKVLDSVQGVEGVLKFDPSMGAFVAGGSIIQEIDAHKSTIKDPVPVAQDAFSVRPAPCSEGENFSIKLEGKLKKTNVSSVNYSEDSKSMAINDGSCQTASLCTKVQDCPEQACLGSVLAKEHDKRILNKGGLSVEKFKRNIVGQSSKTLIGDEMDIGVDGDDGVVERNHPTSSSLIDSSNGSGSMMHSSSSGSQSFKNQDQSKVKSTIVDSRSKLIVKATYREDTIRFKFDPCAGCFSLYEEVAARFKLQNGLFQLKYLDDEEEWVMLVNNADLQECIEILDDIGTRSVRFLVRDMPSVLGSSGSSNSYLGGSS

SEQ ID NO: 215791 - protein, 151 aa, Glycine max
  Coding DNA Sequence Number=SeqID_99013
  Gene Ontology: Mol. function=hydrolase activity, acting on glycosyl bonds; Cellular component=extracellular region; Biological process =polysaccharide catabolic process
  Homolog annotation: Hit_ID=P27054; Match level="QueryCoverage=98%, HitCoverage=60%, E-value=3e-72, Identity=86%"; Hit description =Endochitinase PR4 precursor
  Pfam annotation: Domain name=Glyco_hydro_19; Domain location=6-151; Score=163.2; E_value=6.6e-46; Accession=PF00182.9; Description =Chitinase class I
MTLVDLVPRMTPSARLQLLLPISHMKLDDYCDENTISQYPCLSNRGYYGRGPIQLTWNFNYGPAGQSNDFDGLNAPETVGNDPVISFKTALWYWMQHVRPVINQGFGATIRAINGQLECDGANPSTVQARVNYYTDYCRQFGVATGDNLTC

SEQ ID NO: 215792 - protein, 215 aa, Glycine max
  Coding DNA Sequence Number=SeqID_99014
MGNCLRTSEKLTAEIVPHGGATVYPAVRLHGSPNSIFAAYTRFAVLHNAVPPDPVLAAAPPPQAPTAFCGGRSEAAVPVVFHVGHDVASGSRDALLRFIDLKFPDLAEEETAPPPPAESGGGKEETSLVVRVTRLQHKSMTWHLERMVGWAEDLATRGGTRAVDPKVGTWKMEVVKFGRSYSQLLEVMLEHAQMEERVLFPIFDSADRASLAPRC

SEQ ID NO: 215793 - protein, 177 aa, Glycine max
  Coding DNA Sequence Number=SeqID_99015
MENKGNDDDENGDGCPCPVKLSDCLEELVRLTLNSHSHHLNLSSQFFSNFSRMTQRTHHLHTHNHNQTLKRLFFIWVSSNSLEGVPPYPLYKRIASALLRCMESETFCRIGGNLAMTNEFEDSSIQQKRNEWHKLIVEKGFEIENVNAVLSVAFLCYALVHLPQKLVLISVLLFQQI

SEQ ID NO: 215794 - protein, 74 aa, Glycine max
  Coding DNA Sequence Number=SeqID_99016
  Gene Ontology: Mol. function=isomerase activity
  Homolog annotation: Hit_ID=Q53LS7; Match level="QueryCoverage=63%, HitCoverage=13%, E-value=8e-10, Identity=64%"; Hit description =ProFAR isomerase associated, putative
MAYCCWLNVHTVPPHGVVFEIRVAGGYGARWTEDGSKSPTCKMVTQRDGSTSSAGQATTTAPLYLNVTRFPFIL

SEQ ID NO: 215795 - protein, 540 aa, Glycine max
  Coding DNA Sequence Number=SeqID_99017
  Gene Ontology: Mol. function=serine-type endopeptidase activity
  Homolog annotation: Hit_ID=Q1RW49; Match level="QueryCoverage=91%, HitCoverage=83%, E-value=7e-24, Identity=21%"; Hit description=IMP dehydrogenase/GMP reductase
  Pfam annotation: Domain name=Synaptobrevin; Domain location=184-274; Score=-0.6; E_value=0.049; Accession=PF00957.11; Description =Synaptobrevin
MKSRSDTDYQNNVSEAIIQPDNTIRVDPLDHFQKYRGGFNITNKHYWSVNLYCPFSFLNSAIFTGVYGYAIGVLCILCGIVCGTFLAISTACHKNDGGRRMKKARVKIVFQIENGMVIDLSQLGHGGHRYKERHELCNISTIDKFSFESNSESDQYIYLIAATGLVLAGSARFHSEAKNSVNIIIKTANEASETIHNTTGVLKDMESNFMEANVKADASVNLDSTTERLDDASANIEKQARKNRRLIYKSLKLVFIITTVIISLNLAAVIALSVSGVLRLRRALYLLVVLCWLMTVICWLFFGAYFFLEKFSGDVCTALDSFQENPYNNSLSSILPCDELLSAKSVLSDVSAGIYVLVNKVNANISAMQATSAVNLVQVCNPFSAPPKYSYQPENCPANTIRIGDIPKVLKPFSCLNVTDGTCDNGDLIPGSEYMRVEAYTSSIQDLLNVYPSMEALLKCQVVKDAFSQVLVNHCKPLKKYAKMVWLGLLFLAVIMVLLVVLWTIKASHEHRYHLSDGSVEPHSAPTKALESGPIKEIEI

SEQ ID NO: 215796 - protein, 105 aa, Glycine max
  Coding DNA Sequence Number=SeqID_99018
MSPRRCATHANLENIIQWIEITRLQLKVAHLTQQLGALQPQPLHHDDDNHLVMDDNDFDIDKYPFDVLPQSDCYWEVEFEVDISGFDINIEPIYNIDVEVDDVNK

SEQ ID NO: 215797 - protein, 82 aa, Glycine max
  Coding DNA Sequence Number=SeqID_99019
MALQLIQHNDNAFHPHALLIRKIQSYKNWQWEVQLSPLVFVDAIVSGHCPVIESDISSCGGTTKISKKGGKLEEALIEGEVG

SEQ ID NO: 215798 - protein, 418 aa, Glycine max
  Coding DNA Sequence Number=SeqID_99020
  Homolog annotation: Hit_ID=Q10QE9; Match level="QueryCoverage=87%, HitCoverage=97%, E-value=1e-82, Identity=44%"; Hit description =Expressed protein
  Pfam annotation: Domain name=DUF677; Domain location=42-372; Score =551.1; E_value=1.1e-162; Accession=PF05055.3; Description=Protein of unknown function (DUF677)
  Pfam annotation: Domain name=DUF793; Domain location=8-370; Score= -235.7; E_value=0.082; Accession=PF05633.2; Description=Protein of unknown function (DUF793)
  Pfam module annotation: Pfam domain module=DUF677::DUF793; Domain location=42-372::8-370
MGGQSSKMFSVESPTPIKMGTHSLYAADLSSYEAACVKDPNLQSFDVSIQEHTNRVISSLAHGVEVRSLSFDSLREMTDSLLEMNQEVVKVILDCKKDIWGNSELFSLVNDYFNNSLQTLEFCNSLEKCLRRARENQMIVKSVVTYFEEEGQNGADGVTYVKTLQELKKFKDARDPFTEEFYLLFQSVYAQQASMLQKLQIRKRKLDKKLKSLKTWKRVSNVIFVAAFVSVLIFSVVAASVAAPPVVTALAAALAVPIGSVGKWCNSLFKRYEKALKGQREVISSMQIGTFISLKDLDNIRVLVNKLEGVLESLLQNADFAIKNEDVMKFAIDEIKKKIEAFSETMENLSTHADKCCRQIRRARTVVDLVVVMVFGSLMVDFVMAEGGDIATTHSSSGAMVVRGAELVAWGVRLRLNE

SEQ ID NO: 215799 - protein, 209 aa, Glycine max
  Coding DNA Sequence Number=SeqID_99021
  Homolog annotation: Hit_ID=Q9LUA7; Match level="QueryCoverage=87%, HitCoverage=57%, E-value=5e-28, Identity=39%"; Hit description =Arabidopsis thaliana genomic DNA, chromosome 5, P1 clone:MIF21
  Pfam annotation: Domain name=DUF868; Domain location=24-209; Score =172.0; E_value=1.5e-48; Accession=PF05910.3; Description=Plant protein of unknown function (DUF868)
MKEFPSCFGENGVQVVDSSYSSTTRGAQNAVTCVYQCKLGGRSCLITVSWTKNLMGQGLSVGIDELGNHCLCKVDIKPWLFSKRKGSKNLEVESNKIDILWDLSCAKFGSGPEPLEGFYLVVVFNQEMVLLLGDLTKEACKKIDSDYACAHSEAVFIAKREHIFGKKFYGAKAQFYDKGQVHDVRIECDTLGLNDPCLVIRIDRKTVMQ

SEQ ID NO: 215800 - protein, 1520 aa, Glycine max
  Coding DNA Sequence Number=SeqID_99022
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=96%, HitCoverage=97%, E-value=0.0, Identity=60%"; Hit description=Chromo
  Pfam annotation: Domain name=Chromo; Domain location=1402-1456; Score= 44.8; E_value=3e-10; Accession=PF00385.14; Description='chromo' (CHRromatin Organisation MOdifier
  Pfam annotation: Domain name=RnaseH; Domain location=850-970; Score= -19.7; E_value=0.004; Accession=PF00075.14; Description=RNase H
  Pfam annotation: Domain name=rve; Domain location=1099-1255; Score =115.9; E_value=1.2e-31; Accession=PF00665.16; Description=Integrase core domain
  Pfam annotation: Domain name=zf-H2C2; Domain location=1040-1081; Score=16.0; E_value=0.0027; Accession=PF09337.1; Description=His(2) -Cys(2) zinc finger
  Pfam module annotation: Pfam domain module=Chromo::RVT_1::Retrotrans _gag::RnaseH::rve::zf-H2C2; Domain location=1402-1456::610-795::111 -201::850-970::1099-1255::1040-1081
NADDIKKLYDEVQIQFERFGAVTDARFQTMEDLQSSTDGKLDKINEALLMLLRNSSQTSSHGVTNSNKAPFQVRNVKLDFPRFDGKNVMEWIFRAEQFFDYYETPDKDRLTITSVHLDQDVVPWFQMIQRTHPFNSWAEFTRALELDFGPSIYDCPRATLFKLSQTGTVSDYYRQFTALANRVYGLSTDALVDCFISGLNPDIRRDVMVHTPINIVKAVSLAKVYEEKYTSNTKPQKYQNPNTQYQNRAHFNSNKPEINQKPTNTPLLPTPPTRPMDINQKNPNIKRITPAEMQLRKDKGLCYWCDEKFSFSHKCPNKHLMLLQSDHEPENAAEEETEPPDQPQNIINQTHTEHHLSLNAMKGANSLGTMRFMGKIGKLQVQILIDGGSSDNFVQPRIAHFLKLPVEPAPCFKVLVGNGQTMTAEGVVTQLPIVIQEHEMLIPVYLLPVAGADLILGTAWLATLGPHVADYSALTLKFFHKGKFITLQGDTSMGPGQAQLHQLKRMCNTRSIDEVFTVERVQADAVNDVWDEIPANMSPEVAVILYTYRGIFKTPEGLPPQRPQNHAIPLKEGSNPVKVKPYRYPHSQKEQIEKMVKEMLDQGIIQPSNSPFSSPIVLVKKKDGSWRFCTDYRALNAITVKDSFPMPTVDELLDELCGAKYFSKLDLRSGYHQILIQPEDRHKTAFRTHHGHYEWLVMPFGLTNAPATFQCLMNQIFQHALRKYVLVFFDDILVYSTTWKDHLTHLEAVLQEIEYLGHVVSGKGVAMEATKIEAVLKWPTPPNLKQLRGFLGLTGYYRRFIKSYAKIAAPLTDLLRKDSFCWNETTQEAFQGLQQAITSAPVLALPNFQQTFILETDASGIGVGAVLHQNGHPIAFFSKKLAPRNQKKSAYFREMLAIAEAIAKFRHYLLGSKFIIRTDQKSLRSLMDQSLQTPEQQEWLHKFLGYDFVIEYNPGKENIAADSLSRMFMISWSEPKTRFMQQLLDEVKSNDKMQELITQCKDHPQLKPHYTTKEGLLYWKGRLVIPDASNLIQMILKENHSSPIGGHSGNSRTMARIAYQYFWHNMKKDIEQFVQNCAICQQAKSSHSLPAGLLQPLPIPSQVWEDVAMDFITGLPPSFGYTTIMVVIDRLTKFAHFVPLKSDYSSKTVAEAFMNYIVKLHGIPKSIVSDRDKVFTSDFWKRLFEIQGTTLAMSSAYHPQSDGQSEILNKCLEMFLRCFTFENPKAWYKAVTWAEYWYNTAHHTSIGMTPFKALYGRDPPALTRYRPQPNDPITVQEQLVERDRTLQQLKSNLERAQVYMKNQADKKRRDLELQVGDWVLVRLQPYRQQSVALRKNKKLGMRFFGPFMIIAKVGVVAYKLQLPEEAKIHSVFHVSQLKPFKGGTTEQYMPLPLTMTDIGPIVLPAKVLAARVIQQGELKIPQVLIQWTNMPPDESTWEGLEDMKANYPSFNLEDKVVLNGDGIVIRQIKEKEIDVAESSIQVCKGPHGMQEDNSVMHDPELQGMRKSTRARKANNQLKDF

SEQ ID NO: 215801 - protein, 55 aa, Glycine max
  Coding DNA Sequence Number=SeqID_99023
MELYQLQMEMGGDLHDHINKFNKLLWWSMSKEGIIQGDMMGQEEDQNHNRIHNEI

SEQ ID NO: 215802 - protein, 97 aa, Glycine max
  Coding DNA Sequence Number=SeqID_99024
  Subcellular localization annotation: CTP_CleavageSite=33; ConfidenceScore=5.43e-01
MACHYLLFNSSLKSTSSSPPQAPAPSSSPLDVTAHHRIQRHFGTPVCLLILLILNPYLSSPSKPPKSKSQSPNVVIGRTRELNQTLERVLSKDSSTA

SEQ ID NO: 215803 - protein, 75 aa, Glycine max
  Coding DNA Sequence Number=SeqID_99025
MTRSFPSPFDALKRVNVHLQHFTTLKNNEDGNLDDVEEEGIGGAETGTERFPKCCRQNDVVDNKKPQCQEQHAQS

SEQ ID NO: 215804 - protein, 246 aa, Glycine max
  Coding DNA Sequence Number=SeqID_99026
  Gene Ontology: Mol. function=tryptophan synthase activity; Cellular component=chloroplast; Biological process=aromatic amino acid family biosynthetic process
  Homolog annotation: Hit_ID=P25269; Match level="QueryCoverage=51%, HitCoverage=33%, E-value=4e-35, Identity=51%"; Hit description =Tryptophan synthase beta chain 2, chloroplast precursor
MTPLHPPPSRTPPCPQPRPFSIYLYETNCHIFVEVDAIFAIDLVCDIYGSAPSLCSTLAPVLPLANCTTSLVNSQCPNSSDRFGSKYVLETLIHALTELESVFHSLASDEHFKLAKTLREYVGRKSLLCFAKRLMRRYACKSGGGLERLGKRRVIAETGVGQHGVATATVCERFGLECVMYVGARNMEKHALNVFKMRLLGAKVLSLSSHIGAFVIARSGWRKLLIHIWQQRETPLSLEGVIEEKR

SEQ ID NO: 215805 - protein, 77 aa, Glycine max
  Coding DNA Sequence Number=SeqID_99027
  Gene Ontology: Mol. function=structural constituent of ribosome; Cellular component=ribonucleoprotein complex; Biological process =translation
  Homolog annotation: Hit_ID=O22860; Match level="QueryCoverage=87%, HitCoverage=98%, E-value=2e-30, Identity=94%"; Hit description=60S ribosomal protein L38
  Pfam annotation: Domain name=Ribosomal_L38e; Domain location=10-77; Score=167.5; E_value=3.4e-47; Accession=PF01781.8; Description =Ribosomal L38e protein family
MVNLTVIVSPKQIHEIKDFLLTARRKDARSVKIKRSKDVVKFKVRCSKYLYTLCVFDSEKADKLKQSLPPGLSVQDV

SEQ ID NO: 215806 - protein, 61 aa, Glycine max
  Coding DNA Sequence Number=SeqID_99028
MAVRGEGGCVGGRVSSATALAQAQRDPGKVFEHGKCTESCKYYKTVCKLTIKKENHVSNDV

SEQ ID NO: 215807 - protein, 87 aa, Glycine max
  Coding DNA Sequence Number=SeqID_99029
MNFKISRLGQISLTSSNWNSYTEPGSGQHRNIAMDSSYQCYYQWQMAEGQEHAVAAYNATKVKAMPCHSVVTLGKNSAMPLRHGTSI

SEQ ID NO: 215808 - protein, 111 aa, Glycine max
  Coding DNA Sequence Number=SeqID_99030
MANPTRVLNAPNLLGRQSLQEYLMTLGNLLSEACTNNNWKCFPVLSLFYTSMEHLFCAYFMEYATQASSDTPMEFTRPVSMLVGHSYILIEIDFIHSVHAVEANTCYFTFN

SEQ ID NO: 215809 - protein, 117 aa, Glycine max
  Coding DNA Sequence Number=SeqID_99031
MDPPLTTPKAFIQQVAWPGVQPSIDGGGGQVSVQVVEYESQQREKMLGYLKEIMVRVLREHKGFSYVMPLIWGRGKVKIFLERPHYKPIKVLSDPPSVSKIALTEIKCKIGNINCMS

SEQ ID NO: 215810 - protein, 125 aa, Glycine max
  Coding DNA Sequence Number=SeqID_99032
MKMIRGAVKQHYKPVEGHALEGPIMKEEKRVTNKPVGKINILEQPKEAKIKASKVAPIKGNPKRPPLRQPKRLQLRQAKNDHNYDGFPKHPSCPMPYRLGMWQCKLPNNGSKEASDNNLKFGIRA

SEQ ID NO: 215811 - protein, 1091 aa, Glycine max
  Coding DNA Sequence Number=SeqID_99033
  Gene Ontology: Biological process=thiamin biosynthetic process
  Homolog annotation: Hit_ID=Q1SKJ6; Match level="QueryCoverage=48%, HitCoverage=92%, E-value=0.0, Identity=67%"; Hit description =Pentatricopeptide repeat
  Pfam annotation: Domain name=DUF1336; Domain location=534-699; Score =104.3; E_value=3.6e-28; Accession=PF07059.3; Description=Protein of unknown function (DUF1336)
  Pfam annotation: Domain name=PPR; Domain location=162-196; Score =41.2; E_value=3.5e-09; Accession=PF01535.11; Description=PPR repeat
  Pfam annotation: Domain name=PPR; Domain location=197-231; Score=1.9; E_value=4.5; Accession=PF01535.11; Description=PPR repeat
  Pfam annotation: Domain name=PPR; Domain location=265-299; Score =46.6; E_value=8.1e-11; Accession=PF01535.11; Description=PPR repeat
  Pfam annotation: Domain name=PPR; Domain location=300-334; Score=5.7; E_value=1.6; Accession=PF01535.11; Description=PPR repeat
  Pfam annotation: Domain name=PPR; Domain location=368-402; Score =15.3; E_value=0.11; Accession=PF01535.11; Description=PPR repeat
  Pfam annotation: Domain name=PPR; Domain location=96-130; Score=4.5; E_value=2.2; Accession=PF01535.11; Description=PPR repeat
  Pfam annotation: Domain name=zf-B_box; Domain location=869-916; Score= 49.0; E_value=1.5e-11; Accession=PF00643.14; Description=B-box zinc finger
  Pfam module annotation: Pfam domain module=DUF1336::PPR::PPR::PPR::PPR ::PPR::PPR::zf-B_box; Domain location=534-699::162-196::197-231::265 -299::300-334::368-402::96-130::869-916
MEVRSMWEALQVHGQVVKLGMGHKDASRKLSKVFTFAALSPFGDLNYARLLLSTNPTLNSYYYNTLLRAFSQTPLPTPPFHALSLFLSMPSPPDNFTFPFLLKCCSRSKLPPLGKQLHALLTKLGFAPDLYIQNVLLHMYSEFGDLLLARSLFDRMPHRDVVSWTSMIGGLVNHDLPVEAINLFERMLQCGVEVNEATVISVLRACADSGALSMGRKVHANLEEWGIEIHSKSNVSTALVDMYAKGGCIASARKVFDDVVHRDVFVWTAMISGLASHGLCKDAIDMFVDMESSGVKPDERTVTAVLTACRNAGLIREGFMLFSDVQRRYGMKPSIQHFGCLVDLLARAGRLKEAEDFVNAMPIEPDTVLWRTLIWACKVHGDADRAERLMKHLEIQDMRADDSGSYILASNVYASTGKWCNKAEVRELMNKKGLVKPPGTSRIEVDGGVHEFVMGDYNHPEAEEIFVELAEVVDKIRKEGYDPRVSEVLLEMDDEEKAVQLLHHSEKLALAYGLIRIGHGSTIRIVKNLRIIGSFRIVLVKNAHCTVTLTNADAKECSTASNDPNSQVRKVIDNEFPAGDKPFVWAFNLQLPTKDNYSAIAYFTTKETVLEDLLMDKFLKGGNAFRNSRLKLIANIVKGENFIEVDIDIGSSMVASAIVHLAFGYISTLTVDLAFLIESQAESELPEKIFGAFRFSELDPASARTIEPSDVVSCDNAQTSLPTRLWKSIGQGFSHILHSGPQEDGSTSGSEHTNDVDHKDNPIDITNCSFLMRHSKVRPNAPSDDQSPQLTYNPQLDHGGWSRRGREFCEARRAFLNSYHLSLERKNNGSFKEKLKKSVKEVNQVAMGVVLGMRRGVSKRRVGIKRRVNMKIQCDVCERAPATVICCADEAALCAKCDVEVHAANKLASKHQRLLLQCLSSKLPRCDICQDCDEPIHSAGSLSANHQRFLATGIRVASSSNCTKDNEKSHLEPPTRNAQQVSAKIPPQQVPSFTSSWAVDDLLELTAFESPEKKESLQFGELEWLTDVGIFGEQFAQEALAAAEVPQLPVTHNSSSVASYRTSKSYMSHKKPRIEVLNDDDDEYFTVPDLG

SEQ ID NO: 215812 - protein, 628 aa, Glycine max
  Coding DNA Sequence Number=SeqID_99034
  Homolog annotation: Hit_ID=Q8LDZ9; Match level="QueryCoverage=47%, HitCoverage=68%, E-value=1e-111, Identity=70%"; Hit description =Transcriptional activator RF2a, putative
  Pfam annotation: Domain name=bZIP_1; Domain location=428-490; Score =29.8; E_value=9.4e-06; Accession=PF00170.11; Description=bZIP transcription factor
  Pfam annotation: Domain name=bZIP_2; Domain location=426-480; Score =26.5; E_value=9.1e-05; Accession=PF07716.5; Description=Basic region leucine zipper
  Pfam module annotation: Pfam domain module=bZIP_1::bZIP_2; Domain location=428-490::426-480
MKWIIFFSFSTNLISVMEVMLTYYLSLQEPTCNIGSCLPTFVDLCSSSLLSNHCDWWQTPLSGRLKCNIDAALFKDQNYFEPVEVEECGLLQHALTCIKDQNLNNVDFEIDAKTIVNDIYNTSTGCSDFQFLIRIDYDPKKFGTFKHFIQPIKFNSPDTGSFGFSPFSLRVFTFTHFSSLSICAQSSGLALLGLRSVSIFMDKDKSLGLPPPSGRYSGYSPTRSVFNVKSEPSPSSSSTTSYPPLALGTTSSESSHFGHGMSTDSSGFSHDISRMPDNPPRNRGHRRAHSEILTLPDDISFDSDLGVVGAGDGPSFSDDAEEDLLSMYLDMDKFNSSSATSTFQMGEPSNAVGASASTPGSGAPNYSAENVVFGTIERPRVRHQHSQSMDGSTTIKPELLVSGSEDMSAADSKKAISAAKLAELALIDPKRAKRIWANRQSAARSKERKMRYIAELERKVQTLQTEATSLSAQLTLLQRDTNGLNSENSELKLRLQTMEQQVHLQDALNDALKEEIQHLKILTGQVMAPNGGPMMKLASFGGGQQFYPNNHVMHTLLAAQQFQQLQIHPQKQQQQQHQHQFQQFQQQHQHQHQQHQQSSDLKMRETSPTPCPKDNTSSDVNPSGAKDC

SEQ ID NO: 215813 - protein, 944 aa, Glycine max
  Coding DNA Sequence Number=SeqID_99035
  Gene Ontology: Mol. function=nucleic acid binding
  Homolog annotation: Hit_ID=Q52ZH7; Match level="QueryCoverage=62%, HitCoverage=96%, E-value=1e-167, Identity=55%"; Hit description=FPA
  Pfam annotation: Domain name=RRM_1; Domain location=20-85; Score =58.1; E_value=3e-14; Accession=PF00076.12; Description=RNA recognition motif. (a.k.a. RRM, R
  Pfam annotation: Domain name=RRM_1; Domain location=202-268; Score =29.9; E_value=9e-06; Accession=PF00076.12; Description=RNA recognition motif. (a.k.a. RRM, R
  Pfam annotation: Domain name=RRM_1; Domain location=97-162; Score =54.0; E_value=5.1e-13; Accession=PF00076.12; Description=RNA recognition motif. (a.k.a. RRM, R
  Pfam annotation: Domain name=SPOC; Domain location=472-568; Score =89.2; E_value=1.2e-23; Accession=PF07744.3; Description=SPOC domain
  Pfam module annotation: Pfam domain module=RRM_1::RRM_1::RRM_1::SPOC; Domain location=20-85::202-268::97-162::472-568
MPPPSKFVEGEELGSPTNNLWVGNLPPEVIDSNLMELFAPYGSLDSLISYSSRTFAFVLFRRVEDAKAAKSNLQGAWLRGFQIRIEFARPAKPCKQLWVGGFSPAVAREDLEAEFWKFGKIEDFKFFVDRGTACVEFLNLDDAVRAMKVMNGKRLGGGQICVDFLRPQSTRRDFLVDHGQFQTRPQHLQPSIGRNSQPSKILWIGFPPSFQIDEQMLHNAMILFGEIDKIKIFPSRHYSFVEFRSTDEAQRAKEGLQGRLFNDPRITIMYSSSEPAPGKDYPGFYPGGKEPIRDGLVNEYPFRLQQTDVFGHNRLMVPNNFPGQLPPGHNVPMGPFGSQGLEPLISGPDFNEMGPSWKRPSPPAPGMLPSPVPGSGIGPPTRSTSGAWDVLGINQFQRDSKRSRIHDAWLIGDAPFPLRYIDDRGLGLEQPFAIDPVIDGGGSGPNSHLGPVGTRITSGVPDSVQPDIDHIWRGIIAKGGTPVCCARCVPIGKGIGTEIPGVVDCAARTGLDMLKKHYADAIGFDIVFFLPDSEEDFASYTEFLHYLKAKHRAGIAKLVDNTTLFLVPPSDLLTKVFKVTGPERLYGVVLKFPSVPSSTYMQQAMHLPSPSTQYMQQIPPSQVEYGSISAKEEQVLPMDYNRLLHEDSKHLPKPLHPATSVPSSSHSVPSDYALTHTASVSQAGVTWTPELIASLTSLLPATTQSSTPGGQMGMAGPSTVKSPFPSVAPNNGNQSHLWKQDKQIADPSSHPPQQFGSIHNAQYQPYPPASSTDNPAQVVSGSSRFQDTASSLKQLGAVLSTPMTNFILPPQNGQVAVSLQVSQQYQEVPHGTEKGYGVVQGTDASVLYSSKAFQQPNNFISSSNQVANAGSQQQSVIPYTVDKVNLGPTNQQLQPALFGVGQGVSELEADKNQRYQSTLQFAVNLLQQIQQQQTQGGHGPGNQQ

SEQ ID NO: 215814 - protein, 410 aa, Glycine max
  Coding DNA Sequence Number=SeqID_99036
  Gene Ontology: Mol. function=strictosidine synthase activity; Cellular component=integral to membrane; Biological process =biosynthetic process
  Homolog annotation: Hit_ID=Q58L86; Match level="QueryCoverage=99%, HitCoverage=99%, E-value=0.0, Identity=73%"; Hit description =Strictosidine synthase family protein
  Pfam annotation: Domain name=SGL; Domain location=107-350; Score= -56.3; E_value=7.7e-06; Accession=PF08450.2; Description=SMP -30GluconolaconaseLRE-like region
  Pfam annotation: Domain name=Str_synth; Domain location=200-287; Score=124.9; E_value=2.3e-34; Accession=PF03088.7; Description =Strictosidine synthase
  Pfam module annotation: Pfam domain module=SGL::Str_synth; Domain location=107-350::200-287
MEKIKIKLLMKDETFLQHPFVLAVVLVLGLVMMDPFHLGPVSEHEFRPVKHSIAPYHQVMKNWPRDNMSRLALHGKSEFKNQVFGPESLEFDHMGRGPYTGLADGRVVRWMGEQLGWETFAVVTSNWTEKLCFRGNDSTTAKQWKHEKTCGRPLGLRFDKVNGDLYIADAYYGLLVVGPNGGLATSLATHVEGKPILFANDLDIHKNGSIFFTDTSKRYNRVAHFFILLEGEATGRLLRYDPPTKTTHVVLDGLAFPNGVQFSKDHSFLLYTETTNCRLMKLWTEGPKSGSVELLADLPGFPDNVRINEKGQFWVAIDCCRTPAQEVLSHNPWLRNIYFRLPIRMSLLARAMGMKMYTVISLLDDKGEVLEVLEDQKGEVMKLVSEVREEQGKLWIGTVAHNHIATLSYP

SEQ ID NO: 215815 - protein, 111 aa, Glycine max
  Coding DNA Sequence Number=SeqID_99037
  Gene Ontology: Mol. function=protein kinase activity; Biological process=protein amino acid phosphorylation
  Homolog annotation: Hit_ID=Q9LTU4; Match level="QueryCoverage=80%, HitCoverage=6%, E-value=2e-27, Identity=65%"; Hit description =Helicase-like protein
  Pfam annotation: Domain name=DUF889; Domain location=50-109; Score= -122.6; E_value=0.0035; Accession=PF05970.5; Description=Eukaryotic protein of unknown function (DUF889)
MVASSGIASQLLPGAPMAHKFCFEALDHSLRDIIKHNSKDNTIFGGKVMVFGGDFRQILPVIPRGSRSDIVNATINSSYLWDHCQILRLTKNMRLQNNMQATDQEETAAFA

SEQ ID NO: 215816 - protein, 267 aa, Glycine max
  Coding DNA Sequence Number=SeqID_99038
  Gene Ontology: Mol. function=transferase activity; Biological process= DNA integration
  Homolog annotation: Hit_ID=Q1SB55; Match level="QueryCoverage=93%, HitCoverage=93%, E-value=1e-107, Identity=78%"; Hit description =FAR1; tRNA-binding arm
  Pfam annotation: Domain name=FAR1; Domain location=79-261; Score =110.6; E_value=4.5e-30; Accession=PF03101.5; Description=FAR1 family
MDHQSGQGFNSDDSDLDMQAEISEKHKKVDEFSKNLELCGSEDEMFVEIEQPLANISTDIEAVEPFIGMEFNSREEAREFYIAYGRRVGFTVRIHHNRRSRVNNQVIGQDFVCSKEGFRAKKYVHRRDRVLPPPPATREGCQAMIRLALRDGGKWVVTKFVKEHTHKLMSPSKVPWRGSGKHLVSEAHLNSLDKLIHDEKDKRIRELSLELYNERQKCKRRCAAYEEQLNMILNDLEKHTEHISEKVAAVVRSIREIEEEISDSDGG

SEQ ID NO: 215817 - protein, 871 aa, Glycine max
  Coding DNA Sequence Number=SeqID_99039
  Gene Ontology: Mol. function=protein serine/threonine kinase activity; Cellular component=integral to membrane; Biological process=protein amino acid phosphorylation
  Homolog annotation: Hit_ID=Q6RZU8; Match level="QueryCoverage=99%, HitCoverage=96%, E-value=0.0, Identity=63%"; Hit description =Crinkly4-like protein
  Pfam annotation: Domain name=Pkinase; Domain location=481-766; Score =133.3; E_value=6.7e-37; Accession=PF00069.15; Description=Protein kinase domain
  Pfam annotation: Domain name=Pkinase_Tyr; Domain location=481-753; Score=102.9; E_value=9.3e-28; Accession=PF07714.7; Description =Protein tyrosine kinase
  Pfam module annotation: Pfam domain module=Pkinase::Pkinase_Tyr; Domain location=481-766::481-753
MSSIAVSYGDKGSVFCGLKSDGSHTVTCYGIDSAIIYGTPTHFPFLGLTAGDGFVCGLLMSSNQPYCWGSSGHVEMGVPQPMVKGAQYLEISAGDYHVCGLRKPLTGRHRNTSLVDCWGYNMTNNYVFDGQVQSISAGSQFNCGLFSQNRTVFCWGDETSSQVISMIPQGMRFQKISAGGYHVCGILEGVNSRAVCWGRSLLDLREELSISLTGSGQGQGNVELAPIDPMLSVVGGKFHACGIRSYDRGVVCWGYSFKAGTPVPSGIKAFEIGAGNYFTCGVLVEKSLMPVCWGVGFPTSLPLPVSPRMCRSTPCSPGYYETQQNGLCKSPDSHICMPCSAACPPEMYQRSGCNLKSDILCEYNCSICSSPECLSNCSSSYSNAAFGKRTERFWSMQLPVLIAEIAFAVFLVSIVSITAVLYVRYKLRNCQCSGPKVKKLKGSSINQKDQKCKIRPDLEDFKIRRAQMFPYEELERATSGFKEESIVGKGSFSCVFKGVLKDGTVVAVKRAIVSPNMQKNSKEFHTELDLLSRLNHAHLLNLLGYCEEGGERLLVYEYMAHGSLHQHLHGNKVMQEQMDWVRRVTIAVQAARGIEYLHGYACPPVIHRDIKSSNILIDEEHNARVADFGLSLLGPADSSSPLAELPAGTLGYLDPEYYRLHYLTTKSDVYSFGVLLLEILSGRKAIDMQFEEGNIVQWAVPLIKSGDIAAILDPVLKPPPDLDALRRIANVACKSVRMRGKDRPSMDKVTTVLERALAQLMGSPCIEQPILPTEVVLGSNRLHKKSSSNRSASESTDVEDQRFEFRAPSWITFPSVTSSQRRSGSEAEVEGKNAEGRNLSNVGGGGGVLRSLDEEIGLASPRERLFLQHNF

SEQ ID NO: 215818 - protein, 369 aa, Glycine max
  Coding DNA Sequence Number=SeqID_99040
MSTLKCRNCLTDLKKFISSALGIYHEGLGYTMYKGASKKRKLPVRNSDVHLRNTRSKTVKNFHQNNCGAVETGVSSEEKDFTSSLKATNQPPRCFEFYVRSDEGINLFIDLNSSPSDWTNRYRNEVCVSEKVCRKKEFRSLWQDLSSLGGSSTQGKSSFIWNTNSGHFDDCNGQTKYAPSLKLVKEDVTGLDQQNIGCCPSIYDSLTPCAMTVNVEKNVNENQSTVSTDVSYGAPNSYISGAEYCTKDVSKQTLDSIVTDTAFIKSICGSDCNSQSGLNSLGHESSKPDNEISEDCAMLNGFCPVNPGMICPGALLSGSLELQVSEVLSDPKNSLDVEQGGLIKSSEIKLDTNGKNLPSPTEEWVWCYL

SEQ ID NO: 215819 - protein, 185 aa, Glycine max
  Coding DNA Sequence Number=SeqID_99041
  Homolog annotation: Hit_ID=Q10NX4; Match level="QueryCoverage=40%, HitCoverage=30%, E-value=3e-12, Identity=43%"; Hit description=FAR1 family protein, expressed
  Pfam annotation: Domain name=FAR1; Domain location=68-182; Score=4.0; E_value=6.4e-07; Accession=PF03101.5; Description=FAR1 family
MKILYSRSFVAAVEFGIDGSINVETVGNATVVQISSSTIDENKVGCISFNPKLQHMHSIMHMLHVLDSSYVLSKLSRPRRDGTNIGRALVCNREGYRMPDKREKIVRQRAETRVGCRAMILVRRVSSGKWVVTKFIMEHTHPLTPGKGRRDCIYEQYPAIDRNFRSLSFCIKMDEKYFDNIFCLA

SEQ ID NO: 215820 - protein, 959 aa, Glycine max
  Coding DNA Sequence Number=SeqID_99042
  Gene Ontology: Cellular component=nucleus; Biological process =regulation of progression through cell cycle
  Homolog annotation: Hit_ID=Q5N857; Match level="QueryCoverage=99%, HitCoverage=99%, E-value=0.0, Identity=47%"; Hit description=Cyclin -like
MGVMSRRVVPVCGNLCVFCPSLRARSRQPVKRYKKFIADIFPRNQVAEPNDRKIGKLCEYASKNPLRIPKITDNLEQRCYKDLRNENFGSVKVVLCIYRKLLSTCKEQMPLFANSLLGIIRTLLEQTRADEMQILGCNTLVEFIDCQTDGTYMFNLEGFIPKLCQLAQEVGNNEQALLLRSAGLQALSHMVQFMGEHSHLSMDFDKIISVILENFKDLQSKSNLAKVEKLNSQSQSQLVQGFPKEGAVTESKLDAAKDPAYWSKLCLYNIAKLAKEATTVRRVLKPLFHNFDSENQWSSEKGVASCVLMYLQSLLAESGDNSHLLLSILVKHLDHKNVAKKPILQIDIINTTTQLAQNVKQQASVAIIGAISDLIKHLRKCLQNLAEASSNGNDAYKLNAELQSALEMCILQLSNKVGDIGPILDLMAVTLENIPITTIIARSTISAVYQTAKLITSIPNAFPDALFHQLLLAMAHPDSETQIGAHSVFSMVLMPSMCSPWLDPKTKIAQNDNFSTQHETFSGAENSNGKLEEGKAIASVNGKKYVIHPYRGYSFTPKLTDGEDDQSSLWLSSHQVSLLLSSIWVQATSVENGPANYEAMAHTYSIALLFSRSKASNYMALARCFQLAFSLRSISLDQEGGLQPSHRRSLFTLASYMLIFSARAGNVPGLIPEVKASLTEPTVDPFLELVDDIRLQAVCIESEKIIYGSQEDEVAAAKSLSDVELDDKQLKETIISYFMTKFSKLSEDELSSIKNQLLQGFSPDDAYPSGPPLFMETPRPCSPLAQIEFPNFDEIMVPDDLMEEETGPEHSGSQSDHKTSLSTNYPDVLNVNQLLDSVLETARQVASFSTSSTPLPYDQMKNQCEALVTGKQQKMSVIHSFKHQQESKAIILSSENEVKVSPLPAKALEYSNGDLKLVTQQQFEVQDQARHRSHDSGHQHSLRLPPSSPYDKFLKAAGC

SEQ ID NO: 215821 - protein, 248 aa, Glycine max
  Coding DNA Sequence Number=SeqID_99043
  Homolog annotation: Hit_ID=Q1SB60; Match level="QueryCoverage=93%, HitCoverage=71%, E-value=3e-52, Identity=47%"; Hit description =Double-stranded RNA binding; Fungal hydrophobin
MQVCSLELMADSSDVCPAEDALKAFLEYLVDPVLPAKPSIRDNSPSPSQHQLVAKQAHLKRLALVLRPTISVHMKSMLKPDETELVKQLSLTEGKILNAWVWSVVEKDVDTFSRSSEITSGAIQMYKKRRAIKKPTKNESNSEEEGILQIGYSAVKKAAGINKTDITSLESYTVYSQSKAKTASRFYIMKCSQLINLEFIQPIKSLIERLLGPLVKRSSSSWTVTSVVEYFHVLLYSEVILEWISRLV

SEQ ID NO: 215822 - protein, 240 aa, Glycine max
  Coding DNA Sequence Number=SeqID_99044
  Gene Ontology: Mol. function=4 iron, 4 sulfur cluster binding; Cellular component=intracellular; Biological process=base-excision repair
  Homolog annotation: Hit_ID=Q1RZ12; Match level="QueryCoverage=97%, HitCoverage=63%, E-value=5e-44, Identity=47%"; Hit description=HhH -GPD; Helix-hairpin-helix DNA-binding, class 1; Endonuclease III/Nth
  Pfam annotation: Domain name=HHH; Domain location=210-237; Score =17.3; E_value=0.018; Accession=PF00633.13; Description=Helix-hairpin- helix motif
  Pfam annotation: Domain name=HhH-GPD; Domain location=144-239; Score =15.4; E_value=0.016; Accession=PF00730.15; Description=HhH-GPD superfamily base excision DNA repair protein
  Pfam module annotation: Pfam domain module=HHH::HhH-GPD; Domain location=210-237::144-239
  Subcellular localization annotation: CTP_CleavageSite=56; ConfidenceScore=5.17e-01
MLVVSLGRINVSSVCAKTRKCFSSKSHLHTFTPASVSHQKFPEDPMICTNELPQISSEAPAHWKMVLQGIRQMRSSADEHQPVSREKAADTVPPKHWFSVLRLLFRQTEDNACMSLISSTVRLRLDIVLTLYDGMEERRFAVLTSSLLSSQTKEHVTRGATQRLGENDLLTADAMDKADEETIKKLIYPVGFYKRKASNLKKIANICLLKYDGDIPSSIEELLLLPGVGPKIAHLELVPG

SEQ ID NO: 215823 - protein, 75 aa, Glycine max
  Coding DNA Sequence Number=SeqID_99045
MNHEDVGCMSDFTKEGCTTQHIHHITYCRNVPFCGRARARLTGALSKGEKEGISTSHVCPKGQQPIFKNCGIVLP

SEQ ID NO: 215824 - protein, 166 aa, Glycine max
  Coding DNA Sequence Number=SeqID_99046
MEEVHTKGDQEPLDQVMEDDVVIVATSSREFPQGRDRWLIKESNDEGPVEDLDEVMVCLPISGIFTLQTLLDGIYMLDIDLQNSMFKTSTKIEDEANEEKVKVVEDSLSKADWLSKTHLLSKASSSFSRWETLEEDKSKNCMPSAQSAHPARVLSLLALNSHSLSK

SEQ ID NO: 215825 - protein, 54 aa, Glycine max
  Coding DNA Sequence Number=SeqID_99047
MMVLMVIEESSLETLVLIGDLEGTIVKQVDSKKAIAANQKYMKTSETTLLSQEN

SEQ ID NO: 215826 - protein, 63 aa, Glycine max; identical to SEQ ID NO: 136291
  Coding DNA Sequence Number=SeqID_99048

SEQ ID NO: 215827 - protein, 79 aa, Glycine max
  Coding DNA Sequence Number=SeqID_99049
MERKTKRDSGSTQTIRDNQSLWKVQGSESTKVRSTSIEFDLVEEGETGQRRDNDVRGLDRGRGGKRKKPSNDVDGGRKN

SEQ ID NO: 215828 - protein, 85 aa, Glycine max
  Coding DNA Sequence Number=SeqID_99050
  Subcellular localization annotation: CTP_CleavageSite=37; ConfidenceScore=5.51e-01
MAMPFIASPSSQRVSRSNSGAWLIIRPMKTTPGSHVVALKLSASPTTLTPSTTILNPPRHCQPHHPHCIHHQLPARWKIHHRCYL

SEQ ID NO: 215829 - protein, 106 aa, Glycine max
  Coding DNA Sequence Number=SeqID_99051
MGLRRALDIYGFLFKFSSSAKPNNLGDNLYLCVSNSNTEGPPQNIRAWIKCITACCLIRSKKAIFSTIEAEEIVEIIIYLFLDCQFQGLLVLLNDYMKVIVNYFTD

SEQ ID NO: 215830 - protein, 149 aa, Glycine max
  Coding DNA Sequence Number=SeqID_99052
MERGLEEGNACLGRKCQRKLLSIANDDGVRKWGRELRADPRNSISAMASRYLWQGALTSLDTINEHDSVTEGGILGNKCEGDKALNANILAQEKHADFMAVVFHNPKMIMKPSLQQSTTIIALYQNKIKTPYHDVIMDVENEVEIIVGD

SEQ ID NO: 215831 - protein, 245 aa, Glycine max
  Coding DNA Sequence Number=SeqID_99053
  Gene Ontology: Mol. function=DNA binding; Biological process=DNA integration
MREGMPLKEHLDKLNFFLKELGNLDVKMENEDLEMIMLAFLPPFYENFVSFISVGKDSTIVEEVKYNVYSRELQLKTSGNGDEASTSRLSVTGFAKEQKKNKGKDGIGFVQIRMHDGVVKTLIEVCHIPELKKNLVSVGAMNLKGFSCWVKGGVMQIRGKEKFVVEHLQFCEQCIYGKQHQTKFPNVMHTTKAMLDYVHFDCWGPLRVPSLGRARYFLSIIDDYSMMTWVFMMKQKSKAFKFFKH

SEQ ID NO: 215832 - protein, 115 aa, Glycine max
  Coding DNA Sequence Number=SeqID_99054
MEKENDKICEAKNPPPNVSTNLALHFLHEWRSVRHHPSKQVANSDSQNVVLTWKKPQHGIVKLNINASIFIEQGLFGACLVLCGGEGNFYCNKNHEGIRNNKAKRSQGLSITPSS

SEQ ID NO: 215833 - protein, 107 aa, Glycine max
  Coding DNA Sequence Number=SeqID_99055
MASMTFLWKGINLHGQEAKGKIIFESLSIFENSGLLEQTLNVFIEEGWENGTNGDLIYKLESCSSYMYSWGRHVKVVFKAHIDQCCKEMETLCESSTDEVAHQYVIA

SEQ ID NO: 215834 - protein, 43 aa, Glycine max
  Coding DNA Sequence Number=SeqID_99056
MAKPSKKLKGSLSRSQRHSETQETQIPSSISSSSLFSSEEQRI

SEQ ID NO: 215835 - protein, 149 aa, Glycine max
  Coding DNA Sequence Number=SeqID_99057
  Pfam annotation: Domain name=zf-CCHC; Domain location=77-94; Score =31.7; E_value=2.6e-06; Accession=PF00098.13; Description=Zinc knuckle
MELQRLNQNEETDKKKISIALKASSSMQEENEEEDSDDEEDFSLFVKKFQKFVKKRRIERRQNFNNERRSQEDSQVLKCYKCNQLGHIKANCPSNEEWLEKSDKKRYDERRTNKAYIAWDDNDSSDGSEKEINLLTKDYESDENISQED

SEQ ID NO: 215836 - protein, 146 aa, Glycine max
  Coding DNA Sequence Number=SeqID_99058
MFSKKEGMMRIMKQAKYSLKAQVEKDEGPSGEGQSPRVEKDEGPSNPCGVYPDLSSFTGSGVYPDLSSFTGSGVYPDLSSFTRSGVIQIFVACIKRSAPKMKLKREEGMERIESIPVDYLLAEEFQTVIFSYISMASLLPRQKKIK

SEQ ID NO: 215837 - protein, 131 aa, Glycine max
  Coding DNA Sequence Number=SeqID_99059
  Gene Ontology: Mol. function=phospholipase D activity; Cellular component=membrane; Biological process=phosphatidylcholine metabolic process
  Homolog annotation: Hit_ID=P93733; Match level="QueryCoverage=87%, HitCoverage=11%, E-value=1e-43, Identity=80%"; Hit description =Phospholipase D beta 1
MNLVCGKNVLIDMSIHTAYVKAIRAAQHYIYIENQYFIGSSYNWSQHKDLGANNLIPMEIALKIAAKIRANERLAVYIVIPMWRQRVFQLVLPLKEFYFGSLPVDLSTHQNIRNYLNLCEAGTTYEWVLVI

SEQ ID NO: 215838 - protein, 173 aa, Glycine max
  Coding DNA Sequence Number=SeqID_99060
  Gene Ontology: Biological process=response to biotic stimulus
  Homolog annotation: Hit_ID=P13240; Match level="QueryCoverage=89%, HitCoverage=84%, E-value=1e-58, Identity=68%"; Hit description =Disease resistance response protein 206
  Pfam annotation: Domain name=Dirigent; Domain location=10-169; Score =274.0; E_value=3e-79; Accession=PF03018.5; Description=Dirigent-like protein
MGVKVALVVFFMFFVLCSPFPHLVLFFHDIIYNGSNAANATSAIVAAPEGANLTKLASQFHFGNIVVFDDPVTLDNNLHSNQVGRAQGSYIYDTKNTFTAWLGFTFVLNSTDHRGTITLAGADPTLKKTRDVSVIGGTGDFFMHRGIATIMTDAFEGQVYFRLRVDVKFYECW

SEQ ID NO: 215839 - protein, 580 aa, Glycine max
  Coding DNA Sequence Number=SeqID_99061
  Gene Ontology: Mol. function=protein binding; Cellular component =nucleus; Biological process=regulation of transcription
  Homolog annotation: Hit_ID=Q8GX15; Match level="QueryCoverage=79%, HitCoverage=92%, E-value=1e-105, Identity=49%"; Hit description=Ap2 SCARECROW-like protein
  Pfam annotation: Domain name=GRAS; Domain location=164-470; Score =281.2; E_value=2.1e-81; Accession=PF03514.5; Description=GRAS family transcription factor
  Subcellular localization annotation: CTP_CleavageSite=60; ConfidenceScore=5.75e-01
KPQTKASFHTTAFTFLAMRVPSSPQPNNNHSPTSNLVLHTNNNPTTTFTYEPTSVLDLCRSPSPEKKLTVPKPEPQHNNNNNNLNLDLDDHVLPNSDWWESIMKDLALPEDSPTPLLKTNINPSCIPDFPPSSQDPPFDHPQDFTSLSEIYNQNLPYNYPTNTLEHSFYDLSHNHHHNNNNNVNNNNWDFIEELIRAADCFDSSHFQLAQAILERLNNRLLRSPMGKPLHRAAFHFKDALQSILAGSNRTSSNRLSSMAEIVQTIKTYKAFSGISPIPMFSVFTTNQALLETLNGSSFVHVIDFEIGLGIQYASLMKEIAEKAGAGASPLLRITAVVPEEYAVESRLVRENLNQFAQDLGISAQVDFVPLRTFETVSFKAVRFVDGEKIAVLLSPAIFSRLGSNGGSVGAFLADVRRVSPGVVVFVDGEGWTEAAAAASFRRGVVSSLEFYSMMLESLDASVAAGGGGEWVRRIEMMLLRPKIFAAVEGARRRTPPWREAFYDAAMRPVQLSQFADYQAECLLAKVQIRGFHVDKRHAELVLCWHERVMVATPALTLTLTLQSRDSSLPHDPDSPPSLAK

SEQ ID NO: 215840 - protein, 75 aa, Glycine max
  Coding DNA Sequence Number=SeqID_99062
  Subcellular localization annotation: CTP_CleavageSite=57; ConfidenceScore=5.41e-01
MEQTPRGSWSWLMVLAASKLLSSSSLTQATKLLLSSLCSWVGLAASNRIRQPPHHVACRMSSGLTLSRRAAAEQL

SEQ ID NO: 215841 - protein, 260 aa, Glycine max
  Coding DNA Sequence Number=SeqID_99063
  Gene Ontology: Mol. function=ATPase activity, coupled to transmembrane movement of substances; Cellular component=integral to membrane; Biological process=transport
  Homolog annotation: Hit_ID=Q9CAB3; Match level="QueryCoverage=66%, HitCoverage=35%, E-value=1e-16, Identity=69%"; Hit description =Putative ABC transporter; 82503-78258
MWDLVARDRWVIFDAFSALIVATVRSLFFLFFFAHFVFLEGGGQSCYGDFDTAFLDSIHLHSTEYGPCCFSPEYAVVGSVVRGFGNMKVKRMRETLYSSLLLQCPYCRIYHFLTMKQYEWWLEKLVDISLQQSAAYGVWNFSFNILYHSTQVITVLFGGMSILVGHITAEKLRRSWSNKAPKSITLSFNCPSYKKLSITLKASSGTSLKVTSEDMLSFGVILQSISFLNIPFSSLNNYWITYLCMDLVHTANSYVLFILA

SEQ ID NO: 215842 - protein, 312 aa, Glycine max
  Coding DNA Sequence Number=SeqID_99064
  Homolog annotation: Hit_ID=Q1RZ08; Match level="QueryCoverage=70%, HitCoverage=34%, E-value=2e-12, Identity=28%"; Hit description =Peptidase aspartic, active site
YKCDAYYEISDFDKACYMHSLLSLEDEDSEWLSDSKPSGGSSENSSTPISYKFDAASEISDFSKSSYMHSLLSLEDEDSEWLSDSNSFGWSSENPSTPLNSKCDAFSDILDLNKSSYMHPLISLEDEDSDWLSDSKSCGFSSENSTPLSYKYDAYYEISDLDKASYLLSLLILEDEDSEWLSDSSSWSIVVPPSVSTSSSFTGVQCGNSEEEFSADEPLFWPFEGKLNWNSEEPWSNEALCIVNYETSKLSMWAKSSAKIVPLLECEHFDSNKDQLLLGKEYFDLCQELTIETLVGLKEFDGHEGLDSEFDD

SEQ ID NO: 215843 - protein, 56 aa, Glycine max
  Coding DNA Sequence Number=SeqID_99065
MDIDEPKEKLSIAKKGEGYLRRHSEWSKKERGMECDGGAADDGGDDEQRTKDARLQ

SEQ ID NO: 215844 - protein, 293 aa, Glycine max
  Coding DNA Sequence Number=SeqID_99066
  Homolog annotation: Hit_ID=Q1RZ08; Match level="QueryCoverage=98%, HitCoverage=62%, E-value=1e-39, Identity=37%"; Hit description =Peptidase aspartic, active site
MSLTANGTVFCMEPEHKMTGHHFCNLRNQVDVIFPRVSSDGNMKLRHSLSVEDKSYAVNSFHLFANVLVAFWLFLVAISFFLLSKDVNVFGGFRGKHAEKVSSSDRRTISNATTEDDTNDTFSWSELCTKCDAYCEISDFDKPSYMHSLLSLEGEDSEWLSDSMPYGLSYEDPSTPPSYKCDAYYEISDFEQGSYFHSLLSLDDEDSEWLSDSKSFGCSSENPSTPLSSKCNAYFQISALEKASYVHSLLSLEDEDTEWLSDSKPSVRSFEEPSTPLSYKCDAYYEISDFDKA

SEQ ID NO: 215845 - protein, 107 aa, Glycine max
  Coding DNA Sequence Number=SeqID_99067
  Subcellular localization annotation: CTP_CleavageSite=71; ConfidenceScore=5.58e-01
MKFHHCCALTPLPQTSLYCLKPRSPSNLTVLPQTSVSLNRSPSNLPQLLSLKHHSLKVPRNVTLWPTFLCSGAYNRAVSTHSEVAPAVTCLPSRRSVSVVRRRSLYQ

SEQ ID NO: 215846 - protein, 290 aa, Glycine max
  Coding DNA Sequence Number=SeqID_99068
  Gene Ontology: Mol. function=chitin binding; Cellular component =extracellular region; Biological process=chitin metabolic process
  Homolog annotation: Hit_ID=UPI00006A17C9; Match level="QueryCoverage =99%, HitCoverage=100%, E-value=5e-37, Identity=32%"; Hit description= UPI00006A17C9 related cluster
  Subcellular localization annotation: CTP_CleavageSite=50; ConfidenceScore=5.06e-01
LHVLTFRGLHALAFRGLHALTFRGLRTLTFRGLHALAFRGLHALTFRGLRVLAFRGLHVLAFRGLHVLTFTGLHALAFKGLHVLTFRGPHALAFKGLHALAFRGLYVFAFRGLYTLTFRELHILAFRGLNVLVFRGLHVLAFRGLHVLTFRGLQVLTFGGQNALTFRGLHVLTFRELHALAFRGLHALAFRGLHTLTFRGLDALAFRGLHGFTCRGLHALTFRGLHVLTFRGLHALAVRELHILTFRGLHALAFRGLRVLGLRGLHALAFKGLLVLAFRGPHALAFRGLH

SEQ ID NO: 215847 - protein, 147 aa, Glycine max
  Coding DNA Sequence Number=SeqID_99069
  Gene Ontology: Mol. function=DNA binding
  Homolog annotation: Hit_ID=Q1RZ01; Match level="QueryCoverage=89%, HitCoverage=96%, E-value=2e-49, Identity=77%"; Hit description=HMG-I and HMG-Y, DNA-binding
MGRGRGKGKKLTVANFEDPASGEDEKVPTQKRRGRPQKPLKDDFDEEEVEKIEDDSDNVKNGTAYKEMKSPTATENGRKRKRNSQVKEKLDSVEKENSIGNGTSTTDELTKANGFRHNGSRRKSTPRRAAEAVSFFLGESDLRGCIW

SEQ ID NO: 215848 - protein, 47 aa, Glycine max
  Coding DNA Sequence Number=SeqID_99070
MANPLSARDIGKIQRVHLMLLIDIKFRGNQVRVSTTMQDLGQLSLRK

SEQ ID NO: 215849 - protein, 68 aa, Glycine max
  Coding DNA Sequence Number=SeqID_99071
MRLSGKESLLMKSPITINEILDVSISFLNDHLEETPGSTKIEEIHSKCINLAQCGARKKVASARDSGW

SEQ ID NO: 215850 - protein, 113 aa, Glycine max
  Coding DNA Sequence Number=SeqID_99072
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q08IT7; Match level="QueryCoverage=64%, HitCoverage=14%, E-value=1e-24, Identity=71%"; Hit description =Isoflavone conjugate-specific beta-glucosidase
  Subcellular localization annotation: CTP_CleavageSite=57; ConfidenceScore=5.42e-01
MASLACNTFIVSSTLRSVVTRAEPPKPGPLFDLSSFNRHSFPAGFTFGASSSAYQFEGAAKEYGRGPSIWDTFINQHPGKIADGTNGDRALDQYHRYKVRSEFRMVLGSRKST

SEQ ID NO: 215851 - protein, 64 aa, Glycine max
  Coding DNA Sequence Number=SeqID_99073
VCQQWIIQDEILTSNLVQSFFTINGGDEPTQKEFEQVLPLKDGNMGSGDRWAWIGHLRIQSISI

SEQ ID NO: 215852 - protein, 48 aa, Glycine max
  Coding DNA Sequence Number=SeqID_99074
MEDGNAPAISWEWPCLTLNEKPTSNLDLETFGPHHVLHLGGELEVLST

SEQ ID NO: 215853 - protein, 135 aa, Glycine max
  Coding DNA Sequence Number=SeqID_99075
MPPTRHPLELDKSNRALGFPALITGLCQSFGVPVTPSKGDAPQAVDAPPPPHQADPAGRPTTGGRCRYMSVSTSQGFASFACPTPNQFKAEVTWPGDWPEAQAGEALAEAPSGAEEARMDEKMTNLLGFLGGSGA

SEQ ID NO: 215854 - protein, 193 aa, Glycine max
  Coding DNA Sequence Number=SeqID_99076
  Gene Ontology: Mol. function=chitin binding; Cellular component =extracellular region; Biological process=chitin metabolic process
  Homolog annotation: Hit_ID=UPI000044A8F0; Match level="QueryCoverage =96%, HitCoverage=100%, E-value=6e-25, Identity=28%"; Hit description= PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MRGLHALTFSGIQVLASRGLDALTFRGLHIFTIKGLHALIFRGLHVPAIRGLHALTFRGLHILAFRGLHVLAMRGLHTLTFSGIQVLASRGLDALTLRGLHALAIRGLDILAFRRPHDLAIRGPHVLAIRGLHAVTFRGLQVLGIRGLHILTFRELHGHAIRGLDIHAFRGLDVLAFRGLHVLTIRGQHVLTI

SEQ ID NO: 215855 - protein, 678 aa, Glycine max
  Coding DNA Sequence Number=SeqID_99077
  Gene Ontology: Mol. function=protein serine/threonine kinase activity; Cellular component=ubiquitin ligase complex; Biological process=protein amino acid phosphorylation
  Homolog annotation: Hit_ID=Q1SLQ3; Match level="QueryCoverage=98%, HitCoverage=97%, E-value=0.0, Identity=56%"; Hit description=Protein kinase
  Pfam annotation: Domain name=Pkinase; Domain location=409-667; Score =119.6; E_value=9.1e-33; Accession=PF00069.15; Description=Protein kinase domain
  Pfam annotation: Domain name=Pkinase_Tyr; Domain location=409-672; Score=84.1; E_value=4.3e-22; Accession=PF07714.7; Description =Protein tyrosine kinase
  Pfam annotation: Domain name=Usp; Domain location=8-150; Score=43.3; E_value=8.2e-10; Accession=PF00582.16; Description=Universal stress protein family
  Pfam module annotation: Pfam domain module=Pkinase::Pkinase_Tyr::Usp; Domain location=409-667::409-672::8-150
MASNAGEEESTVIAIDSDRNSLHAVKWAVEHLLKKNASCTLIHVRTKTLYSHDFEVIPKQGRLPTEEELHQFFLPFRGFCARKGIVAKELVLHDIDVSNALTDYIIDNSISNIVVGASRWNALIRKFKDADVATSLVRSVPETCTVHVISKGKVQNIRPAGHSQNISNALSKSLKGIKGSFQSEDLNRKSVKYGHKQGSNNDGVSLVTPRMTNGETTSPKLSDESCSSQNSSNRSSLTGDTSKLLGYQLTEMSPENQDVVENSGSYTFRSNSCKISQKSLEIEKRNPKLELERKTKKCNSTRRETTTTHKAMKHEKFTQKEDAVKAWLPEEATLTLTEVERKKTKASMESAEMLKCLAEMKSHKGKQTGIRAMHEEEERNKALNASACNNKILFKRYNIKEIEVATNYFDNALKIGEGGYGPVFKGVLDHTEVAIKALKPDISQGERQFQQEVNVLSTIKHPNMVQLLGACPEYGCLVYEYIENGSLEDRLFQKDNTPTIPWKVRFKIASEIATGLLFLHQTKPEPVVHRDLKPANILLDRNYASKITDVGLARLVPPSVANKTTQYHKTTAAGTFCYIDPEYQQTGLLGVKSDIYSLGVMLLQIITGKPPMGVAHLVEEAIDKGKLQEVLDPNVTDWPLEETLSYARLALKCCEMRKRDRPDLRSVILPELNRLRNL

SEQ ID NO: 215856 - protein, 81 aa, Glycine max
  Coding DNA Sequence Number=SeqID_99078
MRGMEERMNTIDREKRGGIFRLKLLEWVLDFHRLVQRDTHRLAHSDLVLSELLSLSVFCVSFVHLVCAVRCARVTDSDSRA

SEQ ID NO: 215857 - protein, 45 aa, Glycine max
  Coding DNA Sequence Number=SeqID_99079
MNIWYHCSLGNDLGSLPNLLHFNVYFDSGTASIKFGAVAGEAVSK

SEQ ID NO: 215858 - protein, 331 aa, Glycine max
  Coding DNA Sequence Number=SeqID_99080
MEEEEEEDTWPPFWTESGGGRRLRRSYSLFLSSSALLMCILVIALAFTLVIIPTLQFFTTQIFKPNSVEKSWDSLNFVLILFVILCGFLSRNNTSDTPHEYDKSTPPTLRPWYEESDRTPPYKSFNRLRSFNSHPDLRQDSPWMAADERWRFYDDTHGKKKKRRQLGSVESVKSIPSQASSVFHNMFSSKKSKRKKLNTASSSHVSLSKTEPVRGGVVATSLRPNKREDFYALEENAVVAGNEPPPPPFKMPAWKFRVQGDFVRIDSISSSSSDSPDLEDEIVDSPSNEDGGEPESEILLFYPIQSRFKGGEARDWYVQSTFFTKTRSWTK

SEQ ID NO: 215859 - protein, 287 aa, Glycine max
  Coding DNA Sequence Number=SeqID_99081
  Homolog annotation: Hit_ID=Q1SCT7; Match level="QueryCoverage=98%, HitCoverage=64%, E-value=9e-87, Identity=61%"; Hit description =Ataxin-2, N-terminal
  Pfam annotation: Domain name=PAM2; Domain location=182-199; Score =27.0; E_value=6.5e-05; Accession=PF07145.5; Description=Ataxin-2 C -terminal region
  Pfam annotation: Domain name=PAM2; Domain location=91-108; Score=2.0; E_value=5.7; Accession=PF07145.5; Description=Ataxin-2 C-terminal region
  Pfam module annotation: Pfam domain module=PAM2::PAM2; Domain location=182-199::91-108
MDHTQSCQSNTCVDLSRSGSYDHAKQLASELPAKSYSTSDGESRIQENLNSNQHGDNAITKEENPIQAEEDVQLSRSEDSQGPLYSKKDGSDKGVLSPNASSYAPSSHTSSKTHEKMGSHGDLIEGSASGKANGETKSVNSRGIPSGSDLVGGIAASSVPGLSPSSSVCSLSSEKSTLNPNAKEFKLNPNAKSFIPSPARPPTPVSDGSFYFPTNVTTVPSMPGMPVGIGIGPTFAGPQPIIYNPQVAQMPSQGYFHPNAPQYGQLLGHPRQSLYMPSYLPVRTLVL

SEQ ID NO: 215860 - protein, 84 aa, Glycine max
  Coding DNA Sequence Number=SeqID_99082
MGGGTQQLQGRENDWLTENIGTSDIGCQPLTELILAKSQAFMKREEMVKDGLLIKGMEGENHKELNWSKLKITKQVHLGLVRAV

SEQ ID NO: 215861 - protein, 361 aa, Glycine max
  Coding DNA Sequence Number=SeqID_99083
  Gene Ontology: Mol. function=protein binding; Cellular component =mitochondrion; Biological process=positive regulation of protein biosynthetic process
  Homolog annotation: Hit_ID=Q9LVJ8; Match level="QueryCoverage=95%, HitCoverage=54%, E-value=6e-87, Identity=50%"; Hit description =Arabidopsis thaliana genomic DNA, chromosome 3, P1 clone: MDC16
  Pfam annotation: Domain name=Ataxin-2_N; Domain location=168-291; Score=221.8; E_value=1.5e-63; Accession=PF06741.3; Description =Ataxin-2 N-terminal region
MNLQQAGQPKSSNGYGHRKSEREGATKSENKILSGKLNANRLANAGAVTGSKGGSYESPSHDRLVYVTTCLIGHQVEVQVKNGSIYSGIFHATNTDKDFGIILKMARLTKDGSLRGQKSGTEFVSKPPLKILIIPAKDLVQVTAQDVAITRDGLANESHHDMHQEIMVDSLISQSRHVDLGRELKPWVPDEEDPQCPELENIFDGHWNRGWDQFETNEALFGVKSTFNEELYTTKLEKGPQTRELEKQALRIAREIEGEETQDLHLAEERGLHLHEAFDIDEETRFSSVYRGKHVDDSGFDEDILFDSHNSETFGDETFGGVFGSVVKRPGEISGGKGNDGARTLANSSSMVLNQFMHFIF

SEQ ID NO: 215862 - protein, 223 aa, Glycine max
  Coding DNA Sequence Number=SeqID_99084
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=96%, HitCoverage=13%, E-value=2e-69, Identity=62%"; Hit description=Chromo
METEGWGEVSSTLTQAHLHQLQWLHATSAISNSFVVHLMQHDGLDDKLTELLVDIAPEIATLLHTYSMVFQTPMGLPPTRDQNHAIPFHLNAKPVNVSPYWYPHCQNENIEKMVHEMLDQGIIQPSTSPFSSPIVLVKKKDGKWRFCTDYRALNAITIKDSFPMPTVDELLDELFGAKYFLSWILDRAIIKFWSSMMIDIRLLLGLIMAIMSGLLCHLDSQMH

SEQ ID NO: 215863 - protein, 204 aa, Glycine max
  Coding DNA Sequence Number=SeqID_99085
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=89%, HitCoverage=17%, E-value=9e-49, Identity=42%"; Hit description=Chromo
  Pfam annotation: Domain name=rve; Domain location=51-189; Score=-4.6; E_value=0.015; Accession=PF00665.16; Description=Integrase core domain
MNECQNVQPLDSQYNVKDGQDVKEFVRTCTTCQQAKYEHVLPTGLLQPLPIPNQVREHITMDFITGLPNSSGFTIIMVVIDRLTKYSHFVSMKYDYTSKTVVEAFMCHIVKLHSVPKFLISDRDKVFTKFWYNTSFHSSLGMTSFQALYGREPPALLRYNGSSQDPPVVWEADKNRLDRKFQVGDEVLVKLQPYRQHSRALRKY

SEQ ID NO: 215864 - protein, 296 aa, Glycine max
  Coding DNA Sequence Number=SeqID_99086
  Gene Ontology: Mol. function=aconitate hydratase activity; Cellular component=integral to membrane; Biological process=tricarboxylic acid cycle
  Homolog annotation: Hit_ID=Q1XPB8; Match level="QueryCoverage=98%, HitCoverage=31%, E-value=1e-138, Identity=83%"; Hit description =Aconitate hydratase-like
MKAKASINISEDNTLIESLEIAKSRIQIMIDKGMDNKNQVLQGLINKANKRIAEIRSGEKPALTPDANAKYYAEVVVDLDVIVEPMIADPDVNNEDVSKRYTHDTIRALSYYGGEKKVDLGFVGSCMVHKGDLKIVSQMLRNLEKQQGKVEFNAPLVVAAPTYNIIDELKAEGDWELLEKYSAFEFDDNAPKGEARVEYKNVMYLERPGCNLCMGNQEKAAKGDTVLATSTRLFQGRVVEDSERKKGESLLASTPVVVLSSIIGRIPNIDEYKAAVEGIDLTKFAPPIKELVQVGH

SEQ ID NO: 215865 - protein, 136 aa, Glycine max
  Coding DNA Sequence Number=SeqID_99087
  Gene Ontology: Mol. function=catalytic activity; Biological process =metabolic process
MGEGKGVANDEGMVGDDNYGRHLERGEIGDDGAEEGVHEGEGSGPGDLLVVGEEFVMHDGDEGGGGSGFLAVAAEGGLDGIKECRLRQCSFLCRVGTLILRYIINAKFCTLVLLRMGKNIKEGSWIKHLRLEFIFF

SEQ ID NO: 215866 - protein, 93 aa, Glycine max
  Coding DNA Sequence Number=SeqID_99088
MMNLKLKSFEKWDAPEENSRERRKGRLEFFSEKENQETQQPHPREGNVPEKNPHCVALVLPEKDAGGRQFLLPLWCCQRRSLLMPHNIEWRRP

SEQ ID NO: 215867 - protein, 420 aa, Glycine max
  Coding DNA Sequence Number=SeqID_99089
  Gene Ontology: Mol. function=transporter activity; Cellular component= integral to membrane; Biological process=cell division
  Homolog annotation: Hit_ID=Q9SCU1; Match level="QueryCoverage=99%, HitCoverage=99%, E-value=1e-170, Identity=72%"; Hit description =Patellin-6
  Pfam annotation: Domain name=CRAL_TRIO; Domain location=144-322; Score=62.9; E_value=1.1e-15; Accession=PF00650.10; Description =CRALTRIO domain
  Pfam annotation: Domain name=CRAL_TRIO_N; Domain location=47-129; Score=47.5; E_value=4.5e-11; Accession=PF03765.5; Description =CRALTRIO, N-terminus
  Pfam annotation: Domain name=EMP24_GP25L; Domain location=333-414; Score=10.8; E_value=0.081; Accession=PF01105.14; Description =emp24gp25Lp24 family
  Pfam module annotation: Pfam domain module=CRAL_TRIO::CRAL_TRIO _N::EMP24_GP25L; Domain location=144-322::47-129::333-414
MDTTSSPLSLQTQKTTFQELPEASPKPYKKGIVATLMGGGLFKEDNYFVSLLRSSEKKALQELKTKLKASFEDSPSDASMWGIPLLGGDDKADVILLKFLRARDFRVGDAHHMLMKCLSWRKEFGADTILEEEFLGLKELEGVVAYMQGYDKEGHPVCYNAYGVFKDKEMYERVFGDDEKLKKFLRWRVQVLERGIKVLHFKPGGVNSLIQVTDLKDMPKRELRVASNQILSLFQDNYPEMVARKIFINVPWYFSMLYSMFSPFLTQRTKSKFVISKEGNAAETLYKFMRPEDIPVQYGGLNRPSDLQNGPPKPASEFTIKGGEKVNIQIEGIEAGATITWDIVVGGWDLEYSAEFVPNAEGSYTIAVEKPRKMGASEEAIHNSFTSKESGKMVLSADNTASRRKKVAAYRYFVRKSSTI

SEQ ID NO: 215868 - protein, 80 aa, Glycine max
  Coding DNA Sequence Number=SeqID_99090
MKIIILEQNGVALYTSSLVFDSIFTLFPAPKSSMVVLGGVVCVLVVRWRWGYGGGGGVGGVVLPAWIFGRCKKQKMECRK

SEQ ID NO: 215869 - protein, 68 aa, Glycine max
  Coding DNA Sequence Number=SeqID_99091
MREWGNENKRGLRRDLSLELCVFVTLCVVLCLNESEGDETMKVVFEEETNLNVVMRGVNGDKGSWQRE

SEQ ID NO: 215870 - protein, 157 aa, Glycine max
  Coding DNA Sequence Number=SeqID_99092
MHFLMSLNESYGSIRVVQEEKQREIGASVSTFNSTNDASQSHAFAVRTPNINLITSLMLIPRIDPSMHIVVSLAILKISASSYMVFPPNYKKNKPSSSNTKSKIVNQASTPNFVPDFYLTAKQYGQLMSLLQAQTSNVVIPNIESSNTGNASLQEDW

SEQ ID NO: 215871 - protein, 98 aa, Glycine max
  Coding DNA Sequence Number=SeqID_99093
MKGEGRGKEPGFGVLGGEGGGGEDEEESEEEDREGAVEPEREGLLLGLVVEFVSVSVWVALFFCDDSHAHYSLLTALSFVVATRLKGVSVGYRDNIIA

SEQ ID NO: 215872 - protein, 161 aa, Glycine max
  Coding DNA Sequence Number=SeqID_99094
  Gene Ontology: Mol. function=DNA polymerase processivity factor activity; Cellular component=PCNA complex; Biological process =regulation of DNA replication
  Homolog annotation: Hit_ID=P22177; Match level="QueryCoverage=76%, HitCoverage=63%, E-value=1e-37, Identity=62%"; Hit description =Proliferating cell nuclear antigen
  Pfam annotation: Domain name=PCNA_C; Domain location=12-112; Score =81.1; E_value=3.5e-21; Accession=PF02747.6; Description =Proliferating cell nuclear antigen, C-terminal domain
MKLMDIDSEHLGIQEAYHVMPLLRCHPLSLLRFARISVVLEGVKFSTKGDIGTTNIVCKQNNFVDKPEEAIVIEMNEPLSNTITISLSNEPPFVVEYKIAKMGYVRFYLALRIKEDEKDTKPQVVGIEGENEEWIGAGVGLGAPQHDRGDHDHERGDAEQQ

SEQ ID NO: 215873 - protein, 97 aa, Glycine max
  Coding DNA Sequence Number=SeqID_99095
MSHKTQSRIIIGLYEKRIGIIHGTHGGTSKNRRIGEEELERDQRKRHKLFMKSNSDFEGKISLDKAGSSEDEFGFLYLFSCLLLMYHGAAYMKTISW

SEQ ID NO: 215874 - protein, 314 aa, Glycine max
  Coding DNA Sequence Number=SeqID_99096
  Gene Ontology: Mol. function=oxidoreductase activity; Cellular component=membrane; Biological process=potassium ion transport
  Homolog annotation: Hit_ID=Q8SB92; Match level="QueryCoverage=78%, HitCoverage=97%, E-value=1e-31, Identity=32%"; Hit description =Putative ethylene-forming enzyme
  Pfam annotation: Domain name=2OG-FeII_Oxy; Domain location=112-197; Score=55.6; E_value=1.7e-13; Accession=PF03171.10; Description=2OG -Fe(II) oxygenase superfamily
MEVTAAPVPYVQEIAKALTIVPERYVRPVHEHPILSNSTPLPEIPVIDLSKLLSQDHKEHELERLHYACKEWGFFQGVDSSLVEKVKRGAQGLFDLTMEEKKKFGQREGEAEGYGQLFMVLEEQKLKSGHICFSCSLCHQIRKDGLWIPVKPLPNAFIINLGDMLEVMSNGIYQSIEHGATVNSEKERLSIATFYSTAIDAIICLAPSFVTPKTPAMFKPISVGDYFKGYLAQEICGKYFLVTLTRNQTALILIHHGESLWNEKNLFIGCVDVLLSKKGIDEAIEAGKRISSIPSEAGVYAYTRAAMVLADLYQ

SEQ ID NO: 215875 - protein, 116 aa, Glycine max
  Coding DNA Sequence Number=SeqID_99097
  Gene Ontology: Mol. function=DNA binding; Biological process=DNA integration
  Homolog annotation: Hit_ID=Q1RVN6; Match level="QueryCoverage=90%, HitCoverage=13%, E-value=2e-11, Identity=39%"; Hit description =Integrase, catalytic region
MSKGINAYGPKKTWVPKSQIVSLVGKDQGERSMFLNLKPVKGGAIAFDGMGKGKISGIGKIDIPSLASIDNILYVEGLKYNLLSISQFCNSGYIVSFNKDQCIVKTKDDKSFFTSK

SEQ ID NO: 215876 - protein, 106 aa, Glycine max
  Coding DNA Sequence Number=SeqID_99098
  Gene Ontology: Mol. function=ribonuclease H activity
MICGLHIATTKAEHGDRDATPLLQTKISGEFIMNEPPQQKGLGWGYNCTPNILSPRNLRVPVQNTIRNTLVILEEVSNLSTKLGVEMLGMSKRSTRGLESHLSVQK

SEQ ID NO: 215877 - protein, 212 aa, Glycine max
  Coding DNA Sequence Number=SeqID_99099
MEKHGGPRQMLYPELIPKLPHRDGGNRASSSGDKHLRGTEGGDFRGVGNNGVENEDGMVKGGGEEMGFTLPRNARRIFGVSPEMKQLKRNDGGRSIILLAKSSNSESTSGILILKGCEARLKSLKEDWPRGELTITGHPLKLGQRTAIHVEGSNSQMLMFRGLNDTKKNWLILKIQPSGFVPLNRETSNFVRWEVEVDVRDVVAVEEDGEGL

SEQ ID NO: 215878 - protein, 70 aa, Glycine max
  Coding DNA Sequence Number=SeqID_99100
MPRTLQDLKTKCLSFYVVANGVHADWASRGNPGRATGEEVFSGIPLAFSLVLLLISMGFHPPSWLSCLQQ

SEQ ID NO: 215879 - protein, 120 aa, Glycine max
  Coding DNA Sequence Number=SeqID_99101
  Gene Ontology: Mol. function=nucleic acid binding; Biological process= DNA integration
  Homolog annotation: Hit_ID=Q1SJY4; Match level="QueryCoverage=68%, HitCoverage=17%, E-value=3e-11, Identity=40%"; Hit description=Zinc finger, CCHC-type
MTDNNNNNNSQFIVEGASLTRTLGFTREDYPYGKDRMEIFSIKGGKFVDDMFGRLQVLLNGLEALGDTFTKAEINLKIPDNFPKVWEQKTTTIQEARNLKTLAWDELLGILRVHEIHLQN

SEQ ID NO: 215880 - protein, 270 aa, Glycine max
  Coding DNA Sequence Number=SeqID_99102
  Gene Ontology: Mol. function=RNA-directed DNA polymerase activity; Cellular component=chromatin; Biological process=chromatin assembly or disassembly
  Pfam annotation: Domain name=Chromo; Domain location=207-264; Score =23.9; E_value=0.00056; Accession=PF00385.14; Description='chromo' (CHRromatin Organisation MOdifier
MLNVLSRPVSTTNIRNITTSIPIWEDLSLDFITGLLAFCGHTTILVVVDHFSKGIHLGMLPTHHTSHSVAVLFMDIIRKLQGRPHILTGEQTEVLNHVIVQYLRAFVHKKSSSWGKFLNWVEWSYNTSWHYIDGTSMVDVVDELLTNKEEILDQIGSATYKLQLPKGAHIHPVFHCSMLKPFHHSSSDNNVPPLPLPATSIDNQPIITPLAILSTRRNSNFFYSKLKVLVQWEGLSPDDTSWEDWDQLRSSYHLEDKVILEGKGDDSNHE

SEQ ID NO: 215881 - protein, 116 aa, Glycine max
  Coding DNA Sequence Number=SeqID_99103
FNKWGEKRISIDVQQETRQTRVENKPSKAQTLFALNHFKGSSRVISNGIFSTGFFADGENAYSYGSSGFYSLFFDNDNILRLLYDGLEVSAITGHIHGWHLGKLIRTQCMLDVVVK

SEQ ID NO: 215882 - protein, 223 aa, Glycine max
  Coding DNA Sequence Number=SeqID_99104
  Homolog annotation: Hit_ID=Q6AST9; Match level="QueryCoverage=46%, HitCoverage=47%, E-value=8e-39, Identity=71%"; Hit description =Expressed protein
PRELTGAVDLISHFKLLPHYEFFCKRPLPVSIADTHYLHNVVGDTEIRKGDGMQLDQLIQNTSFRDTNARIQPFDLDVLKEAFQLRETAPIDLPAAEKGIPTIAGKSKSENKDKEKKHKKHKDKDKDKDREHKKHKHRHKDRSKDKDKDKDRDKKKDKSGHRDSSADHSKKHHEKKRKHDGDDDVNDVHKHKKSKHKSSKIDELGAIKRGLSIDIIKFLEEGS

SEQ ID NO: 215883 - protein, 59 aa, Glycine max
  Coding DNA Sequence Number=SeqID_99105
MLKAPMKLYIWDLLTNSEVINIVASAPKRIKTKNGMLLEGSPEPTLNHRLQSPQYLKEG

SEQ ID NO: 215884 - protein, 67 aa, Glycine max
  Coding DNA Sequence Number=SeqID_99106
MVVGGAICMLVVGWRWGYSGSGGVGEPSSGIVSKAKSSGRTIVNLLVALALGFGEFLAELVISFNPP

SEQ ID NO: 215885 - protein, 167 aa, Glycine max
  Coding DNA Sequence Number=SeqID_99107
LVKAVTDEVGKSLIMELTDDKLVDTSRTAAKKWVRMYLARHGCVHSDAISKSQSKLSASIQSNQLTIQVLITAGMPVINHAGYAPLARQSSTTLTESNQRKTSAASESLFAQAISTQLPLDSDDDYCIEQLTNIDNGNMDDEFSAIESIISEIGMGAYQWEIVLGFA

SEQ ID NO: 215886 - protein, 94 aa, Glycine max
  Coding DNA Sequence Number=SeqID_99108
MKANRTRNELKASDSKTYRLKNEKRMKNGEEQRKTFTDLLIETSRKRYGSTSAWIFFTETIFSPKTTEMHSQRGKRGGGCRPARPGELGYFLLK

SEQ ID NO: 215887 - protein, 128 aa, Glycine max
  Coding DNA Sequence Number=SeqID_99109
  Gene Ontology: Mol. function=transporter activity; Cellular component= integral to membrane; Biological process=iron ion transport
  Homolog annotation: Hit_ID=Q9C6B2; Match level="QueryCoverage=51%, HitCoverage=12%, E-value=2e-15, Identity=60%"; Hit description=Metal transporter Nramp2
MSTQLQQHNKREFKGEEEEEEEEEENHLLHSECETIPLSSPHTSPSEWEHGNREEEEEEEEKDTVYAAKDKVQIFDLESASGASVGSTAVPPFSWRKLWLFTGPGLLMSVAFLDPGNLEGDLQAGAIA

SEQ ID NO: 215888 - protein, 79 aa, Glycine max
  Coding DNA Sequence Number=SeqID_99110
FSCLLRQFRAEVAWPKIDRAQAGEAPPEAPGRWREAHEDEEMADLLDFLGGSGDTCLGDPQIHCRVLRLGTSSKSIYVK

SEQ ID NO: 215889 - protein, 293 aa, Glycine max
  Coding DNA Sequence Number=SeqID_99111
  Gene Ontology: Mol. function=transporter activity; Cellular component= integral to membrane; Biological process=iron ion transport
  Homolog annotation: Hit_ID=Q9C6B2; Match level="QueryCoverage=94%, HitCoverage=52%, E-value=1e-116, Identity=73%"; Hit description =Metal transporter Nramp2
  Pfam annotation: Domain name=Nramp; Domain location=1-275; Score =296.9; E_value=3.8e-86; Accession=PF01566.9; Description=Natural resistance-associated macrophage protein
MLWFTIFNPVFCVNSFFFLFLENYGVRKLEGVFAVFIGTMGFSFAWMFFDTNPSEEELLMGLLIPRVNSKTLRQAVEIVGCVITPHNVFLHSALVQSRDIDIRNKGQVQEAINYYSIESSVALLVTLVINLFVITVFARVFYGTEQAKGIGLVNAGQYLQERYGGGLFPILYIWGIGLLAAGQSSTITGTYAGQFITEGFLNLNIKKWLRALITRSCAIVPTMICAIVFNTSEGSLDTMNEWLNVVQAIQIPFALIPLLTLVSKEEVMGTFRIGPIVEKMIQGYSCMAIIAKG

SEQ ID NO: 215890 - protein, 170 aa, Glycine max
  Coding DNA Sequence Number=SeqID_99112
MKKNQVVSMMPKSTLIYEVFGIKMVIDQSLFYDLTQLSSEGVPFEGALNDDWKFDFSMHDAHRLVCTNQADMTGRLFVGSLALESRILHYLIVRILLPRSSNLAQFNIPLDSEPYVPIKRSFLIGAAVIASFGYCKERDGSWVKKGAQPHDDEGHLPIREDSSLLQSILD

SEQ ID NO: 215891 - protein, 195 aa, Glycine max
  Coding DNA Sequence Number=SeqID_99113
  Gene Ontology: Mol. function=chitin binding; Cellular component =extracellular region; Biological process=chitin metabolic process
  Homolog annotation: Hit_ID=Q86AI8; Match level="QueryCoverage=97%, HitCoverage=50%, E-value=3e-21, Identity=34%"; Hit description =Similar to Homo sapiens (Human). Mucin 2
MSGPLNESISCFLKRVDPWVLVPSPSEDYTSSPSEDYTSSPLEDYTSSPSEGFTPSPSEGYASSPSEGYMHALRELCVLTFRGLHALAFRGLHALTFRGLHVLTFRGLHVLAFRGLHTLSFRGLHALAFRGLHVVAIRGLHVLAFRGLHAITFRGLHVLTFRGLHVLTFRGLHTFSFSGLHTLAFRRLDALAFKG

SEQ ID NO: 215892 - protein, 74 aa, Glycine max
  Coding DNA Sequence Number=SeqID_99114
MGKLEDASEDQGSSSEVADASKSCKKFLILYELRLLEVALISKSMGIKSPAIDLLCIQENKTTIIQFKITMNVQ

SEQ ID NO: 215893 - protein, 129 aa, Glycine max
  Coding DNA Sequence Number=SeqID_99115
MGLVFPDSQRSFLGGCVEKGTGHPETEHCPPHFVSWGYEYLEQKLLAEKTKKKLEEATQSGSVDGVIDLSSPVRRHVKWKMACTKKIGEMTTEAAKEIAEKIDSFEEQATQGSFTPMDVKMFSPLLLDI

SEQ ID NO: 215894 - protein, 284 aa, Glycine max
  Coding DNA Sequence Number=SeqID_99116
  Gene Ontology: Mol. function=transporter activity; Cellular component= integral to membrane; Biological process=transport
  Homolog annotation: Hit_ID=Q8X5J2; Match level="QueryCoverage=100%, HitCoverage=41%, E-value=1e-115, Identity=74%"; Hit description =Putative permease component of transport system for ferric iron
MSHTHALHFVKKRDAIFLWVLLGWLAFALLPSWSLDYGLLESTGDEILAAYGWSHRNVSWLWCLLPSLLLLRAYTPAGGERRRRHAFDAGWALLCMAFIVVSATVAGRGLGYATLVQLTALGAIMTLALTRLEWLGGDRFVIGALVTIVALIGVFIVWPSIAIFIPMFTDQTGAFAPLAFMNVLSQAHIVQVILNSIALSIAVGAGCTFFGLVLAIYTTRIARRSAIIGRIFSILPIVTPPFVVGLGVTLMMGRSGYVTEWMVAWFGLTNTNWLYGFTGIWLAQ

SEQ ID NO: 215895 - protein, 90 aa, Glycine max
  Coding DNA Sequence Number=SeqID_99117
  Gene Ontology: Mol. function=structural constituent of ribosome; Cellular component=ribonucleoprotein complex; Biological process =translation
  Homolog annotation: Hit_ID=Q9BBQ0; Match level="QueryCoverage=64%, HitCoverage=48%, E-value=2e-19, Identity=83%"; Hit description =Chloroplast 50S ribosomal protein L14
  Pfam annotation: Domain name=Ribosomal_L14; Domain location=28-90; Score=-4.0; E_value=0.00011; Accession=PF00238.10; Description =Ribosomal protein L14pL23e
MGSGKGSPEYWVAGVELGKNFYEVGGVPENIARKADNSGARELMCIRILGASNRRYAYIGDIVVAVIKQAVPNTNLERSEVIRAVIDTYL

SEQ ID NO: 215896 - protein, 52 aa, Glycine max
  Coding DNA Sequence Number=SeqID_99118
  Gene Ontology: Mol. function=ligand-dependent nuclear receptor activity; Cellular component=nucleus; Biological process=regulation of transcription, DNA-dependent
  Homolog annotation: Hit_ID=Q96RI1-1; Match level="QueryCoverage=88%, HitCoverage=9%, E-value=5e-18, Identity=97%"; Hit description =Isoform 3 of Q96RI1
MAMMTLDHEDQIALLKGSAVEAMFLRSAEIFKKKLPSGHSDLLEERIRNSGK

SEQ ID NO: 215897 - protein, 167 aa, Glycine max
  Coding DNA Sequence Number=SeqID_99119
  Homolog annotation: Hit_ID=Q47336; Match level="QueryCoverage=31%, HitCoverage=57%, E-value=3e-19, Identity=86%"; Hit description=LacZ -alpha peptide
  Subcellular localization annotation: CTP_CleavageSite=37; ConfidenceScore=5.55e-01
MVKVGTSYVPINVSFSPKVGPGLPGAPVASVSISCPSCSATDGVVRNGKSTAGHQRWQAAQLLGRAIGAGLFAITPAGERGMCCKAIKLGNARVFPVTTLANWSSTAVAAALELVDPPGCRNSIAFNIKLGTNMQNGKLGTDLTWKNDKQYTVALYDGNARAVATIQ

SEQ ID NO: 215898 - protein, 57 aa, Glycine max
  Coding DNA Sequence Number=SeqID_99120
MIDGSSSHAQLWKSGKRSWEVNDACLIYPPGEVLHPRPLHPLSNSFPARNRWSGPRY

SEQ ID NO: 215899 - protein, 116 aa, Glycine max
  Coding DNA Sequence Number=SeqID_99121
CQKVQEDVQGLIDSKKLIITRKDKEVCVITPEFQQLEISYNSGRLATTPLVISLPRPVPYASLKAVPYKYNVTMLESGQEVPLPSLTPATYVDNIVSNSKVLRNGRVMLDKWPQIS

SEQ ID NO: 215900 - protein, 224 aa, Glycine max
  Coding DNA Sequence Number=SeqID_99122
  Homolog annotation: Hit_ID=Q1SP02; Match level="QueryCoverage=58%, HitCoverage=29%, E-value=3e-15, Identity=35%"; Hit description=IMP dehydrogenase/GMP reductase
MTGIKGAPYRARIDALTVTNVCWMPYAEHRGVRGYELISLYMGQVRWGPIIVYLRPERVVQQMGYIQTVPPPPVRDSLTSTDIDDQWVQFSDHVTSTGELCVVPGQVALDYMEWFFQISHPFVMPTEDTAEPRPAPPLPTHDDDFVDPPVAQVPVTSDPPAHFVVGCTTCVRMGRIAEHLERVINLRMVTAWTDLYDIMDLCLRIGRDDNPDDSLRPRQRSRID

SEQ ID NO: 215901 - protein, 99 aa, Glycine max
  Coding DNA Sequence Number=SeqID_99123
ACFKIHIPMLDSNDPSYVESDSDVHFNVSPQALDKLMCYFLALKVNVQPNFKNVVVLRCSNDLHLISVVMDMLPDAKACSKIHIPMLDSNDPSQVESIS

SEQ ID NO: 215902 - protein, 126 aa, Glycine max
  Coding DNA Sequence Number=SeqID_99124
  Gene Ontology: Mol. function=RNA-directed DNA polymerase activity; Biological process=RNA-dependent DNA replication
MRVRLDHCLINLEWRLRFKEATLIHQGWLKSNHRPLCLCLEIPSHRNQHRRPFRFEATWVMHEKFPNFVRASEYKKNWREYEQVLDEKELHWFQMSRAKWFYVGDQNAKYFNGITTIRMRKNIFEM

SEQ ID NO: 215903 - protein, 215 aa, Glycine max
  Coding DNA Sequence Number=SeqID_99125
  Gene Ontology: Mol. function=chromatin binding; Cellular component =chromatin; Biological process=chromatin assembly or disassembly
  Homolog annotation: Hit_ID=Q1SAV4; Match level="QueryCoverage=64%, HitCoverage=39%, E-value=1e-23, Identity=40%"; Hit description =Integrase, catalytic region
  Pfam annotation: Domain name=Chromo; Domain location=93-137; Score =16.5; E_value=0.011; Accession=PF00385.14; Description='chromo' (CHRromatin Organisation MOdifier
MAMKEQADTHRRDVSYQPGDWVLLKLRPHRQTTAKGSQSFSEKLPKWLTRLELPNEAKIHSVFHCSMLKPFRGSSDNRAVALPDQFVNHQPVITPMTILDYRRSNEAWEVLVQWHALSPDDTSWEDWTQLQQAYHLEDKVPFLGPWSDKKEEEDMNQVESEAATNETIQGVATTTTTGTRSKENQKSSEEAHLPQGLCLKGGYFHSRIINRISFA

SEQ ID NO: 215904 - protein, 251 aa, Glycine max
  Coding DNA Sequence Number=SeqID_99126
MGVGRVMGWVRVRVQGFYKNRVRRILFLCKQKKYPRDTTVASMVFLVTAKTEVALAARGNLLGECGGRWGSQGRGEKSLRRVRSRGVHGEWGWSWGRPEKGQGWARVLEFFLLKADKARGLGESQRLMGLYLMENLRSEAGDIAAEEERCRKSHDVVCKVFKFGKVCGYCSLLRELEEGPCWVLVLRWRKSGLECLVRNGARDRGGKRRGVGQGRGNMVNEVVDFLVCPMTKTDKVRHGDNESTKLVRSEN

SEQ ID NO: 215905 - protein, 73 aa, Glycine max
  Coding DNA Sequence Number=SeqID_99127
  Gene Ontology: Mol. function=zinc ion binding
  Homolog annotation: Hit_ID=Q7XI08; Match level="QueryCoverage=97%, HitCoverage=14%, E-value=2e-21, Identity=66%"; Hit description=Auxin- regulated protein-like protein
MGQGQSKDELLYQQVSYGNAEGIKTLHREGAGLEWRDKDAKTPLIVACMNPRLYNVAKTLIELGANINAFRPD

SEQ ID NO: 215906 - protein, 166 aa, Glycine max
  Coding DNA Sequence Number=SeqID_99128
MSRLRLGKKLQPAKKAWKSFFNKVQSKVQKLNIPKAIKATFKRLLASLHSLHHLIPSRARHRRSLASNNYHVHSKKNISVISIDDLFTEPASSSSSSVMNVHAHAHHGETSRSKEVKKDLAEGSSDMNTIEDAWKALVAKSPQLQVDQKAEEFISKFRQDMRLQKE

SEQ ID NO: 215907 - protein, 218 aa, Glycine max
  Coding DNA Sequence Number=SeqID_99129
  Gene Ontology: Mol. function=zinc ion binding
  Homolog annotation: Hit_ID=Q0ZCE7; Match level="QueryCoverage=83%, HitCoverage=36%, E-value=6e-55, Identity=57%"; Hit description=Auxin- regulated protein-like protein
  Pfam annotation: Domain name=Ank; Domain location=24-56; Score=39.6; E_value=1.1e-08; Accession=PF00023.20; Description=Ankyrin repeat
MNLIYDLLLLHLLASTFNCCLGRHGGTPLHHAAKRGFDSIVKLLLLHGANPLVLNDDCLTALEVARTKGHSNVVRTIESHLCLFSGWLCEFHGPGFLEVLAPQLVSKKVWVVVLPVGSRTLAKPYKLELAIYSRLQDAQPRTVIGLWNANLQDPKLHQSDPSVTVVDRITKTRVKLGPASENDKQQLTWFSNACKGIPQPSLIPPCEIHGLHDVIRLG

SEQ ID NO: 215908 - protein, 569 aa, Glycine max
  Coding DNA Sequence Number=SeqID_99130
  Homolog annotation: Hit_ID=Q1H0T9; Match level="QueryCoverage=44%, HitCoverage=53%, E-value=2e-29, Identity=32%"; Hit description=Outer membrane efflux protein
  Pfam annotation: Domain name=OEP; Domain location=96-271; Score=7.9; E_value=0.0036; Accession=PF02321.8; Description=Outer membrane efflux protein
DSRGSPKSQAALLNAYQKRLDVGVSGNSDLLPIRLQHDQSAWQLQQLELQIRQTEQKLMHDAGLTDQNNTGLNIAAVNLSQILKARFDQPQAYQDAKTIQHYALTNRMDIQRSLAQYAKAESQLKLAMAKRYPDLSISPGMMYDYGDKIWSLGINSMLNLFNRSSDLWAQAEQLRQNEAARFYALQHQTIQLSAQAHLKYSNAANLLITMSQQYDQQLNRKKQLEKQWKQGLIDKTEYLQAEIQFYTAQQRLITQQANVLRALQEIENVMQKPIVLSQREMAYAKQKQEVPVIFIVILIWVIVFLGRDEYELIQNESEEEIESPIHVSEQNGLQVVQLNLATQKNSGISVQPLQAYDYHGNIKVLGSVISIQTLVDYNSQYQLLKSQLALAESVLPNHQLQYQRYKQLNDDDKNVSDKALQEAQLLVINDQTHIKTTQAQLKALNDTIVAQWGQPLAMLVTQHPSPGPLHDLLMQKKVLVQVSFPLNFKAPEGNSSILITPIQDEITPIRADYVSQSIQTDISNIGKTYFYSAPADYLRVGMRVNVVPAQASSSLKGVLVPNQAIAWHG

SEQ ID NO: 215909 - protein, 143 aa, Glycine max
  Coding DNA Sequence Number=SeqID_99131
  Homolog annotation: Hit_ID=Q1SI74; Match level="QueryCoverage=77%, HitCoverage=58%, E-value=8e-37, Identity=84%"; Hit description =Ribulose bisphosphate carboxylase, large chain
  Pfam annotation: Domain name=DUF640; Domain location=8-114; Score =94.4; E_value=3.4e-25; Accession=PF04852.3; Description=Protein of unknown function (DUF640)
MFLFFFWHHHPEPLREPKAPRLEHVRAVPPQPQAPTLACTVQRRARAGVPALCPFFGHPNPPAACPCPLRQAWGSLDALIGRLRAAFEENGGKPEANPFGARAVRLYLREVRDSQAKARGISYEKKKRKRPQQPPLPPSNNAS

SEQ ID NO: 215910 - protein, 479 aa, Glycine max
  Coding DNA Sequence Number=SeqID_99132
  Gene Ontology: Mol. function=protein serine/threonine kinase activity; Cellular component=phragmoplast; Biological process =protein amino acid phosphorylation
  Homolog annotation: Hit_ID=Q53VE2; Match level="QueryCoverage=99%, HitCoverage=84%, E-value=0.0, Identity=88%"; Hit description=Ser/Thr protein kinase
  Pfam annotation: Domain name=Pkinase; Domain location=129-428; Score =283.6; E_value=3.7e-82; Accession=PF00069.15; Description=Protein kinase domain
  Pfam annotation: Domain name=Pkinase_C; Domain location=446-475; Score=9.5; E_value=0.049; Accession=PF00433.14; Description=Protein kinase C terminal domain
  Pfam annotation: Domain name=Pkinase_Tyr; Domain location=129-406; Score=11.4; E_value=3.6e-13; Accession=PF07714.7; Description =Protein tyrosine kinase
  Pfam module annotation: Pfam domain module=Pkinase::Pkinase _C::Pkinase_Tyr; Domain location=129-428::446-475::129-406
MDRCWFNKFKPKDKTQSSKNKETKGIAKEGSKPLTNEEAPSNVTKQKVAAAKQYIENHYKKQMKDLEERQERLCARNFCKWKLLRNMLEKKLADAEVSEEEQNNLLKYFEKKEREYMRLKRHKMGADDFEPLTMIGKGAFGEVRVCREKTTGHVYAMKKLKKSEMLRRGQVEHVKAERNLLAEVDSNCIVKLYCSFQDEEYLYLIMEYLPGGDMMTLLMRKDILTEDEARFYVGETVLAIESIHKHNYIHRDIKPDNLLLDRNGHMKLSDFGLCKPLDCSNLQEKDFSIGSNRSGALQSDGRPVAPKRSQQEQLQHWQKNRRMLAYSTVGTPDYIAPEVLLKKGYGMECDWWSLGAIMYEMLVGYPPFYSDEPMLTCRKIVNWRSYLKFPEEVKLSAEAKDLISRLLCNVDQRLGTKGADEIKAHPWFKGIEWDKLYQMKAAFIPEVNDELDTQNFEKFEEVDNQTQPSSKSGPWRKLQ

SEQ ID NO: 215911 - protein, 611 aa, Glycine max
  Coding DNA Sequence Number=SeqID_99133
  Gene Ontology: Mol. function=zinc ion binding; Cellular component =cellulose and pectin-containing cell wall; Biological process =metabolic process
  Homolog annotation: Hit_ID=Q9LW67; Match level="QueryCoverage=99%, HitCoverage=99%, E-value=0.0, Identity=70%"; Hit description=Ankyrin- like protein
  Pfam annotation: Domain name=DUF248; Domain location=90-598; Score =1153.4; E_value=0; Accession=PF03141.7; Description=Putative methyltransferase
  Pfam annotation: Domain name=Methyltransf_11; Domain location=217 -312; Score=34.8; E_value=2.9e-07; Accession=PF08241.2; Description =Methyltransferase domain
  Pfam annotation: Domain name=Methyltransf_12; Domain location=217 -310; Score=8.7; E_value=0.072; Accession=PF08242.2; Description =Methyltransferase domain
  Pfam module annotation: Pfam domain module=DUF248::Methyltransf _11::Methyltransf_12; Domain location=90-598::217-312::217-310
MSRGRSDGSQKKRLVASICVVATFLGFLSLKRLGSSYLGAEDDTDGKQDESSSSFRQGDGEDNIVPKSFPVDKLFKLKYISLVCDDRHSELIPCLDRHLIYQMRMKLDLSVMEHYERHCPPAERRYNCLIPPPSGYKVPIKWPQSRDEVWKANIPHTHLAHEKSDQNWMVVKGEKIVFPGGGTHFHYGADKYIASIANMLNFSNNNLNNEGRLRTVLDVGCGVASFGAYLLSSDIIAMSLAPNDVHQNQIQFALERGIPAYLGVLGTKRLPYPSRSFEFAHCSRCRIDWLQRDGLLLLELDRLLRPGGYFAYSSPEAYAQDEEDLRIWKEMSDLVGRMCWKVAAKRNQTVVWQKPPTNDCYMEREPGTRPPLCQSDDDSDAVWGVNMKACITPYSDHDNRAKGSGLAPWPARLTSPPPRLADFGYSNDMFEKDTELWQRRVEKYWDLLSPKITSNTLRNIMDMKANMGSFAAALRDKKVWVMNVVPQDGPNTLKLIYDRGLIGTTHDWCEAFSTYPRTYDLLHAWTVFSDIENKGCSKEDLLIEMDRMLRPTGFAIIRDKQSVIDFIKNHLSALHWEAIDSSSNSVQDGDEVVLIIQKKMWLTSESFRDTE

SEQ ID NO: 215912 - protein, 62 aa, Glycine max
  Coding DNA Sequence Number=SeqID_99134
MDFSSLYHVVNSGTVVPKQCGVTLGRYKEAIASQFSCAAVTTAITEWPKSRWSRCFVDATLK

SEQ ID NO: 215913 - protein, 258 aa, Glycine max
  Coding DNA Sequence Number=SeqID_99135
  Gene Ontology: Mol. function=calcium ion binding; Cellular component =mitochondrion; Biological process=protein amino acid dephosphorylatio n
  Homolog annotation: Hit_ID=Q5QIT3; Match level="QueryCoverage=83%, HitCoverage=39%, E-value=3e-64, Identity=57%"; Hit description =Protein phosphatase 2A beta
  Subcellular localization annotation: CTP_CleavageSite=95; ConfidenceScore=5.55e-01
MLDVKSLLADAKAGAPLNALENSTNTNALSINSLPSLFPAGSTPPLSPRSSSGSPRTTKQRNSPSLGSPLKLASEPVREREVIPQFYFKNGRPPPSEMKEHFLYQIDSRFYGHLDGLQLHEFKSFTKELCKLPSFFSTALFKKIDVNFTGTISRDQFIDYWIRGNMLAMDLPTQIYTILKQPYRAYLVQDDFKPVLRELLSTHPGLEFLQSTPEFQERYGHYPPCTALGKADGGLGSFEKPAPSNNLERECKKKMDNK

SEQ ID NO: 215914 - protein, 878 aa, Glycine max
  Coding DNA Sequence Number=SeqID_99136
  Gene Ontology: Biological process=cell cycle
  Homolog annotation: Hit_ID=Q2QVB9; Match level="QueryCoverage=98%, HitCoverage=72%, E-value=4e-57, Identity=38%"; Hit description =Expressed protein
MVLGLRSKSRKRVSIQVHYIIHVLEIKPWPPSQSLRSVQSVFLQWENGDKNSGSLPSTAGNGKIEFNESFRLSVLMCREASKKGKHPESFQKNCLEFYLYDKTVKSQLLGSAIVNLADFGIIKETKALSIVFNCKKSFRNSSQPFLYVTIQPFDIESSSSSPSSSLSKELSLEKEGSESVSQSLKDDDDLEIASFTDDDSDDIPSNTSQTSRSASEITGETQLSTSAILIACFHLISDSTKISRGREGSHGEFVLPSESTTASLNGNTEGEPSTQFSGINSPSSSTVLSSDVGIAAHGRPLLPKISEEIVKLADASSEIQKSIQQYSPSYISSSMKPNFERSLQPQVTQEDSMTQEDGTRDQRFNKDSLEKVSNVSKTGVLDDKEKMKEGRKGQEQFTMRNELLENELVKNSSDDGSIKKGKFNSTTLLLNKKTHEHPMSILMNDKTEDVTNVKSPPQSSENYGMFISNQNFERSLQSQVTQEDSMTQEDGTRDRRFNNDSLEKVSSVSKTGVMDDKEKMKKGRKGQEQFTMRNELLENELVSNLSDDGSTKKGKFNSTTFLLNKKTHEHPTSILIDDKTVDVTNVKSPPQSAENYGMFSSNQTHIQAEEINTTNDVHVGTSCHEDVNVNGSFLNNETELKAEVEMLQEELREAAALEVSMYSVIAEHGSSSNKVHAPARRLSRFYFHACRVGSPDTMASAAQSAVSGFVLVSKACGNDVPRLTFWFSNLILLRAIVSKEVERDGNGNTLHKEEKPFHSWEDPETFLVALEKVEAWIFSRIVESVWWQTLTPYMQSAAAKSSSSRKAYEKRYRVGDQDQGNFSIDLWKRAFKDACERICPLRAGGHECGCLPVIARLADGIECLYRLYQYPVVPFYCC

SEQ ID NO: 215915 - protein, 387 aa, Glycine max
  Coding DNA Sequence Number=SeqID_99137
  Gene Ontology: Mol. function=RNA binding; Cellular component =membrane; Biological process=regulation of transcription, DNA -dependent
  Homolog annotation: Hit_ID=Q6D2U9; Match level="QueryCoverage=97%, HitCoverage=96%, E-value=7e-73, Identity=41%"; Hit description =Nitrate-and nitrite-responsive positive regulator
  Pfam annotation: Domain name=ANTAR; Domain location=324-379; Score =77.0; E_value=5.9e-20; Accession=PF03861.5; Description=ANTAR domain
  Pfam annotation: Domain name=NIT; Domain location=32-253; Score =184.8; E_value=2e-52; Accession=PF08376.1; Description=Nitrate and nitrite sensing
  Pfam module annotation: Pfam domain module=ANTAR::NIT; Domain location=324-379::32-253
MDDALSWLQASRQSDIASLQRLRQTGKLITTVSELVHQLQRERGASNLWICSEGRLYGEQRLATQPGYSRFCNLIAAALQALAGLPALRQQITQQQIAHAQAVAAFSTIIRSLLNLVFEAADTASHPDITRALIALFSFMQGKELAGQERALGAAGFAAGQFSAEQRSAMVALIEAQEQSFMTFQQFADEAVLHHWQPLAQASREIERLRRIACTDGRRDDSGALHWFSLLSQRIDQMKLLEDQLSATLMLRCREAITLAQHQAAEPLNVAQSGCDFTLYVSGVDWLPTESGALNSDGLAPQLGRSLLSLITEQSQRLQHQANELATLRATLEERKLLDQAKTWLMQQHGLSEEHAWQRLRKSAMDQNKRLPEIAQAIVTVAATMKR

SEQ ID NO: 215916 - protein, 1020 aa, Glycine max
  Coding DNA Sequence Number=SeqID_99138
  Gene Ontology: Mol. function=nucleoside-triphosphatase activity; Cellular component=membrane; Biological process=cobalt ion transport
  Homolog annotation: Hit_ID=Q6D2V0; Match level="QueryCoverage=38%, HitCoverage=93%, E-value=1e-158, Identity=68%"; Hit description =Nitrate-binding proteint
  Pfam annotation: Domain name=ABC_tran; Domain location=625-806; Score= 249.8; E_value=5.7e-72; Accession=PF00005.17; Description=ABC transporter
  Pfam annotation: Domain name=BPD_transp_1; Domain location=472-633; Score=8.8; E_value=0.0025; Accession=PF00528.12; Description=Binding- protein-dependent transport s
  Pfam annotation: Domain name=NMT1; Domain location=53-277; Score= -82.7; E_value=0.073; Accession=PF09084.1; Description=NMT1THI5 like
  Pfam annotation: Domain name=Pyr_redox; Domain location=964-1020; Score=3.1; E_value=0.0083; Accession=PF00070.17; Description =Pyridine nucleotide-disulphide oxidor
  Pfam annotation: Domain name=Pyr_redox_2; Domain location=826-1016; Score=43.8; E_value=6e-10; Accession=PF07992.4; Description=Pyridine nucleotide-disulphide oxidor
  Pfam module annotation: Pfam domain module=ABC_tran::BPD_transp _1::NMT1::Pyr_redox::Pyr_redox_2; Domain location=625-806::472 -633::53-277::964-1020::826-1016
MSKSPVSLSRRQLLLSTAAAGGLWLLPGLRNAVWAAGSDAPEKATVRVGFIPLTDCAPVVMASVKGFDKKYGLTLQPSKEASWAAVRDKLISGELDAAHVLYSMIYGLQLGVAGPQHAMANLMTLNNNGQAISLSNQLKAQKVTDAASLKKTIDSKAKGSLTFAHTFPTSTHAMWLYYWLANAGINPFDDVRTVVVPPPQMVMNMKIGNMSGFCVGEPWNQRAISDDIGFTVATSQQIWPDHPEKILGTRAAWVKENPNTARALTAAVLEAARWIDASDDNRRETAQVLAGRAWINTKPEILQGRMLGQYENGQGQKWQDPHAMRFFHDGSVSFPYLSDGMWFLTQLKRWGMLTEDPDYLGVAKQINRIDIYKQAASAVGNITLPGSEMRSSTLIDGKTRSLTQPETLPTRATVVPLQRAIPALCGVMLLLLIWQIAALSSKGFPGPYATWEAAKILFADPFYNNGPNDQGIGWNVLASLQRVAIGFGLAALVGIPAGFLLGRFAFVARMFNPVIALLRPDYLNVARVLQLSEWTILRRILFPAVLPAVLTGVRLSIGIAWLVIVAAEMLTGGLGIGFWIWNEWNNLNGNTMQPIIRVQQVSQRFTTSGGDFLALDNVSFDIHQGETLSLIGHSGCGKSTLLNLIAGLTRPTSGVLLCDNREVTGPGPERAVVFQNHSLLPWLTAYQNVELAVEQVFKGKMNKAEMRDWIEHNLNQVQMSHAMHKRPGEISGGMKQRVGIARALAMKPRVLLLDEPFGALDALTRAHLQDSVMRIQQALNTTIVLITHDVDEAVLLSDRVLMMTNGPAAQVGDILTIDLDDTMRQRLLVAGNGMAGMHMVETLLQLAPMRYDITVIGREPHGNYNRVLLSPLLAGETTVEQTLIHDPDWYHRHGITLRVGETVEQVNIAERTLRTDQRLLHWDRLVLATGSQPCRPSVPGSDLPHVSTFRTLQDVNTLLAGHGPVVVVGGGYLGIEAAAGLQAQGRQVTLIHRHLAAIRTDSVILHDGRVLAAQQVVMAI

SEQ ID NO: 215917 - protein, 311 aa, Glycine max
  Coding DNA Sequence Number=SeqID_99139
  Gene Ontology: Mol. function=RNA binding; Cellular component =membrane; Biological process=regulation of transcription, DNA -dependent
  Homolog annotation: Hit_ID=Q6D2U9; Match level="QueryCoverage=96%, HitCoverage=73%, E-value=2e-48, Identity=38%"; Hit description =Nitrate-and nitrite-responsive positive regulator
  Pfam annotation: Domain name=NIT; Domain location=32-273; Score =208.1; E_value=2e-59; Accession=PF08376.1; Description=Nitrate and nitrite sensing
MDDALSWLQASRQSDIASLQRLRQTGKLITTVSELVHQLQRERGASNLWICSEGRLYGEQRLASEQDVTRCQRDFCQALPRVEAQPGYSRFCNLIAAALQALAGLPALRQQITQQQIAHAQAVAAFSTIIRSLLNLVFEAADTASHPDITRALIALFSFMQGKELTGQERALGAAGFAAGQFSAEQRSAMVALIEAQEQSFSTFQQFADEAVLHHWQPLAQASREIERLRRIACTDGRRDDSGALHWFSLLSQRIDQMKLLEDRLSATLMLRCREAIALAQHQAAEPLHVAQSGCDFTLYVSGVDWLPTES

SEQ ID NO: 215918 - protein, 323 aa, Glycine max
  Coding DNA Sequence Number=SeqID_99140
  Gene Ontology: Mol. function=methionyl aminopeptidase activity; Cellular component=mitochondrion; Biological process=proteolysis
  Homolog annotation: Hit_ID=Q66E99; Match level="QueryCoverage=79%, HitCoverage=98%, E-value=1e-116, Identity=76%"; Hit description =Methionine aminopeptidase
  Pfam annotation: Domain name=Peptidase_M24; Domain location=74-311; Score=280.1; E_value=4.4e-81; Accession=PF00557.14; Description =metallopeptidase family M24
MGIVKISDLMHENLRIASTALSRSINAQAEHWMKIGMLAELYPQLSHQELTRLLMRVERNRAMSIKLHTAEEIERARAAGHAAAKVLEMIAPWVKPGVTTDELDRRCHDYIVSELKVIPANIGYQGYTRTVCTSVNHVVCHGIPGEKKLKDGDIVNIDVAVIKDGWYGDTSRMYFVGQPSVRAKRLVDVTYESMVAGIRVVKPGATLGDIGAAIQQVAEKAGFSVVREYCGHGVGEIYHSDPQILHYGTPGQGLALQAGMIFTIEPMINAGKAGTSVLSDGWTVVTKDRSLSAQWEHTIAVTDTGFDLLTPWPEGTGDYAAIV

SEQ ID NO: 215919 - protein, 82 aa, Glycine max
  Coding DNA Sequence Number=SeqID_99141
MLQDEEGIRVAVSSYVFCNYKIATYSTLLVAAEQAEEGEDVRIVRRILQQESQMASWLLQLLPQAAEEAIVLRTEPELSGTD

SEQ ID NO: 215920 - protein, 343 aa, Glycine max
  Coding DNA Sequence Number=SeqID_99142
  Gene Ontology: Mol. function=methyltransferase activity; Cellular component=chloroplast; Biological process=electron transport
  Homolog annotation: Hit_ID=Q8PDN8; Match level="QueryCoverage=97%, HitCoverage=97%, E-value=1e-126, Identity=65%"; Hit description =Vanillate O-demethylase oxygenase subunit
  Pfam annotation: Domain name=Rieske; Domain location=23-122; Score =85.4; E_value=1.7e-22; Accession=PF00355.16; Description=Rieske [2Fe- 2S] domain
MNNITPPAHCTFEPDDWLRLARQWHPVARSCDIAGAPTKAVLLDEQLVLYRLQGQVVAARDVCPHRGVPLTLGFHDEEGIVCPYHGLRFGADGRCNRIPSSPDQPIPAKLNLISYAVEERFGLIWVCLAPDADQPAPLPTMPHWDDAGFQQINCPGFDVNGFAGRQVEGFLDVAHFAWVHTETFADPNNQLVPAYNPVETETGFAVDYWSSVSNFAADSPQQAPEGFSWLRHFEMHLPFTATLTIHFPGESRLVIMNAASPVSARKTRMFAPIARNFDLHIPVEEVHAFNQRVFEEDRLMVETQQPERLPLDLALEAHIPADRSSIAYRRGLKRMGFGEFFLV

SEQ ID NO: 215921 - protein, 105 aa, Glycine max
  Coding DNA Sequence Number=SeqID_99143
MHSPYPHLVTIFLHHFKIPLEDEPFVQVKRSFAISAGAIISFGYRKDDDGQWVRKQNLPQPIPDECTLSPPPQRVDSSSLLNDVLSELHSVRAFVGDRFDAMDTR

SEQ ID NO: 215922 - protein, 61 aa, Glycine max
  Coding DNA Sequence Number=SeqID_99144
MEEKSEVYKHYSTDAGDWRLVVARLLLMLACTEEQWLTILQYKHKIRNNYSKSFYVYQLGQ

SEQ ID NO: 215923 - protein, 234 aa, Glycine max
  Coding DNA Sequence Number=SeqID_99145
  Gene Ontology: Mol. function=lipid binding; Cellular component =nucleus; Biological process=endocytosis
  Homolog annotation: Hit_ID=Q9LW61; Match level="QueryCoverage=73%, HitCoverage=62%, E-value=6e-48, Identity=55%"; Hit description =Arabidopsis thaliana genomic DNA, chromosome 3, P1 clone: MLM24
  Pfam annotation: Domain name=ENTH; Domain location=31-155; Score =142.9; E_value=8.7e-40; Accession=PF01417.11; Description=ENTH domain
MGSLFLGQIKKQTSTFLQEKFKSARMTFTDVTEAEMLAEEATNKDDCSPDAKTMTRIAEASFDIDEYWRIVDVLHRRLYNIDWDQWRQSYKALVLLEFLLTHGPREFAPEFQCDAEVIEELGIFTHIDEKGFNWGSRMLKLSEQILKLLQDEEALIEARLKALKITNEIQGFGSSFNSPTSSSSSSSSPWSLSSEASQGSSSFYSFSTTSTPAYTFDSNDQLNKHHSPTSIAND

SEQ ID NO: 215924 - protein, 945 aa, Glycine max
  Coding DNA Sequence Number=SeqID_99146
  Gene Ontology: Mol. function=transmembrane receptor activity; Cellular component=membrane
  Homolog annotation: Hit_ID=Q9FHR5; Match level="QueryCoverage=90%, HitCoverage=62%, E-value=1e-138, Identity=38%"; Hit description =Similarity to COP1-interacting protein 7
  Pfam annotation: Domain name=Spc24; Domain location=571-712; Score= -17.2; E_value=0.095; Accession=PF08286.2; Description=Spc24 subunit of Ndc80
MAFARAVAAGFDIDYIPPLMSFAECFGASRMKDACTKFRDLWRRKHETGQWLEIEAAETMSNRSDFSPLNVSGIILPSMASASHTELDSESNGKASSDVPPMDRQPSVGNHDNIQGQFPHHMFPPWPVHSPPGSVPVFSPYPVQGIPYYPAYPGNSPFMQPNYSPMEDPRLTAGQNNGRRRHSMDSRHSNTEPETQDEVDMEREGLHTGDQRKKDRRSARQKSGMVVIRNINYITKAENSGSGSYSDSASETDEDNKESVKTSKRREPGKESLKKLDSSDMEETEHGKDADGGHWQAFQNCLLRDVDEDRHAIDKDQFDQEKVHDVRRKKHIAINDPLVFNDREMHEVQGSSAIDMHSISKGLTHMPKTSNDDLLLSASAGQSGDGWSGDDVQSLEANGKRGGYRRAARDDFIISKQENQFGNAYPSSDVETSLGYSNNKLERKLFHDMNDDSYILEHRSMEVNDAGNVERNAIDMDSEIPMVQRSSDEINCINYEPDELSMLPERGAESASMSYDPALDYEMQAQAGGTLQNKNKEVLTDTKPGSKRLDKEAKSKLTPNNSDKRKTGGPIRRGKTSKPNALDEARARAESLRNYKADLQKMKKEKEEEEMKRLEALKMERQKRIAAKSSSITAQSPSQLSKKQLPTKLSPNSRKGSKFSDSEPGASSPLQRFPVRTASVGSNDSLKASKTSRLISGSHLDSNKLSRSVSSLPESKIEKDDSTTDTKASMARIRRLSEPKMSNTRQTSSVKPHGTGTISKTKAADAPESKKISAIVSHDKSKTAALPELKIRTSKASDVPQNRTAVKEKAHKLNDNKSSMNSRGTMPKKKEIGTSSNDDGDDNPVVEKTVVMLECEKPYVPPIHGSEENFDIPKKQYDNDEVTEKTETTSNYAAIRAPVSPFSMDITDKETSENQSHLQPISTELCFTKRKDVLPIRCAYCKLWK

SEQ ID NO: 215925 - protein, 88 aa, Glycine max
  Coding DNA Sequence Number=SeqID_99147
  Gene Ontology: Mol. function=protein phosphatase type 2C activity; Cellular component=protein serine/threonine phosphatase complex; Biological process=protein amino acid dephosphorylation
  Homolog annotation: Hit_ID=Q9LW60; Match level="QueryCoverage=94%, HitCoverage=32%, E-value=5e-24, Identity=64%"; Hit description =Protein phosphatase 2C-like protein
MLACQSGNAAGAKHSRGSDLSVRSERIDSDTEFLILASNGIWEVMKNQEAVNLISHIEDPQEAAECLAKEALIRMSKSSISCLIIRFD

SEQ ID NO: 215926 - protein, 191 aa, Glycine max
  Coding DNA Sequence Number=SeqID_99148
  Gene Ontology: Mol. function=protein phosphatase type 2C activity
  Homolog annotation: Hit_ID=Q9LW60; Match level="QueryCoverage=99%, HitCoverage=66%, E-value=5e-27, Identity=36%"; Hit description =Protein phosphatase 2C-like protein
MGFYLNLKRKAFRLKRFLLGHEGRKRKYKQAKKPSWMRPMTYGYQVVESNMARDGSDDSDFDSVVAQREEMDQTELWYFGIFDALIGDKVTKYMQSYFFDKMLQETHIRRKSKEALKRAYLGVRAMIREQHKLEETCRMGSASVMLIDGEKLVVANMGDYRIVVCRDGIAHQTTGTYLQSAKIHWSRRFFA

SEQ ID NO: 215927 - protein, 48 aa, Glycine max
  Coding DNA Sequence Number=SeqID_99149
  Homolog annotation: Hit_ID=O22797; Match level="QueryCoverage=91%, HitCoverage=23%, E-value=5e-09, Identity=66%"; Hit description =Expressed protein
MEVTVFTPALEGIKLVKSEQGEILTQPFLDACKHILPVIGTSMALYFF

SEQ ID NO: 215928 - protein, 116 aa, Glycine max
  Coding DNA Sequence Number=SeqID_99150
MREREMITTIDTLPVFYYEKMVGYMPSSFVDLVFAGERIEVRLRRGKFDYVASMISGNRRPRAGGEQKKEGDAHAKIVVPTWPSSPQTPHNPMYQYPQHQYNYLANIGSPPCPTPL

SEQ ID NO: 215929 - protein, 227 aa, Glycine max
  Coding DNA Sequence Number=SeqID_99151
  Pfam annotation: Domain name=PBD; Domain location=68-138; Score=21.1; E_value=0.00048; Accession=PF00786.18; Description=P21-Rho-binding domain
MDPFWLDGSLARRMELFKWKVKPVETLMLIRCSWRIGKVVGIMKDHEWKEGGKLIETIIDEEDEKEIQIGFPTDVKHLAHIGAENAKASQPSWLSEFKELSEGGTVTKGTSEGDASGIVEDDANSKGEGSRRSRKSRPRSTESQSSMTPDICKPSRRHHSESSRRMSRHSSEEEKTSKPTHRRKSKTSEEKDEKEGSSRRAPRSRRQPKGDSLTDFSFSDSGPSGPN

SEQ ID NO: 215930 - protein, 239 aa, Glycine max
  Coding DNA Sequence Number=SeqID_99152
  Gene Ontology: Mol. function=structural molecule activity; Cellular component=chloroplast thylakoid membrane
  Homolog annotation: Hit_ID=Q5QJB6; Match level="QueryCoverage=82%, HitCoverage=84%, E-value=4e-97, Identity=84%"; Hit description =Harpin binding protein 1
  Pfam annotation: Domain name=PAP_fibrillin; Domain location=65-237; Score=147.4; E_value=3.8e-41; Accession=PF04755.3; Description=PAP _fibrillin
  Subcellular localization annotation: CTP_CleavageSite=52; ConfidenceScore=5.78e-01
MSLLSASFTASTPIALASSSSLSSRPTARSILGDGNTSDSISTVGVADSSPSSSGYAGNTSDSISSLKLNLLELEAGGGFVNLSLGLENLQGRWKLIYSSAFSSRTLGGSRPGPPIGRLLPITLGQVFQRIDILSKDFDNIVELQLGAPWPLQPLEVTATLAHKFELIGSSKIKIVFEKTTMKTAGNLSQLPPLEVPRIPDALRPPSNTGSGEFEVTYLDSDTRITRGDRGELRVFVIA

SEQ ID NO: 215931 - protein, 76 aa, Glycine max
  Coding DNA Sequence Number=SeqID_99153
MKRDCHPLLRGGRRCNKYTPHILSSAEMESLSSICEALLPPLQLDSTKSKTVQHFWKASGSQFSIPHEGLANHSEH

SEQ ID NO: 215932 - protein, 756 aa, Glycine max
  Coding DNA Sequence Number=SeqID_99154
  Gene Ontology: Mol. function=microtubule motor activity; Cellular component=microtubule associated complex; Biological process =microtubule-based movement
  Homolog annotation: Hit_ID=O23291; Match level="QueryCoverage=98%, HitCoverage=74%, E-value=0.0, Identity=55%"; Hit description=Kinesin like protein
  Pfam annotation: Domain name=Kinesin; Domain location=60-385; Score =282.2; E_value=1e-81; Accession=PF00225.13; Description=Kinesin motor domain
  Subcellular localization annotation: CTP_CleavageSite=44; ConfidenceScore=5.47e-01
MAPTPSSKQNHPTQLKTPQSKHRLNFNALKSAPQTHPSPNPNSVANKEPPPEHPIEVIARIRDYPDRKDKPLSVLQTSSNSSSIRVRADFGYRDFTLDGVSVSEEEDLDVFYKKFVESRIHGVKLGDKCTIMMYGPTGSGKSHTMFGSSKQAGIVYRSLRDILGDGDGADGDSGGGLGTFVQVTVLEIYNEEIYDLLSTNGGGGGGGFGFGWPKGGSASKVKLEVMGKKAKNATYISGNEAGKISKEIQKVEKRRIVKSTLCNDRSSRSHCMVILDVPTVGGRLMLVDMAGSENIEQAGQTGFEAKMQTAKINQGNIALKRVVESIANGDSHVPFRDSKLTMLLQDSFEDDKSKILMILCASPDPKETHKTISTLEYGAKAKCIVRGPHTPVKDDESSSAVILGSRIAAMDEFILKLQMETKQREKERNEAHRKLLKKEEEIVALRAKLNMAEGKGTPPSEEEINLKVNERTRLLRQELEKKLEECQRMTNEFVELERKRMEERILQQQEEVETLRRRLEEIELQLCSKQGCKEENESKDVESSGFMRRLLRVYKSEDDPGMVKSMDLDMDDQEPLGREVNIVGGVMCRSDYNVKQDSSNQPGPNALTGVKEDAHVFSPNFGQRACLSTVYEEEGEGEGEDEEVEKGIIEEKRVCSVEKPSGAGSLGTLNLSNTSPNKEEFCLKVSSGDNDSRLLRIQNIFTLCGNHRQLSQHIGTPVSTKKRSDETFEFSPANDKDSIFKTSNKENFEPHHVLGN

SEQ ID NO: 215933 - protein, 50 aa, Glycine max
  Coding DNA Sequence Number=SeqID_99155
MRGGGCIATCPGKLLASSRSYLAFLGELTKCAIIDVKQLNSTSKNPNVCK

SEQ ID NO: 215934 - protein, 255 aa, Glycine max
  Coding DNA Sequence Number=SeqID_99156
  Gene Ontology: Mol. function=hydrolase activity, acting on carbon -nitrogen (but not peptide) bonds, in linear amides; Cellular component=endoplasmic reticulum membrane; Biological process =ceramide metabolic process
  Homolog annotation: Hit_ID=Q2HVG4; Match level="QueryCoverage=99%, HitCoverage=100%, E-value=1e-117, Identity=78%"; Hit description =Alkaline phytoceramidase
  Pfam annotation: Domain name=aPHC; Domain location=6-255; Score =338.8; E_value=9.3e-99; Accession=PF05875.3; Description=Alkaline phytoceramidase (aPHC)
MAEIISSFWGPVTSTTDCCEKNYAYSSYIAEFYNTISNIPTILLALIGLISAHTQRFEKRFCVLHLSIMAFAIGSMLYHATLQHVKQQSNETPMMWEILLYIYILYSPDWHYPRTMPIFLCLYGAIFAIVHSVLRFGIGFKVHYVILSLLCIPRMYKYYIYTDDVCAKCLARLYVATLLLGSLAWLSDLVFCNKISSWPINPQGHALWHVFMGFNSYFANTFLMFCRAQQCGWSPRIVRLMGVLPYVKIQKPKRQ

SEQ ID NO: 215935 - protein, 603 aa, Glycine max
  Coding DNA Sequence Number=SeqID_99157
  Gene Ontology: Mol. function=oxidoreductase activity, acting on CH-OH group of donors; Biological process=electron transport
  Homolog annotation: Hit_ID=Q9LW56; Match level="QueryCoverage=98%, HitCoverage=83%, E-value=0.0, Identity=61%"; Hit description =Similarity to long chain fatty alcohol oxidase
  Pfam annotation: Domain name=DAO; Domain location=96-494; Score= -61.5; E_value=0.074; Accession=PF01266.14; Description=FAD dependent oxidoreductase
  Pfam annotation: Domain name=GMC_oxred_C; Domain location=448-596; Score=-33.7; E_value=0.0007; Accession=PF05199.4; Description=GMC oxidoreductase
  Pfam annotation: Domain name=GMC_oxred_N; Domain location=142-377; Score=350.0; E_value=3.8e-102; Accession=PF00732.10; Description=GMC oxidoreductase
  Pfam annotation: Domain name=Pyr_redox_2; Domain location=96-524; Score=-39.5; E_value=0.076; Accession=PF07992.4; Description =Pyridine nucleotide-disulphide oxidor
  Pfam module annotation: Pfam domain module=DAO::GMC_oxred_C::GMC _oxred_N::Pyr_redox_2; Domain location=96-494::448-596::142-377::96 -524
MALHQQLLKSFFGQQRKGSAEMCDDNGENPAWEAIGYQVDSDGITTTSNVHRERPLEKGIVEAMKESNLSLPKSLIEKGLEVAIDSKNNTLNIKCDVVIVGSGCGGGVAASILASSGLKVLVLEKGNYFTPNDYSSLEGPSLNELYELGGTFASRDGKMAILTGTTVGGGSAVNWAASIRTPDFVLEEWGKDHKLSLFSSHEYLSAMDMVCKRIGVTDKCIEEGLQNQVLRKGCKNLGLPVDYVPRNSSERHYCGSCNYGCTRGEKQGTEVTWLVDAVDHGAVILTGTKAERFILGKKNKGGGVRRKKCLGVMANVVTNNITWRLKVEAKVTVSACGALFTPPLMISSGLKNKHIGKNLHLHPVLMSWGYFPDSNSELKGKCYEGGIITSVHKVVSEDYSKVKAIVETPALGPGALSTLIPWVSGLDFKDRMLKYSRTVHLITIIRDMGCGEVRSEGRVHYELDESDKENIRDGVKQALRILIAAGAVEVGTHRSDGHRIECNGKNEKELERFVESVYATEGLMSHEEKWSIYSSAHQMGSCRMGMSEKEGAVDENGMSWEAEGLFVCDASLLPTAIGVNPMITIQSTAYCVAKRIAAFLKIE

SEQ ID NO: 215936 - protein, 167 aa, Glycine max
  Coding DNA Sequence Number=SeqID_99158
  Gene Ontology: Mol. function=RNA-directed DNA polymerase activity; Biological process=RNA-dependent DNA replication
MGPSLLAFLPSHRREGCDRKGREKLSLFTRARATGGADQSRLPELGATMFPRLQIEKLADHRATGDFYFEFDVVKSDNESYESSDTKDLDVDFEKPVNQVEEEEGDDWGFPSDLKRIVEREERKIKSHQEETEVVNLGTSEEKKEDIPGLSLEIVQHKLPMNLECSP

SEQ ID NO: 215937 - protein, 453 aa, Glycine max
  Coding DNA Sequence Number=SeqID_99159
  Gene Ontology: Mol. function=phosphatidate cytidylyltransferase activity; Cellular component=membrane; Biological process =phospholipid biosynthetic process
  Homolog annotation: Hit_ID=Q2HT24; Match level="QueryCoverage=99%, HitCoverage=99%, E-value=0.0, Identity=83%"; Hit description =Phosphatidate cytidylyltransferase
  Pfam annotation: Domain name=CTP_transf_1; Domain location=67-398; Score=470.4; E_value=2.2e-138; Accession=PF01148.10; Description =Cytidylyltransferase family
MQKDTSTTAPSTTSGRVRHRKRSNEKLILKFEENMEKCQNSKVIPEVSKANGTKLLVNDKSKYKSMLIRAYSSVWMIGGFVLIIYMGHLYITAMVVVIQIFMARELFNLLRRAHEDRQLPGFRLLNWHFFFTAMLFVYGRILSQCLVNTVTSDMVLYWLVSNLIKYHMVICYSLYIAGFMWFILTLKKKMYKYQFGQYAWTHMILIVVFGQSSFTVASIFEGIFWFLLPATLIVINDIAAYIFGFFFGRTPLIKLSPKKTWEGFIGASVTTIISAFMLANIMGRSQWLTCPRKDLSTGWLHCDPGPLFKPESYPLPGCISHWFSWKEISILPIQWHSLCLGLFASIIAPFGGFFASGFKRAFKIKDFGDSIPGHGGITDRMDCQMVMAVFAYIYHQSFVVPQTLSVEMILDQMFNLWNCRCSLQISMNLTFDEQQALYWRLGEILQQGFARMS

SEQ ID NO: 215938 - protein, 38 aa, Glycine max
  Coding DNA Sequence Number=SeqID_99160
MAKIPLRHFIEHLVGALLGTNNKGMGAMWLAPLSQNTT

SEQ ID NO: 215939 - protein, 186 aa, Glycine max
  Coding DNA Sequence Number=SeqID_99161
  Gene Ontology: Mol. function=receptor activity; Cellular component =integral to membrane; Biological process=red or far red light signaling pathway
  Homolog annotation: Hit_ID=Q8S403; Match level="QueryCoverage=98%, HitCoverage=24%, E-value=6e-40, Identity=51%"; Hit description =Putative phosphate transporter 1
  Pfam annotation: Domain name=SPX; Domain location=2-173; Score=20.2; E_value=1.3e-07; Accession=PF03105.10; Description=SPX domain
MVKFSKELEAQLIPEWKEAFVNYWQLKKQIKRIKLSRIPKQSHHHAKPDFGLSIFDSLSFFVKNIAQNFSASDHHDLNIIQVRKKTTKDDEEEIYETELAQLFSEEDEVRVFFMRLDEELNKVNQFYRRQESEFIERGETLNKQLQILLDLKQIISDCRRKNSPSKPYSTGVSPQYSPTRDSDYSG

SEQ ID NO: 215940 - protein, 217 aa, Glycine max
  Coding DNA Sequence Number=SeqID_99162
  Gene Ontology: Mol. function=receptor activity; Cellular component =integral to membrane; Biological process=red or far red light signaling pathway
  Homolog annotation: Hit_ID=Q8S403; Match level="QueryCoverage=99%, HitCoverage=27%, E-value=4e-93, Identity=73%"; Hit description =Putative phosphate transporter 1
MDEVESIFTKHFANNDRKKAMKFLRPQQHKDSHMVTFLVGLSTGCFVSLFCVYAILAHLCGIFSSNNEPAYMETVYPVFSVFTLLSLHLFMYGCNLFMWKNTRINYNFIFEFSPSTALKHRDAFLMSTTLMTTVIGAMVIHLLLRAANFSPTEIDAIPGILLLFFVVLLICPFDLFYRPTRYCFIRVIRNIVCSPFYKVLLVDFFMADQLTSQIPIA

SEQ ID NO: 215941 - protein, 136 aa, Glycine max
  Coding DNA Sequence Number=SeqID_99163
  Gene Ontology: Mol. function=calcium-dependent phospholipid binding; Cellular component=integral to membrane
  Homolog annotation: Hit_ID=Q1S322; Match level="QueryCoverage=80%, HitCoverage=56%, E-value=6e-34, Identity=59%"; Hit description =Uncharacterized Cys-rich domain
  Pfam annotation: Domain name=PLAC8; Domain location=11-109; Score =138.4; E_value=1.9e-38; Accession=PF04749.7; Description=PLAC8 family
MLGGRSFPPKWSAKFCDCGEDPKTCLITCCLPCVTFGQIAEIVDEGRSSCFGQGCAYGLLMLVTCHWLYSCLYREKLRSKFGLPAEPCCDCCVNFCCEACALCQEHAELKARGFDPSKGWIGPPNAPPRMPPSMSR

SEQ ID NO: 215942 - protein, 104 aa, Glycine max
  Coding DNA Sequence Number=SeqID_99164
  Gene Ontology: Mol. function=transition metal ion binding
MEKTKPVGILESRHDKRVRGKGSRGLHVIAPSLEELQQTYLYILNNNNEVLLYIVRLEALVKENIIFGDHNASEMLRKLAGGPKRNVITWQGYDINKYSFYKKS

SEQ ID NO: 215943 - protein, 52 aa, Glycine max
  Coding DNA Sequence Number=SeqID_99165
  Gene Ontology: Cellular component=integral to membrane
  Homolog annotation: Hit_ID=Q1S566; Match level="QueryCoverage=96%, HitCoverage=16%, E-value=4e-11, Identity=65%"; Hit description =GNS1/SUR4 membrane protein
PPEPPRSVDLGCDREEDASKDRDGDEGHGEAVDGGEWPKRDLTTAKEERKRE

SEQ ID NO: 215944 - protein, 154 aa, Glycine max
  Coding DNA Sequence Number=SeqID_99166
  Subcellular localization annotation: CTP_CleavageSite=72; ConfidenceScore=5.20e-01
MNCVFVLGPSPLEFGAMRSDCLVQFSILNLFRSPMNCVFVHVSSTFEFGAMRSDCLVQFSIVNLFRSPMNCVFVHVSSTFEFGAMRSDCLVQLSMLNLFRSPMNCVFVHVPSTFEFGAMRSDCLVQFSILNPLSEPHELCFRSWALNLRVWSYA

SEQ ID NO: 215945 - protein, 115 aa, Glycine max
  Coding DNA Sequence Number=SeqID_99167
MVINLPEVAMQTRLHSYAIVANLLINREMLAYATLTCGKEMHAHALRTGVIQNVGKEPMPLLKQPCVEPQHLEDKVYFQGPWNDMNDTSKPTKPETRETPATRVQKGEETKRRGG

SEQ ID NO: 215946 - protein, 45 aa, Glycine max
  Coding DNA Sequence Number=SeqID_99168
MEEGYAASSFASQVLQGKVAKEPQMFAISGAVVVAAGLVEERMVY

SEQ ID NO: 215947 - protein, 71 aa, Glycine max
  Coding DNA Sequence Number=SeqID_99169
MVGPMTCGGTLWSRILFFHYPETIKSDSTQRQIMVIRTLLLSGQRVGWWAEIPYGHLRLSSTERNEFEEVP

SEQ ID NO: 215948 - protein, 231 aa, Glycine max
  Coding DNA Sequence Number=SeqID_99170
  Gene Ontology: Mol. function=nucleic acid binding; Biological process= DNA integration
  Homolog annotation: Hit_ID=Q1RWN2; Match level="QueryCoverage=83%, HitCoverage=14%, E-value=8e-58, Identity=60%"; Hit description =Peptidase S8 and S53, subtilisin, kexin, sedolisin; Integrase, catalytic region; Zinc finger, CCHC-type
MASENFVQLNLLRSKEFWQVVADGVATPSNDVALTDAQQKEYEVMKLKDLKAKNYLFQAIDRSILETILCKDISKEIWDSMKKKYQGSSQVKRAQLQALRRDFEVLQMKEGEPVTNYCSRTMGIANNMRFHGEKMTDTTIVEKIIRSLTPKFDYVVCSIEESNDIDDLSLDEIQSSLLVHEQKMNRSSTMKEHALKVSTNTHSNNFKGRGRGKGRGRGHRDRGDRDFSNNS

SEQ ID NO: 215949 - protein, 81 aa, Glycine max
  Coding DNA Sequence Number=SeqID_99171
MGGYLMVTRSFRQPGANEPVDARRLTSSSAPFVVLTRESGDMRGYLMVIYTFRQLGANEPVYARRLKSSSAPFDVLTREVR

SEQ ID NO: 215950 - protein, 251 aa, Glycine max
  Coding DNA Sequence Number=SeqID_99172
  Homolog annotation: Hit_ID=Q9AVH2; Match level="QueryCoverage=33%, HitCoverage=41%, E-value=3e-39, Identity=70%"; Hit description =Putative senescence-associated protein
MTEGCGEGFCLANLPGDAFSLWGNFFEAKKQMMADAKFAGLLGLGKPLKKNFAPRSTSWFLPVVGLARVGGAGLWPRAKFRIGWPPPPPREGRIKATRAESQWIVAARPLCHLQYPVAYLSRLQRILPAARWELRFKASRRANPPHEGHQRHVPLGGRGPLLLVGKRTAGARVASSPDSDLEAFSHNPTHGSFAPLAFQPSAMTNSHVPYWWVNNPTLGEFCFTMIGRADIEGSKSNVAMNAWLPQASYPC

SEQ ID NO: 215951 - protein, 440 aa, Glycine max
  Coding DNA Sequence Number=SeqID_99173
  Gene Ontology: Mol. function=hydrolase activity, hydrolyzing O -glycosyl compounds; Cellular component=periplasmic space; Biological process=carbohydrate metabolic process
  Homolog annotation: Hit_ID=UPI00005F91D7; Match level="QueryCoverage =98%, HitCoverage=55%, E-value=0.0, Identity=73%"; Hit description =COG1472: Beta-glucosidase-related glycosidases
  Pfam annotation: Domain name=Glyco_hydro_3_C; Domain location=47-307; Score=240.1; E_value=4.8e-69; Accession=PF01915.12; Description =Glycosyl hydrolase family 3 C terminal domain
WMRLWGRVLTEKFRLGLFEEPYVDENGIDLQNEVTRQVAREVATKSVTLLENNGILPLGGKPRVAVVGPTADDPLALLSGYSFPVHLIISDMVEETSQVTTPRAALEHYLGASQVRYAKGCHIIEKRMAGAPVFPGDSGGKPMQQSPVSQSTVLIPEAVNAAQESDVVVACVGDLAGLFQSGTVGEGSDTDSLNLPGVQQQLLEALVATGKPVIVVMTGGRPYHLQGLEDKVAALIVAWAPGQEGGWAIADVLTGRAEPQGRLVVSVPKSAGAMPYYYNHKLKSGGTPFAFHFGARYPFGFGLGWTTFSWGNASVASSEVSVDGEVALSVEITNTGERSGSEVVQVYVRDKVATQVRPLQELKAFQRVTLSPGETATLTFTLPVEMFNFTRRDGKRIVEPGEFELQMGASSADIREAVTVNVTGETRVLPAEWRMLSTCE

SEQ ID NO: 215952 - protein, 139 aa, Glycine max
  Coding DNA Sequence Number=SeqID_99174
  Subcellular localization annotation: CTP_CleavageSite=81; ConfidenceScore=5.47e-01
MTTLAQTWSVLSFSNLIPTSHTSYVTLDRAKLIYVTFRRPRKGRGKRSEAPTTSAPPETLAPSSSTAPLPPTQTPVIPPTSTSEEETSIDQILEPSSAPIPDDAIPSAPVTEPEQPIQESSVAPALDLNEDQPQDEQDI

SEQ ID NO: 215953 - protein, 112 aa, Glycine max
  Coding DNA Sequence Number=SeqID_99175
MKLTLVVVTMELVSTMMMWWWWQPMMVTLTVMEAILVMMMVEMVTTSGSNGSCGDGDKGGVVGSNSSSNNNIDDNDCGIKWWRCSDTNGGNNVGDVGDNDDSSDDGGGGGDN

SEQ ID NO: 215954 - protein, 382 aa, Glycine max
  Coding DNA Sequence Number=SeqID_99176
  Homolog annotation: Hit_ID=Q9FMU1; Match level="QueryCoverage=91%, HitCoverage=89%, E-value=3e-33, Identity=32%"; Hit description =Arabidopsis thaliana genomic DNA, chromosome 5, P1 clone:MUA22
  Subcellular localization annotation: CTP_CleavageSite=29; ConfidenceScore=5.04e-01
MKLFQWVHRKLRQNSIDPFKGFTLGNPCTCLTVQPTLDNQYSQTKPSFSSINQPSFSKPHHQENQTSYSGLVDSREDKPQEETPAIVAELFEGFLTIGTLGAETVTNEPGTPTFAMPSENITLRSEEVTENELKLISYELEKFLEAEKEESSYDSSGRNSYVSIITLCGKEIDGPKAEDYRNKDDCPLQGYLLGSSFELPETKQERKERASLAELLYKIKATSQDCIETGIQGETQVKRTTKSSAMHIMRKILKRVHSSSKSCNTSRDDADSASTNKKLHKVLRMFHRKVYPESPVDGNDCIQSHKGKIKNVPHECLQEYDDGKFTNPDKGKRFYSDTKSRKWSQHCMTNWNPPQHGLICSSSTGNNEHWIKTDAKYLVLEL

SEQ ID NO: 215955 - protein, 74 aa, Glycine max
  Coding DNA Sequence Number=SeqID_99177
MVDLTITKHAKVWPKSDREKLWELEIKDEELDIGHSNVHPVVANALKNNTSHAIGNEKMLVLESTMRVSLNIDT

SEQ ID NO: 215956 - protein, 117 aa, Glycine max
  Coding DNA Sequence Number=SeqID_99178
MIGLSLLWEGEWYLGIDFGRVGLMCSSVVDVEITCEGLSLIVVRESFVRTIYLFLTVELGVSSAWLDFLLKVDQHDAPPEWRIPPQQLQGDDTTMMVVREVGGAMMWQHGSSGARWA

SEQ ID NO: 215957 - protein, 152 aa, Glycine max
  Coding DNA Sequence Number=SeqID_99179
  Subcellular localization annotation: CTP_CleavageSite=2; ConfidenceScore=5.04e-01
MEASSLRSLNANASTLLLFGSGGVRKLGAWFVTSVVVPIVEKKEKNKVIFTSFFKKKIPMYNPTQTKITHDTTRRMSMCSINDHIMIRTRGLHRALGIVIGRTLGTQVSCDAKEAPQRRRPITSARGQRAAAIIAEDVEHVNNSTNEVHEQA

SEQ ID NO: 215958 - protein, 192 aa, Glycine max
  Coding DNA Sequence Number=SeqID_99180
MDSVSREERAYFERGVITVDSGKLEPAIASMVQRGKRNPIGGFKAVYVVIHGGSGWVPGSATANRQGGVMGISASNYRNFNDRKAMIPPKLARPKYEVVWKGDVNGAELKVAGSIHNNAAEGWTIIIGMQVAWERGFKDLFIESDSTTIISLINDGCSSDHAFNHVVEAIKDFARKDDITNGVISLEKPACG

SEQ ID NO: 215959 - protein, 45 aa, Glycine max
  Coding DNA Sequence Number=SeqID_99181
MNSKNEEQLFGAIPRLETQKEMEGGSAQRGIVSTHSLMVRITFSP

SEQ ID NO: 215960 - protein, 211 aa, Glycine max
  Coding DNA Sequence Number=SeqID_99182
  Gene Ontology: Mol. function=nucleotidyltransferase activity
  Homolog annotation: Hit_ID=Q6R3K6; Match level="QueryCoverage=57%, HitCoverage=18%, E-value=3e-43, Identity=75%"; Hit description=Metal- nicotianamine transporter YSL6
MGTETSSVDISEPLLVDSHGNEEKEEYLREEVPEWKEQITIRGLVVSAVLGTLFCIITHKLNLTVGIIPSLNVAAGLLGFFFVRTWTGFLTKMGFFTKPFTRQENTVIQTCVVACYGLAFSGDGTCDLSHLPFSLNHPTHLSLLVTCLIVLDSIVKPWWLKGEREEEVMGRVKEEGRGVMSRLGGALLEDMSQLGVGFVKVKGFESFVEEI

SEQ ID NO: 215961 - protein, 226 aa, Glycine max
  Coding DNA Sequence Number=SeqID_99183
  Homolog annotation: Hit_ID=Q9STX3; Match level="QueryCoverage=24%, HitCoverage=55%, E-value=3e-07, Identity=56%"; Hit description=F-box protein GID2
MSDGDVKDMKMKKKVKAVENDNNMEGQAHFDNNFMFEVLKHVDAWTLTLAAGSNNHDSWSSCSVASVASMRFISSHSPSHNKHHLLPPYWLSLILPTPERARFVRGKACDKPHLNFASSGGVGAGVVDGNLLVGEDPEVKVTKEGSRTTQTAPRVVASIYWGGGAVARSVMQGGGVTTVVVKDVGRTWVGAYTNLVGPPGRVVVGVCYGGVCRGGDDAQKERERLG

SEQ ID NO: 215962 - protein, 90 aa, Glycine max
  Coding DNA Sequence Number=SeqID_99184
MGVMEIRVNLQSPWCRKGLVLSSSFPREFYSISVDYFEDQEGSKRDLVLLSRQASVEGVVLRNLTPPASVFKVQLMYLLDNFTQYQSVLS

SEQ ID NO: 215963 - protein, 497 aa, Glycine max
  Coding DNA Sequence Number=SeqID_99185
  Gene Ontology: Mol. function=nucleotidyltransferase activity; Cellular component=integral to membrane; Biological process=aromatic amino acid family biosynthetic process
  Homolog annotation: Hit_ID=Q6R3K6; Match level="QueryCoverage=93%, HitCoverage=61%, E-value=0.0, Identity=68%"; Hit description=Metal -nicotianamine transporter YSL6
  Pfam annotation: Domain name=OPT; Domain location=1-463; Score=124.9; E_value=2.3e-34; Accession=PF03169.6; Description=OPT oligopeptide transporter protein
MPSSLLCRFYFDFSPTYVGCGLICPHLVNCSVLLGAIISWGFLWPFVSEHAGDWYPADLGSNDFKGLYGYKVFISIALILGDGIYNLIKIILITIREMWRTSSKQLPVVTEVQGELVTFIVTLNLDLYGILAMDNKELVALWKTTELNGVNYLLKIIFDYLLPESSIETSDDENSQLQSEEKKREEVFLKDRIPTWFAASGYVGLAAISIATIPIIFPPLKWYLVLCSYILAPALAFCNSYGTGLTDWSLASTYGKIGLFIIAAAVGQNGGVIAGVAACAVMMSIVATAADLMQDFKTGYLTLSSAKSMFVSQLIGTAMGCVIAPLTFWMFWTAFDVGSPDGPYKAPYAVIFREMAILGVQGFSELPKYCLEMCGGFFAAALAINLLRDVTPKKFSQYIPIPMAMAVPFYIGAYFAVDMFVGTVILFVWERLNRKDAEDYAGAVASGLICGDGIWTIPSAILSIMRIDPPIWISFSSLTVSGEPENRRKAPRGKGVP

SEQ ID NO: 215964 - protein, 336 aa, Glycine max
  Coding DNA Sequence Number=SeqID_99186
  Gene Ontology: Mol. function=DNA-directed RNA polymerase activity; Cellular component=chloroplast; Biological process=transcription, DNA-dependent
  Homolog annotation: Hit_ID=Q8HVY5; Match level="QueryCoverage=99%, HitCoverage=38%, E-value=1e-176, Identity=79%"; Hit description=DNA -directed RNA polymerase beta chain
  Pfam annotation: Domain name=RNA_pol_Rpb2_6; Domain location=1-245; Score=270.3; E_value=3.8e-78; Accession=PF00562.18; Description=RNA polymerase Rpb2, domain 6
  Pfam annotation: Domain name=RNA_pol_Rpb2_7; Domain location=247-324; Score=144.1; E_value=3.6e-40; Accession=PF04560.10; Description=RNA polymerase Rpb2, domain 7
  Pfam module annotation: Pfam domain module=RNA_pol_Rpb2_6::RNA_pol _Rpb2_7; Domain location=1-245::247-324
MPWEGYNSEDAVLINERLVYEDIYTSFHIRKYEIQTHMTSYGSERITNKIPHLEAHLLRNLDKNGIVILGSWVETGDILVGKLTPQMAKESSYSPEDRLLRAILGIQKREIKVGDKVAGRHGNKGIVSKILSRQDMPYLQDGRPVDMVFNPLGVPSRMNVGQIFECSLGLAGASKQTSNPWIFEPEYPGKSKIFDGRTGNSFKQPAIMGKPYILKLIHQVDDKIHGRSSGHYALVTQQPLRGRAKQGGQRVGEMEVWALEGFGVAHILQEMLTYKSDHIKTRQEVLGTTIIGGTIPKPTDAPESFRLLVRELRSLAMELNHFLVSEKNFRIHRKEA

SEQ ID NO: 215965 - protein, 90 aa, Glycine max
  Coding DNA Sequence Number=SeqID_99187
MKFQHQGKLVCLQGEQISENIIELEASAKRNTPRLSARKTLEEDELYRFAKRTTSVHSLSEKGALRQKSLMCTKRSIHALSARARKRPPI

SEQ ID NO: 215966 - protein, 182 aa, Glycine max
  Coding DNA Sequence Number=SeqID_99188
  Homolog annotation: Hit_ID=O04892; Match level="QueryCoverage=38%, HitCoverage=13%, E-value=2e-23, Identity=76%"; Hit description =Cytochrome P450 like_TBP
WGYGAQLRANLDPTKGVGRLRQQDGGHGKSKSAKGVCNNSPAESTSPENGWRREPGRAVVGADLGGTGEARLIALCARTPKGNRPAHPGNGSAGGRVQRLEEHRTSRASGRWNNVGKGSRQNGSVTSGKGLALRAGHGGPSPEPVGCRWTARAASAARAGRRVPVGGRIGNGPFGASSPGVE

SEQ ID NO: 215967 - protein, 38 aa, Glycine max
  Coding DNA Sequence Number=SeqID_99189
MVENFVDILEMRIQRRPRIDIMLVMDDIGAYIQKHALK

SEQ ID NO: 215968 - protein, 101 aa, Glycine max
  Coding DNA Sequence Number=SeqID_99190
MVEVKVLRRLVNEQNEGKADMNEQNEDKVGAKLKHVDYSGVFNTSQVFAIRDDILNCSSKLHDDEPNNFDDAKSPSNSFKTSRSNIKNPIQDSREEIKKQQ

SEQ ID NO: 215969 - protein, 46 aa, Glycine max
  Coding DNA Sequence Number=SeqID_99191
  Homolog annotation: Hit_ID=Q2HU52; Match level="QueryCoverage=97%, HitCoverage=4%, E-value=8e-13, Identity=84%"; Hit description =Tropomyosin; tRNA-binding arm; t-snare
MRQKLSLCERNTIRELQLLRERLMLSLRKGIHSIESRIKKVMQLLS

SEQ ID NO: 215970 - protein, 162 aa, Glycine max
  Coding DNA Sequence Number=SeqID_99192
  Gene Ontology: Mol. function=binding
  Homolog annotation: Hit_ID=Q10L20; Match level="QueryCoverage=54%, HitCoverage=10%, E-value=2e-12, Identity=65%"; Hit description =Expressed protein
MCKVYDLWEQAYCVSNLSTVVVMMGKFLQDEESQMVKCQVAIIGMIKYEFVFSNFINCMYAIPVSFRRRDDIHSIAPGIPAMRREFCFLAVLMMTKMMTKSPKNDFKIESTSSRSRLISSFMRRNQEKFDFKIQEKMNSRFKRRNQEDFTREVLKRFFKKQT

SEQ ID NO: 215971 - protein, 183 aa, Glycine max
  Coding DNA Sequence Number=SeqID_99193
  Gene Ontology: Mol. function=binding
  Homolog annotation: Hit_ID=Q2QPI5; Match level="QueryCoverage=61%, HitCoverage=18%, E-value=4e-12, Identity=43%"; Hit description =Expressed protein
MLALESKNNYHRILKLKVLERLIDALKVPLLRVNDGRILTNLCTYSGSEALKQLRGVIAAAPTVLQAIMSQENKLQEVMIGLAASVFTFMTSYESSLEDKEVCDRAGNLDDERKIRKHSYFQGFGNRGGAGSATDEDDDVDRLGLNIGRKGTLPISQYFAKIMSFGKELTEYRPAQITHALVV

SEQ ID NO: 215972 - protein, 133 aa, Glycine max
  Coding DNA Sequence Number=SeqID_99194
  Gene Ontology: Mol. function=protein serine/threonine kinase activity; Cellular component=extracellular region; Biological process=protein amino acid phosphorylation
  Homolog annotation: Hit_ID=Q2HV72; Match level="QueryCoverage=77%, HitCoverage=17%, E-value=1e-29, Identity=54%"; Hit description =Protein kinase; Peptidoglycan-binding LysM
MKLPEVVQSLQERKYSIIQGIICKRVPLQRPSEVIPFYFSGNIYQHNTPYIACKNGTYYELVKETFQGLTTCQAVMGQNYYTPINIAIGAELTVPMLCACPTENQTARGSIGKAYGVDEQSVLEANKFITDEP

SEQ ID NO: 215973 - protein, 109 aa, Glycine max
  Coding DNA Sequence Number=SeqID_99195
  Gene Ontology: Cellular component=nucleus
  Homolog annotation: Hit_ID=Q9LXM2; Match level="QueryCoverage=68%, HitCoverage=40%, E-value=5e-10, Identity=52%"; Hit description=CCR4 -associated factor 1-like protein
MAQALGQERMHRLETSAMESGAWGLHVTSNVSLRHSIVVLRLPESGMGVHDNAWKISVHGNERVGDNDRTDELKLRFKVEGQHWSRDNRRMWEEHDDDFLVCEEEKTRK

SEQ ID NO: 215974 - protein, 53 aa, Glycine max
  Coding DNA Sequence Number=SeqID_99196
MASNDNSWWPSMVVGGGGGVSRVISLSELVSLSGCPLLALSVTICAQRNSLSD

SEQ ID NO: 215975 - protein, 249 aa, Glycine max
  Coding DNA Sequence Number=SeqID_99197
  Gene Ontology: Mol. function=nucleic acid binding; Biological process= DNA integration
  Homolog annotation: Hit_ID=Q1SS72; Match level="QueryCoverage=56%, HitCoverage=9%, E-value=3e-15, Identity=35%"; Hit description =Integrase, catalytic region
MMLVLEMKNKIGFMDCMIPKPNEQDLNYSAWKQFSPDIATSVLWLNQAYEDELCNFCPIPTCDATPAESCKRVQLFKNYRDCDSVLCFLHGLNESFAYAKSHILNLDPLPSLDRVFSMILQQERQLHVGVLPTPIAFTAQAPSNTSQGRSKAPFSLTKDQIQSLLALLPSATPIANATNSSNVQVSNQKMISTAREFKGLYYLIQSGLGSSSSMDSFASWKMNGSGMEKEEREETPLQGEDESRRSSPP

SEQ ID NO: 215976 - protein, 339 aa, Glycine max
  Coding DNA Sequence Number=SeqID_99198
MNEDQWMYDSIMSEEVDMDYQNEEECGVNEPHVDCSDVFNISQVFDSQDDILQWARSVAHENGFMAMIDLFPLSYLDLRLSEVDLMRLSSFVVALLQRFKGGITNICYNLLELGFEGGALIWGEANRDVDVDLSLIVVTAAQGLPWFVLSLLALYCKFKQKQLLEEGYTQIKRKMILFLLRVSLLHLKVRLTYIGMRKCKGLPLAIVAIGGLLSTKSKTMFEWQKARMQCLKDKLAISETTTKAESQLKQQWKHESKRDKTLTSTSMEQHQQKMNMQSRGEDHHHHAANNVEEERATRTGSRTTSPIAEERIEEDEVQSQKEEETEETRCRRKKKCWVH

SEQ ID NO: 215977 - protein, 101 aa, Glycine max
  Coding DNA Sequence Number=SeqID_99199
  Gene Ontology: Mol. function=small conjugating protein ligase activity; Cellular component=cytosol; Biological process=protein modification process
  Homolog annotation: Hit_ID=Q6PQ37; Match level="QueryCoverage=87%, HitCoverage=89%, E-value=3e-33, Identity=56%"; Hit description =Ubiquitin-conjugating enzyme family protein
MVQVRYNFSGPGVPRNFRLLEELERGEKGIGDGTVSYGMDDGDDIYMRSWTGTIIGPHNVEPKKFGLLANWQREYTMEDILTQLKKEMAAPHNRKLVQPPE

SEQ ID NO: 215978 - protein, 70 aa, Glycine max
  Coding DNA Sequence Number=SeqID_99200
  Subcellular localization annotation: CTP_CleavageSite=34; ConfidenceScore=5.07e-01
MKHSSKLFGALGTSHIVKQRMPSISKRPIKGCISSSVEKRINEFQEPRDLRSNPFQGGGNDAILPPKGIG

SEQ ID NO: 215979 - protein, 103 aa, Glycine max
  Coding DNA Sequence Number=SeqID_99201
MASRKRNSIGTRPTSQYDTRRFSSLDAWTRYTDNVLGRNILPERKVELYHTELDDFKAELERRNFHKHLTNLADGSIDLALVKEFYANLYSSEDRPPKQSRVR

SEQ ID NO: 215980 - protein, 86 aa, Glycine max
  Coding DNA Sequence Number=SeqID_99202
MLLLLPFSSTIEASIKAPNFAYHFCSKSQKEAIFGVVKRTSTLWDFKFQLFVKKSVENMLNLSCLVKLIEMKGRVNLGFKGVNVVI

SEQ ID NO: 215981 - protein, 93 aa, Glycine max
  Coding DNA Sequence Number=SeqID_99203
MDEDQWRYDFAMSQEVHMDYDYDNQEECGVNESHVDCSNAFNTSQVFATRDDVLQWARIVAHENGFVAVIMRSDTETGSRGRSSFVLIGCERS

SEQ ID NO: 215982 - protein, 132 aa, Glycine max
  Coding DNA Sequence Number=SeqID_99204
MITSFSSEGNDEEDHHEHWNGSMSRSQSKHHNQQASPLPTKLPAGAHIPSCAWPEEGGSEYPRHMPGADHKQPNHKGGETSSSTESNGGSQNVRSSIPILPNSSSSLVSMTYSPSFNSSQLVGQRKLFAESQ

SEQ ID NO: 215983 - protein, 112 aa, Glycine max
  Coding DNA Sequence Number=SeqID_99205
MTLTQAGDLPRHPPVMQNEKYVEPDMPKFPVAAAAMEEALAHGPFDVETPRHAVKACQTITERLEHLLNLRIVTEGTKAHDVMQDYLRIARGVTVERNAYVRSRRKRHTDHA

SEQ ID NO: 215984 - protein, 647 aa, Glycine max
  Coding DNA Sequence Number=SeqID_99206
  Gene Ontology: Mol. function=protein serine/threonine kinase activity; Cellular component=mitochondrion; Biological process =protein amino acid phosphorylation
  Homolog annotation: Hit_ID=Q9FNE1; Match level="QueryCoverage=91%, HitCoverage=85%, E-value=1e-124, Identity=42%"; Hit description =Receptor-like serine/threonine kinase
  Pfam annotation: Domain name=DUF26; Domain location=167-220; Score =47.9; E_value=3.3e-11; Accession=PF01657.8; Description=Domain of unknown function DUF26
  Pfam annotation: Domain name=DUF26; Domain location=57-110; Score =55.1; E_value=2.3e-13; Accession=PF01657.8; Description=Domain of unknown function DUF26
  Pfam annotation: Domain name=Pkinase; Domain location=298-575; Score =153.0; E_value=7.6e-43; Accession=PF00069.15; Description=Protein kinase domain
  Pfam annotation: Domain name=Pkinase_Tyr; Domain location=298-594; Score=111.7; E_value=2.1e-30; Accession=PF07714.7; Description =Protein tyrosine kinase
  Pfam module annotation: Pfam domain module=DUF26::DUF26::Pkinase::Pkin ase_Tyr; Domain location=167-220::57-110::298-575::298-594
MAEPRARTVNITCNNKLEHNTTIFVPNFVATMEKISEQMRNTGYGTAVVGTGGPDTNYGLAQCYGDLSLLDCVLCYAEARTVLPQCFPYNGGRIYLDGCFMRAENYSFYDEYIGPGDKAVCGNTTRKSTSFQAAAKKAVLSAVQAAANNKGYARKEVFVAGTTNDAAYVLANCWRSLDTRSCRACLENASSSILGCLPWSEGRALNTGCFMRYSDTDFLNKEQENGSSGGNVLVIVVAVVSSVIVLVVGIAIVVYIRKHRYIQMKRRGSNDAEKLAKSLHHNSLNFKYSTLEKATNSFDEANKLGQGGFGTVYKGVLADGREIAIKRLYFNNRHRAADFFNEVNIISSVEHKNLVRLLGCSCSGPESLLIYEYLPNRSLDRFIFGNNSTHGIDCLLSDLKIPSFHDKNKGRELNWDKRYDIIIGTAEGLVYLHENSNIRIIHRDIKASNILLDAKLRAKIADFGLARSFQEDKSHISTAIAGTLGYMAPEYLAHGQLTEKADVYSFGVLLLEIITGRLNNRSKASEYSDSLVTMTWKHFQSGTAEQLIDPCLVVDDNHRSNFKNEILRVLHIGLLCTQEIPSLRPSMSKALKMLTKKEEHLDLEAPSNPPFIDESTMELHDQNDDPFYPLNAEDSLATMSHSSFYAR

SEQ ID NO: 215985 - protein, 96 aa, Glycine max
  Coding DNA Sequence Number=SeqID_99207
MMTLSNPLEISTIFPIPLKIIEATRSNKECPQLKRKIHSIDKKKKSLMVTWDDLDSEKSSNSDNEQATICLMANTDEVIKMMKKICPILFFFKTIK

SEQ ID NO: 215986 - protein, 143 aa, Glycine max
  Coding DNA Sequence Number=SeqID_99208
  Gene Ontology: Mol. function=sequence-specific DNA binding; Cellular component=nucleus; Biological process=regulation of transcription, DNA-dependent
  Homolog annotation: Hit_ID=Q4VPF0; Match level="QueryCoverage=81%, HitCoverage=52%, E-value=5e-47, Identity=73%"; Hit description =Homeobox knotted-1-like protein KNOX3
  Pfam annotation: Domain name=ELK; Domain location=40-61; Score=26.2; E_value=0.00012; Accession=PF03789.4; Description=ELK domain
  Pfam annotation: Domain name=Homeobox; Domain location=63-122; Score =5.3; E_value=0.0014; Accession=PF00046.19; Description=Homeobox domain
  Pfam module annotation: Pfam domain module=ELK::Homeobox; Domain location=40-61::63-122
MGPSLYFSEVADDGGVSSEEGFSAGDGDPQDGQLRSEDRELKDRLLRRFGSHVGSLKLEFSKKKKRGKLPKDARQTLLQWWNIHYKWPYPTEGDKIALAKSTGLDQKQINNWFINQRKRYWKPSENMPFSMVDGLTGRFLTDE

SEQ ID NO: 215987 - protein, 74 aa, Glycine max
  Coding DNA Sequence Number=SeqID_99209
MARPQNRQMRWNDIILTNHLEQILTLIIGKPKSHSKSKKSKGSRWEKFLEHHHGREHYPFKGGGGGGLIRKLGI

SEQ ID NO: 215988 - protein, 75 aa, Glycine max
  Coding DNA Sequence Number=SeqID_99210
MMFPQASFVDLIITFVMHSIRKKRALRCPYRTRAKARVMSEIEEVQEQMKVDMEAMKEQMTTMMEAIMSIRKMME

SEQ ID NO: 215989 - protein, 100 aa, Glycine max
  Coding DNA Sequence Number=SeqID_99211
MIKISNGGGERDTCEIVDTRGAVPVRCRFGDSKSATFVLYSVVEICIVGRGRVVVSYFSCAARVSRASSIKRTKIRRQVKITEQRSKFLTPGLGSLLPQA

SEQ ID NO: 215990 - protein, 110 aa, Glycine max
  Coding DNA Sequence Number=SeqID_99212
MGDKPWDFNGLIKRQTAPLSSLQNGQVTKSNRKYTLREFQERFAKDRIRLHDLSPLSKGQSIYVSQKKSNQNQNQKIGKECHEHFHYIALFHTKSAFTAFQDKGCMHQHH

SEQ ID NO: 215991 - protein, 93 aa, Glycine max
  Coding DNA Sequence Number=SeqID_99213
  Homolog annotation: Hit_ID=Q1S622; Match level="QueryCoverage=75%, HitCoverage=47%, E-value=2e-13, Identity=63%"; Hit description=YABBY protein
  Pfam annotation: Domain name=YABBY; Domain location=6-90; Score= -28.3; E_value=3.6e-08; Accession=PF04690.4; Description=YABBY protein
MGYWQVSVPYSSLLTIVTVRCGHCANLLSVNMGASLQAFPPQDPQKQHLSFQEPSSKELGSSSKCSKIAPFEAVEHELPRIPPIRREPSLSIN

SEQ ID NO: 215992 - protein, 158 aa, Glycine max
  Coding DNA Sequence Number=SeqID_99214
  Gene Ontology: Mol. function=chitin binding; Cellular component =extracellular region; Biological process=chitin metabolic process
  Homolog annotation: Hit_ID=UPI0000612705; Match level="QueryCoverage =61%, HitCoverage=90%, E-value=1e-11, Identity=30%"; Hit description =UPI0000612705 related cluster
MGSEIYPEVHENPRAFFSSSSPILLEPLAHGSSDWSLPREDCITPSPSEDYTSSPSEDVLAFRGLDVLAFRGLHALAVRGLDVLAFRGLDVLAFRGLDVLAFRGLHTLAFIGLHAFAFIGLHALTFRGLHVIAFRGLHFLAFIGLHALTFKGLHVLAF

SEQ ID NO: 215993 - protein, 498 aa, Glycine max
  Coding DNA Sequence Number=SeqID_99215
  Gene Ontology: Mol. function=protein serine/threonine kinase activity; Cellular component=membrane; Biological process=protein amino acid phosphorylation
  Homolog annotation: Hit_ID=Q39886; Match level="QueryCoverage=99%, HitCoverage=100%, E-value=0.0, Identity=74%"; Hit description =Protein kinase
  Pfam annotation: Domain name=Pkinase; Domain location=191-447; Score =200.3; E_value=4.5e-57; Accession=PF00069.15; Description=Protein kinase domain
  Pfam annotation: Domain name=Pkinase_Tyr; Domain location=191-447; Score=217.6; E_value=2.7e-62; Accession=PF07714.7; Description =Protein tyrosine kinase
  Pfam module annotation: Pfam domain module=Pkinase::Pkinase_Tyr; Domain location=191-447::191-447
  Subcellular localization annotation: CTP_CleavageSite=87; ConfidenceScore=5.48e-01
MDEDSSNSWIRRAKFSHTVCHRLNYSSSGFGSFSIQPRAQHSSSLKSRPEVAFASKASSQAQKKPIMNKQRSLSPLPQTSLSETFKEARHEQKRFSTPGPRRKEQDKDKRIMGKLLNKDSHVFNSKSNHSSPITTKSPYSSPIRHLASMKLSDKSKQHRKDLGWTKYFDHGGGKVTAVETAEEWNVDLSKLFVGVRFAHGAHSRLYHGMYKDEAVAVKIITVPDDDENGMLADRLEKQFIREVSLLSRLHHQNVIKFVAACRKPPVYCVITEYLSEGSLRSYLHKLERKTIPLEKLIAFALDIARGMEYIHSQGVIHRDLKPENVLIKEDFHLKIADFGIACEEAYCDLFADDPGTYRWMAPEMIKRKSYGRKVDVYSFGLILWEMVTGTIPYEDMTPIQAAFAVVNKNVRPVIPSNCPPAMRALIEQCWSLHPDKRPEFWQVVKVLEQFESSLAHDGTLTLVENPCCPDHKKGLLHWIQKLGPVHHNNGPVPKPKFT

SEQ ID NO: 215994 - protein, 40 aa, Glycine max
  Coding DNA Sequence Number=SeqID_99216
MENNPSSSRTDTKSIEQNRRNQMKDLFSKLNSVVPHQSSR

SEQ ID NO: 215995 - protein, 106 aa, Glycine max
  Coding DNA Sequence Number=SeqID_99217
  Gene Ontology: Mol. function=transcription regulator activity; Cellular component=nucleus; Biological process=regulation of transcription
MKDKRNNLIDIERSKNASMNMGLKSPQFKIQQMGSALEIVLVTGMDCQFMFNETIRVLQEEGSDIVNASYTVVENAVFHTIHCQVGGSANGALRISEKIKKYLNGC

SEQ ID NO: 215996 - protein, 374 aa, Glycine max
  Coding DNA Sequence Number=SeqID_99218
  Gene Ontology: Mol. function=binding; Cellular component=nucleus; Biological process=mRNA editing
  Homolog annotation: Hit_ID=Q6K2P5; Match level="QueryCoverage=90%, HitCoverage=79%, E-value=3e-56, Identity=29%"; Hit description =Putative pentatricopeptide (PPR) repeat-containing protein
  Pfam annotation: Domain name=PPR; Domain location=128-162; Score =27.9; E_value=3.5e-05; Accession=PF01535.11; Description=PPR repeat
  Pfam annotation: Domain name=PPR; Domain location=190-224; Score =26.3; E_value=0.00011; Accession=PF01535.11; Description=PPR repeat
  Pfam annotation: Domain name=PPR; Domain location=237-271; Score =41.5; E_value=2.9e-09; Accession=PF01535.11; Description=PPR repeat
  Pfam annotation: Domain name=PPR; Domain location=272-305; Score=5.5; E_value=1.7; Accession=PF01535.11; Description=PPR repeat
  Pfam annotation: Domain name=PPR; Domain location=43-77; Score=18.5; E_value=0.024; Accession=PF01535.11; Description=PPR repeat
  Pfam module annotation: Pfam domain module=PPR::PPR::PPR::PPR::PPR; Domain location=128-162::190-224::237-271::272-305::43-77
FTFTITLHTEMKRCNVFISRLCKEGKIDNVRKVFDEMPEWDIGLWTTMITGYLKYGMIREARKLFDRRDAKKNVVTWTAMANGYIKFNQVKEAESRMSERDVVSWTTIITTLVQCGTLFDQMPVRNVVSWNAMIMGHAQNRRLHEALELFQGLPERDMHSWNTMITGFIQNGKLNYAEKLFGEMREKNVITLTAMMMGYVQHGLSEEALKVFNKMLATDGLKPNTGTFVTAKGLDLISWNGMIAGYAHHGYGKEAINLFNEMQELGVCSNDVTFVGLLRACSHTGRLKEAFNIIEGLGEEAPLTVWGVLLARLGKWKEAANIRMKMKDKGLKKQPGCSWIEVGNTVQVFVVDDKSRSQYELLGHLLHGLHTEMK

SEQ ID NO: 215997 - protein, 124 aa, Glycine max
  Coding DNA Sequence Number=SeqID_99219
  Homolog annotation: Hit_ID=Q1S1G2; Match level="QueryCoverage=53%, HitCoverage=4%, E-value=6e-08, Identity=40%"; Hit description =Integrase, catalytic region; Zinc finger, CCHC-type; Peptidase aspartic, catalytic
  Pfam annotation: Domain name=zf-CCHC; Domain location=64-81; Score =7.2; E_value=0.063; Accession=PF00098.13; Description=Zinc knuckle
MSLINAAGNNSSNSRPSCTYYGKDNHTIDRCYRKNGPPQNYPSKGGKGTQSNSGKGNFGARGNKVCTHCGLSNHTIDDCYKKHGYPPGHKFYKVQNPNINNVNTIREEVLARLAKMSGSLILEP

SEQ ID NO: 215998 - protein, 48 aa, Glycine max
  Coding DNA Sequence Number=SeqID_99220
MVDDDNALHVRVEVEALDLEKHLLWRFEGKKLREKDKTSSYHMVEFDH

SEQ ID NO: 215999 - protein, 223 aa, Glycine max
  Coding DNA Sequence Number=SeqID_99221
  Homolog annotation: Hit_ID=Q1S062; Match level="QueryCoverage=76%, HitCoverage=54%, E-value=1e-11, Identity=27%"; Hit description =Arabidopsis conserved protein
  Pfam annotation: Domain name=DUF241; Domain location=4-223; Score =116.9; E_value=5.6e-32; Accession=PF03087.5; Description=Arabidopsis protein of unknown function
MAPLDFVALKDLHNSANNLLHSPMVQQAIVHQTEEKWFDDVSESSLRMLEVCGISKDVLLLVKEHLQELQFTLRRASIGDPGIEEKIAAYNCYRKKLKKETLKWLKWLKKGMKKGMKSQTATMHPPMINEQKLVLVVDVLREVRMTSICIVESLLSLVSSPWLDTKSGKLRSFTSKLVRASLHCCSDDMIYYDAMVLQSENKRLAGVRMAIEDLEVELECMFR

SEQ ID NO: 216000 - protein, 386 aa, Glycine max
  Coding DNA Sequence Number=SeqID_99222
  Gene Ontology: Mol. function=nucleic acid binding; Cellular component= intracellular; Biological process=regulation of transcription
  Homolog annotation: Hit_ID=Q9FJS0; Match level="QueryCoverage=93%, HitCoverage=54%, E-value=1e-126, Identity=57%"; Hit description =Arabidopsis thaliana genomic DNA, chromosome 5, P1 clone:MQD22
  Pfam annotation: Domain name=JmjC; Domain location=192-315; Score =169.6; E_value=7.8e-48; Accession=PF02373.13; Description=JmjC domain
  Pfam annotation: Domain name=JmjN; Domain location=37-76; Score=33.2; E_value=8.9e-07; Accession=PF02375.7; Description=jmjN domain
  Pfam module annotation: Pfam domain module=JmjC::JmjN; Domain location=192-315::37-76
MTGKSSITQRTARHGSRKPRKFDLADLEWTNTIPECPTYHPSEHEFEHPLVYLQKIAPEASEYGICKIVSPIAASNPAAFVLMKEKKDFKFEANVQPLRLSKWIDEKDIISFSLRGRKYTYHEFEALANKAFFSRFHSSGGLPSSYAEKEFWHEMGSGERETVEYGVNNFSRLPPSLLRLVDREIPGITDPMLYIGMLFSMFAWHVEDHYLYSINYHHSGANKTWYGVPGYAASQFEKTVLQHVYSNKILTKHGDDGAFKFLAQKTTMFPPNVMLQHDVAVYKAVQKPGEFIITFPRAYHAGFSHGFNCGEAVNFANGDWFQLRAAASRRYAHLRRMPLIPYEELLSKEAMQVYKSSRVRSSKKKPEDTASYQSYYTAFLASYAIL

SEQ ID NO: 216001 - protein, 462 aa, Glycine max
  Coding DNA Sequence Number=SeqID_99223
  Gene Ontology: Mol. function=nucleic acid binding; Cellular component= intracellular; Biological process=defense response signaling pathway, resistance gene-dependent
  Homolog annotation: Hit_ID=Q9C801; Match level="QueryCoverage=91%, HitCoverage=93%, E-value=2e-91, Identity=44%"; Hit description =Protein MOS2
  Pfam annotation: Domain name=G-patch; Domain location=160-204; Score =33.6; E_value=6.8e-07; Accession=PF01585.13; Description=G-patch domain
  Pfam annotation: Domain name=KOW; Domain location=224-256; Score =10.2; E_value=1.1; Accession=PF00467.19; Description=KOW motif
  Pfam annotation: Domain name=KOW; Domain location=402-435; Score =13.6; E_value=0.47; Accession=PF00467.19; Description=KOW motif
  Pfam module annotation: Pfam domain module=G-patch::KOW::KOW; Domain location=160-204::224-256::402-435
  Subcellular localization annotation: CTP_CleavageSite=19; ConfidenceScore=5.28e-01
MKLSFSVPSSKPHSKPKAVSNTFDDNSTSQNDTGGTKYLITEFDPSKPAPTSVPKTLIPPIQNQWQPFKKMKNLHLPTAADVESLAFELHTDGDQPESDISYGLNVRADNNPEGNNKDDSDAAAPRRRVPLEATALQKLKSDLERLPEDQGMEEFKDVAVEGYGAALLAGYGWKEGMGIGRNAKEDVKVVEIKRRTAKEGLGFVGDAPAALVLSNNEKDNKKKEKKEKVVRIVGGRDSGLKGSVVSRIGDDYLVLELSRSGEKVKVKVKVGDVAELGSKEEERCLRKLKELKTQSEEDKVSKSKRGRDEVEEKRGDLNRRKEKRVDVGRKEERRVVDHRKVSWLTSHIRVRVISRDLKGGRLYLKKGEVLDVVGPTTCDISMDENREIVQGVSQDVLETVIPKRGGPVLVLAGKYKGVYGSLAERDFDRETAIVRDADTHELLNVKLEQIAEYIGDPSLLGH

SEQ ID NO: 216002 - protein, 112 aa, Glycine max
  Coding DNA Sequence Number=SeqID_99224
  Pfam annotation: Domain name=zf-CCHC; Domain location=25-42; Score =26.0; E_value=5.1e-05; Accession=PF00098.13; Description=Zinc knuckle
MATKGNRRRSNFNPKKKGEESSSVPKCYECDQPGHIRVDCPIFKRRMDKSDKKTFKDKKGKKDYITWEDNDMNSSGDSENEVVNFSLMAKNHESEEEHWKNGMGSKRISSQN

SEQ ID NO: 216003 - protein, 92 aa, Glycine max
  Coding DNA Sequence Number=SeqID_99225
MDPLVIGRVIGAFHRLRLSEDIVFNNCSQVINCSNPEGPEFISTNSEGMVDSDAPRPGNPNQREYLHCIFFPCEEAVSYEDPSNLLQLKPSI

SEQ ID NO: 216004 - protein, 82 aa, Glycine max
  Coding DNA Sequence Number=SeqID_99226
  Homolog annotation: Hit_ID=Q9FJF3; Match level="QueryCoverage=69%, HitCoverage=7%, E-value=8e-10, Identity=65%"; Hit description=Serine protease-like protein
MVLLQYLMKMKQRMFQVLHPNVISVFLNKERKLHTTNSWNFLGLERNGVFPHDSVWKKTKGEDIIIGNIDTGTINQTLGIYV

SEQ ID NO: 216005 - protein, 108 aa, Glycine max
  Coding DNA Sequence Number=SeqID_99227
MPHYSDEDKAYYIATFCTLTHDGRDNSAQAMQQIIEGGNSDYALQKIHFQSGLAEHLQTVWQDLSPQQQQQARQDAFVCRQLFSDKLLPGQPDNCTVCRVRIYAHRNK

SEQ ID NO: 216006 - protein, 243 aa, Glycine max
  Coding DNA Sequence Number=SeqID_99228
  Gene Ontology: Mol. function=serine-type endopeptidase activity; Cellular component=integral to membrane; Biological process =pathogenesis
  Homolog annotation: Hit_ID=Q7BS42; Match level="QueryCoverage=88%, HitCoverage=15%, E-value=1e-33, Identity=40%"; Hit description =Serine protease pic precursor
MPHAIFRLFSGRLRRGLTGDTPIGSPYAGIMRHDIDVQEYRDFAENRGKYAIGATDIPLYRKDGSFDGYVLDVPMPDFSMVSDEGFSSFIAPSFVTGAKHVRYVLSLNLGKKAKFSPTYRGINYNNDPTRDFHLPRVNKVVVESAPSPYIGGEELLANRSRYTVFARLGAGYQQIDDPESGKLIPIDGAYVYNTGGTFKPGAITTFYHYYIKWRTFAPDNPAFSPLSIGTRSGDSGSPIFAWD

SEQ ID NO: 216007 - protein, 80 aa, Glycine max
  Coding DNA Sequence Number=SeqID_99229
MAKALLASVPLFLLLAVSSSVVAEELETLPPSYPHPHSPTQAPLHPPASAPHPHFNYHSCSIFQCKTPLIMWKTHIRRTK

SEQ ID NO: 216008 - protein, 67 aa, Glycine max
  Coding DNA Sequence Number=SeqID_99230
MRHQQTKKSNGTAKVMLNVRLVRVCEGRARECEKGLSENVREGSPEQYAQSLFVRHEKWKATPQCYE

SEQ ID NO: 216009 - protein, 74 aa, Glycine max
  Coding DNA Sequence Number=SeqID_99231
MALPLHRSILLSAVGKSAKVEKPAAPEAAELLSSNWSQVNLQAANLAVEAKSGAMKEQDSYKEIESSALKLNSV

SEQ ID NO: 216010 - protein, 201 aa, Glycine max
  Coding DNA Sequence Number=SeqID_99232
  Gene Ontology: Mol. function=oxidoreductase activity; Cellular component=integral to membrane; Biological process=electron transport
  Homolog annotation: Hit_ID=Q43071; Match level="QueryCoverage=91%, HitCoverage=42%, E-value=5e-71, Identity=71%"; Hit description =Cytochrome P-450
MHYVFLVRINFEVWTLARMVLHPEIQAKAQREIDFVCGSSRPVSEADIPNLRYLQCIVKETLRVHPPGPLLSWARLAVHDVTVGGKHVIPKGTTAMVNMWAITHDERVWAEPEKFRPERFVEEDVSIMGSDLRLAPFGSGRRVCPGKALGLASVHLWLAQLLQNFHWVSSDGVSVELDEFLKLSMEMKKPLSCKAVPRVSV

SEQ ID NO: 216011 - protein, 62 aa, Glycine max
  Coding DNA Sequence Number=SeqID_99233
MLTSHIAPGLVTITNVDKAIRNQVSGTHIDLRKKVNVNISSIAVKRTQVTSSGRCDGLAFSN

SEQ ID NO: 216012 - protein, 176 aa, Glycine max
  Coding DNA Sequence Number=SeqID_99234
  Gene Ontology: Mol. function=Ran GTPase binding; Cellular component =intracellular; Biological process=protein transport
  Homolog annotation: Hit_ID=Q9C7F5; Match level="QueryCoverage=55%, HitCoverage=78%, E-value=2e-42, Identity=85%"; Hit description =Nuclear transport factor 2
  Pfam annotation: Domain name=NTF2; Domain location=6-118; Score =116.7; E_value=6.7e-32; Accession=PF02136.11; Description=Nuclear transport factor 2 (NTF2) domain
MDPDALAKAFVEHYYSTFDTNRNGLANLYQEGSMLTFEGQKIQGASSIVAKLTSLPFQQCHHSISTVDCQPSGVNAGMLVFVSGNLQLAGEQHTLKFSQNICWISKGKLVSLLFIVPSTTLLTRGSPLSSQILDAFNMLLDLNLPPHVLLPMTVLVFFIYINLLAKLLHFSLSVLW

SEQ ID NO: 216013 - protein, 301 aa, Glycine max
  Coding DNA Sequence Number=SeqID_99235
  Gene Ontology: Mol. function=oxidoreductase activity; Cellular component=membrane; Biological process=electron transport
  Homolog annotation: Hit_ID=Q9C9D1; Match level="QueryCoverage=96%, HitCoverage=62%, E-value=9e-62, Identity=42%"; Hit description =Putative cytochrome P-450; 4810-6511
  Subcellular localization annotation: CTP_CleavageSite=74; ConfidenceScore=5.02e-01
MSPDFTLLFFPELMQSPMITFQATLCVLLFTLMFTLLFTPGGLPWAWARPRPIIPGPVTALLGIFTGSTPHRALSKLARNYHAEKLMAFSIGLTRFVISSEPETAKEILGSPSFADRPVKESAYELLFHRAMGFAPYGEYWRNLRRISALHLFSPKRITGSESFRSEVGLKMVEQVKKTMSENQHVEVKKILHFSSLNNVMMTVFGKSYEFYEGEGLELEGLGVRKRCRCLVEKVNVFVGGVIKEHRVKRERGECVKDEGTGDFVDVLLDLEKENRLSEADMIAVLWDLLLFNMHAKTFSG

SEQ ID NO: 216014 - protein, 772 aa, Glycine max
  Coding DNA Sequence Number=SeqID_99236
  Gene Ontology: Mol. function=calcium ion binding; Cellular component =nucleus; Biological process=regulation of transcription, DNA -dependent
  Homolog annotation: Hit_ID=Q9FYG2; Match level="QueryCoverage=96%, HitCoverage=79%, E-value=1e-166, Identity=44%"; Hit description =Calmodulin-binding transcription activator 4
  Pfam annotation: Domain name=Ank; Domain location=471-503; Score =36.0; E_value=1.3e-07; Accession=PF00023.20; Description=Ankyrin repeat
  Pfam annotation: Domain name=IQ; Domain location=590-610; Score=7.2; E_value=7; Accession=PF00612.17; Description=IQ calmodulin-binding motif
  Pfam annotation: Domain name=IQ; Domain location=644-664; Score=19.4; E_value=0.013; Accession=PF00612.17; Description=IQ calmodulin -binding motif
  Pfam annotation: Domain name=IQ; Domain location=667-687; Score=33.8; E_value=6e-07; Accession=PF00612.17; Description=IQ calmodulin -binding motif
  Pfam annotation: Domain name=TIG; Domain location=242-325; Score =16.6; E_value=0.021; Accession=PF01833.14; Description=IPTTIG domain
  Pfam module annotation: Pfam domain module=Ank::IQ::IQ::IQ::TIG; Domain location=471-503::590-610::644-664::667-687::242-325
  Subcellular localization annotation: CTP_CleavageSite=61; ConfidenceScore=5.83e-01
GKLSSGAGAQLSPSSSSVYTQSPSPYSTQNPGSTSILGDSYEPNQSFSSPGSTEVTSDMFVLNNKMGHMDGTDTESGTSPELEVTQALRRLEVQLSLNEDNFEDIVSFGSKHETTHDSNPQHDQRVISNQEQSAAFSGPDDQGLFYDGYNGRQGDGGEFYHELIDHGYPDGNEKALWTEVLESSVFSQPQGVDEVKFPVYSSMVETQVINSDYYETLFDQSQIGAPPDANSSLTVAQKQKFTIKTISPEWGYATETTKVIVVGSLLCHPSDSAWACMFGDVEVPVEIIQDGVISCEAPSHLPGKVTLCITSGNRESCSEVREFEYRDKTNSCTQCTQSETEATRSPEELLLLVRLEQMLLSASTIKNDNIESGIPLIKQKADDDSWSHIIEALLVGSGTSTGTVDWLLEELLKDKLQQWLSCRSQEKDEETGCSLSKKEQGIIHMVAGLGFEWALNPILTCGVNINFRDINGWTALHWAARFGREKMVASLIASGASAGAVTDPNAQDPTGKTAASIAAGNGHKGLAGYLSEIAVTSHLSSLTLEESELSKSSAELQADMTVNSVSKENLTASEDQASLKDTLAAIRNVTQAAARIQSAFRSHSFRKRRAREVAASAGGIGTISEISAMSKLAFRNSREYNSAASAALSIQKKYRGWKGRKDFLALRKKVVKIQAHVRGYQVRKHYKVIWAVGILDKVVLRWRRKGAGLRGFRQEMDINENENEDEDILKVFRKQKVDVEIEEAVSRVLSMVDSPDAREQYHRMLEKYRQAK

SEQ ID NO: 216015 - protein, 41 aa, Glycine max
  Coding DNA Sequence Number=SeqID_99237
MVVVVMAYDHGGMVTGDNNNGSDNDNTSGLCYENRLDNRFS

SEQ ID NO: 216016 - protein, 115 aa, Glycine max
  Coding DNA Sequence Number=SeqID_99238
  Homolog annotation: Hit_ID=Q9FYG2; Match level="QueryCoverage=62%, HitCoverage=7%, E-value=2e-21, Identity=64%"; Hit description =Calmodulin-binding transcription activator 4
  Pfam annotation: Domain name=CG-1; Domain location=15-115; Score =121.7; E_value=2.1e-33; Accession=PF03859.7; Description=CG-1 domain
MMMMMGRVLNYLTYLCCEAQARWLKPAEVMYILQNHEKFQFTQEPPQQPTSGSLFLFNKRVLRFFRKDGHNWRKKRDGRTVGEAHERLKLSMKKENLLASKCLEGLSVVEMQSIN

SEQ ID NO: 216017 - protein, 302 aa, Glycine max
  Coding DNA Sequence Number=SeqID_99239
  Homolog annotation: Hit_ID=Q1SL34; Match level="QueryCoverage=38%, HitCoverage=22%, E-value=3e-10, Identity=29%"; Hit description =Endonuclease/exonuclease/phosphatase
MGVGNLYSMKMSFSNANGAPSYKDTIVGIRPTTVGPTTEESMTADEIINVVIEEICPTPFMDDNEIEKVKPINPFPEIEVNVEQYERWCGYWKHPLLVKLMGKKVNLNFISARLQKLWACIGTVQVLDLNHDFFLFRFSHEDIYGGRHLWGTTSIFISMVFSSTYHVHLHINPRSLNLWVFTTIYASPQLGNLVILWDKLCNIDNDGSNPWIVAGDVNQVLYQSEKHGGGFLNLSSATLLVDCLNDCNISELGFSSPPFTKKRGTLYKHLDRVVANVVAVEIPQFQSGLFTVPSYDHCWHPL

SEQ ID NO: 216018 - protein, 101 aa, Glycine max
  Coding DNA Sequence Number=SeqID_99240
MSLARCITLAQSSFLSILGYIMQSTLLLASVGKAIEKLCKDFIWDSSHDRKQFVNQNTKVFEDYPIWSFSKDREFSIKKAYVMLSNEDEFLPHPIRNERNE

SEQ ID NO: 216019 - protein, 133 aa, Glycine max
  Coding DNA Sequence Number=SeqID_99241
  Gene Ontology: Cellular component=anchored to membrane
  Homolog annotation: Hit_ID=Q2R3Y3; Match level="QueryCoverage=82%, HitCoverage=80%, E-value=4e-12, Identity=56%"; Hit description =Expressed protein
MSDWGPVFVSLVLFVLLTPGLLFQVPGRSRVVEFGNFQTSGAAILIHSLLYFALICVFLLAGVMAADWGPVVISVVLFVLLSPGLLFQLPAKGKVVAFGNMQTSGLSILVHTIIFFGLITIFLLAIGVHIYSG

SEQ ID NO: 216020 - protein, 74 aa, Glycine max
  Coding DNA Sequence Number=SeqID_99242
MPQAEEEEHEHSKGRDLNKKWTNTPRRRRNALGEEACHDKKERKKKTKRELREEERKKNAKSRREKQAGCTKTF

SEQ ID NO: 216021 - protein, 86 aa, Glycine max
  Coding DNA Sequence Number=SeqID_99243
  Homolog annotation: Hit_ID=Q1S6Z7; Match level="QueryCoverage=40%, HitCoverage=6%, E-value=7e-09, Identity=88%"; Hit description =Metallo-dependent hydrolase, composite
MCHSFVETVVNHNEVSCGRWSFGADKSRVCKLEELQETIRVTKDAKNDAAAGEATPCAIHLADFVNTPLYVVHVMSIDVMEEIAKA

SEQ ID NO: 216022 - protein, 67 aa, Glycine max
  Coding DNA Sequence Number=SeqID_99244
  Gene Ontology: Mol. function=sequence-specific DNA binding; Cellular component=nucleus; Biological process=regulation of transcription, DNA-dependent
  Homolog annotation: Hit_ID=Q9S7Q7; Match level="QueryCoverage=89%, HitCoverage=31%, E-value=2e-18, Identity=70%"; Hit description =FLOWERING LOCUS C protein
  Pfam annotation: Domain name=SRF-TF; Domain location=9-59; Score =104.6; E_value=2.9e-28; Accession=PF00319.9; Description=SRF-type transcription factor (DNA-binding and dimerisation domain)
MGKKKLEIKRIENKSNRQITFSKRRKGLMKKARELSILCDAKLALLIFSSTGKLYELCNGDRKHFKV

SEQ ID NO: 216023 - protein, 169 aa, Glycine max
  Coding DNA Sequence Number=SeqID_99245
MDQLKRLSIPSEMIRFSNHACHPRLGHSTRKISMQQGQTVILIARFPDPNYGVKTSFIATIDEIKTLTSFQEALKYEWVQAMNREIRTLERNSTSEIVDKPKDKKAAGLEKLTKGLLALSPNKIIANVINVVIQFMHDPCERHLQEVDRILQYPRKGLLFKKSTFIHYQ

SEQ ID NO: 216024 - protein, 163 aa, Glycine max
  Coding DNA Sequence Number=SeqID_99246
  Gene Ontology: Mol. function=sequence-specific DNA binding; Cellular component=nucleus; Biological process=regulation of transcription, DNA-dependent
  Homolog annotation: Hit_ID=Q533S6; Match level="QueryCoverage=93%, HitCoverage=63%, E-value=2e-76, Identity=91%"; Hit description=MADS box protein SEP3
  Pfam annotation: Domain name=K-box; Domain location=2-96; Score =134.0; E_value=4.1e-37; Accession=PF01486.8; Description=K-box region
MTHICNVLDELSSQQEYLKLKARYEALQRSQRNLMGEDLGPLSSKELESLERQLDSSLKQIRSTRTQFMLDQLSDLQRKEHLLSEANRSLRQRQLEGYQINPLQLNPGVEEMGYGRHPAQTHGEALFQQMECEPTLQIGYQPDPVSVVTAGPSMSNYMAGWLP

SEQ ID NO: 216025 - protein, 236 aa, Glycine max
  Coding DNA Sequence Number=SeqID_99247
  Homolog annotation: Hit_ID=Q8W2F3; Match level="QueryCoverage=43%, HitCoverage=22%, E-value=1e-10, Identity=40%"; Hit description =Phytochrome-interacting factor 4
MKNIIPGWDFETDACLTKQTKLIGPDQELVQLLWQNGQVVRHNQTYRKPLGNSSNLRQVQKTDHSTLRSSGPYGNSSNLDQEEATPWIQFPLEDPLEQDFCSNLLSELPPTCEFESYKPIKQLEEDKFTNFFASRFAPNAQDNREGLVLLMDAIEKAGYTGFGRFSSSHGSKSSVRGSVGSSEGFSTVLKTMWVSRERFPVDFRLEEKEKSDFKQEEKVKSECKVFERAGCEMSTF

SEQ ID NO: 216026 - protein, 61 aa, Glycine max
  Coding DNA Sequence Number=SeqID_99248
MSICSCLRQGSLVMCSSPRRSIFTLLMLWGSELDKHKPSCILHRILMPRLGSAGALALMVL

SEQ ID NO: 216027 - protein, 37 aa, Glycine max
  Coding DNA Sequence Number=SeqID_99249
MENMVSTDFKGVLVIEEIIGAPVVPRGRKHMGSVLVF

SEQ ID NO: 216028 - protein, 77 aa, Glycine max
  Coding DNA Sequence Number=SeqID_99250
MVFFERKKELEKRKNESSKTHKELTIVLAKEKELEKGKNESSKRQRVDNFFERKKSQKNGKMSLQEHTRVDKCTGKR

SEQ ID NO: 216029 - protein, 171 aa, Glycine max
  Coding DNA Sequence Number=SeqID_99251
  Gene Ontology: Mol. function=protein binding; Cellular component =nucleus; Biological process=regulation of timing of transition from vegetative to reproductive phase
  Homolog annotation: Hit_ID=Q76BW4; Match level="QueryCoverage=93%, HitCoverage=91%, E-value=1e-64, Identity=71%"; Hit description =Flowering locus T
  Pfam annotation: Domain name=PBP; Domain location=15-161; Score =188.8; E_value=1.4e-53; Accession=PF01161.10; Description =Phosphatidylethanolamine-binding protein
MDPLVLGRIIGDILDPFTSSVSLRVVYNNQSSVINSCEFKPSQIVNKPRINIRGNDLGIFYTLIMVNPDAPSPSDPHMKEYLHWLVTNIPASTGATTGEEIVEYESPRPTSGIHRIAFVLFRQFDRQIVHAPRWRQNFNTRDFAEVYNLGSPVAAVYFNCQREGGWGGRRR

SEQ ID NO: 216030 - protein, 151 aa, Glycine max
  Coding DNA Sequence Number=SeqID_99252
  Gene Ontology: Mol. function=DNA binding; Cellular component=integral to membrane; Biological process=regulation of transcription, DNA -dependent
  Homolog annotation: Hit_ID=Q6D4K6; Match level="QueryCoverage=76%, HitCoverage=28%, E-value=8e-45, Identity=68%"; Hit description =Putative membrane protein
  Pfam annotation: Domain name=TerC; Domain location=47-134; Score =55.0; E_value=2.6e-13; Accession=PF03741.6; Description=Integral membrane protein TerC family
EYRALAHLYGPSPTSLHLFPALLSTHPDTCRKESLMEFLFDPSIWAGLLTLIVLEIVLGIDNLVFIAILADKLPPKQRDKARLIGLSLALVMRLGLLSLISWMATMELHERLENRGMEHQGNKAYASFWAVVTQIVVLDAVFSLDAVITGV

SEQ ID NO: 216031 - protein, 140 aa, Glycine max
  Coding DNA Sequence Number=SeqID_99253
MLSFNFRHVAELHGLPNHGCQVPRNGQMRVSSQQQDGPQTKLGYDKPLKASMQEKTNSIKCFKFKCLGRRHITSQCPTKKTMIMRGQDIYSSQDELTTSPSSSESEEAKGEESSEEIYPQEGGQPLMVKEECKDLSVSSK

SEQ ID NO: 216032 - protein, 221 aa, Glycine max
  Coding DNA Sequence Number=SeqID_99254
  Gene Ontology: Mol. function=two-component response regulator activity; Cellular component=intracellular; Biological process=two -component signal transduction system (phosphorelay)
  Homolog annotation: Hit_ID=Q6D241; Match level="QueryCoverage=99%, HitCoverage=62%, E-value=4e-78, Identity=87%"; Hit description=Two -component system response regulator
  Pfam annotation: Domain name=AAA_2; Domain location=77-207; Score= -42.1; E_value=0.014; Accession=PF07724.4; Description=ATPase family associated with various
  Pfam annotation: Domain name=Sigma54_activat; Domain location=58-201; Score=119.1; E_value=1.2e-32; Accession=PF00158.16; Description=Sigma- 54 interaction domain
  Pfam module annotation: Pfam domain module=AAA_2::Sigma54_activat; Domain location=77-207::58-201
PVIILTAHGSIPDAVAATQQGVFSFLTKPVDRDALYKAIDEALAQRAPVSDDGWREAIVTRNPLMLRLLEQAHMVAQSDVSILINGQSGTGKEVLAQAIHAASPRAGKPFIAINCGALPEQLLESELFGHAKGAFTGAVSAREGLFQAAEGGTLFLDEIGDMPQALQDPGTARTRRRHPAAGQPSAAPVGRSPQTVCAQLLGRCDETAGECQLAGKCAPAG

SEQ ID NO: 216033 - protein, 222 aa, Glycine max
  Coding DNA Sequence Number=SeqID_99255
MTTLTQIWMTLLLSNIQPSDHNSNLPLPKYQLVYATLTWMSIHVAQLITDAICLFAGMPPTRHPLDPDKSNRALGFLALITGLCQSFGVPVAPSKVIRSPITRAFIEKYCTTRQAQGGDPQAPDAPPPPPHADPTGRRPTTGCTCRPMTLYISLASALQSQGFASFPCPTPDQFRAEVAWPGDWLEAQAGEASAEAPDEADEAHEDEEMTDLLDFLGGSGAT

SEQ ID NO: 216034 - protein, 116 aa, Glycine max
  Coding DNA Sequence Number=SeqID_99256
MSMTLYAKSMTLARRNGPNFVRAAERPFVGGCVKKGTDHPETKQPLTCCLLMEEKKKKQLDEAAKSRSTYTVIDPPSSIRRHVKWKMAHTKKIGQMTYEAAKEIANKIDSLEEQAS

SEQ ID NO: 216035 - protein, 107 aa, Glycine max
  Coding DNA Sequence Number=SeqID_99257
  Gene Ontology: Mol. function=sequence-specific DNA binding; Cellular component=nucleus; Biological process=regulation of transcription, DNA-dependent
  Homolog annotation: Hit_ID=Q2EMR9; Match level="QueryCoverage=89%, HitCoverage=32%, E-value=8e-29, Identity=69%"; Hit description=MADS -box protein SEP3-1
  Pfam annotation: Domain name=SRF-TF; Domain location=9-59; Score =121.8; E_value=2e-33; Accession=PF00319.9; Description=SRF-type transcription factor (DNA-binding and dimerisation domain)
MGRGRVELKRIENKINRQVTFAKRRNGLLKKAYELSVLCDAEVALIIFSNRGKLYEFCSSSRFEGFCKRVAVRSATGNALELSLSFPFLVLNPAFEIAVFLLRQTDQ

SEQ ID NO: 216036 - protein, 202 aa, Glycine max
  Coding DNA Sequence Number=SeqID_99258
  Gene Ontology: Mol. function=nucleoside-triphosphatase activity; Cellular component=membrane; Biological process=mRNA catabolic process, nonsense-mediated decay
  Homolog annotation: Hit_ID=Q69VT5; Match level="QueryCoverage=45%, HitCoverage=6%, E-value=5e-31, Identity=79%"; Hit description =Putative type 1 RNA helicase
MVNEGRIPTTDGQRVIGEPAASGLVLDESWLWHLDFETSTKLVPLLGNEDMIRPQLRTEATNVAKIVTTFLKSGVVPSQIGVITPYEGQKTYIVNYMSRNGVSRQQLYKEIELLHEFYSFPVASVDSFIGREKYYIILSCVRSNVHQGKTIGVNVEDDDSYMDTYVSPLTAQITRNVVGEEEADDVHSNRNDHDEGELINIV

SEQ ID NO: 216037 - protein, 387 aa, Glycine max
  Coding DNA Sequence Number=SeqID_99259
  Gene Ontology: Mol. function=oxidoreductase activity; Cellular component=membrane; Biological process=metabolic process
  Homolog annotation: Hit_ID=Q7CQG2; Match level="QueryCoverage=58%, HitCoverage=90%, E-value=7e-83, Identity=70%"; Hit description =Putative oxoacyl-(Acyl carrier protein) reductase
  Pfam annotation: Domain name=CobA_CobO_BtuR; Domain location=224-387; Score=318.7; E_value=1e-92; Accession=PF02572.6; Description =ATP:corrinoid adenosyltransferase BtuRCobOCobP
  Pfam annotation: Domain name=Epimerase; Domain location=8-269; Score=- 48.2; E_value=0.0053; Accession=PF01370.11; Description=NAD dependent epimerasedehydratase family
  Pfam annotation: Domain name=KR; Domain location=8-190; Score=-17.7; E_value=2.5e-06; Accession=PF08659.1; Description=KR domain
  Pfam annotation: Domain name=adh_short; Domain location=6-177; Score =120.0; E_value=6.7e-33; Accession=PF00106.15; Description=short chain dehydrogenase
  Pfam module annotation: Pfam domain module=CobA_CobO_BtuR::Epimerase:: KR::adh_short; Domain location=224-387::8-269::8-190::6-177
DLLDNRIILVTGASDGIGREAALTYARYGARVILLGRNATTLQQTAEAINQLNKQPAATLLLDLAHATPESCQQLAQQVAALVPRLDGVLHNAGILGEIVPLAELDPAVWQQVMQINLDATFYLTQALLPLLLKSDAGSLVFTTSSVGRTGRAGWGAYAVSKFATEGMMQVLADEYKNRHLRVNCINPGGTRTKMRASAFPEENASLLKTPADLMPLYLYLMGDDSRRKTGKTTAAFGTALRACGHGKNVAAVQFIKGEWPNGERNLLAQHGVEFQVMATGFTWETQNRASDTAACQQVWQHARRMLQDASLDLVILDEITYMVSMDYLDLDELIAALQQRPPQQSVIITGRGCHRTLLELADTVSEMRPVKHAFDAGIQAQQGIDW

SEQ ID NO: 216038 - protein, 71 aa, Glycine max
  Coding DNA Sequence Number=SeqID_99260
MEMHKQAKQPHTIPSNEAFRDENMWRNGRKMSGEVFSGSQWLSSSSSFRFFVLLPIRSPLFPPILSLEKPL

SEQ ID NO: 216039 - protein, 90 aa, Glycine max
  Coding DNA Sequence Number=SeqID_99261
MSSQVSKHVTEQESGQDLFESKREKSLLKGIPRFKEVFAKYKARTGKRASNHWAIRVGVWSSRSQGSKISGLSTISDKASQSQFDFEQCG

SEQ ID NO: 216040 - protein, 39 aa, Glycine max
  Coding DNA Sequence Number=SeqID_99262
MEVELCTHRGCQKLYHFKENNICINIIARGPYSKFGTSL

SEQ ID NO: 216041 - protein, 448 aa, Glycine max
  Coding DNA Sequence Number=SeqID_99263
  Gene Ontology: Mol. function=L-isoleucine transporter activity; Cellular component=integral to membrane; Biological process=amino acid transport
  Homolog annotation: Hit_ID=Q53MQ4; Match level="QueryCoverage=94%, HitCoverage=95%, E-value=1e-120, Identity=50%"; Hit description =Transmembrane amino acid transporter protein
  Pfam annotation: Domain name=Aa_trans; Domain location=73-436; Score =107.7; E_value=3.4e-29; Accession=PF01490.8; Description =Transmembrane amino acid transporter protein
  Pfam annotation: Domain name=Spore_permease; Domain location=74-372; Score=-177.5; E_value=0.097; Accession=PF03845.4; Description=Spore germination protein
  Pfam module annotation: Pfam domain module=Aa_trans::Spore_permease; Domain location=73-436::74-372
MLKSLRKSLSLQQKCLQHKNQVDNAESVHGANLANCIFCVEETKQCKCDHNNIEDTKSAEGGTNLDAEHDSEANCSFTHAVINMVGMLIGLGVICAYSSHLLGKCLEKNTKLRSYVDIGGHAFGAKGRIMATTFIYMEIFMALVSYTISLHDNLNSIFSGMHLKLQLAKLSTLQLLTIGAVLIALPSLWLRDLSSISFLLTGGILMSLVIFVSIASTPIFGGVQINHKIPLLHLHSIPSISGLYIFSYGGHIVFPNLYKAMKDPSKFTKVSIVSFTLVTLLYTTLGFMGGKMFGPDVNSQVTLSMPPKLFVTKIALWATVVTPMTKYALEFAPFAIQLEKRLPKFNSGRTKMIIRSSVGSFLLLVILALALSVPYFEHVLCLTGSLVSVAICLIFPCAFYIKICWGQISKPLFVLNLSIITCGFLLGVMGTISSSNLLVKHFLQAQSA

SEQ ID NO: 216042 - protein, 444 aa, Glycine max
  Coding DNA Sequence Number=SeqID_99264
  Gene Ontology: Mol. function=DNA primase activity; Cellular component= alpha DNA polymerase:primase complex; Biological process=DNA replication, synthesis of RNA primer
  Homolog annotation: Hit_ID=Q1SFA0; Match level="QueryCoverage=100%, HitCoverage=98%, E-value=1e-178, Identity=69%"; Hit description =Eukaryotic-type DNA primase, large subunit
  Pfam annotation: Domain name=DNA_primase_lrg; Domain location=161 -434; Score=291.0; E_value=2.2e-84; Accession=PF04104.4; Description =Eukaryotic-type DNA primase, large subunit
MEIVRPQNRRNLLSSSNEAVSAPTIPLYRSAPPLEVRLEDFESFAIDRLRVLKGISDGKGPVESEYETSRGNSGSEQGYYISFCSTSGVLQNDLRKWFLSMETALFRYRFRLLNAEAQRTVMEEFDLPYRAVSNVEFESIKEKLGQVARSMGQPSPTADAIFYKVPFEEVPELVAGRRVFINQGYAYVAMNQSIGYSKSCLCFNFATFLDCFTCSHTIPQSAVKGTYPYKQILRVSSNCCRKWTSSIREQEKHRLTPIVEALSSSYLGPDYSQSREYADISLKDIDQVAKSSFPLCMRHLFDKGVGLNLDDALAFWRSEFSKKVGLEKFEKQYAYNIRHNYGKEGKRTDYTPYSCQKIISSTPGAGDHHGCPYRHFSEENLRAALSGMGVNSQAMEDVMDKVRNRHYQLACTLTFEALHGMPCDAGINHPNQYFSDSQKILKPK

SEQ ID NO: 216043 - protein, 224 aa, Glycine max
  Coding DNA Sequence Number=SeqID_99265
  Gene Ontology: Mol. function=Rho GDP-dissociation inhibitor activity; Cellular component=cytoplasm; Biological process=actin cytoskeleton organization and biogenesis
  Homolog annotation: Hit_ID=Q1SF97; Match level="QueryCoverage=77%, HitCoverage=86%, E-value=1e-66, Identity=79%"; Hit description=RHO protein GDP dissociation inhibitor
  Pfam annotation: Domain name=Rho_GDI; Domain location=35-218; Score= -22.6; E_value=3.4e-07; Accession=PF02115.7; Description=RHO protein GDP dissociation inhibitor
FRMSAAVSATKDVPFNAHLEEDIKNKGSNKVVGEADRLPYNDDAEGTDSETEEDPKLELDLGPQFSLREQLEKDKDDESLRKWKEQLLGGIDVSAVGENKEPEVKIVSLTIICPGRPDLILPIPFTSESKNSIFTLKEGSQYRLKFSFTVSNNIVSGLKYTNVVWKTGLRGEPIQQEPRDGGGNGPHVDKGTEINKYPQLLLVLYQANSQKVRQFFDGPEAFVI

SEQ ID NO: 216044 - protein, 265 aa, Glycine max
  Coding DNA Sequence Number=SeqID_99266
  Homolog annotation: Hit_ID=Q1SF96; Match level="QueryCoverage=94%, HitCoverage=40%, E-value=1e-104, Identity=73%"; Hit description =Membrane attack complex component/perforin/complement C9
MMRKIDFKKQFQNFLAFCLVKEKTHVTMLIEVVSEQKPVVGMRMYLEGRKCDRLALHINHLSSLPNKMILSSGTSTLSTPSMWRGSDDNESSDQFLERIRWKRFSNVCTAVVKHDPNWLNNSGGVYIVTGAQLLSKGSWPRNVLHLRLLFAHTPNCSIRKSEWTAAPEASRKSSFLTNLSTTFSFTQHGNTGPPKQAPTVLNSGVYPDGPPVPVRAGKLLKYVETAEVVRGPHDAPGHWLVTAAKLVTDGGKIGLQVKFALLDYW

SEQ ID NO: 216045 - protein, 73 aa, Glycine max
  Coding DNA Sequence Number=SeqID_99267
MTMIQPSLTTVVCHIPDLRHFSDAPLQDGILEAMVMWLQCVGGLGRISVGCGDHGHKSECSRVLKEPWSEVEV

SEQ ID NO: 216046 - protein, 153 aa, Glycine max
  Coding DNA Sequence Number=SeqID_99268
  Gene Ontology: Mol. function=hydrogen-exporting ATPase activity, phosphorylative mechanism; Biological process=hydrogen transport
  Homolog annotation: Hit_ID=Q5Z800; Match level="QueryCoverage=64%, HitCoverage=13%, E-value=1e-37, Identity=78%"; Hit description =Putative NF-E2 inducible protein
  Pfam annotation: Domain name=DUF544; Domain location=42-152; Score =155.5; E_value=1.4e-43; Accession=PF04424.4; Description=Protein of unknown function (DUF544)
MSEDAHMSEDAPQMIADVDATVAEDLGRDDIEGSHADEGFPGNVLLLRNNLNLSPDIAEVSQEKLLSLVAERLIDSNSSVNGKDAGYVENQQQNIADAIDLLPRLATGIDVNIKFRRIADFEFTRECAIFDLLDIPLYHGWMVDPQLPPCATS

SEQ ID NO: 216047 - protein, 273 aa, Glycine max
  Coding DNA Sequence Number=SeqID_99269
  Gene Ontology: Mol. function=nucleic acid binding; Cellular component= chromatin; Biological process=DNA integration
MVLWRGSTDIEIRNQPNGALILTQSMYIRDLLTKTKMNEVNPVSSRMVGGCLLWLPCSMQQSSDLRSALILTQSMYIRDLLTKTKMNEVNPVSSRMVGGCKLTKSVYESFSDPTLYRSVVAALQYATITRPKISFSVNKVCQFKSDPSEQHWMAVKRILRYLAVTINFGLSFHPHSSGPQFPLHAYFDVDWASDPGDRRSTSRAAIFFGPNLVSWWSKKQTVVACSSTEAEYRSLALAAAKVTWIFFLISKDNTFYIDKRVPEVLVYIRLATR

SEQ ID NO: 216048 - protein, 385 aa, Glycine max
  Coding DNA Sequence Number=SeqID_99270
  Gene Ontology: Mol. function=RNA-directed DNA polymerase activity; Cellular component=nucleus; Biological process=RNA-dependent DNA replication
MLFYHSELGPEQHEESEAQKLGILFNIVAEALTGLVREACINGECEAILRSFELASGLKINFAKSSLGAIGANQRRGQLWEPIIKKCEKALSKWKQRHLSFGGIPKKVNDELVRLQLRFLWGGGSDTNKIAWIKWDTVCLPKEKGGLGIKDISTFNLAMLGKWRWNLFHDEGQLWAKILVSKYGGWRGLEENGGNSFESLWWRDLKSIFQTTQQGEDAIKGVKWRVGCGDSIKFWQDTWLDGATSLLFENEIPMAVNFLQDIEGKTIYTQRRDEWEWMADPIEGIQDQAFEELWRLKVPLKYGVFAWRLLINRLPTKANLHRRQVQLLDRRCLFCTNMEEEPGHMFFHCSKVIPNWWETLSWVKKSTTLPDMDNLAAKEQDDILQ

SEQ ID NO: 216049 - protein, 650 aa, Glycine max
  Coding DNA Sequence Number=SeqID_99271
  Gene Ontology: Mol. function=triacylglycerol lipase activity; Biological process=lipid metabolic process
  Homolog annotation: Hit_ID=Q1SZS0; Match level="QueryCoverage=51%, HitCoverage=90%, E-value=1e-143, Identity=74%"; Hit description=AAA ATPase
  Pfam annotation: Domain name=MMR_HSR1; Domain location=213-315; Score= -13.6; E_value=0.018; Accession=PF01926.13; Description=GTPase of unknown function
MTYAYIIPRLYHVQTDLSCLLIYDLFMSDDFSSFSRIEQQFPHLKQWLGFKAAGTVELGHIVESPVIRTATSIVPLGWNDGLGAKNGEPLKVDITGFGLHLCTLVHAQVNGNWCSTTVESFPSPPNYSSNQGIQPELQKLRIFVGPPLRSPPKHQTVLDSLMPAFTSVDSETASSSAPADKDKFIRPENLNNFVIFCTSDFTTVSKEVHVRTRRVQLVGLEGAGKTTLLKAVLHKCKPNTAANEDAASEVVREVIADGLCYCDSNGINMQELNVETSRFRDELWLGIRDLSRKTDLIVFVHNLSHSIPRCSNSNDTQQRPVLSLFLDEAKSLGIPWVLAITNKFAVSAHHQKTAIDAALKAYQASPSSAEVINSCPYVMPGFVGASLSLDATNTDSNRRVGAEKLIFAPINFIRKPFLKKEIVFPVEGVNSLCQQIHCILRSREESSFQEFARDRLLMELAREQAMSIEASRDAQVKANSLNSAAVGASVGAGLGLVLAIGDEVVVETEEDELEEEADYEEYLQLKVAKKSLTSSTISGHNSIVCISQSGSNQSSWIIDSGAFDHIADNSSLFSSLSPPKIPHFITLDDGSRVAAIGINHISPTSSLSLNYERGTGWTIDVGHESHGLYYLKSNLSWVCSAATSPKLLHE

SEQ ID NO: 216050 - protein, 98 aa, Glycine max
  Coding DNA Sequence Number=SeqID_99272
MGRLQSLNTSFMAITQGCPSLECQVARETALLETVFTKEALLDLFTKSETEFEQMTLGTGCDLLNVLRNIGDMMRCPSQDTSFVKVQIEQWLGEFVEE

SEQ ID NO: 216051 - protein, 112 aa, Glycine max
  Coding DNA Sequence Number=SeqID_99273
MWDATVFGVFNQDFPLYIKHEDLSKISHGGQCLSISVIQLWILHLTKTSMRAGNSDVNGFLEPQSIQRSGQSQFESESYIKSWMQSSKHDIYLGAYLNGPLEAERLKALRIQ

SEQ ID NO: 216052 - protein, 120 aa, Glycine max
  Coding DNA Sequence Number=SeqID_99274
  Gene Ontology: Mol. function=transferase activity
  Homolog annotation: Hit_ID=Q67V33; Match level="QueryCoverage=94%, HitCoverage=43%, E-value=4e-19, Identity=43%"; Hit description =Ribosomal protein-like
MDEIFGYKYLRRPNNNDINHLLQIGEAHGFLDMLGSIHLTLCKVELLQYNLQLMKPHTIGYYLVNDIYLDWATLMKTFPMPQGEKRKLFAKCQKATRKNVERTFGVLKFGFAIICGPLCN

SEQ ID NO: 216053 - protein, 76 aa, Glycine max
  Coding DNA Sequence Number=SeqID_99275
MINANCPQESLHSISNGNLRNCVGRCSIPQRLLGKGKGRRWSMRLFLGLLSSQVVGIGSCSDGGGGDGGGDPRVPP

SEQ ID NO: 216054 - protein, 53 aa, Glycine max
  Coding DNA Sequence Number=SeqID_99276
MGENCHVEIDPSGRYGRLLAASALEETNIFQNKLLPETISNGTNIWDIQLLEG

SEQ ID NO: 216055 - protein, 98 aa, Glycine max
  Coding DNA Sequence Number=SeqID_99277
MNLMKYEKLGLVTKHHIIKNEYMCLSYPNFVQGSLFVGMRPPFEHFKMFNTYCRGIRKVLGRFGKKTTKNTKAGGELIKHRGALKKLHLETLWKVGVN

SEQ ID NO: 216056 - protein, 164 aa, Glycine max
  Coding DNA Sequence Number=SeqID_99278
  Homolog annotation: Hit_ID=Q9FE41; Match level="QueryCoverage=43%, HitCoverage=2%, E-value=9e-09, Identity=43%"; Hit description=Oryza sativa (japonica cultivar-group) genomic DNA, chromosome 1, PAC clone:P0433F09
MDTDDIKGKGKKMDIDAIEVKKERMDTNAIKEKGTKMDTNVIEEKKERMDIDVIKENGKKMDKYEDMYELNRELVEHRLAICEGKKPVKQTPRRFVPNIIEAVKVKIERLLKEHQEAFDDIKRYLANPPVLVSPLKGRDLKLYIFTSNLTIASMLVQEDDNGIE

SEQ ID NO: 216057 - protein, 165 aa, Glycine max
  Coding DNA Sequence Number=SeqID_99279
  Gene Ontology: Mol. function=nucleic acid binding
MEGVVTYDGDIFKLTTENYSYWKPMMEDHLYCKDLHELITQKDKSEEKITDKEWELQNWKASWYTLIVTRSNSAPEGKLTMDTVVDSLLNEQARRKERGMVVQFEANIVENRIRSENHTRSAGRSRNLEDDLNLSLLGLPATIVASQVTRNLNVDISRETKNRHC

SEQ ID NO: 216058 - protein, 101 aa, Glycine max
  Coding DNA Sequence Number=SeqID_99280
  Gene Ontology: Mol. function=protein-tyrosine kinase activity; Cellular component=integral to membrane; Biological process=protein amino acid phosphorylation
  Homolog annotation: Hit_ID=Q8L3Y5; Match level="QueryCoverage=95%, HitCoverage=11%, E-value=2e-22, Identity=55%"; Hit description =Receptor-like kinase RHG1
  Pfam annotation: Domain name=LRR_1; Domain location=16-38; Score =13.2; E_value=0.93; Accession=PF00560.23; Description=Leucine Rich Repeat
  Pfam annotation: Domain name=LRR_1; Domain location=40-62; Score=5.4; E_value=28; Accession=PF00560.23; Description=Leucine Rich Repeat
  Pfam annotation: Domain name=LRR_1; Domain location=64-86; Score =14.4; E_value=0.42; Accession=PF00560.23; Description=Leucine Rich Repeat
  Pfam module annotation: Pfam domain module=LRR_1::LRR_1::LRR_1; Domain location=16-38::40-62::64-86
MGAKGHITERIGQLRGLRKLSLHDNQIGGSIPSALGLLLNLRGVQLFKNRFTGTTPPSLGSCPLLQSLDLSNNLLTRTIPMSLGNATKLYWLNFSFNSLGW

SEQ ID NO: 216059 - protein, 327 aa, Glycine max
  Coding DNA Sequence Number=SeqID_99281
  Gene Ontology: Mol. function=oxidoreductase activity; Cellular component=cytoplasm; Biological process=response to red or far red light
  Homolog annotation: Hit_ID=Q1SA90; Match level="QueryCoverage=98%, HitCoverage=97%, E-value=1e-114, Identity=66%"; Hit description=2OG -Fe(II) oxygenase
  Pfam annotation: Domain name=2OG-FeII_Oxy; Domain location=167-275; Score=104.3; E_value=3.6e-28; Accession=PF03171.10; Description=2OG -Fe(II) oxygenase superfamily
MLNESCLVKTCKPSIMFTRVPEVDLSDPEAKSLIIKASKECGFFKVVQHGVAFELITNLENEVLRFFHQPQPQKDKVVPPDPCGYGSRKIGANGDEGWLEYLLINTNPDDPKSLHLFQQNPANFRSAVEDYIGAVKNLCSDVLELMADGLGVEPRNVFSRLTMDERSDCLLRVNRYPVCAELDEFEALSEQYLIGFGEHTDPQIISVLRSNNSHGLQICLRDGTWASIPPDQTSFFVIVGDLLQVMTNGRFKSVKHRVLTDSTISRISIIYFGGPPLNENIAPLPSLVLKEEESLYKELTWQEYKTATFKSRLSDNRLRLFEKFPSE

SEQ ID NO: 216060 - protein, 254 aa, Glycine max
  Coding DNA Sequence Number=SeqID_99282
  Gene Ontology: Mol. function=DNA binding; Biological process=DNA integration
  Homolog annotation: Hit_ID=Q1SKC8; Match level="QueryCoverage=64%, HitCoverage=46%, E-value=1e-48, Identity=52%"; Hit description =Integrase, catalytic region
YIYLGLTENKRGYISCGLVLVDGTSTRFKENKGGYIPCGSLLVKGFLQGHSIQQAEVSNRELKKILEKTIASNRKDWASKLDDALWAYRTAFKTSIVLSSFQMAASGEQRKTQLLELEELRWNAYESARLYKDKVKAYHDKKLLKKEFRAGQQVLMFNSRLKLFPGKLKSKWLGPFTIKEVRPYGTVELFDPHSSTSDRTWVVNGQRLKLYHGGNIDRQVTSRANGLAEQALCAKPKNFSRISSFGMGLSESSC

SEQ ID NO: 216061 - protein, 250 aa, Glycine max
  Coding DNA Sequence Number=SeqID_99283
MDRARLVYGMVMRMDIDVGSLISHQISQMGQPNSSRLGFPALVIALCIARGVIFDSLTFESLSHAINLAYIKKNCWNLDDPTIIFPGTRKSRARGPDSIVPFSSTPVDPASTSTPAPSTSAPPLPSALVQTGTSAPPSSDLVKCRCSEVIVPMLQSLHHGLRLVAWPGVQPSPLGGGKASAAQEPLPEPKVAREATLETTPQVSPATSPIVEVSEGREGIEDTDYAKDLQAAHSTSDPWPPTARETPQPA

SEQ ID NO: 216062 - protein, 86 aa, Glycine max
  Coding DNA Sequence Number=SeqID_99284
MGWWMNPLAFNFPQLRGWLSGTGQESGQAELSTASYYIDRWWANPPGPACFPIPTNIILHLGHNKSKLYFLEVWKLDLLHLISIPF

SEQ ID NO: 216063 - protein, 120 aa, Glycine max
  Coding DNA Sequence Number=SeqID_99285
MSTTLCLTMITLFGLSLSLFLLVVHHVGVIMPHIHALSRRCHCASQSHLLIIFSLSLSLLILLCAHFDDTHRVQASRSQSQTHGVPLALNLMLMTLCLIVMLFDLSLLVVHHVDVVVPHT

SEQ ID NO: 216064 - protein, 97 aa, Glycine max
  Coding DNA Sequence Number=SeqID_99286
MTPKVCILKNLNGQIVETCLRKLRTKFEDDATVNESGCYICNKRERRRHFKEKMSLEEAHHHRRPWIRAWRKKEMNEGRGREEHEILCSKRALKSEV

SEQ ID NO: 216065 - protein, 999 aa, Glycine max
  Coding DNA Sequence Number=SeqID_99287
  Gene Ontology: Mol. function=microtubule motor activity; Cellular component=microtubule associated complex; Biological process =microtubule-based movement
  Homolog annotation: Hit_ID=Q9LDN0; Match level="QueryCoverage=99%, HitCoverage=86%, E-value=1e-147, Identity=56%"; Hit description =Phragmoplast-associated kinesin-related protein 1
  Pfam annotation: Domain name=Kinesin; Domain location=4-227; Score =158.2; E_value=2.1e-44; Accession=PF00225.13; Description=Kinesin motor domain
  Pfam annotation: Domain name=Kinesin-related; Domain location=228 -942; Score=753.7; E_value=1.2e-223; Accession=PF06548.2; Description= Kinesin-related
  Pfam module annotation: Pfam domain module=Kinesin::Kinesin-related; Domain location=4-227::228-942
MWGPANALSDGNSASDQQGLAPRVFERLFACINEEQIKHSDKQLKYQCHCSFLEIYNEQIADLLDPNQRNLQIREDVKSGVYVENLTEELVCTKKDVTQLLIKGLLNRRIGATSINSESSRSHTVFTCVVESRCKSTANGVSRFRTSKINLVDLAGSERQKLTGAAGDRLKEAGNINRSLSQLGNLIKILAEVSQTGKPRHIPYRDSSCKSETFSTLRFAQCVKDIKNKAVVNEVMHDDVNQLRDVICQLRDELHRIKANGYSPSDGSRGHSAALIRRSLNLLKPTLNRPLSLPHVDEDGDEEMEIDEEGVEDHAVVLHNSNGGFAGFSAPNGSIGSPSAAMNGDSLAGGMVKCKTSPILKSPPSSLSPTISSSRKSLRTSLKQSPSENNIHGESDLGTNTVNQKCLSTALSSQTAPNFVTKTENLAVSIRHGLEIIDSHHHGTSLSSLSLRPKDSRLIIPVEKVDVGVQTFLDDNAKKEDYAMLTCNNCKSRMQLDVNEIDNSSNVQQLLIDCPQSTGKPKKQILKAVEKVLAGSIRREMALEEFCAKQTSDIMQLNCLLQKYRQERECNATITQIREDKILRLQSLIDGVLSTKESMDEELVSLTHENKDLPAIKIQQLLKENHEHHLEVLKMKIELKRVQDELQEYQNFYQFGEREVLMEEICSLRNQLHFYVDSSSTAATKQYPPLQLTYSSEPSLEANLTAIPDLTEASTKANANPESTEDSAKVKLEQEKSQWTEAESRWISLTEKLRAELETSRLLAEKRKQELDTERKCAEELNETMQMAIEGHARILEQYADLEEKHIQLLDRHRKIQDGIDDVKEAASRAAGVRGADSKFINALAAEISALKAEKEKEMEILRDENRGLRAQLKDTAEAVQAAGELLVQLNEAEEAVITAQKRAMDAEQEAAKAYKQIDKLKKKHDKEISTLNKLLAKTHLPNEEIRPTLDDLVMPTCDDTKVPNNVNGQFELFCSEEDIELANLADQSWLSSYDTCNI

SEQ ID NO: 216066 - protein, 236 aa, Glycine max
  Coding DNA Sequence Number=SeqID_99288
  Homolog annotation: Hit_ID=Q2R2Z6; Match level="QueryCoverage=80%, HitCoverage=72%, E-value=4e-32, Identity=65%"; Hit description =Membrane associated salt-inducible protein, putative, expressed
  Pfam annotation: Domain name=DUF860; Domain location=1-204; Score= -57.4; E_value=1.2e-09; Accession=PF05898.4; Description=Plant specific of unknown function (DUF860)
  Subcellular localization annotation: CTP_CleavageSite=6; ConfidenceScore=5.04e-01
MVIPVRSLPRPPPPPPDQPPQAPPCLRFPPQNAQPLRTLQGPEGGALVRHDPKSRELDGTTTKGHRRTRRQSHRTRHELFKVVKSLDGVEFLELVSWNPDWAITELEKKGGDRNNRNYQNFTIEKRLVTDHLTHFRWELVMPQKLMRLLLKDCGIFYVSKRGKRFSVFLTEAYEGSELIEKCPLVLWKEKVLGLVGYTGRKKKLEVCKRNSEVGDLHVQIEPRGTLHYEDPLVGDD

SEQ ID NO: 216067 - protein, 518 aa, Glycine max
  Coding DNA Sequence Number=SeqID_99289
  Gene Ontology: Mol. function=amidase activity; Cellular component =cytosol; Biological process=translation
  Homolog annotation: Hit_ID=Q1SF95; Match level="QueryCoverage=98%, HitCoverage=98%, E-value=0.0, Identity=73%"; Hit description=Amidase
  Pfam annotation: Domain name=Amidase; Domain location=60-495; Score =201.9; E_value=1.5e-57; Accession=PF01425.11; Description=Amidase
  Subcellular localization annotation: CTP_CleavageSite=40; ConfidenceScore=5.13e-01
MACNTVGCFSLFFQFILLIPLVTFSSLFLPTTTAKGFSIEEATVYDLQLAFRRNQLTSRQLVEFYHKQIQTQNPVLRGVLELNPDALAQADKADHERKANAPGTLPALHGIPILVKDNIATKDKMNTTAGSFALLGSVVPRDAGVVTRLREAGAIILGKATLSEWSHYRSNDAPSGWNGRGGEGKNPYTMDGPCGSSSGSAISVAANLVAVSLGSETDGSILCPSGSNSVVGIKPTVGLTSRAGVVPITPLQDTVGPICRTVSDAALVLETIAGIDVNDNATIKASKYLPRGGYAQFLKKDGLRGKRLGVVRTFYGFGNDTFMHDTFELHLKTIRQKGAVLVDNLEINNIQEIFNDQSEDIAMAYEFKLSLNAYLRDLVASPVRSLADVIAFNKKHPKLEKLKEYGQDLMLIAQKTNGVRELKEAVLNMARLSHNGFEKLMITKKLDAVVVPFSFFVSILARGGYPGVTVPAGYEKGAPFGIIFGGLKGSEPKLIEIAYSFEQATLIRKPPPLRKLKV

SEQ ID NO: 216068 - protein, 88 aa, Glycine max
  Coding DNA Sequence Number=SeqID_99290
MGEMLMAKCTTLVEENEEIGNQASEGKVKKRVVDPKTSQSTRKIKHPNSLLGVVHVLVSKSKVNVIDVVGRFPDDDTNDIDDYRQGMI

SEQ ID NO: 216069 - protein, 203 aa, Glycine max
  Coding DNA Sequence Number=SeqID_99291
  Gene Ontology: Mol. function=protein translocase activity; Cellular component=chloroplast inner membrane; Biological process =intracellular protein transport
  Homolog annotation: Hit_ID=Q9SZB2; Match level="QueryCoverage=57%, HitCoverage=44%, E-value=7e-20, Identity=40%"; Hit description=Tic22- like protein
  Pfam annotation: Domain name=Tic22; Domain location=2-202; Score =24.9; E_value=7e-09; Accession=PF04278.3; Description=Tic22-like family
MMNFDGFQKALAEFQGRCSTLLGSLTRLQPNRARPPWARIAQPWGGRPMAMTVEAIEERLEGIPVYALSNASEEFLLVSGSSSGKNLGLFCFNKDDAEALLNQVTLIDPHARQGSKVVPVALNKVFQLKVNGVAFRLIPEFSQVKNALQLDSLKPCSATLRTVIPKFKTLHTPKPYKNPKGRLVGFFLSCPGIMNPGNHVYWE

SEQ ID NO: 216070 - protein, 68 aa, Glycine max
  Coding DNA Sequence Number=SeqID_99292
MWTTGKHVINVQHLVCTCAARASARYDHSTAAESGRGYMAVTVGRMTANEVGGWSKISVMCSVYGLSM

SEQ ID NO: 216071 - protein, 167 aa, Glycine max
  Coding DNA Sequence Number=SeqID_99293
MAPRKLPSKRSRKDATEEGYSAAPQVDTDFDEHRFRSIDHQQRFEEEIAHRCWAPLVTHMAKFDLEIVMELYANAWPTEEGGQQCEYSQRRRQVFGFDEEAIAQLLCILGQDFAWTAVGRHVWIMRTSMTILTQIWMTLLLSNILLGDHNSDLPLPKCQLVYAILTQ

SEQ ID NO: 216072 - protein, 209 aa, Glycine max
  Coding DNA Sequence Number=SeqID_99294
  Gene Ontology: Mol. function=nucleic acid binding; Biological process= DNA integration
  Homolog annotation: Hit_ID=Q1SDG1; Match level="QueryCoverage=43%, HitCoverage=10%, E-value=1e-12, Identity=35%"; Hit description =Integrase, catalytic region; Zinc finger, CCHC-type
  Pfam annotation: Domain name=zf-CCHC; Domain location=178-195; Score =24.6; E_value=8.6e-05; Accession=PF00098.13; Description=Zinc knuckle
MASSNYLFPEGNSINRPPIFIVKGYHYWKTRMQIFIDAIDLNIWEAIEIGPYVLTMVAGNITSALGMDEYFKVSNCKNAKDKWDTLQVTHESTTNEHEMELLRLNQHEENDKKKKGIAFKASSSIQEESDKEGSIDLDEDEDLSLYVKRFNIFLRMRRIQRRQNFKPKRRTQESSQTPRCYECNQPEHLSVDCPIFKKKMEKLEKKNIG

SEQ ID NO: 216073 - protein, 153 aa, Glycine max
  Coding DNA Sequence Number=SeqID_99295
  Subcellular localization annotation: CTP_CleavageSite=26; ConfidenceScore=5.03e-01
YNPGWRNHPNLRWASPPQQQQPVPPYQNAAGPSKPYVPPLMQEQQQQQQRQQATEAPSLPSLEELQPPIPLPFPPRAIPNKKIEEVDKEILETFRKVEVNIPLLDAIKQIPRYAKFLKELCTHVATYPSTGGRREDSRVRLPWEEYARSRHQR

SEQ ID NO: 216074 - protein, 155 aa, Glycine max
  Coding DNA Sequence Number=SeqID_99296
PFYKPRAKIPIYHKPCPQKKTKEKGTSQSKEWEKEKREKSQSKNERKQKHKKGKKILDQGSEENRRNMQKGLLTRRYLNNTDLSPRKHEKKGNHDLKWSSLFDCQPKSCASVTCLPRAKQKNRKGKGQKYSKPKSHKKHHSQGKVLLIHDHACSL

SEQ ID NO: 216075 - protein, 206 aa, Glycine max
  Coding DNA Sequence Number=SeqID_99297
MSVEQFIEKVAWPGARPSFVGDNESFTAQAPQQHEPEPENDHSSEATIPRVVDFAKRRLETRSNEAAHPGPMPASADAPFPGVDPSSPQHATDSSTPVLEIHEGQTIPVLTLDTSPPTTPLKHLCLSETVAVRLWFKLLSLISVLCLTPSNYSGYILFFSLDNCIPCDATLPRRALGRRLQVDWARDPREGPRILMSLRVDFEPMG

SEQ ID NO: 216076 - protein, 130 aa, Glycine max
  Coding DNA Sequence Number=SeqID_99298
MGHLDKCRLYIEENPPCLVALGRVYKGSTTIHNIPLLHDQVKVGVKEVRHTDAPIPIPAEEFKLVGQTLNTFLAWPTHLVMFIKIVVGPAKPIDRSNHEVDDPLYLMTLTIQQLFLKPLQKNRHMIETSM

SEQ ID NO: 216077 - protein, 296 aa, Glycine max
  Coding DNA Sequence Number=SeqID_99299
  Gene Ontology: Mol. function=transporter activity; Cellular component= periplasmic space; Biological process=transport
  Homolog annotation: Hit_ID=Q66F16; Match level="QueryCoverage=91%, HitCoverage=52%, E-value=1e-78, Identity=55%"; Hit description=ABC transporter, periplasmic oligo-dipeptide/nickel binding protein precursor
  Pfam annotation: Domain name=SBP_bac_5; Domain location=71-296; Score= -22.4; E_value=0.00061; Accession=PF00496.12; Description=Bacterial extracellular solute-binding proteins, family 5
MKKIIPSLLALSLVAAFSAQAATPKDTLVIAQSTDDADSFDPAQGFELTTVQAFTNIYQRLVQSDPANPTDLKPTLATSWQPGSDNRSLTFALRKDAKFASGNPLRPEDVIFSLGRVVKLNLDPSFILTQLGWNKDNVDSFLKKVDEDHVQISWSANVSPAYVLSLLSAPVSSIVDEKTAQANAKNGDFGHAWLGTHSAGSGPFQIRKVVLHEAILLSANPTSPAGAPKLKNILIKNVPEPAARRLLLEQGDVDIARNLGADQIAALKGQSRREDRSDSDGVALLHSVQRRCQSRY

SEQ ID NO: 216078 - protein, 40 aa, Glycine max
  Coding DNA Sequence Number=SeqID_99300
MVTKRVKKYEKMMTHQLSSSESETQHDHRSTSTPYGSHRP

SEQ ID NO: 216079 - protein, 71 aa, Glycine max
  Coding DNA Sequence Number=SeqID_99301
MTKFGRPAPEIEEMTITLDDVASLLHLPIVRAFHIFEQLHVNDVVDMLVELLEVSTTEARVEMIQCHASYV

SEQ ID NO: 216080 - protein, 81 aa, Glycine max
  Coding DNA Sequence Number=SeqID_99302
  Subcellular localization annotation: CTP_CleavageSite=56; ConfidenceScore=5.51e-01
MNGSSFLGDPTVPSYEGKDGNSLPGSSPLKAKVCSPLNARTCSPLKARMCSPLKARASSPLKARTCSPLKARTCSPLKTRT

SEQ ID NO: 216081 - protein, 68 aa, Glycine max
  Coding DNA Sequence Number=SeqID_99303
MRGVLRKLHAEHSRWGAVLGEKTCFHEENPSRGATVLLLRRFREQIHEDYPPFFTVLRLIFVHSLVFN

SEQ ID NO: 216082 - protein, 124 aa, Glycine max
  Coding DNA Sequence Number=SeqID_99304
MNISMAHDQGSFVEAKTQEKSPIKEHESREKDEEQAQQQWEKYSIVENQQENIFQSNNLPHQLIDKKGRQEEHEETLSAILSIITNTFLEMIWNVLPDYMKFMEFLAKRRNFKEDVFFVTFMPP

SEQ ID NO: 216083 - protein, 757 aa, Glycine max
  Coding DNA Sequence Number=SeqID_99305
  Gene Ontology: Mol. function=protein serine/threonine kinase activity; Cellular component=integral to membrane; Biological process=protein amino acid phosphorylation
  Homolog annotation: Hit_ID=Q8LKR3; Match level="QueryCoverage=93%, HitCoverage=80%, E-value=0.0, Identity=85%"; Hit description =Receptor-like kinase RHG4
  Pfam annotation: Domain name=LRRNT_2; Domain location=22-58; Score =24.2; E_value=0.00046; Accession=PF08263.3; Description=Leucine rich repeat N-terminal domain
  Pfam annotation: Domain name=LRRNT_2; Domain location=319-358; Score =7.9; E_value=0.13; Accession=PF08263.3; Description=Leucine rich repeat N-terminal domain
  Pfam annotation: Domain name=LRR_1; Domain location=109-131; Score =11.0; E_value=2.5; Accession=PF00560.23; Description=Leucine Rich Repeat
  Pfam annotation: Domain name=LRR_1; Domain location=133-157; Score =6.4; E_value=18; Accession=PF00560.23; Description=Leucine Rich Repeat
  Pfam annotation: Domain name=LRR_1; Domain location=159-181; Score =4.4; E_value=44; Accession=PF00560.23; Description=Leucine Rich Repeat
  Pfam annotation: Domain name=LRR_1; Domain location=183-205; Score =17.8; E_value=0.039; Accession=PF00560.23; Description=Leucine Rich Repeat
  Pfam annotation: Domain name=LRR_1; Domain location=207-230; Score =0.4; E_value=2.4e+02; Accession=PF00560.23; Description=Leucine Rich Repeat
  Pfam annotation: Domain name=LRR_1; Domain location=232-253; Score =3.7; E_value=59; Accession=PF00560.23; Description=Leucine Rich Repeat
  Pfam annotation: Domain name=LRR_1; Domain location=255-277; Score =10.7; E_value=2.9; Accession=PF00560.23; Description=Leucine Rich Repeat
  Pfam annotation: Domain name=LRR_1; Domain location=279-300; Score =7.6; E_value=11; Accession=PF00560.23; Description=Leucine Rich Repeat
  Pfam annotation: Domain name=LRR_1; Domain location=361-383; Score =2.5; E_value=97; Accession=PF00560.23; Description=Leucine Rich Repeat
  Pfam annotation: Domain name=LRR_1; Domain location=385-407; Score =17.9; E_value=0.036; Accession=PF00560.23; Description=Leucine Rich Repeat
  Pfam annotation: Domain name=LRR_1; Domain location=409-430; Score =11.9; E_value=1.7; Accession=PF00560.23; Description=Leucine Rich Repeat
  Pfam annotation: Domain name=LRR_1; Domain location=62-84; Score=8.3; E_value=7.9; Accession=PF00560.23; Description=Leucine Rich Repeat
  Pfam annotation: Domain name=LRR_1; Domain location=86-107; Score =18.1; E_value=0.033; Accession=PF00560.23; Description=Leucine Rich Repeat
  Pfam annotation: Domain name=Pkinase; Domain location=561-756; Score =59.2; E_value=1.4e-14; Accession=PF00069.15; Description=Protein kinase domain
  Pfam annotation: Domain name=Pkinase_Tyr; Domain location=561-756; Score=21.3; E_value=8.9e-14; Accession=PF07714.7; Description =Protein tyrosine kinase
  Pfam module annotation: Pfam domain module=LRRNT_2::LRRNT_2::LRR _1::LRR_1::LRR_1::LRR_1::LRR_1::LRR_1::LRR_1::LRR_1::LRR_1::LRR _1::LRR_1::LRR_1::LRR_1::Pkinase::Pkinase_Tyr; Domain location=22 -58::319-358::109-131::...
  Pfam module annotation: Domain location=133-157::159-181::183 -205::207-230::232-253::255-277::279-300::361-383::385-407::409 -430::62-84::86-107::561-756::561-756
MSLPKTLLSLSLLFAIAITAVTGDDAAVMSNFLISLTPPPSGWSQTTPFCQWKGIQCDSSRHVTSISLASQSLTGTLPSDLNSLSQLRTLSLQDNSLSGTLPSLSNLSFLQTAYLNRNNFTSVPPSAFSSLTSLQTLSLGSNPTLQPWSFPTDLTSSVNLIDLDLATVTLTGPLPDIFDKFTSLQHLRLSYNNLTGNLPASFAVADNIATLWLNNQAAGLSGTLQVLSNMTALKQAWLNKNQFTGSLPDLSQCKALSDLQLRDNQLTGVVPASLTSLPSLKKVSLDNNELQGPVPVFGKGVNFTLDGINSFCLDTPGNCDPRVMVLLRIAEAFGYPIRLAESWKGNDPCDGWNYVVCAAGKIITVNFEKQGLQGTISPAFANLTDLRSLFLNGNNLTGSIPESLTTLSQLQTLDVSDNNLSGLVPKFPPKVKLVTAGNALLGKALSPGGGPNGTTPSGSSTGGSGSESAKGSSLLSPGWIAVVLFVSWKCFVNRRQGKFSRVNGRENGKGIFKPDAAHVSNGYGGVPSELQSQSSGDRSDLQALDGPTFSIQVLQQVTNNFSEENILGRGGFGVVYKGQLHDGTKIAVKRMESVAMGNKGLKEFEAEIAVLSKVRHRHLVALLGYCINGIERLLVYEYMPQGTLTQHLFEWQEQGYVPLTWKQRVVIALDVARGVEYLHSLAQQSFIHRDLKPSNILLGDDMRAKVADFGLVKNAPDGKYSVETRLAGTFGYLAPEYAGYYFNIMLWCPANLSSSIE

SEQ ID NO: 216084 - protein, 43 aa, Glycine max
  Coding DNA Sequence Number=SeqID_99306
MHGLHEHAMAPKKLLTKRARKDAAGEGSSAAPQAEIEFDGHHF

SEQ ID NO: 216085 - protein, 153 aa, Glycine max
  Coding DNA Sequence Number=SeqID_99307
  Gene Ontology: Mol. function=RNA-directed DNA polymerase activity; Biological process=RNA-dependent DNA replication
  Homolog annotation: Hit_ID=Q2HS44; Match level="QueryCoverage=91%, HitCoverage=58%, E-value=5e-19, Identity=34%"; Hit description =Hemopexin
MDIPMVGYPFTWSHSKGTINVVEERLDRALVTSDWLDYHLDVKLQNSIAFISYHSPIILATQEASNHQTITHRRRMFKFENALLLKEDVEEMVKGNNNNFGEIDFTSKIQTFKEKLEAWGRCIRMRFQKDIKRNKHKLKDLIRAIEEEKVEEF

SEQ ID NO: 216086 - protein, 312 aa, Glycine max
  Coding DNA Sequence Number=SeqID_99308
  Gene Ontology: Mol. function=acyl-ACP synthetase activity; Cellular component=plastid; Biological process=fatty acid elongation
  Homolog annotation: Hit_ID=Q8W471; Match level="QueryCoverage=69%, HitCoverage=28%, E-value=2e-76, Identity=64%"; Hit description=A6 anther-specific protein
  Subcellular localization annotation: CTP_CleavageSite=59; ConfidenceScore=5.58e-01
MATIPITYNHAWTFSHPHHALSRFLSPCNFSRITFSRRKYGVGGPAPSSPLSHFRVFCQSKHEKEKESLAKTEILEIRKCSPFLESSLLLGNGGVASDEWKAVPDIWRSSAEKYGNNVALVDPYHDPPTTMTYTQLEQAILDFAEGLRVIGVRPDEKLALFADNSCRWLVADQGMMASGAINVVRGSRSSVEELLQIYNHSESVALVVDNPEMFNRVANTFYSRTSMRFIILLWGEKAELVGQENKHVPVFTFMEVIDLGRQSRRALSNAHDAGTSPRFLGLYHITRHDNRPEIINPDSPTYTRIHSRYPTS

SEQ ID NO: 216087 - protein, 707 aa, Glycine max
  Coding DNA Sequence Number=SeqID_99309
  Gene Ontology: Mol. function=AMP deaminase activity; Cellular component=integral to membrane; Biological process=purine ribonucleoside monophosphate biosynthetic process
  Homolog annotation: Hit_ID=Q1SKM8; Match level="QueryCoverage=100%, HitCoverage=83%, E-value=0.0, Identity=83%"; Hit description =Adenosine/AMP deaminase active site
  Pfam annotation: Domain name=A_deaminase; Domain location=392-707; Score=431.3; E_value=1.3e-126; Accession=PF00962.12; Description =AdenosineAMP deaminase
MDTHAVHLALAAIVGASVVAVSAYYMHRKTLAQLLEFARTVEREADGGGSSDTEPPTAHLKKRLGSSRRRGNGGYRRGSASLPDVTAISGGFDGEEKRNGPVHVDGIPVGLPRLHTLREGKSSQSGSFKRSLLRPTSPKSPVASASAFESVEGSDDEDNMAGEVKLDTTYLHTNGTVVPEGKIPFETLPNHVNANGEQMAITPSMIRSHSVSGDLHGVQPDPIAADILRKEPEHETFTRLRITPLEAPSPDEVEAYVVLQECLEMRKRYVFSEAVAPWDKEVISDPSTPKPNPDPFLYILEGKSDHYFEMRDGVIHVYPDRDAKEELFPVADATTFFTDLHHILRVIAAGNIRTLCHHRLNLLEQKFNLHLMLNADREFLAQKSAPHRDFYNVRKVDTHVHHSACMNQKHLLRFIKSKLRKEPDEVVIFRDGTYLTLEEVFKSLDLTGYDLNVDLLDVHADKSTFHRFDKFNLKYNPCGQSRLREIFLKQDNLIQGRFLGELTKQVFSDLAASKYQMAEYRISIYGRKQSEWDQLASWIVNNDLYSENVVWLIQLPRLYNVYKEMGIVTSFQNMLDNIFIPLFEVTVNPDSHPQLHVFLKQVVGLDLVDDESKPERRPTKHMPTPEQWTNVFNPAFSYYVYYCYANLYTLNKLRESKGMTTIKFRPHSGEAGDIDHLAATFLTAHNIAHGINLKKSPVLQYLYYLAQ

SEQ ID NO: 216088 - protein, 108 aa, Glycine max
  Coding DNA Sequence Number=SeqID_99310
  Gene Ontology: Mol. function=catalytic activity; Cellular component =plastid; Biological process=metabolic process
  Homolog annotation: Hit_ID=Q1SB22; Match level="QueryCoverage=90%, HitCoverage=16%, E-value=1e-29, Identity=68%"; Hit description=AMP -dependent synthetase and ligase
MGKCLTKNKKQASYAYSMLDWLWARTIATILLPLHILAKKLVYSKIHSAIGISKAGISGGGSLPWEVDKFFEAIGVKVQNGYGLTETSPVIAARRPRCNVSNVPNQMH

SEQ ID NO: 216089 - protein, 189 aa, Glycine max
  Coding DNA Sequence Number=SeqID_99311
  Homolog annotation: Hit_ID=Q1SB28; Match level="QueryCoverage=24%, HitCoverage=31%, E-value=5e-23, Identity=100%"; Hit description=G10 protein; Cytochrome c and b562
  Subcellular localization annotation: CTP_CleavageSite=35; ConfidenceScore=5.09e-01
MDHGRQQKAKSTKKVILRNPPLATKTRIGIQSVPTCTTLAPTVNTLYDLLLPKLLGNSANTSGGKIVITWLHAPQAAKTGAAPIHDEEGRSGAVQRRGRYRSRVGRSGTGSGPDFRAATLTPWKFQKCLHLMWESEALRPNHSKTLVSTATGEAARTTTSLHPTKLRPRHLRPASGGPDDESALRRHLA

SEQ ID NO: 216090 - protein, 48 aa, Glycine max
  Coding DNA Sequence Number=SeqID_99312
MKIEPGLKDEVGPSNVQPQRSVPPSSLFGSFNQPLATRQATTPDPTSY

SEQ ID NO: 216091 - protein, 72 aa, Glycine max
  Coding DNA Sequence Number=SeqID_99313
EGESADGIPITINEILDVSISFLNDHSEETLGSTKIEEIHSKCINLAQCGANKSPMHRILVGNQREKTTFRL

SEQ ID NO: 216092 - protein, 1132 aa, Glycine max
  Coding DNA Sequence Number=SeqID_99314
  Gene Ontology: Mol. function=identical protein binding
  Homolog annotation: Hit_ID=Q9FGU0; Match level="QueryCoverage=82%, HitCoverage=68%, E-value=9e-97, Identity=31%"; Hit description =Arabidopsis thaliana genomic DNA, chromosome 5, TAC clone:K21L19
  Pfam annotation: Domain name=Fip1; Domain location=332-394; Score =116.2; E_value=9.3e-32; Accession=PF05182.4; Description=Fip1 motif
MEDDDEFGDLYTDVLRPFASSPSLSSAPQPHQPSPAPPSLDLSPNPDDAQIPCDAPHANSPAPTNPLPEPDPREAPTEPPKIPDAKPTTDSNLAAAAVAVDPMDREVKFDIEEDEEDGGEPVIPGLTGELAAPTEGEGDDWDSDSEDDLKIVLNENNHMAMERGGMADGDEEEEDGDEELVIVAGGDPNQGAEEPEWGENATLAAGDGERKDAAGELAKAGGAAVPPKIGYSNQGYHPFHSPFKYQYVRPGAALMPGAAASAPGGPPGQIRPLANMAGRGRGDWRPPGIKGGAAMQKGFHAGPGLPGWGNGAAGRGFGGGLEFTLPSHKTIFDVDIENFEEKPWQYPNIDTSDFFNFGLNEESWKDYCKQLEQLRLESTMQSKIRVYESGRTEQEYDPDLPPELAAATGIHDSPVENTNSLKSDVGQSDVMKGSGTGRVRPPLPTGRAIQVEGGYGDRLPSIDTRPPRIRDSDAIIEIVLQDTEDDQSSAGVAQDPPEGGEPHREDFREDHVAGDEIPRLEPEYFDGFPQVYNGRKKEIAGRRMSFINSSAANMPNGDEKLFFPQEEPIEYSGSKGQNRRSYGGNCSSSHDERQMQRRVGGQSPSITPIQELATDNSLKEESAESMEGRHRSSPAVKDIRESSVEEKDIELEDTGTADGSSRLEKEETVDKVDALEDGVAKRQKLTSRVEPPLLDEVDDWEDSKAAKSSDNSKARSASSRDNQKRREGFEEEVVQDPRSAQLSSIRQHPDEIEQGFYRREHDAKQEPGRNLMMLKGRERPYPYKDRHPSSATQLNTNADGFDGQKERDNSEMDWSRRDDDLYNRRVRNDEPRKRDRAKVRENEKNDKEDSLHSRKQLDNGSYRVSYEKDVGSRDSRQRERDEGLRIRYEAVEDYRGKKRKDEEYLRREHIDKEEVLHGYREIASSRRRRERDEVLDPRKRDDLQRARDNPDDQYATRQKDEAWVLKERGDRQRDREEWCRMKQSHEEHLPKREREGRSSVRSGRGAEHKLSEKEYQSREAMRHNDQLKRRDRIQDESPHHKGRDDASARGNQYTTEERRSRLERSSSRSDRVANVSDNQKVKHREGSRKSKERDVSDLNSLGLSKRSQENQSGPTNEKVCTLACKNVKLSGE

SEQ ID NO: 216093 - protein, 115 aa, Glycine max
  Coding DNA Sequence Number=SeqID_99315
  Gene Ontology: Mol. function=transferase activity; Cellular component= endoplasmic reticulum membrane; Biological process=DNA integration
  Homolog annotation: Hit_ID=Q1T010; Match level="QueryCoverage=96%, HitCoverage=9%, E-value=1e-22, Identity=44%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MEEPRTPHLLAGKRILRYVKGTLNFGIMFPNDERYTKAKLFGYSDSNECDDKSDQNSTTGCSKKQGVVALSSCEAEYIVASMVACQALWLETLLEELNLRESKPIKLLVDKQVNY

SEQ ID NO: 216094 - protein, 80 aa, Glycine max
  Coding DNA Sequence Number=SeqID_99316
MESVSTLVYCDVGIIPSDEGIMFESPSDPKVITISEDMSLAALRKTIFYANRDEILTLLYKPRKPRTTGEIIALINNESM

SEQ ID NO: 216095 - protein, 388 aa, Glycine max
  Coding DNA Sequence Number=SeqID_99317
  Gene Ontology: Mol. function=transmembrane receptor activity; Cellular component=integral to membrane; Biological process=defense response to bacterium
  Homolog annotation: Hit_ID=Q9XGQ5; Match level="QueryCoverage=93%, HitCoverage=54%, E-value=1e-172, Identity=80%"; Hit description =Putative transmembrane 9 superfamily protein member 2
  Pfam annotation: Domain name=EMP70; Domain location=56-388; Score =27.9; E_value=2.9e-16; Accession=PF02990.7; Description=Endomembrane protein 70
MELRKSFICHWVFLFVIVFVQVVNGFYLPGSYMHTYSNKDLIYAKVNSLTSIETELPYSYYDLPYCQPDGGIKKSAENLGELLMGDQIDNSPYRFRMNVNETLYLCTTSPLNEHEVKLLKQRTRDLYQVNMILDNLPVMRFTNQNGVKIQWTGFPVGYTPADGGEDYIINHLKFTVLVHEYEGSGVEIVGTGEEGLGVISESDNKKASGYEIVGFQVVPCSIKYDPEVMTKHNRYDTLSPISCPAELDKYQVIKERERISFTYEVEFVKSDIRWPSRWDAYLKMEGSRVHWFSILNSLMVISFLAGIVFVIFLRTVRRDLTRYEELDKETQDQMNEELSGWKLVVGDVFREPDCSKLLCVMVGDGVQILGMAGVTIVFAALGFMSPAS

SEQ ID NO: 216096 - protein, 88 aa, Glycine max
  Coding DNA Sequence Number=SeqID_99318
MLYMMHYNIYSYRTNVVTASRGTVKDGVVEEQEGDDYEAIGDGGVNGVKVEAKREKVGYLATTLFDANSESLDPSMTMAQADDGKQLH

SEQ ID NO: 216097 - protein, 126 aa, Glycine max
  Coding DNA Sequence Number=SeqID_99319
METKQHPRQQSPPIVASMHDEGLQPHAQSYEFMPQLHHHHQEDYGYNPQFFNARREDFMSNPMGTVVRISESAYTYIQIILLMTSSRKSNLFLMNNLNHKNMNEYVDEWHEISNLPDKGIGRHRRH

SEQ ID NO: 216098 - protein, 211 aa, Glycine max
  Coding DNA Sequence Number=SeqID_99320
  Gene Ontology: Mol. function=catalytic activity; Biological process =metabolic process
  Homolog annotation: Hit_ID=O23300; Match level="QueryCoverage=60%, HitCoverage=53%, E-value=2e-20, Identity=52%"; Hit description =Carnitine racemase like protein
MCTLKKRGNIFILTLTGEGEHRLNPTLLDSIQSSLHRVPQEATASSALVTTVHDKFFSNAYDIAWAQSSDEVKERMILMDSLLHSVILQSPHAPKADYSRRHRPRLCCKLHPRLRLHPRSFGFGGQERGIEVEEECGVGGSSCVGEKVESGHWEEERNGHREVCEEEQAQGMKLKLLTFKDGFMKTIFEMLAVFTKLPLLHKQRRFFDNCR

SEQ ID NO: 216099 - protein, 84 aa, Glycine max
  Coding DNA Sequence Number=SeqID_99321
MNEGKDVVFFEIVARIEGLRIGRRLSEGVRVEENAEGGVVAVNRALVVPLGLFSGKVLAMIVFGDSSVDVGNNNNIAMVARSHF

SEQ ID NO: 216100 - protein, 142 aa, Glycine max
  Coding DNA Sequence Number=SeqID_99322
MRVLNRLFHNGLLANKKIGCARCKKGGGGAATQREGGKKGCRPFMFNDGIFNDRNSRCIAKINLYANPVYTTFEKPRFASSLVSLHLFMFNVIRKLEERREREEGKVAQSEQRWWTRPAVLEEEGGWSIFVHSIPKVLWEVQ

SEQ ID NO: 216101 - protein, 72 aa, Glycine max
  Coding DNA Sequence Number=SeqID_99323
MMFRGCGNGGIGWRQNLLGRGRGICVHFGLLGDVGSGKGEARTRNFIGVSCIGPAPDTHAGKTPVRRGVRCF

SEQ ID NO: 216102 - protein, 205 aa, Glycine max
  Coding DNA Sequence Number=SeqID_99324
  Gene Ontology: Mol. function=transcription factor activity; Biological process=regulation of transcription, DNA-dependent
  Homolog annotation: Hit_ID=Q35NC3; Match level="QueryCoverage=81%, HitCoverage=81%, E-value=4e-39, Identity=50%"; Hit description =Putative TetR-family transcriptional regulator
  Pfam annotation: Domain name=TetR_N; Domain location=25-71; Score =49.5; E_value=1.1e-11; Accession=PF00440.13; Description=Bacterial regulatory proteins, tetR family
MTSKPNPAPAARERGRPRNFDIDEALDSAMIVFRQKGFHAASIADLGEAMNLTAGSIYKAFQDKRSLFLRVFERYILLRNVDLRARLQQYPTGRARIAELLQFYLDSASEIEGRRGCLVVGSTVELQTLDEELSQLVREAVLRNRNFLTSLVEQGQEDGSISPRLDADTAAGLLLCVAFGMRVVGKIQDVTNGKETINMVLSILD

SEQ ID NO: 216103 - protein, 84 aa, Glycine max
  Coding DNA Sequence Number=SeqID_99325
MNGTHGTLYFSLLTLIHSKRGVEVAQKLAQASSAHPDKLLAYSRSNLLAHASSARPIELVTSSLSFLVGPGVENFPKVTPCPFF

SEQ ID NO: 216104 - protein, 137 aa, Glycine max
  Coding DNA Sequence Number=SeqID_99326
MHYIIVRILLPRSSNLAQASEEDLILMWAFLTDRQIDWAHLVRYRMHKALRANAPLPYPQLVTLFLRHFQIPLDDEPFVQVKRSFAIELRGLRTYVGERFDSLDGRFEGMDIHVTQLEEDVTYIRQSFNLRPPPPPS

SEQ ID NO: 216105 - protein, 198 aa, Glycine max
  Coding DNA Sequence Number=SeqID_99327
  Gene Ontology: Mol. function=helicase activity; Biological process =protein amino acid phosphorylation
  Homolog annotation: Hit_ID=Q1SN45; Match level="QueryCoverage=98%, HitCoverage=12%, E-value=8e-38, Identity=43%"; Hit description=AAA ATPase
  Pfam annotation: Domain name=DUF889; Domain location=1-196; Score =190.2; E_value=5e-54; Accession=PF05970.5; Description=Eukaryotic protein of unknown function (DUF889)
MHLHRNLESVDEQETATFAKWILDIGDGIIDDENDGYATIQIPAHLLITQYDDPISAIVKSTFPDLDQHHNNPEFFKSKAILASTNETVEQINDYVLSFIPGDHMEYLSSDSIDKSETSENSYFQSITTEFLNSLKTSGLPTHSIKLKIGSPIMLLRNLDQNQGLCNDTRLVVKTLAWLFIFQECQCLLHNHPGRLNY

SEQ ID NO: 216106 - protein, 1378 aa, Glycine max
  Coding DNA Sequence Number=SeqID_99328
  Homolog annotation: Hit_ID=Q6DAT3; Match level="QueryCoverage=27%, HitCoverage=87%, E-value=1e-116, Identity=60%"; Hit description =Putative exported peptidase
  Pfam annotation: Domain name=Glycos_transf_1; Domain location=930 -1099; Score=119.7; E_value=8.5e-33; Accession=PF00534.10; Description=Glycosyl transferases group 1
  Pfam annotation: Domain name=Peptidase_M23; Domain location=327-422; Score=128.4; E_value=2e-35; Accession=PF01551.12; Description =Peptidase family M23
  Pfam annotation: Domain name=Polysacc_deac_2; Domain location=443 -654; Score=362.5; E_value=6.6e-106; Accession=PF04748.3; Description= Divergent polysaccharide deacetylase
  Pfam module annotation: Pfam domain module=Glycos_transf_1::Peptidase_ M23::Polysacc_deac_2; Domain location=930-1099::327-422::443-654
TVTHTRTRYNDPASPLSFRWSDISLSLLCAGALLLPVAAHSADDSKTQLKSIQQDIAEKEKSVKAQKLQRSKLLDQLQSQEKVIAQASRQLRETRNSLSALNGEIAQTTAAIARLEKQQAQQEKLLAQQLDAAFRQGQHNGVQLLLGGEEAQRSERILAYFGYLNAARQKNIDELKQTQQELAQQRQALQGKQEQQKSLLAQQQTQQNKLETASAARKKTLSALESALEKDQADLVEMRQNESRLQDKIAKAEREARERAQREAREAEKVRQRQAQAKAKGSSYSPTQSERELMARTGGLGRPDGQAIWPVRGRIEHRFGEAMQGELRWKGLVIDAPEGTEVKAIADGRVLMADWLQGYGLVVVVEHGKGDMSLYGYNQSALVSVGAQVKAGQPIALVGTSGGRGTPSLYFEIRRQGQASQKLSAALCGLFLTFAAHAGKLAIVIDDFGYRPAEENKVLQMPAAISVAVLPNAPHAHDMATKAHQGGHEVLIHLPMAPLSKQPLEKDTLTPEMSSEEIARIVRDASNKVPYAVGLNNHMGSKMTSSLPGMQKVMQVLNHYNYYFLDSMTIGNSQSIPAAQGTQVKVLKRRVFLDDSQNEAAIRTQFTRAVKLAQRDGYAIAIGHPHPTTVRVLQQMLPTLPGDITLVRPSQLLNEPLRQGATPPASTPEKPRTPVFRAPGVCKPGQPLPAVPQSRAVEAQRAAPYLTPHLFRARISEQMTSTRKKILLLDTGREWGGGTNSMLELLKRIDRQRFAITCCFYQNYARGNQETIASVLDAIGIPVLFIAQRRQPLWAKITKELLRTLLFFNRAVKKNAIDRIDRQWRMQPNARQIATILRDGGYDALYMNNQPSTNVEGYLAAEQTHVALIQHCRIDPLLNNALVKMINRHCDAVIAVSQGVHRTLSESGVDAQRCFTVSNAIDIHQPLPVREAVRQRFDYPADTFIFGSIGSLIARKSNHHILQALGAFSRAHPAAKWKMVIVGAGPEQQHLQQLAQKEGIAAQVIFTGFQNNALDYLAAFDTFILASASEGLPRVVLEAMLVNTAVIGSNVVGTSELIQHRETGLLFDYGNTQQLSQHLSALWQDTVLRQRLIAAAAARVRERYSIEHYVSGVENILENGTIAVSSVVIPCTGADYIEEAVLSAYFASRCADTISEIVIVSDQPSSAFPPLPARVRVVTLEVPFREENYRYKQIYRSRLIKLQAPLQATGEGILMIDSDLNLLKTPDIAMREHHLYSSFRQGKMIAKLAGAPEEHIPAYYHHTVRPYLQDHVNGAYLAASRRTWQRICPLWLTLFNDTWELMNDDQPPTDQLPLAALLDLLDVRTVNLGEWANWPVSKRIGGQSAVIPPQDPHQPLSFKGQDYTRKVRYLTDAEKQQS

SEQ ID NO: 216107 - protein, 427 aa, Glycine max
  Coding DNA Sequence Number=SeqID_99329
  Gene Ontology: Mol. function=transferase activity, transferring glycosyl groups; Cellular component=membrane; Biological process=UDP- glucose metabolic process
  Homolog annotation: Hit_ID=UPI00005F8269; Match level="QueryCoverage =94%, HitCoverage=59%, E-value=0.0, Identity=81%"; Hit description =COG1215: Glycosyltransferases, probably involved in cell wall biogenesis
  Pfam annotation: Domain name=Glycos_transf_2; Domain location=130 -301; Score=84.3; E_value=3.8e-22; Accession=PF00535.16; Description =Glycosyl transferase
MSKLGFYLLLLVLAPVAAVIVITPMDSQKQYIFGLISIGMMFLLGFSKSRKITIVMVFLSALMSTRYIWWRTTETLQFNSEIEAILGIGLYLAELYVWLILILGFLQTSWPLKRTIEPLPDDTRLWPTVDVYVPTYNESLDVVRDTVLAAQCIDYPRDKIKVYLLDDGKRSEFAVFAADVGVGYITRDDNRHAKAGNLNHAMKITKGELICVFDCDHVATRTFLQATVGPFLKDPKLALLQTPHYFYSPDPFERNLRAARSIPNEGSLFYGPVQQGNDNWNATFFCGSCAVIRRSALEQIGGFAVETVTEDAHTALKMQRLGWGSAFLAIPLAAGLATERLGLHVIQRTRWARGMTQIFRVDNPLLGRGLKWQQRLCYLNAMLHFQFGLPRVAFLTAPLAYLLFNLNIIHSSASLIFAYVLPHLVMS

SEQ ID NO: 216108 - protein, 420 aa, Glycine max
  Coding DNA Sequence Number=SeqID_99330
  Gene Ontology: Mol. function=cobyrinic acid a,c-diamide synthase activity; Biological process=cobalamin biosynthetic process
  Homolog annotation: Hit_ID=UPI00005F790D; Match level="QueryCoverage =59%, HitCoverage=94%, E-value=2e-96, Identity=69%"; Hit description =COG1192: ATPases involved in chromosome partitioning
  Pfam annotation: Domain name=CbiA; Domain location=158-371; Score =30.0; E_value=2.4e-07; Accession=PF01656.13; Description=Cobyrinic acid a,c-diamide synthase
  Pfam annotation: Domain name=YhjQ; Domain location=220-413; Score= -35.8; E_value=0.045; Accession=PF06564.3; Description=YhjQ protein
  Pfam module annotation: Pfam domain module=CbiA::YhjQ; Domain location=158-371::220-413
ALIMKNYDDLQRFQEKTQTLDIAFKDMSGQSLEADHSQWAIIRQLATDDEPELGSGQRVDLPQPQPIRGDEFVAPPQALNPAPVARSEKALLLQSLAASAPAPDKETPRSAHARSASGGHFTVPTAAGGRPCCRSTGHCARRGAAGACYALALWRTVPLACGGTGGVGKTTMAANLAWSLARAGSKVLAIDFDVQNALRLHFGVPLHDSRGFVARSEEHADWSQSILTTGSNIFVMPYGEVTEAQRERFEHNLAHDAHFLKRGLDTVLNYPGLVIIADFPPGPGPALKAMQELADMHLVVMLADTASVALLPQIENHRMIGQPLNNQHGHYFVLNQSDNRRNISREVTAFMQQRLGDNLLGVVHRDESVAEANASQQSIYDFSPASAAAFDIELVAKRVANILNINVGNGEVQAPIRSHY

SEQ ID NO: 216109 - protein, 46 aa, Glycine max
  Coding DNA Sequence Number=SeqID_99331
MTFTRSELPSGKNSYLSGILLESKCEVFSPSIVQQLVLEPMIQHGD

SEQ ID NO: 216110 - protein, 136 aa, Glycine max
  Coding DNA Sequence Number=SeqID_99332
  Homolog annotation: Hit_ID=Q00M75; Match level="QueryCoverage=21%, HitCoverage=4%, E-value=1e-08, Identity=96%"; Hit description=PPR -repeat containing protein
LGCAGSNVERMKRRRVVKRRRKHIEIVDWALERRALLELELILLKECGEGEEEILVAMIGVGVLFSSGKKTHGCPCMREGCCIPLPRGSSLCEGMGEGCCTQPYPCICKEAVSGFEPMTNKSPRHNFTAASGLARN

SEQ ID NO: 216111 - protein, 1207 aa, Glycine max
  Coding DNA Sequence Number=SeqID_99333
  Gene Ontology: Mol. function=binding; Cellular component=outer membrane; Biological process=cellulose biosynthetic process
  Homolog annotation: Hit_ID=UPI00005F8267; Match level="QueryCoverage =98%, HitCoverage=92%, E-value=0.0, Identity=46%"; Hit description =COG0457: FOG: TPR repeat
  Pfam annotation: Domain name=BCSC_C; Domain location=913-1205; Score =187.8; E_value=2.6e-53; Accession=PF05420.2; Description=Cellulose synthase operon protein C C-terminus (BCSC_C)
  Pfam annotation: Domain name=TPR_1; Domain location=299-332; Score =20.6; E_value=0.0055; Accession=PF00515.18; Description =Tetratricopeptide repeat
  Pfam annotation: Domain name=TPR_1; Domain location=36-69; Score=3.9; E_value=1.9; Accession=PF00515.18; Description=Tetratricopeptide repeat
  Pfam annotation: Domain name=TPR_1; Domain location=380-413; Score =5.6; E_value=1.1; Accession=PF00515.18; Description=Tetratricopeptide repeat
  Pfam annotation: Domain name=TPR_2; Domain location=265-298; Score =10.1; E_value=2.2; Accession=PF07719.7; Description=Tetratricopeptide repeat
  Pfam annotation: Domain name=TPR_2; Domain location=299-332; Score =23.6; E_value=0.0007; Accession=PF07719.7; Description =Tetratricopeptide repeat
  Pfam annotation: Domain name=TPR_2; Domain location=36-69; Score=9.1; E_value=2.9; Accession=PF07719.7; Description=Tetratricopeptide repeat
  Pfam annotation: Domain name=TPR_2; Domain location=380-413; Score =10.7; E_value=1.9; Accession=PF07719.7; Description=Tetratricopeptide repeat
  Pfam annotation: Domain name=TPR_2; Domain location=455-488; Score =11.1; E_value=1.7; Accession=PF07719.7; Description=Tetratricopeptide repeat
  Pfam annotation: Domain name=TPR_2; Domain location=677-710; Score =3.4; E_value=13; Accession=PF07719.7; Description=Tetratricopeptide repeat
  Pfam annotation: Domain name=TPR_2; Domain location=70-103; Score =1.8; E_value=20; Accession=PF07719.7; Description=Tetratricopeptide repeat
  Pfam annotation: Domain name=TPR_2; Domain location=777-810; Score =3.0; E_value=15; Accession=PF07719.7; Description=Tetratricopeptide repeat
  Pfam annotation: Domain name=TPR_4; Domain location=119-144; Score =19.5; E_value=0.012; Accession=PF07721.5; Description=Tetratricopepti de repeat
  Pfam annotation: Domain name=TPR_4; Domain location=299-324; Score =7.9; E_value=4.3; Accession=PF07721.5; Description=Tetratricopeptide repeat
  Pfam annotation: Domain name=TPR_4; Domain location=343-370; Score =9.8; E_value=2.5; Accession=PF07721.5; Description=Tetratricopeptide repeat
  Pfam annotation: Domain name=TPR_4; Domain location=380-405; Score =10.2; E_value=2.3; Accession=PF07721.5; Description=Tetratricopeptide repeat
  Pfam annotation: Domain name=TPR_4; Domain location=489-514; Score =9.9; E_value=2.5; Accession=PF07721.5; Description=Tetratricopeptide repeat
  Pfam annotation: Domain name=TPR_4; Domain location=70-95; Score=5.3; E_value=8.8; Accession=PF07721.5; Description=Tetratricopeptide repeat
  Pfam annotation: Domain name=TPR_4; Domain location=777-802; Score =7.8; E_value=4.4; Accession=PF07721.5; Description=Tetratricopeptide repeat
  Pfam module annotation: Pfam domain module=BCSC_C::TPR_1::TPR_1::TPR _1::TPR_2::TPR_2::TPR_2::TPR_2::TPR_2::TPR_2::TPR_2::TPR_2::TPR _4::TPR_4::TPR_4::TPR_4::TPR_4::TPR_4::TPR_4; Domain location=913 -1205::299-332::36-69::...
  Pfam module annotation: Domain location=380-413::265-298::299-332::36- 69::380-413::455-488::677-710::70-103::777-810::119-144::299-324::343- 370::380-405::489-514::70-95::777-802
MKKQLISAGIRQAFLLGGALTFSQPLLAAESTNPALQALFDQAAYWHQKAHDDLAKASLQKILMVEPNNTQALYLLALYSQQSGSAADAAQWRARLSAVSPNDPHLTELDNARQLQSIPQAQLSLARQQARSGNIAAALQTWRNTFSGNEPPPSVAAEYYLTMAGDRTLLPQAVEALRQFAADHPQDTGAQLALGKALTYQEATRRQGIDVLASMADGNKEADRSLRQALLWLAPQASDAALYQTWQQRHPQDSAVVDYYRKNVGGAEKGAGFSALNSGDVSGAQNNFEKVLQANPLDADALAGMGYVAQRAGRYAEAADYLTRAAQLGGDQSQQRQQQAADARFYAQLANAQQALKNGDSAQALALSEPLTQAEGEKGISAKLFRADVLRRSNQLQQAEQTYRAILQSDVDNRSAKEGLFYVLRQQNRSAEANTLLASLPDSVRQSVAPRGNSSDPLRAQAKRELAAGNRSAAIATLNSAIQRYPSDGWLRLDLARIYRAQGDNLLAANVMQPTLRSVASTSELYAGALNASESGAWQQASQLLARIPNGSKNSEMRELAQRVNFNLQMATADRYLAQGSDAAAANTLRALAATPPANPVDAGNLAQKLAKAGDLTTAVTVVRGNMQRGVQGNAGDYAAQVAVLNQAGLTTEAQSFLSSPELQARSTPTQLAGIRNGYLINEVDRLREQKQYAAAYDKLVGALQHDPQNRDLMFAMARLYQSGKMNKEAGVVYDYLLTQDTPTQDARTGAIDVALAQNDIDKANTLTRGLRNEQTPDRLLLLARVAEANGEHSQAMSYLRSARGQLIGLQGAQSGSVPTVGGLALADNPFINRSTSPVSGSPSSYGTVMPWQTAPATSSSAQDVTLASTTPEVRQSQTLRQIDEMMDNLQEKTGTWVQGQMQVRGRDGESGLSKLTEAKAPLTFSTVPFGESRFDFTMTPVSLTAGSAAGDAWRRFGSNALVQGNVVASGAAKIDDTPSSSTDSQKATGVELNMALKGDSYKIDLGSTPLGQDLSTLVGGVQWSPKLTDFLTLILTGERRAMTDSLLSYVGVEDKTSGKRWGRVTKNGGNAMLSFDNGDAGFYVGGGAYSYLGENVASNNSVQATAGAYVRPFHYDDRELKVGMSLSWMDFSKNLSYFSYGQGGYFSPQNYAAVSFPVDFSRKFDDLKVNVGGSVGYQSYSQDKSAYFPNDPSLQSQLQSLADQGF

SEQ ID NO: 216112 - protein, 169 aa, Glycine max
  Coding DNA Sequence Number=SeqID_99334
  Homolog annotation: Hit_ID=UPI00005EF164; Match level="QueryCoverage =52%, HitCoverage=91%, E-value=2e-27, Identity=70%"; Hit description =COG2929: Uncharacterized protein conserved in bacteria
  Pfam annotation: Domain name=DUF497; Domain location=6-97; Score =59.2; E_value=1.3e-14; Accession=PF04365.3; Description=Protein of unknown function (DUF497)
MQTEPEFEWDTTKAETNFRKHGIRFEVAARVFEDPFHLSVQDRYENGEYRWQTIGNVMGHVVILVAHTVRFETDVERIRIISARHATRIERRRYEQSQDSDIQCDDIAPLDDSFWQAAERGRFYRPVKTQASIRIDADILEWLKAPGKGYQTRLNAILRAAMLRELQGK

SEQ ID NO: 216113 - protein, 932 aa, Glycine max
  Coding DNA Sequence Number=SeqID_99335
  Homolog annotation: Hit_ID=UPI00005FA947; Match level="QueryCoverage =45%, HitCoverage=78%, E-value=1e-157, Identity=62%"; Hit description= COG0050: GTPases - translation elongation factors
  Pfam annotation: Domain name=EAL; Domain location=840-931; Score= -100.0; E_value=0.00052; Accession=PF00563.11; Description=EAL domain
  Pfam annotation: Domain name=GGDEF; Domain location=666-826; Score =22.4; E_value=1e-08; Accession=PF00990.12; Description=GGDEF domain
  Pfam module annotation: Pfam domain module=EAL::GGDEF; Domain location=840-931::666-826
MIGAAFVLLVIYLFVAQWIRVTVLVSLALIWLNVLTLAGPAVSLLPSKAAAPPVALNDKPAASPAAAGLDQSAPPTSSNLTAWLNRFYDSERQRVTHFPDALPADSQPFDILVINICSLAWSDIDVAQLRDHPLWKHFDIVLNNYNSATGYSGPAGIRLLRASCGQTSHSNLYKATDQRCYLFDNLAKLGFKQQLMMDHTGVFGNYLKELREDGNMQAPLMSQAGIAPELTSFDGSPVYNDGQLMQRWLDDRSKSSDARSATFYNLIPLHDGTRELGSTRTAEWQPRARVLFDQLDTFLTNLEKSGRRVMVLVVPEHGAALQGDKMQMSGLRDIPSPGITHVPVGIKFVGMKAPHQGQPLTIDTPVSLLAISELVSRVVDGQVFNAPNVNMSVLADNLPQTPVVSENDNAVVMMYQGKPWIRLNGGDWADKMLKPRAKRGSCVIFAFIPAQKNADLGYTCCAFRQLSRPPAARRGFVARQSFVNDKADGHRVRRGAGHHLVDYAQQMENVAHTVRQPLSEAVLKADIPQAERILNTLKPAGILSRADVVLPNAFQALHADFAPEKPVPRFVARLFELPVQITLPLYSVERSGLPKPIAYLHAVHHDHHLSAAGADSVRGDQLELPPPAILTHKLALPHNHRDDEIGMLIRSYNRNQQVLESIHDEMSRLTTHFAVTDLPNRALFLALLDQHIRHRHSQQPWGLMVIRIETLQEANGVLSDEQRDTLMLTLVEKIRSTIDDHTLLAQTGPSDFALLMKRAHNPFRAMRLARNLMLRINQPVNLYQLQLRPNASIGLALHDDNTVSAGEQLARATSAMMSARHQGKNQILFFDPALTERAQKRLTQEHDILQGLQDGQFALYLQPQINMATGDLAGAEALLRMRMPDGSYGLSEEFIASAEEIGVISALGRWVFEEACRIIAGWQRHGINLPLS

SEQ ID NO: 216114 - protein, 1052 aa, Glycine max
  Coding DNA Sequence Number=SeqID_99336
  Homolog annotation: Hit_ID=Q8ZA28; Match level="QueryCoverage=39%, HitCoverage=96%, E-value=0.0, Identity=83%"; Hit description=C4 -dicarboxylate transport protein
  Pfam annotation: Domain name=EAL; Domain location=1-96; Score=-113.1; E_value=0.0038; Accession=PF00563.11; Description=EAL domain
  Pfam annotation: Domain name=Peptidase_M16_C; Domain location=747 -926; Score=63.4; E_value=7.3e-16; Accession=PF05193.11; Description =Peptidase M16 inactive domain
  Pfam annotation: Domain name=SDF; Domain location=140-532; Score =696.4; E_value=2.1e-206; Accession=PF00375.9; Description =Sodium:dicarboxylate symporter family
  Pfam module annotation: Pfam domain module=EAL::Peptidase_M16_C::SDF; Domain location=1-96::747-926::140-532
GLLEPHRIAPGNFVLEITETAQIGDAEQAMALLRSLQQTGFVAALPDDDTMVRIVAAIADIIHLDVIAEGVETAEQRDWLLARGITIGQGYLYAEALPIAPLWGAEAFQFIAACRMRFSITMAVNAVYTWTPVMKLFKSLYFQVLVAIGIGVLLGHYYPELGAQMKPLGDGFVKLIKMIIAPVIFCTVVTGIAGMESMKAVGRTGAVALLYFEIVSTIALIIGLVVVNVIQPGAGMNVDPATLDAKAVAVYAQQAEQQGVIAFLLDVIPNSVVGAFASGNILQVLLFAILFGFALHRLGNAGTVMFNVIESFSKVIFGVINMIMRLAPIGAFGAMAFTIGKYGVGSLVQLGQLIICFYITCVLFVVIVLGIIARWAGFNIFKFVAYIKEELLIVLGTSSSESALPRMLDKMEKLGCKKSVVGLVIPTGYSFNLDGTSIYLTMAAVFIAQATNAHMDVFHQITLLVVLLLSSKGAAGVTGSGFIVLAATLSAVGHLPVAGLALILGIDRFMSEARALTNLVGNGVATVVVAKWVGQLDEAQMKATLSSAKKGTRIRLLVGGWLLAASGFGVHAETLQPDPAWQEGKLDNGFSWQLLTTPQRPSDRIELRLIVNTGSLVESAQQTGFSHLLPRLAMVHNTALDTNQQRALWQQAMDPQRPLPPAISSYDFTQYNLSLPNNRPELLKEALSWLAATAGKMTINEQVVSTALTATDPIATWPPNTQDVWWRYRLKGSTMLAHDPGEQPRAPVDIAQLNAFYQQWYTPDGMTLYVVGNVDSRSMAEQINKAFSPLQGKRVAPAALPTLSPLPHQPINLVNGGMIQDRLSLVWDTPWQPIRDSQNLQRYWQSDLAREALFWHVQRALADSKAQNVQVGFDCRVLYQRAQCAINMDSPNASLAQNLNQVARELATVRDKGLPQEEFDALMAQKLLELNKLFATYARTDTDILMGQRLRSQQNSVVDIAPEQYQKLRQAFLSELTRDQLNQELRQQLTQELTMVLIQPQGEPETNVRMLQDSWDKVMKVPDAPAAAATPDEAKPENNGSASATDPAQPSS

SEQ ID NO: 216115 - protein, 567 aa, Glycine max
  Coding DNA Sequence Number=SeqID_99337
  Gene Ontology: Mol. function=2-dehydro-3-deoxygluconokinase activity; Cellular component=cytoplasm; Biological process=D-ribose metabolic process
  Homolog annotation: Hit_ID=P37647; Match level="QueryCoverage=51%, HitCoverage=93%, E-value=1e-109, Identity=67%"; Hit description=2 -dehydro-3-deoxygluconokinase
  Pfam annotation: Domain name=Abhydrolase_3; Domain location=338-544; Score=-23.0; E_value=3.4e-06; Accession=PF07859.3; Description =alphabeta hydrolase fold
  Pfam annotation: Domain name=Peptidase_S9; Domain location=353-566; Score=-29.6; E_value=1.8e-05; Accession=PF00326.11; Description =Prolyl oligopeptidase family
  Pfam annotation: Domain name=PfkB; Domain location=3-308; Score =242.8; E_value=7.4e-70; Accession=PF00294.14; Description=pfkB family carbohydrate kinase
  Pfam module annotation: Pfam domain module=Abhydrolase_3::Peptidase _S9::PfkB; Domain location=338-544::353-566::3-308
MTQKTIAIIGECMIELSEKGENIKRGFGGDTLNTAVYLARQSDSSQLRVEYVTALGTDSFSDQMIAAWQQEQVHTQLVQRLPDKMPGLYFIETDAHGERTFWYWRSDAAARFWLDSPQAGAICQQLAHYDYLYLSGISLAILPEASREKLMALLSACRQNGGTVIFDNNYRPRLWADSASAQQAYAAMLRHTDIAFLTLDDEHLLWGEQPLADVIARTRAAGVQEIVIKRGADSCLVARGDDPLRDVAAIKLAPAQIVDTTAAGDSFSAGYLAVRLAGGSVEQAATRGHLTASASDSRAQPQIVDLAREFEPYDRAATGVRCPEMAIWHPETSNGITLLVAPGGGYQRVLIDREGSALATFFTSMGYTLAVMTYRLPYDGHHEGPDAPLADAQRAVRVLRERSQRGLNGKYIVMMGFSAGGHVAASLGTRFGEKIYPLQDQADSLSPRPDAMVLLYPVISMRDGLAHESSRTRLLGAWPDQKSIEAYSLETRVHGQTPPTLLIHAADDETVSVNNSMVFFSALREHKVPAEIHFYQKGGHGFGIRGVADLPLASWPMLVTEWLRAKT

SEQ ID NO: 216116 - protein, 162 aa, Glycine max
  Coding DNA Sequence Number=SeqID_99338
  Homolog annotation: Hit_ID=Q1R578; Match level="QueryCoverage=92%, HitCoverage=58%, E-value=4e-35, Identity=48%"; Hit description =Hypothetical protein yhjH
  Pfam annotation: Domain name=EAL; Domain location=17-159; Score= -129.5; E_value=0.045; Accession=PF00563.11; Description=EAL domain
MVMKNLSHRLPFSPELEQQQETRLYWQQCQRCYTFQPIYQVSGRLLAIELLTAVVHPAAPEQNVSPEDYFEALTIAQRLDIVQEQLELLLQWASFFSQRQLVASVNIDGPTLLAIQQHAPVRALIVQLPWVRFELTEHHALPQEEMVAQMPDWARYGWMTLG

SEQ ID NO: 216117 - protein, 127 aa, Glycine max
  Coding DNA Sequence Number=SeqID_99339
MLDKYGAVGPAKPTDKLDHDVDDPLYLKPAKPTVFGVYNDNFPLYIKHEDLSEIAHGGQCLNISVIQLWILRMTETSMRAGNADVYGFLELQSIQKSGQSQFESESYIKNWMQNSRRDVYLGAYLNE

SEQ ID NO: 216118 - protein, 79 aa, Glycine max
  Coding DNA Sequence Number=SeqID_99340
MQSQGLALPSEPEVGPSTARGSTTIHNIPLLLDQVKVGDEEIRDADAPVPMPTEEVKLVEQTHNTFFAWPRHLVKRLSG

SEQ ID NO: 216119 - protein, 95 aa, Glycine max
  Coding DNA Sequence Number=SeqID_99341
MEVTYDGDHREIIKLLATLELKVEECIQKVKISKTGGAASGNKKAGCERNALLNTFWEWKFRWEKQIVVCNSGNLMLVAGSLQVEICNSGLQLPA

SEQ ID NO: 216120 - protein, 139 aa, Glycine max
  Coding DNA Sequence Number=SeqID_99342
MLALQLGWILAFSIYMFMPENATTYGGNLEFGCLERNLSVRIMSPSCFVTMLPRLYCRSTLPLTCEGVRILFAKGRLLLYGMEDDCPLSLKCYGASTLVMSWLSKEGCVPLVLRMLRRKHLSHESTSKEREIDDNVLYF

SEQ ID NO: 216121 - protein, 48 aa, Glycine max
  Coding DNA Sequence Number=SeqID_99343
MGNNFHCAEHPQVLRKVPCKGIEGIVVGLAPDAEDDEAVVGEEEGVGE

SEQ ID NO: 216122 - protein, 95 aa, Glycine max
  Coding DNA Sequence Number=SeqID_99344
  Gene Ontology: Mol. function=DNA binding; Biological process=DNA integration
MTFINQSKYYKELLKIFGMDIGKEIATPTSTACYLDKDEGGKSVDIKKYRGLWYPKGTSYSLIWHPNYNSDFAGCKIDRKITSGTCHWIGSTLVS

SEQ ID NO: 216123 - protein, 91 aa, Glycine max
  Coding DNA Sequence Number=SeqID_99345
MTRLQPYFKEEKLRNATTSDQVTEEVVLEVVKVSEEEFHKIEVDARIQLVLETSVEIFSVVYVERDIKLQRTIVQEKINEEEMEALVAAIL

SEQ ID NO: 216124 - protein, 222 aa, Glycine max
  Coding DNA Sequence Number=SeqID_99346
  Gene Ontology: Mol. function=helicase activity; Cellular component =nucleus; Biological process=metabolic process
  Homolog annotation: Hit_ID=Q1RTU9; Match level="QueryCoverage=100%, HitCoverage=21%, E-value=9e-88, Identity=72%"; Hit description =DEAD/DEAH box helicase, N-terminal
  Pfam annotation: Domain name=DUF1726; Domain location=106-200; Score =193.1; E_value=6.6e-55; Accession=PF08351.1; Description=Domain of unknown function (DUF1726)
MRKRIDERIRTLIENGVKTRHRSMFVIIGDKSLDQIVNLHYMLSKAQMKSKPTMLWCYNHKLQLSSKKEKRHRQIQKLRLRGLLDHEKVDAFSLFMETKDITYCLYKDSEKILGNTFGMCILQDFETLTPNLLARTIETVEGGGLIVLLLGSLSSLTSLYTMVMDVHKRFRTESHSEAAGRFNERFLLSIASCKACLVMDDEMNILPISSHIRSITPVLVNE

SEQ ID NO: 216125 - protein, 803 aa, Glycine max
  Coding DNA Sequence Number=SeqID_99347
  Gene Ontology: Mol. function=helicase activity; Cellular component =nucleus; Biological process=metabolic process
  Homolog annotation: Hit_ID=Q1RTU9; Match level="QueryCoverage=99%, HitCoverage=78%, E-value=0.0, Identity=70%"; Hit description =DEAD/DEAH box helicase, N-terminal
  Pfam annotation: Domain name=DUF699; Domain location=56-234; Score =284.6; E_value=1.8e-82; Accession=PF05127.4; Description=Putative ATPase (DUF699)
DAEGLSKAKQGLKKLKEQLSENYLVGLIRKCCTLDQGHAVVTFLDAILSKTLRGTVALLAGRGCGKSAALGLSIAGAIAAGYSNIFVTAPSPDNLKTLFEFILKGFEALDYKEHINVVKSGKNTYILPHEHEKLSLAELLVVDEAAAIPLSMVKSLLGPYLVFLSSTVNGYEGTGHSLTLKLLHQLEAQSNTFSKSTEGTDSGYLFKKIELSESIRYASGDPIESWLNKLLCLDVSNAIPNLSSRFLPPCSECDLYYVNRDTLFSYHRDSELFLQRMMALYVASDYKNSPNDIQLMADAPAHHLFVLLGPVDESKNQLPDILCVIQVSLEGQISRQSVKQSLSNGHIPSGDQIPWKFCEQYQDTVFPSLSGARIVRIATHPDDMKHGYGSQAVELLIRYYEGRLTPISGIDVDDEVQTSQIRVTEAAEKVSLLEENIKPRKELPHLLVHLRERRPEKLHYIGVSFGLTLDLFRFWRKLKFAPFYISQIPNTVTGEHSIMVLKPLNNDEIKVDGSNQWGFVSPFYQDFRQRFFRLLASNFRGMEFKLAMSILDPKINFEEQDPSKTASHKFMGSVREYLSPHDMKRLKAYVSNFADFNLHLILDLVPILARLYFEEKLPVKLSYVQASVLLCIGLQNHNILYIEGQMKLERQQLLSEFRRIMKLFYNYLNGLASKEIESTLPRMKEIVMEPHSVSVDDDLNNAAKQVEDGMKLKAEAPVTPELLQRYAIVEGESDLETVLQNNRGKIPIGGLISVKSSSKPEMMKRSRKNDKKRTRFFWSHNHFFWWNCSYNHKLSKRRRTIQD

SEQ ID NO: 216126 - protein, 62 aa, Glycine max
  Coding DNA Sequence Number=SeqID_99348
MYRLPATKLLKFKFKTLFNSYFSTFPFEANISRLENIYGVDRGLSKKEEFGLGGLNIDGPIT

SEQ ID NO: 216127 - protein, 91 aa, Glycine max
  Coding DNA Sequence Number=SeqID_99349
MKTQQLGCCPQDLNLKPNLNEWLFQTKMSDSILVSEDTDYLRAPLELVGLGSSSSMDSFASWKMNDSGMEKEEREETPLQGKDESRRSSPP

SEQ ID NO: 216128 - protein, 495 aa, Glycine max
  Coding DNA Sequence Number=SeqID_99350
  Gene Ontology: Mol. function=inorganic anion exchanger activity; Cellular component=integral to membrane; Biological process=anion transport
  Homolog annotation: Hit_ID=Q9XI23; Match level="QueryCoverage=98%, HitCoverage=71%, E-value=1e-175, Identity=63%"; Hit description =Boron transporter-like protein 2
  Pfam annotation: Domain name=HCO3_cotransp; Domain location=1-371; Score=-328.6; E_value=0.00056; Accession=PF00955.11; Description =HCO3- transporter family
MVGEFSVPEEGDPTLEKYKFHWLYANGLLGIIFTFGLLYTSLKSRRARSWLYGTGWFRSFIADYGVPFMVVVWTALSFTVPRKVPSGVPRRLTSPLAWESTSLHHWTVIKNMGEVSPAYVFAAFIPALMIAGLYFFDHSVASQMAQQKEFNLRKPSAYHYDILLLALTTLLCGLIGLPPSNGVLPQSPMHSKSLAVLKKQLIRRKMVKSAKESIRQKASKSEIYGKMQAVFMEMDNCPDNHSVVKELEDLKDVVLNGEDKGLNNKSTFDPEKNIDAYLPVRVKEQRVSNLLQSLLVGASVFAMPAIKKIPTSVLWGYFAYMAIDSLPGNQFWERILFLFVTPNRWYKLLEGDHASFIESVPYKYIVFFTLFQCIYFLVCFGVTWIPIAGILFPLPFFLLITLRQHILPKLFKPHHLRELDAAEYEEIVGAPALSFNKSFREVESPRVGSKEIGNAEILDELTTNRGELKVRTVSFGEERNDQVYPDENGSPLTDF

SEQ ID NO: 216129 - protein, 76 aa, Glycine max
  Coding DNA Sequence Number=SeqID_99351
  Gene Ontology: Mol. function=inorganic anion exchanger activity; Cellular component=integral to membrane; Biological process=anion transport
  Homolog annotation: Hit_ID=Q9XI23; Match level="QueryCoverage=88%, HitCoverage=9%, E-value=4e-19, Identity=67%"; Hit description=Boron transporter-like protein 2
MESLKKPFKGVINDLRGRAGYYKDDWTSGFYSGTGILAPTTYIFFASSLPVIAFGEQLSRDTAQAFCTCGIFPTEM

SEQ ID NO: 216130 - protein, 91 aa, Glycine max
  Coding DNA Sequence Number=SeqID_99352
MEGIQDRAFEELWKLKVPIKFAVFAWRLLRDRLPTKKHGRGNRTLVFSLHENHPYLVGNVIMGEHHWSFSERSKAALPPTWYDNGGWDKID

SEQ ID NO: 216131 - protein, 56 aa, Glycine max
  Coding DNA Sequence Number=SeqID_99353
MGSSQAPGLKKRFYQVKIKSLGVASLKKCFTIGDFQLTPTAEEFEEILGCPLGGRK

SEQ ID NO: 216132 - protein, 110 aa, Glycine max
  Coding DNA Sequence Number=SeqID_99354
  Homolog annotation: Hit_ID=Q9FKI1; Match level="QueryCoverage=88%, HitCoverage=12%, E-value=3e-24, Identity=56%"; Hit description =Similarity to zinc metalloproteinase
MAEPDPNDVVSTPILSTLQTDEPDPDDQEFQRINDTTTAVCNRLSEALEMLRSEVSAMQATSILQTLLKIIRNVIEHPEVEKYKRLRKANPVIERNIVNNKGLHLLTIGF

SEQ ID NO: 216133 - protein, 63 aa, Glycine max
  Coding DNA Sequence Number=SeqID_99355
  Homolog annotation: Hit_ID=Q6ZK12; Match level="QueryCoverage=54%, HitCoverage=5%, E-value=7e-07, Identity=71%"; Hit description=Zinc metalloproteinase-like
MGHCHTKNCYPLNQFSLLCFYQSEDVMFDNLGKENAYLVLKRNDPGLLWLAKATLESSTSLTC

SEQ ID NO: 216134 - protein, 93 aa, Glycine max
  Coding DNA Sequence Number=SeqID_99356
EDSWSLVSTHLLKELEKFSYEYMKLFGGKERFEELRMSLLVDGLTKVTTDKWMDITDMGYVISSRYNVYLKDRCPLPPAALLWSTNCHPQVKQ

SEQ ID NO: 216135 - protein, 322 aa, Glycine max
  Coding DNA Sequence Number=SeqID_99357
  Gene Ontology: Mol. function=oxidoreductase activity, acting on CH-OH group of donors; Cellular component=membrane; Biological process =alcohol metabolic process
  Homolog annotation: Hit_ID=Q0MFW2; Match level="QueryCoverage=98%, HitCoverage=57%, E-value=4e-86, Identity=51%"; Hit description =Glucose-methanol-choline (GMC) oxidoreductase family protein
  Pfam annotation: Domain name=DAO; Domain location=5-322; Score=-57.1; E_value=0.037; Accession=PF01266.14; Description=FAD dependent oxidoreductase
  Pfam annotation: Domain name=GMC_oxred_N; Domain location=4-311; Score=277.9; E_value=2e-80; Accession=PF00732.10; Description=GMC oxidoreductase
  Pfam module annotation: Pfam domain module=DAO::GMC_oxred_N; Domain location=5-322::4-311
MKEYDYIVVGGGSAGCIVAARLVSEGNARVLLLEAGRDEYHPVLKMPAGYMKFLASDRFLTMHQTEAQPQLNGRGVIVPQAKVLGGGSTVNAMVYMRGHKQDYADWNQALGHQGIDWSWEALLPHFTAIEDNDHLGAPNHGVGGPMKVSHLGHFSPLSRAYVKTLQGLGIPYTPDFNSGNPSGVGFMQHTIDGQTRQRCSVVDAFINPLRHDARLTLVTGAQVEEVLFDGTCASGVRYRQDGQPQQARASREVILAAGAYQTPKLLMLSGIGPQEQLKQHGITVRHALPGLGKNLQDHYEVPVVASTRGAFGYYGQDRGWPM

SEQ ID NO: 216136 - protein, 99 aa, Glycine max
  Coding DNA Sequence Number=SeqID_99358
MVHDILVKVKLEVTGTSTILNVFGSRRSSDVYDPNMRKMQGSCMSKHENKRYAKSMCSMCAVKKVIWTFQLPVKKDETNIQRMRDDMMQMRKSGTGGCT

SEQ ID NO: 216137 - protein, 66 aa, Glycine max
  Coding DNA Sequence Number=SeqID_99359
MEQLLVLMDDGYVPWETFKGVFLSKYLPTDLCKQKHKVFLDLKQRGMFVGEYTTKFNELLKYWPQY

SEQ ID NO: 216138 - protein, 649 aa, Glycine max
  Coding DNA Sequence Number=SeqID_99360
  Homolog annotation: Hit_ID=UPI00005F956B; Match level="QueryCoverage =37%, HitCoverage=97%, E-value=2e-98, Identity=72%"; Hit description =COG0584: Glycerophosphoryl diester phosphodiesterase
  Pfam annotation: Domain name=GDPD; Domain location=146-373; Score =206.5; E_value=6.3e-59; Accession=PF03009.8; Description =Glycerophosphoryl diester phosphodiesterase family
  Pfam annotation: Domain name=G_glu_transpept; Domain location=489 -648; Score=-209.7; E_value=1.3e-06; Accession=PF01019.11; Description=Gamma-glutamyltranspeptidase
  Pfam annotation: Domain name=TOBE_2; Domain location=67-122; Score =5.6; E_value=0.05; Accession=PF08402.1; Description=TOBE domain
  Pfam module annotation: Pfam domain module=GDPD::G_glu_transpept::TOBE _2; Domain location=146-373::489-648::67-122
VVEQVGTPVEVYERPASQFVASFIGAPAMNLLPGQINSDGSRFTLDALNSLPLGAGKARWANRPLTLGIRPEHIQLSSREAGGVPLVVDTLEILGADNLAHGHIGNTRLVPVATTAARCVTLLRFYPWKASGMSVKNWPYPHIVAHRGGGKLAPENTLAAIDVGAHYGHTMIEFDAKLSQDKQIFLLHDDTLDRTSNGWGVAGDLPWQQLAQLDAGSWFSREFDGEPLALLSEVAARCRQHQMMANIEIKPSSGTEVETGRDVALAARTLWQGQTAPLMSSFSYAALEAAMQAAPELPRGLLLDEWHDDWQALTAALDCVSIHLNHRLLDARRTAALKAAGLRILVYTVNQPARARELLSWGVDAICTDRIDAIGPDFPCAASPDFAAADPDATAAAVAAAGPACASACAAGSGYSRHVRHAAQRHQCRDNNQPFFHGVPPSVRPADEDKERCAPVRLGAVNEFYRGAGGAGGAGQRPAVDAMATRVGVDILKQGGNAVDAAIAVGFALAVTHPQAGNLGGGGFMLLRTAAGRTTAIDFREMAPARASRDMFLDKQGNADSKLSLTSHLASGTPGTVAGFALAAQKYGTLPLSTLLAPAIKLARDGIIVNDALADDLATYGKENLINHDNSRAIFYKADGQPYQKGDRL

SEQ ID NO: 216139 - protein, 155 aa, Glycine max
  Coding DNA Sequence Number=SeqID_99361
EPVETQRLTSSSAPLSSRDGESDDIREYLVVIRTFCQPEASEPVDTQRLTSESDDMRGYLVVIRTFCQLEASEPIDMQRLTSPSAPLSSRDGESDDMWGGANSNKAHLGLLEGSKRRQCLLVEATQLAWASRAATTSLFSPINRGRRAEQMVQPF

SEQ ID NO: 216140 - protein, 398 aa, Glycine max
  Coding DNA Sequence Number=SeqID_99362
  Gene Ontology: Mol. function=acyltransferase activity; Cellular component=glyoxysome; Biological process=tricarboxylic acid cycle
  Homolog annotation: Hit_ID=Q6D010; Match level="QueryCoverage=86%, HitCoverage=64%, E-value=1e-147, Identity=71%"; Hit description =Malate synthase A
GAETIDIAFARVTVEQCPQLSRAAIRQRAGGIDGAAQVNDLFGTVRTAVSPESGQQAVARQGEERNQLFVGGDLRHQRSRIFIATGVKARVTQAVAQGRQLFIKKLFEQRGGHQLTIAEDLLVVNPLPDGGAGNLRGSGILHQPINRHAAIAADPRFQILQRNADVGAHPGFGALTTARAQQALGGDRRILFTTDVQLIGAIAQLTVKLRHGDIRQAGMGDPGTVMAVARFPCFVLLHFLHHPGVAFSVFGRDERRHAAHRQRTAPVAGFDQQARISLEERLVHADLLTIRQNAVTMLAQRFDVAEDVIPATTVEANHVIAQFPQDLIHLEYRGQRLDQYRGFDSAARQIETIFTETEDFPPPCHFRRMLGFRQIEPRSVALLQQRGDVVKQIERKVE

SEQ ID NO: 216141 - protein, 67 aa, Glycine max
  Coding DNA Sequence Number=SeqID_99363
MVQWWFGRAYLMKVVVWTNKYGEWEVGGGPGVVLESRSGEEEASGAAVVVWVSKSDEQEAGGGVVVV

SEQ ID NO: 216142 - protein, 61 aa, Glycine max
  Coding DNA Sequence Number=SeqID_99364
MKIECWECEMSLKFGVELKDTTLSKLITTGREEVGCSTFLCRVVIALVVVGKEEKIVEEKE

SEQ ID NO: 216143 - protein, 77 aa, Glycine max
  Coding DNA Sequence Number=SeqID_99365
MTEGCGEGFCLANLPGDAFSLWGNFFEAKKQMMADAKVGGAGLWPRAKFRIGWPPPSPPENSFVARILANFGLRPVG

SEQ ID NO: 216144 - protein, 104 aa, Glycine max
  Coding DNA Sequence Number=SeqID_99366
MNRMKTVQVEVFNPFSVSLTFGNSIGAVGRITEGISGNRVGPESKGKGFDGLFGAFSQNSVTLTGHPMILLSENDLTYPFCGVSCYVLLCAPRWFFTDMVPHCI

SEQ ID NO: 216145 - protein, 177 aa, Glycine max
  Coding DNA Sequence Number=SeqID_99367
  Gene Ontology: Mol. function=N-acetyltransferase activity; Biological process=metabolic process
  Homolog annotation: Hit_ID=Q5PJM6; Match level="QueryCoverage=70%, HitCoverage=96%, E-value=1e-25, Identity=47%"; Hit description =Hypothetical protein yhhK
  Pfam annotation: Domain name=Acetyltransf_1; Domain location=73-151; Score=21.5; E_value=0.0029; Accession=PF00583.14; Description =Acetyltransferase (GNAT) family
MAGFSPPGQRVMLVFSAIDAGLLHNPGKVRVMKLTIQRISTLTPQDRLDLAKVWPQQDIAQLEASLSEAQRLYAARFNDRLLGALRLEIRGTLGKITQLEVREVTRRRGVGQYLLEETIAQNSALDHWWVADDGEDDQRVRAAFMQACGFRAQSDGAVRMDARPTGIANERTDCVGS

SEQ ID NO: 216146 - protein, 199 aa, Glycine max
  Coding DNA Sequence Number=SeqID_99368
  Gene Ontology: Mol. function=methyltransferase activity; Biological process=methylation
  Homolog annotation: Hit_ID=Q8ZLE8; Match level="QueryCoverage=97%, HitCoverage=97%, E-value=2e-71, Identity=69%"; Hit description =Putative methyltransferase
  Pfam annotation: Domain name=Cons_hypoth95; Domain location=14-190; Score=299.7; E_value=5.3e-87; Accession=PF03602.5; Description =Conserved hypothetical protein 95
MSKSPRNSGAAGQIRLIGGQWRGRKLPVPDSAGLRPTTDRVRETLFNWLAPDIQQARCLDCYAGSGALGLEALSRYAASATLLELERHVAQQLTQNLHTLRASNASVIQTNTLQWLSQPGEPFDVVFVDPPFRKGLLQETLTLLENNGWLAAHALIYVESEVEHGTPLAPANWDLYREKIAGQVAYRLYQRQQETDDVA

SEQ ID NO: 216147 - protein, 934 aa, Glycine max
  Coding DNA Sequence Number=SeqID_99369
  Homolog annotation: Hit_ID=Q8ZLE9; Match level="QueryCoverage=34%, HitCoverage=64%, E-value=1e-144, Identity=84%"; Hit description =GTPase domain of cell division membrane protein
  Pfam annotation: Domain name=ABC_tran; Domain location=517-680; Score= 180.9; E_value=3.2e-51; Accession=PF00005.17; Description=ABC transporter
  Pfam annotation: Domain name=SRP54; Domain location=297-498; Score =409.5; E_value=4.9e-120; Accession=PF00448.13; Description=SRP54 -type protein, GTPase domain
  Pfam annotation: Domain name=SRP54_N; Domain location=204-285; Score =68.7; E_value=1.9e-17; Accession=PF02881.9; Description=SRP54-type protein, helical bundle domain
  Pfam module annotation: Pfam domain module=ABC_tran::SRP54::SRP54_N; Domain location=517-680::297-498::204-285
MAKEKKRGFFSWLGFGKEEQQPAEEQAQQQPTDQPAPAAEESALASAEAQAAETVIVTEQVAEQQAESSVHADAETHPVAEAETAAESDANADDAETAVVSAIEEEVLPEDHPQPELMPVEEEPQAEELIIEAPVLSEAPQPEDADAPLSDEELEALALAETYAEDAAEELVATDTVSDLPLAAAPIVAQEQERPTKEGFFARLKRSLVKTRENLGSGFISLFRGKKIDDELFEELEEQLLIADVGVEATRRIITSLTQQASRKQLRDAEALYGLLKAEMAGILEKVDAPLDVAGKTPFVILMVGVNGVGKTTTIGKLARQYQAQGKSVMLAAGDPFRAAAVEQLQVWGQRNNIPVVAQHTGADCASVIFDAIQAAKSRHVDVLIADTAGRLQNKAHLMEELKKITRVMKKLDEEAPHEVMLTIDASTGQNAISQAKLFHEAVGLTGITLTKLDGTAKGGVIFSVADQFGIPIRYIGVGEGIEDLRPFKAADFIEALKAYLGGRQALQGVDFHLRPGEMAFLTGHSGAGKSTLLKLICGIERPSAGQIWFSGHDISRLRHSEVPFLRRQIGMIFQDHHLLMDRSVYDNVAIPLIISGASGEDIRRRVSAALDKVGLLDKAKSYPIQLSGGEQQRVGIARAVVNKPAVLLADEPTGNLDNALSEDILRLDVCTEATMVNKRNKRPAAPKAAKQPSKSKALKGGWQEQWRYAWRGTLSDMYRQPLATLLTVMVIAISLTLPSVCYMVWKNVSQAAAQWYPAPQLTVYLDKALDDTAAENVTAELKKLDGVDKVNYLTREEAQSEFRNWSGFGGAMDMLEQNPLPAVAIITPKLNFQNSDTMANLRDRVAKVQGVDEVRMDDSWFARLAALTGLVGQVASMIGLLMVVAVFLVIGNSVRLSIFARRDTINRCGAVADSVGSAGAAPAVGGGAVASVF

SEQ ID NO: 216148 - protein, 213 aa, Glycine max
  Coding DNA Sequence Number=SeqID_99370
  Homolog annotation: Hit_ID=Q6CZ04; Match level="QueryCoverage=53%, HitCoverage=95%, E-value=7e-21, Identity=38%"; Hit description =Putative exported protein
  Subcellular localization annotation: CTP_CleavageSite=39; ConfidenceScore=5.04e-01
MSKPPLIFFIVLAVIAILATRQFIKQRREAAVNDASPVRSMSVEVKTKREFPAPNRRSRQREEIVAEEMKYEAWFHPLNGAGDFKVNVSASDYHQMDKGVKGELKMQGTRFLKYTKEEDFRLRGAAQLWRFLRLRGTQQHQLQAVHHHHKEQRNVDKVAQRRREGMHQAIGHLTGNLLAIQVPVSRCQRGAVFHFALNINQRIGGEPAIVLQQ

SEQ ID NO: 216149 - protein, 138 aa, Glycine max
  Coding DNA Sequence Number=SeqID_99371
  Homolog annotation: Hit_ID=Q6CZ01; Match level="QueryCoverage=40%, HitCoverage=7%, E-value=8e-13, Identity=53%"; Hit description=Cation- transporting ATPase
SRRGNALFDSRSYIAVRLHQQIVTGEYHPRAGDLRQLLHGGFDFAGAARAVHAGNLPAELIGRGCAPVTVGVAAAGTVVIAGAAAAIAGRGHRLRGGNLQGCRLNAAYRAQRFWLTKRADARSLHATLWSGLQSQAVR

SEQ ID NO: 216150 - protein, 227 aa, Glycine max
  Coding DNA Sequence Number=SeqID_99372
  Gene Ontology: Mol. function=RNA-directed DNA polymerase activity; Biological process=RNA-dependent DNA replication
MDLIENMAASDIAILRDRAHIPTKKSLLELTSQDALLAQNKLLSKKLEALTETLRCTIYGGAHESGCCIPIEEQPTHEVNYMGNQPVNNFNAGGFSGFQHGQQYNQQQGQWRNHPGNQFNRDQGGPSTRLQQLGPSIYDHTTKLEETLAQFMQVSMSNQKSIEFAIKNLEVQVGQLAKQLADRSSSSFIANTEKNPMEECKAMMTRSKKAIHVDESEAEKKMEEHKK

SEQ ID NO: 216151 - protein, 417 aa, Glycine max
  Coding DNA Sequence Number=SeqID_99373
  Gene Ontology: Mol. function=protein serine/threonine kinase activity; Cellular component=membrane; Biological process=protein amino acid phosphorylation
  Homolog annotation: Hit_ID=Q10KZ7; Match level="QueryCoverage=95%, HitCoverage=96%, E-value=1e-126, Identity=55%"; Hit description =Protein kinase APK1A, chloroplast, putative, expressed
  Pfam annotation: Domain name=Pkinase; Domain location=96-365; Score =118.1; E_value=2.6e-32; Accession=PF00069.15; Description=Protein kinase domain
  Pfam annotation: Domain name=Pkinase_Tyr; Domain location=96-365; Score=134.0; E_value=4.2e-37; Accession=PF07714.7; Description =Protein tyrosine kinase
  Pfam module annotation: Pfam domain module=Pkinase::Pkinase_Tyr; Domain location=96-365::96-365
MKHPSKPWKPLTTNCCTIQNQTIFGNLKPSSSDISNDIAQLPNSFHWMSFSDLGHFSSIRSNEDQIAKSFASDLYDFQLSDLRAITQNFSNSFWQGEGGFGTVHKGYIDANLRPGLKAQPVAVKILNVQGLQGHREWLAEVIFLGQLRHKNLVKLIGYCYEDEERLLIYEFMPRGSLENHLFRRKTSLPWATRLKITIGAAKGLAFLHAAKNPVIFRDFKTSNILLDSDFTAKLSDFGLARLVSEGSKSHVTTRVWGNYGYAAPEYISKGHLTTKSDVYSFGVVLIELLTGRRAIDKKRPKTEQNLVDWSKPYLSNSKRLRCIMDPRLVGQYSVKGAKEMALLALQCTSLNPKDRPRIQTAVETLENLQKFKDMAVTYGHWPQCARNGASNKVKIDLRAGGNHKRLSPLVSGRTTWF

SEQ ID NO: 216152 - protein, 256 aa, Glycine max
  Coding DNA Sequence Number=SeqID_99374
  Gene Ontology: Mol. function=chitin binding; Cellular component =extracellular region; Biological process=chitin metabolic process
  Homolog annotation: Hit_ID=UPI000044A8F0; Match level="QueryCoverage =94%, HitCoverage=99%, E-value=8e-26, Identity=25%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MRGTVHEPQGGPLGTSTLAIRGLHVLAIRGLHVLAFRGLHVLTFRGLNILIFRGLHMLIFKGLHILTFRGLHILTSRGLHALTFRGLNILTFRGLHALSFRGLHVLAFAFVGLHALTFIGLHVLTFRGLNIPIFRGLHIHIFRGLHILTSRGLNVLTFKGLHALSFRGLHVLTVGGLHALTFRGQHVLAFRGSYTFTFRGQHVLGSRGLLSSPLEDYTSSPSEGFTSTPSEDYTYSPSEGCTPSPSKDCTSSPSED

SEQ ID NO: 216153 - protein, 124 aa, Glycine max
  Coding DNA Sequence Number=SeqID_99375
MGTNHTGKRFYQVKIKGLDVTSLKELGRLMGPLQMQAFRKAYGKILDLTIAEISTEVVDVLLGEGNRIFSPGCGKAREMENQEEWVPFMDVLALLIFGVVLFPNVHGLVDLAAIDAFLAYHHSK

SEQ ID NO: 216154 - protein, 107 aa, Glycine max
  Coding DNA Sequence Number=SeqID_99376
MTLGGSFEIILSGVADDAVMEERWSSLGELRVSGSWGKQKSQQVVDEGAGVLGKALCMILGKAILMKSKGSIACSEFMLSKSKELDRQGLKKVRLDERHYLILALNV

SEQ ID NO: 216155 - protein, 144 aa, Glycine max
  Coding DNA Sequence Number=SeqID_99377
  Gene Ontology: Mol. function=GTPase activator activity; Biological process=regulation of GTPase activity
  Homolog annotation: Hit_ID=Q5W7F2; Match level="QueryCoverage=53%, HitCoverage=9%, E-value=2e-30, Identity=86%"; Hit description=ARF-GAP
MAFNHDYMKHILRRAFIPVHSLLKGNDDLRKKIEGSSSQHPGQRNSSELASGLLSRWLSSHHHGGVHDEKSVAHHTVNLLTSTIKVDNDQSDLRFCFRIISPTKNYTLQLVYSFLRKVRSFHESFLHSAGILDYVKLGTKPHKF

SEQ ID NO: 216156 - protein, 57 aa, Glycine max
  Coding DNA Sequence Number=SeqID_99378
MEAWGLLLSWFPGCSPRRANLPFFFGGNITMPPLFTGLLGCLAATFSACPAPGRDDD

SEQ ID NO: 216157 - protein, 377 aa, Glycine max
  Coding DNA Sequence Number=SeqID_99379
  Gene Ontology: Mol. function=kinase activity
  Homolog annotation: Hit_ID=Q1SMI5; Match level="QueryCoverage=20%, HitCoverage=4%, E-value=4e-24, Identity=64%"; Hit description =Prefoldin; tRNA-binding arm; t-snare; Protein kinase PKN/PRK1, effector
  Pfam annotation: Domain name=KIP1; Domain location=8-82; Score=163.2; E_value=6.7e-46; Accession=PF07765.3; Description=KIP1-like protein
MMKNQQSQWWWLESHNHTRRSPWLQSTLTELNEKTKAMLKLIEEDADSFAQRAEMYYKKRPQLVSMVEDFYRTHRSLAERYDQVTGIRQQKTGSPFSPIKNHQSEKLMSFTHDSYDSYSECFDVEESVESEVDDPEQEEEEVTKFDNCIEEEEVKIVAANDEVMGLRKEINRLGEENKDHKDQIKEKYNVYDEVMVLREEVEGLRKENRVQKDELNQKSIICGEVMILREEIERLKEENREQKDELNQKDIICGDVMMLREEIERLRKENRVQNDELKQKGTIYGEVMMLRKEIERVSEENMVQKDHLMQKDLEKIEVIRHLSLAIDVLKQENVKMRSFIAKEFTNKWNNPFEFKKLMGSLSMKLFNGKNQPSIVAL

SEQ ID NO: 216158 - protein, 182 aa, Glycine max
  Coding DNA Sequence Number=SeqID_99380
  Gene Ontology: Mol. function=serine-type endopeptidase activity; Cellular component=chloroplast thylakoid membrane; Biological process=proteolysis
  Homolog annotation: Hit_ID=O82261; Match level="QueryCoverage=99%, HitCoverage=29%, E-value=6e-90, Identity=90%"; Hit description =Protease Do-like 2, chloroplast precursor
DSVTVVGYPLGGDTISVTKGVVSRIEVTSYAHGSSDLLGIQIDAAINPGNSGGPAFNDQGECIGVAFQVLRSEEAENIGYVIPTTVVSHFLTDYERNGRYTGFPCLGVLIQKLENPALRAWLKVQSNEGVLVRRVEPTSDANNVLKEGDVIVSFDDVRVGSEGTVPFRSNERIAFHFLISQK

SEQ ID NO: 216159 - protein, 426 aa, Glycine max
  Coding DNA Sequence Number=SeqID_99381
  Homolog annotation: Hit_ID=Q8GV45; Match level="QueryCoverage=48%, HitCoverage=92%, E-value=3e-55, Identity=85%"; Hit description =Fertilization independent endosperm development protein
  Pfam annotation: Domain name=zf-U1; Domain location=233-258; Score =22.7; E_value=7.8e-05; Accession=PF06220.3; Description=U1 zinc finger
MVGETATGKSVGLGLGCDPVVGSLTCSKKREYRVTNRLQEGKRPLYAVIFNFIDSRYFNVFATVGGNRVTVYQCLEGGVIAVLQSYVDEDDESFYTVSWACNVDGTPFVVAGGINGVMRVIDAGSEKIHKSVDNEIILWEPKVKEQTPGEGVVDILQKYPVPECDIWFIKFSCDFHFNIAAVGNREGKIFVWELQSSPPVLVARLSHPQSKSPIRQTATSFDGRHQYVANVVCVLLQPSVRKQHNAGYKHKANVRTYYQQFEEQQTQSLIDQRIKEHLGQAAAFQQVGVAYNHLMVQRPNLPPVLPPPRLPIPGNAQIPGSQPLMPGMRPPVFPRPPGAPGYVSAPTMPPMLPPPGAPQAPGQLNTIPRPPSLAPPPAVPGSTAAPASNGAPSMVSSAMYQANPPAPSSGSYDNYNASAQAPEGNH

SEQ ID NO: 216160 - protein, 313 aa, Glycine max
  Coding DNA Sequence Number=SeqID_99382
  Gene Ontology: Mol. function=binding; Cellular component =mitochondrial inner membrane; Biological process=transport
  Homolog annotation: Hit_ID=Q2QPD3; Match level="QueryCoverage=59%, HitCoverage=93%, E-value=1e-57, Identity=60%"; Hit description =Mitochondrial carrier protein, expressed
  Pfam annotation: Domain name=Mito_carr; Domain location=125-214; Score=95.3; E_value=1.8e-25; Accession=PF00153.17; Description =Mitochondrial carrier protein
  Pfam annotation: Domain name=Mito_carr; Domain location=219-312; Score=89.9; E_value=8e-24; Accession=PF00153.17; Description =Mitochondrial carrier protein
  Pfam annotation: Domain name=Mito_carr; Domain location=29-115; Score= 77.1; E_value=5.4e-20; Accession=PF00153.17; Description =Mitochondrial carrier protein
  Pfam module annotation: Pfam domain module=Mito_carr::Mito_carr::Mito_ carr; Domain location=125-214::219-312::29-115
  Subcellular localization annotation: CTP_CleavageSite=43; ConfidenceScore=5.78e-01
MSGNSTSNNSPPSGSGNDKKQNWAASPSTVFNHFATSGLSVAVATAITHPLDVLKVRLQMQLVGQTGPLSGMGKLFLSAVKNEGPKSLYQGLTPALTRSFVYGGLRLGLYEPSKYACDLAFGSSNVLVKIASGMFAGAISTALTNPMEVLKVRLQMNPDMRKSGPIIELRRTVSEEGIKALWKGVGPAMARAAALTASQLATYDETKQILVRWTSLKEGFPLHLISSTVAGILSTLVTAPIDMVKTRLMLQREAKEIRIYKGGFHCAYQVLLTEGPRGLYKGGFAIFARLGPQTTITFILCEELRKHAGLKAM

SEQ ID NO: 216161 - protein, 210 aa, Glycine max
  Coding DNA Sequence Number=SeqID_99383
  Gene Ontology: Mol. function=serine-type endopeptidase activity; Cellular component=chloroplast thylakoid membrane; Biological process=proteolysis
  Homolog annotation: Hit_ID=O82261; Match level="QueryCoverage=60%, HitCoverage=23%, E-value=6e-38, Identity=60%"; Hit description =Protease Do-like 2, chloroplast precursor
  Subcellular localization annotation: CTP_CleavageSite=75; ConfidenceScore=5.80e-01
MAVALSSCTSLSSVLFSTVKFRYSLRHRPIVASFHCNNHPLRVSSSSSSSSSSKSNRKKEGAGHKKQSKDERPARGNVLESQPTSSKPFGIQRKNKDLIFDSKDQQVEQSILQDSAFLNAVVKVYCTHTAPDYSLPWQKQRQYTSTGRQDFENLDCRVVKVKKRGDDSKYVAKVLARGVDCDIALLSVESEEFWRDVEPLRLGRLPHLQV

SEQ ID NO: 216162 - protein, 120 aa, Glycine max
  Coding DNA Sequence Number=SeqID_99384
  Gene Ontology: Mol. function=nucleic acid binding; Cellular component= ribonucleoprotein complex; Biological process=multicellular organismal development
  Homolog annotation: Hit_ID=Q7XAN8; Match level="QueryCoverage=67%, HitCoverage=19%, E-value=4e-19, Identity=58%"; Hit description =Putative CUG triplet repeat RNA-binding protein 1
  Pfam annotation: Domain name=RRM_1; Domain location=55-118; Score =43.7; E_value=6.4e-10; Accession=PF00076.12; Description=RNA recognition motif. (a.k.a. RRM, R
MKHFTDTLISANIVSHWHDRFPDWKAGSERNAINASSPLQVKYADGELERLEHKLFIGMLPKNISEDEVSNLFSKYGTIKDLQILRGSQQTSKGCAFLKYETKEQAFTALEAINGKHTME

SEQ ID NO: 216163 - protein, 128 aa, Glycine max
  Coding DNA Sequence Number=SeqID_99385
  Gene Ontology: Mol. function=nucleic acid binding; Cellular component= ribonucleoprotein complex; Biological process=mRNA splice site selection
  Homolog annotation: Hit_ID=Q69Q05; Match level="QueryCoverage=55%, HitCoverage=17%, E-value=5e-25, Identity=71%"; Hit description =Putative apoptosis-related RNA binding protein
  Pfam annotation: Domain name=RRM_1; Domain location=48-119; Score =86.5; E_value=8.2e-23; Accession=PF00076.12; Description=RNA recognition motif. (a.k.a. RRM, R
  Subcellular localization annotation: CTP_CleavageSite=30; ConfidenceScore=5.20e-01
MNPRNYPAPPASYIGSYPAVPGGNSNSSSSGASKSSSGQIEGPPGANLFIYHIPQEYGDQELTTAFQPFGRVLSAKIFVDKVTGVSKCFGFVSYDTPEAAQAAISTMNGCQLGGKKLKVQLKRDNKQS

SEQ ID NO: 216164 - protein, 66 aa, Glycine max
  Coding DNA Sequence Number=SeqID_99386
  Gene Ontology: Mol. function=calpain activity; Cellular component =intracellular; Biological process=proteolysis
  Homolog annotation: Hit_ID=Q1SMV7; Match level="QueryCoverage=80%, HitCoverage=62%, E-value=4e-10, Identity=53%"; Hit description =Cyclin-like F-box
  Pfam annotation: Domain name=F-box; Domain location=7-54; Score=40.3; E_value=6.6e-09; Accession=PF00646.23; Description=F-box domain
MRSEKKPWSPLLCDELIEEILSRLPVKPLIQFKCVCKGWNSLMSDPYFIKLHLSKSAAKDDLDTFN

SEQ ID NO: 216165 - protein, 279 aa, Glycine max
  Coding DNA Sequence Number=SeqID_99387
  Gene Ontology: Mol. function=histidine ammonia-lyase activity; Cellular component=cytoplasm; Biological process=histidine catabolic process
  Homolog annotation: Hit_ID=Q46XQ6; Match level="QueryCoverage=97%, HitCoverage=51%, E-value=5e-87, Identity=63%"; Hit description =Histidine ammonia-lyase
  Pfam annotation: Domain name=PAL; Domain location=7-279; Score=76.5; E_value=8.4e-20; Accession=PF00221.9; Description=Phenylalanine and histidine ammonia-lyase
MSGSVQAIRLVPGEVDLATLRRIYQEKVTLQLAEEARADIDRARETVEAIVASGKVVYGINTGFGKLAQTQIPAERLAELQRNLVLSHSVGLGDLLPDNVTRLVVASKIISLARGHSGIRMELIDTLLALFNAGVMPCIPAKGSVGASGDLAPLAHLSLMLLGEGQVRIDGQLVPASEGLARVGLQPIVLGPKEGLALLNGTQVSTALALRGLFEAENLFAAGLMAGALSLEAIKGSVKPFDARIHQARGQHGQIAVAAAVATLLEGSEILSSHSNCGR

SEQ ID NO: 216166 - protein, 62 aa, Glycine max
  Coding DNA Sequence Number=SeqID_99388
MKTLHGFGISTNIIDNNEGSHGHVAPHATGLLGHGNKRWGGRQKQGFCSYVSSICDEELRPA

SEQ ID NO: 216167 - protein, 41 aa, Glycine max
  Coding DNA Sequence Number=SeqID_99389
MVVVVVEVGDIVSGLLAVQRTTCFISLKVLVLANGTVLFVI

SEQ ID NO: 216168 - protein, 133 aa, Glycine max
  Coding DNA Sequence Number=SeqID_99390
AAGSMTCGEPFGPELFSPLSSKGGGPDDMSSESSDKRAETNYGHSVPFVIQISQVEDSKSRGGRRQIMVIPHTFSPSRGDRVWWHAETNYGHSAPCHPGSIVSEGTQRQIMVILHLVSTKRNEFDNIRMMLVI

SEQ ID NO: 216169 - protein, 111 aa, Glycine max
  Coding DNA Sequence Number=SeqID_99391
MVDNIDDNNVRQDLLTTKKSNVEIPLLLAADKGHTEITRFLYEKTPTDELSQPDLVLLLERCIKAEIFEQTEKKKPTRLTNPSVSHTNIISKVETMKIIWALVKKKQGMMK

SEQ ID NO: 216170 - protein, 67 aa, Glycine max
  Coding DNA Sequence Number=SeqID_99392
RLLRGDLLDLQETKVVGKEGEELARVGDEEARLLRGDLLDLQETKVVEKEGEELARVGDEEGGLGSW

SEQ ID NO: 216171 - protein, 639 aa, Glycine max
  Coding DNA Sequence Number=SeqID_99393
  Gene Ontology: Mol. function=aminoacyl-tRNA ligase activity; Cellular component=cytoplasm; Biological process=tRNA aminoacylation for protein translation
  Homolog annotation: Hit_ID=Q1SZT2; Match level="QueryCoverage=95%, HitCoverage=95%, E-value=0.0, Identity=66%"; Hit description=TRNA synthetase, class II (D, K and N); Nucleic acid-binding, OB- fold
  Pfam annotation: Domain name=tRNA-synt_2; Domain location=217-635; Score=17.8; E_value=5.2e-16; Accession=PF00152.11; Description=tRNA synthetases class II (D, K and N)
  Subcellular localization annotation: CTP_CleavageSite=29; ConfidenceScore=5.17e-01
MAAAKTTTTSAQQTSSAPLRLDAPRIPPLAYSGRVQLKALLDRPESVVGRHVIVGGWVKSAKEVKKKAAAPPSFATATEETTDAGEGGKGKDVSCVEILQSRIPLLRSLLDVFGGGGYVQRKKRENVIVPNHKVLPPKASTAYLLLTDGSCVPSLQVVVDSSVATPSRLLPTGTCLLVEGQLERAEGKHAIELKAEKVLHIGTVDFDKYPLSKKRIPLDTLRDYSQFRPRTTTVATVVRIRSSLSFATHTFFNEHAFIDVQVPIITSTDSEGFSNMLKVNTLEQKAEKEKLDTIYETEGVSLEHVKAAAKEKSNIIEHLKRTESNREALAAAVQDLRKTNELASQMEAREKRKLGASFKDDDKVDSSKEFFPFQTYLTVSGRLHLESYACALGNVYSFGPRFLADKTDSAKHAAEMWMVEVEMAFSLLKDSMNCANDFFKYLCNWVLIHCSEEMKFVAKRIDNTCVNRLQQIILGSPVMMTYHEAIDVLRKLSYQAEDKKFETNFESGFALTSEHLSYLTDTIYQKPVVIYNYPKEAKPFYARQNDDGTVAAFDLVVPKLGTIISGSQNEERLNMISSRIDELGLPREKYEWYLDLRRNGTVKNSGFTLRFDLMVLFATGLGNVRDVIPFPRSYGKANN

SEQ ID NO: 216172 - protein, 80 aa, Glycine max
  Coding DNA Sequence Number=SeqID_99394
MLGDTSNSEVSRKELQTAKPKRQLVFFMETYWISKRQKSLEKRVKSLLEWEMKKVDLGVGRRLDNKEKGESGTYRERKKT

SEQ ID NO: 216173 - protein, 67 aa, Glycine max
  Coding DNA Sequence Number=SeqID_99395
MKCYNDVHGDGGFHAVWWLRWWFWVVMGCSGHGCLEERYLNLTPPSAKIGDALDDLWQARPANPIGQ

SEQ ID NO: 216174 - protein, 788 aa, Glycine max
  Coding DNA Sequence Number=SeqID_99396
  Gene Ontology: Mol. function=steroid hormone receptor activity; Cellular component=exocyst; Biological process=vesicle docking during exocytosis
  Homolog annotation: Hit_ID=Q9LXX6; Match level="QueryCoverage=99%, HitCoverage=100%, E-value=0.0, Identity=69%"; Hit description =Probable exocyst complex component 6
  Pfam annotation: Domain name=Sec15; Domain location=429-785; Score =26.1; E_value=7.4e-11; Accession=PF04091.3; Description=Exocyst complex subunit Sec15-like
MDVKTKRRAHVENGDEGEDLVLATLVANGDDISPLVRHAFEMGRPEGLLRQLDFVVKKKEAEIEAMCKTHYEEFILAVDELRGVLVDAEELKSELQSDNFKLQQVGTTLLIKLEELLESYTIKKNVTEAIKMSKNCIKVLELCVKCNNHISEGQFYPALKTVDLLEKCYIQNIPARALKKVIEKKIPSIKLHIEKKVCSQVNEWMVQIRSSCKKIGQTAIGRAAQVRQRDEEMLERKRKAEGLNISEVDDQAYNLVVEEDEDSAMKFDLTPLYRACHIHSCLGILEQFHDYYYKNRLLQLNSDLEISSAQPFVESHQTFLAQIAGYFIVEDKVLRTAGGLLVPDKVETMWETALAKVTSMLDMQFSHMNSATHLLLVKDYVTLLASTLRQYGYDIGQLLDVLDNSRDKYHRLLLQECQKQIVDVLGKDSYEQMVIKKDTDYENNVLSFNIQTSDIMPAFPYVAPFSSMVPDACRIVRSFIKGSVDYLSNGVRTGFFDFVRKYLDKFLIEVLNETLLDTINSGNISVSQAMQLAANITVLERACDFFLRHASQQCCISVRSVEKPQATLTAKVLLKTSRDAVYITLLSLVNTKLDEYMNLVESINWTSEEAKPNGNDYINEVIFYLDSLMSTAQQILPLDAMYKVGTSAIEHISNTIVAAFLSDNVKRFNANAVMNFNNDLRMLESFADEKFHCSGLAEFYSGASFKSCMIEARQLMNLLSSSQPENFMNPVIREKNYYALDYKMVGSICDKFKDSPDGIFGSLSNKNTKQSAKKKSMDMLKKRLKDFN

SEQ ID NO: 216175 - protein, 168 aa, Glycine max
  Coding DNA Sequence Number=SeqID_99397
  Gene Ontology: Mol. function=nucleoside-triphosphatase activity; Cellular component=integral to membrane; Biological process=protein catabolic process
  Homolog annotation: Hit_ID=Q4W5U8; Match level="QueryCoverage=92%, HitCoverage=42%, E-value=1e-36, Identity=52%"; Hit description=FtsH protease
  Pfam annotation: Domain name=Peptidase_M41; Domain location=51-168; Score=-42.4; E_value=5.2e-08; Accession=PF01434.8; Description =Peptidase family M41
MQQSISFNTLDTSKFIDEIDDVGRLRGTGIVGGNDEREQTLNQLLTEMKKLDKDVSLSVIAMRTPGFSGADLANLMNQAVILASEDPSLISKNQLFARIVGGLGERAEEEVIFGETEITTGAAGDLQQITQIARQMVTMFGMSEIGPWALTDPAVQGHDVVLRMLARN

SEQ ID NO: 216176 - protein, 110 aa, Glycine max
  Coding DNA Sequence Number=SeqID_99398
NLARQGELGGHHIPCFVEKWDSGASGTPVMLPTFFEAGLLLKQPSSPGRAKDPSAPWLCISAVLGEKNCFREENPSRGASVTLPRCFRKQIREGFRPFFIVLHPFFVLQR

SEQ ID NO: 216177 - protein, 183 aa, Glycine max
  Coding DNA Sequence Number=SeqID_99399
  Gene Ontology: Mol. function=electron carrier activity; Cellular component=integral to thylakoid membrane; Biological process =electron transport
  Homolog annotation: Hit_ID=P49161; Match level="QueryCoverage=99%, HitCoverage=76%, E-value=1e-76, Identity=67%"; Hit description =Apocytochrome f precursor
  Pfam annotation: Domain name=Apocytochr_F_C; Domain location=129-165; Score=-64.8; E_value=0.045; Accession=PF01333.10; Description =Apocytochrome F, C-terminal
GYENPREATGRIVCANCHLANKPVDIEVPQAVLPDTVFEAVVRIPYDMQVKQVLANGKKGALNVGAVLILPEGFELAPPDRISPEIKEKIGNLSFQNYRPTKKNILVVGPVPGGNRGRGQIYLDGSKSNNNVYNATAAGMDSELLVSEGESIKLDQPLTSNPKCGWIWSGGCGNSTSRSVTCP

SEQ ID NO: 216178 - protein, 111 aa, Glycine max
  Coding DNA Sequence Number=SeqID_99400
  Gene Ontology: Mol. function=metal ion binding; Cellular component =nucleus; Biological process=regulation of transcription from RNA polymerase II promoter
  Homolog annotation: Hit_ID=Q1SB28; Match level="QueryCoverage=80%, HitCoverage=62%, E-value=6e-48, Identity=97%"; Hit description=G10 protein; Cytochrome c and b562
  Pfam annotation: Domain name=G10; Domain location=1-103; Score=172.1; E_value=1.4e-48; Accession=PF01125.8; Description=G10 protein
MPKVKTNRVKYPEGWELIEPTLRELQAKMREAENDPHDGKRKCETLWPIFKIAHQKSRYIFDLYHRRKEISKELYEFCLDQGYADRNLIAKWKKEKSLKKEHSPSQLPLKT

SEQ ID NO: 216179 - protein, 57 aa, Glycine max
  Coding DNA Sequence Number=SeqID_99401
MYQRGLYFNNYDLSSFWWLLKKNEVGWAILSSFTNLQPSIAQFFEFDIGIWHMASGY

SEQ ID NO: 216180 - protein, 187 aa, Glycine max
  Coding DNA Sequence Number=SeqID_99402
  Subcellular localization annotation: CTP_CleavageSite=69; ConfidenceScore=5.37e-01
MILFLLAFSLLMFLFSLSPLHLFSSFHHPFPCSQCTNLVSGLPRPLPHPRSNVTKLDDAVFCSETDRLYSDTKSSPPLQPLSSTTILLLHRHQQSHHHHPQNHNNPNHNPTQTHSQNKSASVHSITRGETVKALCFRVTSCFRLARIAVSQLGVAKNWDRENNKNLVGWVGFRGTTLLTVNLVGTWI

SEQ ID NO: 216181 - protein, 56 aa, Glycine max
  Coding DNA Sequence Number=SeqID_99403
  Homolog annotation: Hit_ID=Q6WNU4; Match level="QueryCoverage=96%, HitCoverage=6%, E-value=2e-20, Identity=83%"; Hit description =Subtilisin-like protease
MTPSPNLAFFQIELDWITPLCSSPMKSHDRVVCSFLPRFSNTDNTLGCSRSSMDNR

SEQ ID NO: 216182 - protein, 328 aa, Glycine max
  Coding DNA Sequence Number=SeqID_99404
  Gene Ontology: Mol. function=DNA binding; Cellular component =membrane; Biological process=DNA integration
  Homolog annotation: Hit_ID=Q1SS72; Match level="QueryCoverage=96%, HitCoverage=22%, E-value=1e-63, Identity=38%"; Hit description =Integrase, catalytic region
  Pfam annotation: Domain name=zf-CCHC; Domain location=205-222; Score =13.1; E_value=0.0068; Accession=PF00098.13; Description=Zinc knuckle
  Pfam annotation: Domain name=zf-CCHC; Domain location=243-260; Score =3.5; E_value=0.26; Accession=PF00098.13; Description=Zinc knuckle
  Pfam module annotation: Pfam domain module=Retrotrans_gag::zf -CCHC::zf-CCHC; Domain location=36-151::205-222::243-260
MITALSAKNKVKFVDGSAPEPFKTDRTYGAWCRCNNMVVSWIVHSVATSIKQSILWMDEEEEIWRDLKSRYLQGDLLQISDLQQEASTMKQGVLSVTEYFTRLRIIWEEIKNFRPDPICSYSIRCSCSALTIIAQRKLEDRAMQFLRGLNEQYANIRSHVLLMDPIPAISKIFSYVAQQERQLLGNVSSNPNLESRDISINAVKVVCDFCGRVGHMENVCYKKHGMPSNYDGKNKSNNMRYGKICTHCSKNGHTIDVCYRKHGFPPGCKTYNGRTTANNVVAVDSKATDDQTQHHESQDIVRFCPEQYEALLALIQQPSSGNTTPSQS

SEQ ID NO: 216183 - protein, 126 aa, Glycine max
  Coding DNA Sequence Number=SeqID_99405
  Homolog annotation: Hit_ID=Q6WNU4; Match level="QueryCoverage=38%, HitCoverage=6%, E-value=2e-20, Identity=93%"; Hit description =Subtilisin-like protease
MFYKDCYYPIKPNRLCFCYIQNKAKAKEDFLERQSNEATKFFHPLSPSNSSCLSTAQTQLCIEKAHSHKPELSSVDFNQVTQSHHEFLGSFLGSSNTTKDSIFYSYTRHINGFAAILEEEVAAEIS

SEQ ID NO: 216184 - protein, 70 aa, Glycine max
  Coding DNA Sequence Number=SeqID_99406
MKSNGSVSMEKMMGVVMKSTDSVSMEKMMGAVMKSTGSVPMEKMMVKSLTLNKYFHWLDDESVLENWQMV

SEQ ID NO: 216185 - protein, 265 aa, Glycine max
  Coding DNA Sequence Number=SeqID_99407
  Gene Ontology: Mol. function=DNA binding; Cellular component =cytoplasm; Biological process=DNA integration
  Homolog annotation: Hit_ID=Q1SS72; Match level="QueryCoverage=95%, HitCoverage=18%, E-value=2e-55, Identity=42%"; Hit description =Integrase, catalytic region
HRQKLDPKAHRCIFIGFKSHTKGYLVYDLHSHSITSSRNIIFYEDHFPSFHETQHSNLTPTVPAPGSFSSNHLDPPVETTPPHPIIQDSSSYDPPANTSSLQLCRSTRTKHAPTYLQDYHRDLSSLTANTSTTVWYPLNSVLSYSRLSPSHRHFVMSISSTTEPTSYAEASHHDCWIKVMQVELQALQLNNTWTLTTLPPHKTAIGCRWVYKIKHHADGSVERYQARLVEKGYTQMEGLDYLDTFSPVAKLTTVRLLLALAALHQ

SEQ ID NO: 216186 - protein, 204 aa, Glycine max
  Coding DNA Sequence Number=SeqID_99408
  Gene Ontology: Mol. function=DNA binding; Cellular component =mitochondrion; Biological process=DNA integration
  Homolog annotation: Hit_ID=Q1SKN1; Match level="QueryCoverage=94%, HitCoverage=16%, E-value=3e-45, Identity=47%"; Hit description =Integrase, catalytic region
  Subcellular localization annotation: CTP_CleavageSite=72; ConfidenceScore=5.37e-01
MAFTYVNENTLLTFSDPGMLGSRPNSTPMDYSTRLQALSGTPLSADSSSSYPRLGKPGSSLFFAAHGTPQLQAFSDSDWAGSSEAEYRALASTTCELQWLTYVLQDFRVPFIQPATLYCDNQFAIQIASNPVFHERTKHFEIDCQIVRHKVNSGLIKLLPISSSKQLADIFTKALSPAVFQGLCSKLGMMNIHSQLAEGSQQQQ

SEQ ID NO: 216187 - protein, 169 aa, Glycine max
  Coding DNA Sequence Number=SeqID_99409
MDQHLGQRDSKLAAMESEEAEECTSTTGDASFASVADVSEVDTKVEFDLNERLNADDGKCSEIPGSTPAARLVSPVQFYASSMSFAHYPRPYIVSLRDGSNSMVLRTARKGQGRVSILMLDLEPNGGWDGYKQPLWQLSQPTLRREGDAGLAGACSKKGICAESPPTFI

SEQ ID NO: 216188 - protein, 48 aa, Glycine max
  Coding DNA Sequence Number=SeqID_99410
MAIQVFADMCFTGVNFVMDCKSVQEAWCNAAEEVKLGFICSGTAQPVS

SEQ ID NO: 216189 - protein, 489 aa, Glycine max
  Coding DNA Sequence Number=SeqID_99411
  Gene Ontology: Mol. function=monooxygenase activity; Cellular component=membrane; Biological process=electron transport
  Homolog annotation: Hit_ID=Q1SKI2; Match level="QueryCoverage=95%, HitCoverage=88%, E-value=1e-164, Identity=62%"; Hit description =Arthropod hemocyanin/insect LSP; E-class P450, group I
  Pfam annotation: Domain name=p450; Domain location=11-476; Score =251.2; E_value=2.1e-72; Accession=PF00067.12; Description=Cytochrome P450
MEATHYRKCTPSCYICTTPKTKRLGQVYGPLMHLQLGEVFTVIVSSAEYAKEIMKTHDVIFATRPHILAADIFSYGSTNTIGAPYGNYWRQLRKICTVELLTQKRVNSFKPIREEELTNLIKMIDSHKGSPINLTEEVLVSIYNIISRAAFGMKCKDQEEFISAVKEGVTVAGGFNVADLFPSAKWLQPVTGLRPKIERLHRQIDRILLDIINEHKDAKAKAKEDQGEAEEDLVDVLLKFPDGHDSKQDICLTINNIKAIILVRPRVRRSSKVNPHFERDIFGAGGETAATAINWAMAEMIRDPRVLKKAQAEVRAVYNMKGMVDEIFIDELQYLKLVVKETLRLHPPVPLLVPRVCGESCGIGGYHIPVKSMVIVNAWAIGRDPNYWTQPERFYPERFIDSSIEYKGTNFEYIPFGAGRRLCPGITFGLKNVELALAFLLFHFDWKLPNGMKNEDLDMTQQFGVTVRRKADLFLIPITSRPILVRKLP

SEQ ID NO: 216190 - protein, 64 aa, Glycine max
  Coding DNA Sequence Number=SeqID_99412
MLQREVSTKRNHEDMKLTSNPIAIMVARLAVRTVRLAIVKGRRTRRGGVAMKTGINTELRQRHN

SEQ ID NO: 216191 - protein, 134 aa, Glycine max
  Coding DNA Sequence Number=SeqID_99413
MGLFLKIFHHGFVFARRVRCMQVNSPCGWRVKGGTGTWHVATATGDLASVKLASPIQRHPRPVAAARRLAKEQGQLMVSPVMLVICFSKGISPLLLASWFGVGLQLYKEPWTCMIRGNLCSPSAFLASSVAFLA

SEQ ID NO: 216192 - protein, 305 aa, Glycine max
  Coding DNA Sequence Number=SeqID_99414
  Gene Ontology: Mol. function=protein serine/threonine kinase activity; Cellular component=condensed nuclear chromosome kinetochore; Biological process=protein amino acid phosphorylation
  Homolog annotation: Hit_ID=Q1SKH6; Match level="QueryCoverage=99%, HitCoverage=77%, E-value=1e-116, Identity=69%"; Hit description =Cellular retinaldehyde-binding/triple function, C-terminal
  Pfam annotation: Domain name=Mad3_BUB1_I; Domain location=1-94; Score= 87.8; E_value=3.3e-23; Accession=PF08311.2; Description=Mad3BUB1 homology region 1
CIKWVQEAFPPGGDSSGLVVIYEQCVRAFWHSELYKDDLRYLKADNCFDADVIYAFLDANGIGKTHSIFYISYALHLESKNKFKAANQMMELGISRNAQPVDKLKAAYRQFFARSMARPIAIDDAVEKLAPTRSFGTVLAKGENRAPLSILNSNRDPCAKNDRTRAAPLSIYKDSADTGDTDPHKPDLSHSWHTLGARADRNKENNAIPGKWKSYKIPQRPGTRTGGATASAFIPVFVDEECQDSQSKKAEGCKSSNLKIRQEDDKELKRGPHELTPICIIVPFRETELLRKNPLRNFPQNSLPR

SEQ ID NO: 216193 - protein, 113 aa, Glycine max
  Coding DNA Sequence Number=SeqID_99415
MHAYRQHAWRDKPARDPPGGLAIWHPFVATMPDDLSLACPLGPSRFFLQKAVASGESNLALLGELGGKLLPYFAINRGRSEERRGSTFLALLILSKLLRKIVSVKKIQAEALS

SEQ ID NO: 216194 - protein, 252 aa, Glycine max
  Coding DNA Sequence Number=SeqID_99416
  Homolog annotation: Hit_ID=Q0Z424; Match level="QueryCoverage=37%, HitCoverage=61%, E-value=8e-25, Identity=47%"; Hit description =Hypothetical protein precursor
TGPQLFAVAQIDQASGYGNAGFAEGFLHYSDRQHIVTGLGQRQGGAGEHAVAGFDVRRLVNRRQDQDRLRLALMERRIVIRRLLGTAAKQQGGGNGEERNSLNGADSGNSVFSVLNSFMACPSLPIFAVQQPQLRMQTWRYGFILGAGFLDDLFQRGDLLLRALPPPAGSIDREKSGSHPNCKAFSARRSRPAGAPCAVFDTGDQVIDGFTHGQIQHLAVEGGVVAGGAPETDDFAIGQFVFTGTLSGIDDF

SEQ ID NO: 216195 - protein, 263 aa, Glycine max
  Coding DNA Sequence Number=SeqID_99417
  Gene Ontology: Mol. function=protein disulfide oxidoreductase activity; Cellular component=membrane; Biological process=glycerol ether metabolic process
  Homolog annotation: Hit_ID=Q6CYX1; Match level="QueryCoverage=81%, HitCoverage=71%, E-value=4e-54, Identity=52%"; Hit description =Probable amino acid metabolite efflux pump
  Pfam annotation: Domain name=DUF6; Domain location=14-132; Score =52.8; E_value=1.1e-12; Accession=PF00892.11; Description=Integral membrane protein DUF6
MTLRDRLLALLVVVIWGVNFVVIKFGLQGMPPFLLAGMRFLLVALPAIFFIPRPTIPWKWLLLYGMTMSFAQFAFLFVAIKVGMPAGLASLVLQAQVFFTLLLGVVLMGEKLRVNHFVGIAIASGGMLVLAQASLHKPGSGAVPLAGLLLTLAAAFSWALGNLTNKKILAGFPQRNILSLVVWSAPIPVVPFLACSWLFDGPQAVLSSLGHVQVGTWLAVAYLAFAATLFALSPAQFGGALLVLGGMAVNTFGLPRRRAAIAR

SEQ ID NO: 216196 - protein, 37 aa, Glycine max
  Coding DNA Sequence Number=SeqID_99418
MALSNHRFIPVDCPAATAILPPGSQNRTGDAHSSPGG

SEQ ID NO: 216197 - protein, 135 aa, Glycine max
  Coding DNA Sequence Number=SeqID_99419
  Gene Ontology: Mol. function=hydrogen ion transporting ATP synthase activity, rotational mechanism; Cellular component=proton -transporting two-sector ATPase complex; Biological process =regulation of transcription, DNA-dependent
  Homolog annotation: Hit_ID=P0AG30; Match level="QueryCoverage=95%, HitCoverage=35%, E-value=3e-57, Identity=85%"; Hit description =Transcription termination factor rho
  Pfam annotation: Domain name=OB_RNB; Domain location=33-93; Score =9.9; E_value=0.0021; Accession=PF08206.2; Description=Ribonuclease B OB domain
  Pfam annotation: Domain name=Rho_N; Domain location=1-27; Score=30.3; E_value=7e-06; Accession=PF07498.2; Description=Rho termination factor, N-terminal doma
  Pfam annotation: Domain name=Rho_RNA_bind; Domain location=29-103; Score=142.7; E_value=9.9e-40; Accession=PF07497.2; Description=Rho termination factor, RNA-binding doma
  Pfam module annotation: Pfam domain module=OB_RNB::Rho_N::Rho_RNA _bind; Domain location=33-93::1-27::29-103
MGLENLARMRKQDIIFAILKQHAKSGEDIFGDGVLEILQDGFGFLRSGDSSYLAGPDDIYVSPSQIRRFNLRTGDTISGKIRPPKEENARSKILFENLTPLHANNCLRMERERFDRRPDGARAGSGIANRRAQRV

SEQ ID NO: 216198 - protein, 821 aa, Glycine max
  Coding DNA Sequence Number=SeqID_99420
  Homolog annotation: Hit_ID=P0A6S7; Match level="QueryCoverage=38%, HitCoverage=92%, E-value=1e-126, Identity=74%"; Hit description =Glycerol-3-phosphate dehydrogenase [NAD(P)+] (EC 1.1.1.94) (NAD(P)H- dependent ...
  Homolog annotation: Hit description=glycerol-3-phosphate dehydrogenase)
  Pfam annotation: Domain name=3HCDH_N; Domain location=312-438; Score=- 111.4; E_value=0.052; Accession=PF02737.8; Description=3-hydroxyacyl -CoA dehydrogenase, NAD binding domain
  Pfam annotation: Domain name=ApbA; Domain location=315-468; Score= -4.8; E_value=0.00078; Accession=PF02558.6; Description=Ketopantoate reductase PanEApbA
  Pfam annotation: Domain name=F420_oxidored; Domain location=314-489; Score=-55.1; E_value=0.09; Accession=PF03807.7; Description=NADP oxidoreductase coenzyme F420-dependent
  Pfam annotation: Domain name=Glutaredoxin; Domain location=118-175; Score=19.4; E_value=0.0018; Accession=PF00462.14; Description =Glutaredoxin
  Pfam annotation: Domain name=Hexapep; Domain location=753-770; Score =7.3; E_value=19; Accession=PF00132.14; Description=Bacterial transferase hexapeptide (three rep
  Pfam annotation: Domain name=Hexapep; Domain location=785-802; Score =9.3; E_value=11; Accession=PF00132.14; Description=Bacterial transferase hexapeptide (three rep
  Pfam annotation: Domain name=Hexapep; Domain location=803-820; Score =11.9; E_value=2.3; Accession=PF00132.14; Description=Bacterial transferase hexapeptide (three rep
  Pfam annotation: Domain name=NAD_Gly3P_dh_C; Domain location=490-631; Score=241.5; E_value=1.8e-69; Accession=PF07479.4; Description=NAD -dependent glycerol-3-phosphate deh
  Pfam annotation: Domain name=NAD_Gly3P_dh_N; Domain location=313-472; Score=268.3; E_value=1.6e-77; Accession=PF01210.13; Description=NAD -dependent glycerol-3-phosphate deh
  Pfam annotation: Domain name=NAD_binding_2; Domain location=312-482; Score=-69.8; E_value=0.0066; Accession=PF03446.5; Description=NAD binding domain of 6-phosphogluconate dehydrogenase
  Pfam annotation: Domain name=Rhodanese; Domain location=37-131; Score= 65.5; E_value=1.7e-16; Accession=PF00581.10; Description=Rhodanese -like domain
  Pfam annotation: Domain name=SATase_N; Domain location=631-726; Score= 100.1; E_value=6.5e-27; Accession=PF06426.4; Description=Serine acetyltransferase, N-terminal
  Pfam annotation: Domain name=SecB; Domain location=184-316; Score =213.1; E_value=6.3e-61; Accession=PF02556.5; Description=Preprotein translocase subunit SecB
  Pfam module annotation: Pfam domain module=3HCDH_N::ApbA::F420 _oxidored::Glutaredoxin::Hexapep::Hexapep::Hexapep::NAD_Gly3P_dh _C::NAD_Gly3P_dh_N::NAD_binding_2::Rhodanese::SATase_N::SecB; Domain location=312-438::...
  Pfam module annotation: Domain location=315-468::314-489::118 -175::753-770::785-802::803-820::490-631::313-472::312-482::37 -131::631-726::184-316
MQFASNHPILSLAWVALLILVIVTTVKGMFSKVKTISRGEATHLINKEDAVVVDVRSRDDYRKGHISGAINIAAADIKKGSFGELEKHKSQPIIVVCATGQSAAEPAATLSAAGFDKVTVLKDGVSGWSGENLPLVRGVSYQEIPIDGDAVKREEMIKRSGRTTVPQIFIDAQHIGGCDDLYALDGQHSSNEMQFQIQRVYTKDVSFEAPNAPQVFQKEWEPEVKLDLDTASSQLADEVYEVVLRVTVTATVGEDTAFLCEVQQAGIFTISGIEGTQMAHCLGAYCPNILFPYARECVTSLVSRGCLMTTLNASISVIGAGSYGTALGITLARNGHPVLLWGHNPQSVAQLQADRCNTAFLPDVPFPDNLVPEADLARVVSASRDLLVVVPSHVFGDVLMQLKPLLRADSRIVWATKGLEKETGRLLQDVAREILGDSIPLAVISGPTFAKELAAGLPTAIALAATDAQFADDLQQKLHCGKSFRVYNNPDFIGVQLGGAVKNVIAIGAGISDGIGFGANARTALITRGLAEMSRLGAALGADPTTFMGMAGLGDLVLTCTDNQSRNRRFGMMLGQGESVDEAQRIIGQVVEGYRNTKEVKALAARVGVEMPITEQIYQQTAMSSEELELVWNHIKAEARALADCEPMLASFYHATLLKHENLGSALSYMLANKLANPIMPAIAIREIVEEAYRQDPEMIVSAPRTVLATGCGKRDGRALAVYLQNEISVSFAVDIHPAARIGRGIMLDHATGIVIGETAVVENDVSILQSVPLGGTGKTSGDRHPKIREGVMIGAGAKILGNIEVGRGAKIGAGSVVLQP

SEQ ID NO: 216199 - protein, 203 aa, Glycine max
  Coding DNA Sequence Number=SeqID_99421
  Gene Ontology: Mol. function=metalloendopeptidase activity; Biological process=proteolysis
  Homolog annotation: Hit_ID=UPI00005F97BC; Match level="QueryCoverage =77%, HitCoverage=35%, E-value=4e-39, Identity=57%"; Hit description =COG4942: Membrane-bound metallopeptidase
MKGKATVTHTRTRYNDPASPLSFRWSDISLSLLCAGALLLPVAAHSADDSKTQLKSIQQDIAEKEKSVKAQKLQRSKLLDQLQSQEKVIAQASRQLRETRNSLSALNGEIAQTTAAIARLEKQQAQQEKLLAQQLDAAFRQGQHNGVQLLLGGEEAQRSERILAYFGYLNAARQKNIDELKQTQQELAQQRQALQGKQEQQKS

SEQ ID NO: 216200 - protein, 76 aa, Glycine max
  Coding DNA Sequence Number=SeqID_99422
  Pfam annotation: Domain name=LTXXQ; Domain location=46-68; Score =19.5; E_value=0.012; Accession=PF07813.3; Description=LTXXQ motif
MRYLTAVVFASAMVLSHASAEAADTTTIDEMHHNGGLTTGSMTQNPQSHMFDGIELTEQQRQQMRDLMQQARHERP

SEQ ID NO: 216201 - protein, 365 aa, Glycine max
  Coding DNA Sequence Number=SeqID_99423
  Homolog annotation: Hit_ID=Q7CPI4; Match level="QueryCoverage=58%, HitCoverage=91%, E-value=5e-64, Identity=58%"; Hit description =Putative outer membrane lipoprotein
  Subcellular localization annotation: CTP_CleavageSite=33; ConfidenceScore=5.21e-01
MIPLALTDENQAGGGEQRSRFPPGLFSRRVTVRGRSVTLGPASRDRNPSDPLQIVWRRRLPAIAPASASKQAISMPGCYQPELHALLHSAALAGRLRCTVVQQARTSVKHCRPAVCTAGAIALFFRTFPSESNLAIVTTGVELWRQEFPASLSACGDKEGDQRKAFTDFLQNTVMRSGEHLPSLSENQKQTFGNYASDYAILYGFSQQVNQAVDQGMRPVVDELAAIRVPQDYLTRRDSLRQASGNLSVLTQQIQSAKMQADSSKATLKQPDDLKKVYDSVYAKVVTQPASTLIPLLPQLQALSQSAVQAGDYLQSQGARVSFNDGGVQFPTQEQATQYNTLMSNLASNTQALTQAQNAVQGGLQ

SEQ ID NO: 216202 - protein, 566 aa, Glycine max
  Coding DNA Sequence Number=SeqID_99424
  Gene Ontology: Cellular component=membrane; Biological process=sulfur metabolic process
  Homolog annotation: Hit_ID=Q0VNB3; Match level="QueryCoverage=58%, HitCoverage=93%, E-value=1e-121, Identity=64%"; Hit description =Sulfonate ABC transporter periplasmic-binding protein
  Pfam annotation: Domain name=NMT1; Domain location=126-332; Score= -57.7; E_value=0.003; Accession=PF09084.1; Description=NMT1THI5 like
  Subcellular localization annotation: CTP_CleavageSite=34; ConfidenceScore=5.53e-01
MAKFDSLGKVLKNSAMAPAVQTAGLQCFTLVRACCTTVQRSLPASAALSDRGQPTSPHNLQWVTRVPIARCWSESDRPSSDGYTAGKKPGRKARTVALFSVPSLAAAKPSFKLCWSIYAGWMPWDYAQQSGIVKKWADKYGIDIQFVQVNDYIESVNQYTAGGFDGCTMTNMDALTIPATGGVDSTALIVGDYSNGNDGILLKGADSVSALKGKPINLVELSVSHYLLARALEKSGMSEKDVRVVNTADADLVAAFGTADVNAIVTWNPLLAEAEKQPDSHLVFSSAQIPGEILDLLVVNTATLNKYPQLGKALTGAWYETLHSMAGQSDSAKAARTQMAQASGTDLAGFDQQLAATHLFSDAKTTLDFVDSPQLKATMQLVAEFSFKHGLLGEGAPGADAVGVATPAGNWGDAGNIKLRFTDTFTKLAAAGQLQAAAGIQRHGRGHQPDGVSAQPAHRRVSAVERYRRQPAAFAEWCRYQRAAGTGNWPVHRRATGGARGAGAAGDAVCAGAAAGDSAHFVYLLWPWRSLQSGADRYRHHAADRPRSAAAGAENPAGAAGQSADA

SEQ ID NO: 216203 - protein, 895 aa, Glycine max
  Coding DNA Sequence Number=SeqID_99425
  Gene Ontology: Mol. function=nucleotide binding; Cellular component =membrane
  Homolog annotation: Hit_ID=Q0BRA8; Match level="QueryCoverage=42%, HitCoverage=95%, E-value=2e-76, Identity=52%"; Hit description =Hypothetical cytosolic protein
MACRVRMIRTAIAPRESPHADGNRRRVVTVTGIVELRTVGDQHQNVHLRHHLNILTRRGDAIGKRQAAVVGHRHIHKEVNVVRDIAARQARLRMRGDRQHPAVTAGVHVALFEVITHRITLARAGAAERIVTATGIGGDGQHRPIKIRTQHAAGREKHVVLAAQRLAHAVALGGIVGVEKQRIRRLIAFQIGNAQRLAGGNALQPVITGVDLLLQTRLRRTDFRQRRTLRIQRQLQRLARIIARRAERVRTAPAVIGAYLRKQIEAGCHVALAKAIFRQLDQEAVVAVLMAQVARLLIVADPIARGRLCRVQRAAHTLVPAETVVFNTAENAPHVRVETVAGGEPESVLALERVRRVIALQQVFRVIKQQAGAGAALHIGQRQRAAAAHDKRPVRPGGQQALQRRAECDPAAGPLFQIVGDHENGQLMLLPQLGDQLMHLAANTGIERAKRFIQQQNARLFHQRLRQGQTLLHAARQLMRIFALRLFQSDLRQHCLRALANRLTFASPDASQPACAAELVSQHHVAEHRQMRKHRVALKHHAAMGIRLVGNRCAIQQQLAFGRRFGAEQHIQKRGFAAAGGADNRHEFAALDLHIQPLQHHLIAVVEGKGQQGDPRHVRQNHIHGQIAAHQEDAITEAFRGRNRFGSNQEQPRRTERQPHRIAQARHQLRQNHPPQNLRAMRTQRLRFDQLLLRDFLHLQLQIAGDQRRDADNDQHHFGDFAKAKADKQNGQNRQRRYQRKQRHQRCQHRAHHRQRAGEQADCQRQQRADSNAAQQTQQAGGGIAPQQILAGARAGLKRHPADGLAHSVKSRQQFVCRVQAETRIRREQIDQQHRQQRQNAKQQAAERQRLLTGGGQFGEGVGKAQFDVAGIAPVTGRGSDPYRIGPRRAFAQQT

SEQ ID NO: 216204 - protein, 55 aa, Glycine max
  Coding DNA Sequence Number=SeqID_99426
  Gene Ontology: Mol. function=carbamoyl-phosphate synthase activity; Biological process=fatty acid biosynthetic process
  Homolog annotation: Hit_ID=Q1N576; Match level="QueryCoverage=98%, HitCoverage=4%, E-value=1e-12, Identity=64%"; Hit description =Allophanate hydrolase subunit 2
MIDRVLIANRGAIAVRIIRTLQAMNIRAIAVYAEADRHARHVRLADEAWSLGEGQ

SEQ ID NO: 216205 - protein, 197 aa, Glycine max
  Coding DNA Sequence Number=SeqID_99427
  Gene Ontology: Mol. function=hydrolase activity; Cellular component =membrane; Biological process=guanosine tetraphosphate metabolic process
  Homolog annotation: Hit_ID=Q2SJ02; Match level="QueryCoverage=85%, HitCoverage=91%, E-value=3e-40, Identity=52%"; Hit description =Guanosine polyphosphate pyrophosphohydrolase/synthetases
  Pfam annotation: Domain name=HD; Domain location=31-127; Score=28.1; E_value=2.1e-05; Accession=PF01966.12; Description=HD domain
MRDSLEEQARRYATQAHADAGQRRKYTDEPYIVHPAAVAELVRSVSDDEAMIAAAWLHDTVEDTASTLQDIEEHFGARVAHLVDMLTDSAQPQAKNRTARKLAHFRHTAEASPEAQTIKLADIIDNTRAIVQFDPNFARVYLVEKQIQIQLLQQGDRRLWQQANHIIEQGIAQLAKPPYSVPESWFVKQAAKYGGLS

SEQ ID NO: 216206 - protein, 154 aa, Glycine max
  Coding DNA Sequence Number=SeqID_99428
  Gene Ontology: Mol. function=transcription factor activity; Cellular component=intracellular; Biological process=regulation of transcription, DNA-dependent
  Homolog annotation: Hit_ID=UPI00005F904E; Match level="QueryCoverage =88%, HitCoverage=95%, E-value=9e-44, Identity=64%"; Hit description =COG1846: Transcriptional regulators
  Pfam annotation: Domain name=DUF24; Domain location=52-131; Score= -34.5; E_value=0.075; Accession=PF01638.8; Description=Transcriptional regulator
  Pfam annotation: Domain name=MarR; Domain location=45-114; Score =100.8; E_value=4.1e-27; Accession=PF01047.13; Description=MarR family
  Pfam annotation: Domain name=PadR; Domain location=44-118; Score= -14.1; E_value=0.044; Accession=PF03551.5; Description=Transcriptional regulator PadR-like family
  Pfam annotation: Domain name=Pencillinase_R; Domain location=45-145; Score=-22.3; E_value=0.018; Accession=PF03965.7; Description =Penicillinase repressor
  Pfam module annotation: Pfam domain module=DUF24::MarR::PadR::Pencilli nase_R; Domain location=52-131::45-114::44-118::45-145
MNSNQDDKKVKPAPLQLDQHLCFALYSANLAMHKVYRQLLAALEITYPQYLVMLVLWHQDDLTVSEIGEKLFLDSATLTPLLKRLESAGLLRRQRSRQDERQVVVTLTDQGRALQEKAASIPEAVQCATACDTDTMAALKQQLDDLRGNLNRAT

SEQ ID NO: 216207 - protein, 323 aa, Glycine max
  Coding DNA Sequence Number=SeqID_99429
  Gene Ontology: Mol. function=hydrolase activity; Cellular component =cytoplasm; Biological process=metabolic process
  Homolog annotation: Hit_ID=Q3KGM5; Match level="QueryCoverage=59%, HitCoverage=16%, E-value=3e-46, Identity=51%"; Hit description =Allophanate hydrolase subunit 2
  Pfam annotation: Domain name=Biotin_lipoyl; Domain location=121-197; Score=45.8; E_value=1.4e-10; Accession=PF00364.12; Description =Biotin-requiring enzyme
MEGPGGYQFVGRTLQMWNRDRRTSAFTQPWLLRFFDQIRFYPVSADELLQIRERFPWGDYPLRVEAGEFRLADYQALLTAQATEIDAFQQQRQQAFEAELARWRADGQFTFDSQLQAQSSEEVVVPAGCHSVESQVAGSVWQWLVAEGSDVTAGATVGILESMKMEIPIVAPVSGKIHSLQRQAGQQVQAGKTVSGYSLIRPVSAPGGAYLSTFTCFIVSFKEFSMEIKDPMVELLSSLEQIVLTRDAKTPVSEIALNTVSVPEPQRLREMTGMQVDEFARVMGVSVSSVKSWEAQRTRPSATARKLMKLLQANPYLGRQLLE

SEQ ID NO: 216208 - protein, 219 aa, Glycine max
  Coding DNA Sequence Number=SeqID_99430
  Gene Ontology: Mol. function=RNA-directed DNA polymerase activity; Biological process=RNA-dependent DNA replication
MEEILSFLHPQHSLRLSSFERSEWGNGSNPKPSIEEPPKLELKLLASSLKINTEEGFPPNQVDNCGKEMESLCEAFDEDYTPHYIAINEKLNALISQEESYPKYRQQTGLNKSFSLPKLTRPPLSSFQNHPTQKTMKDFKPISLCNVLFKIIFKSLANRLKPLLQKCISPEQSSFVEGRSILNNELIPFEFFHHMKCKTKGKTGEKALKIDISKAFDMV

SEQ ID NO: 216209 - protein, 137 aa, Glycine max
  Coding DNA Sequence Number=SeqID_99431
  Gene Ontology: Mol. function=nucleic acid binding; Biological process= DNA integration
  Homolog annotation: Hit_ID=Q1RSN0; Match level="QueryCoverage=71%, HitCoverage=14%, E-value=8e-16, Identity=43%"; Hit description=Zinc finger, CCHC-type
MEEGEYIQSMFECFQAILNELRYLGRTYDNYDYIDKILRSLSRKWRVLVTVLRALKNLDSMSFEKLVGALKVHEQELQHDEGPKREKSLALNSQKHKKVSLSKEKASRSSSKALKDDDSFDEEFEEEYDEDELTFIS

SEQ ID NO: 216210 - protein, 39 aa, Glycine max
  Coding DNA Sequence Number=SeqID_99432
MEMGESALLAIAYGKNKATKSQANQKGNGYAKPKETSGK

SEQ ID NO: 216211 - protein, 53 aa, Glycine max
  Coding DNA Sequence Number=SeqID_99433
MMAHQLGSTKIEENHSKCINLTRGKVYGELGIWLKACRTDGHDICQGVGLVQG

SEQ ID NO: 216212 - protein, 101 aa, Glycine max
  Coding DNA Sequence Number=SeqID_99434
MPLLVERPSLDGLEALLVLDTPKTLHLLRYCLHGGGIVLRRRDGVLCGGSVVLCLCDGVFRGGGAVLRCHDGALLSGFCVSVAEVQNSKSQDRIEVNENDK

SEQ ID NO: 216213 - protein, 79 aa, Glycine max
  Coding DNA Sequence Number=SeqID_99435
  Subcellular localization annotation: CTP_CleavageSite=33; ConfidenceScore=5.37e-01
MVHDIFIKVKLEVTGTSTALNVFGSRRSSDVTRAFRKMVTSILQLDSMNLFRKSTSLVQPHKPGNGNFDCQYFINISLG

SEQ ID NO: 216214 - protein, 85 aa, Glycine max
  Coding DNA Sequence Number=SeqID_99436
MTRAMLGENSLHKHLWVEAINMASYKNLYSRTLVMEESIHVRFNDELTSDRRLSNLEDDLVDMQRGLSYPNFVRGPSVCWDATLV

SEQ ID NO: 216215 - protein, 76 aa, Glycine max
  Coding DNA Sequence Number=SeqID_99437
MFFYRHSFNKCNVLASICRTYFLSSYLSILAFLLDSVRDNLVALARVVAFFLLVMGEWTVIELAPTAPPQVAVPPS

SEQ ID NO: 216216 - protein, 133 aa, Glycine max
  Coding DNA Sequence Number=SeqID_99438
MDMPSNDSTYYRHTALDWNLKKGHLLMLIIIKLRVVIELSITLASLQKLPSIGYAHGKGIYPIIEEVYPDTNVVSGSMVVQTSFYKKASGWKPHHSPTPLGSPFTISSDSEDSSDEFLRKLDEEAAKQRGRKM

SEQ ID NO: 216217 - protein, 123 aa, Glycine max
  Coding DNA Sequence Number=SeqID_99439
MVEEATIFVVDGEPVLEEVIVESIQAHSVLEAKQVELEELERLQSAVENGVEVISTDVATRQVELEVTLVLEGLKPLVKEALEEALVQSIIEAFLHESEDWVTEIDYGVRPIRFKPMSNTDER

SEQ ID NO: 216218 - protein, 134 aa, Glycine max
  Coding DNA Sequence Number=SeqID_99440
  Subcellular localization annotation: CTP_CleavageSite=35; ConfidenceScore=5.19e-01
MVEGNKYTNRKYLISLKGSIFLSFSIDVPPSFSPSSSTPPSHKVLSSLRLELFMGCDNSYPSSLELAQLIEGKPWMELNIISFPYLLQNLARMKTCKKTCALGGIQIGIEFWGPYADFVSLKCEGLNEGEPMLK

SEQ ID NO: 216219 - protein, 87 aa, Glycine max
  Coding DNA Sequence Number=SeqID_99441
MLGAPSSSLPPPTTNDEGETRGNNDNEGRKVVAVINGSQSGAVGEGKGEVVVVVICRGVLKCCPIITIDNSERWSKKFVGRRLKDSM

SEQ ID NO: 216220 - protein, 189 aa, Glycine max
  Coding DNA Sequence Number=SeqID_99442
MDNNTKKDKERECVKSLKAFEQMWNHTKHEKNRGEGPKAHQPFKGNEKNQRRNREQGPTCMGKETKVTRAVMEALAGTTRRKLALRVSTWRVASNRACPTVQPCPVTVEATNTASHRSRTRMHVWCESNAGHVGEVPRPYFLGFNLDNLCMCNPNISVQKLRFDMVREQGLVVFGSKEGVKKWCLNKVR

SEQ ID NO: 216221 - protein, 94 aa, Glycine max
  Coding DNA Sequence Number=SeqID_99443
  Subcellular localization annotation: CTP_CleavageSite=18; ConfidenceScore=5.00e-01
MRHAATAGAFLALSAPCRCRPRFDPFMDWPRERRAASSTVSFASPAGGGNGDAGTDDGCGSGSESGDANLKLVGDVAQELFRLSPDVIILDVSM

SEQ ID NO: 216222 - protein, 344 aa, Glycine max
  Coding DNA Sequence Number=SeqID_99444
  Gene Ontology: Mol. function=hydrolase activity, acting on carbon -nitrogen (but not peptide) bonds, in linear amidines; Cellular component=nucleus; Biological process=metabolic process
  Homolog annotation: Hit_ID=Q394Q5; Match level="QueryCoverage=100%, HitCoverage=81%, E-value=1e-102, Identity=55%"; Hit description =Amidase, hydantoinase/carbamoylase
  Pfam annotation: Domain name=M20_dimer; Domain location=191-297; Score=21.5; E_value=0.0013; Accession=PF07687.4; Description =Peptidase dimerisation domain
  Pfam annotation: Domain name=Peptidase_M20; Domain location=62-310; Score=64.1; E_value=4.6e-16; Accession=PF01546.18; Description =Peptidase family M20M25M40
  Pfam annotation: Domain name=Peptidase_M28; Domain location=59-231; Score=-54.7; E_value=0.045; Accession=PF04389.7; Description =Peptidase family M28
  Pfam module annotation: Pfam domain module=M20_dimer::Peptidase _M20::Peptidase_M28; Domain location=191-297::62-310::59-231
MAQIGGTPAGGVTRLALSEEDRIARNLLRDWALDAGFTCDVDSMGNMFIRRAGKNPQLAPVMTGSHVDTQPLGGNYDGVYGVLAGLELLRTLNDHNVETERDVVLVNWTNEEGARFAPAMLSSGVWTGQFSEAYAHARADNDGITVGEALDSIGYRGETPARAFPVHACYELHIEQGPILEDEAIDIGLVRAAMGQRWFTLTLDGFAAHAGTTPMHSRRDALTAFAELALKVEEIGYRHAPDGRATIGMAKVTPNSRNVVPSRVECSVEFRHPMQQALETMEAALHKVAESLSLRGVAAAVERIFDYAPIAFDAECLARSEKAVAELGYSSKPMVSGAGHDACY

SEQ ID NO: 216223 - protein, 186 aa, Glycine max
  Coding DNA Sequence Number=SeqID_99445
VFRKYGNIKEVFILAKKDKRKERFDFARFEDVGDERLQEGHKQESDGSWEDMKIWNECSLETEDPKDVGEYINEGTDWVFRWFEEITSWKTSHMDNEILVCLKATVQAWTYSFFKLLASLYKQFMYVKVVTEKKERLDVSRFVIRTNSLDLINYSVRDSIIGGSMLDGEAKAVCPGGVGRGGGEEW

SEQ ID NO: 216224 - protein, 165 aa, Glycine max
  Coding DNA Sequence Number=SeqID_99446
MAKRQLWHPGKGKAPLPSLKLSMIPGRILPERNVKIYHTEFGEFKAEMERRNLHKCLANLQDGSIDVAMVKEFYANLYNLEDQSPNQGRVRGHLIKIDANSLNTFLETLVVFEEGETLPTYSRFTRMRIDPQEFASRLCIPGRGFVLNAEGHPWKLPRKDLTTLA

SEQ ID NO: 216225 - protein, 132 aa, Glycine max
  Coding DNA Sequence Number=SeqID_99447
  Subcellular localization annotation: CTP_CleavageSite=30; ConfidenceScore=5.71e-01
MASPPASPHLPPPSPPPPPSDASALLFAVKRTRKASRLRSLSTRPPGAERPVVHVDPATDKPDGPHRKKLRTYLGIVAHDKVDVTYENWKEEEFEIPEASDSRTKKKLLQTVGERWRQFKSDLTRKWALVAD

SEQ ID NO: 216226 - protein, 171 aa, Glycine max
  Coding DNA Sequence Number=SeqID_99448
MRSWVRGQWISFDADAIGQLLGYPLVLEEGQECEYGQRRNRSDGFDEEAIAQLLKTSMQTPESLSSFNECPRPSSLAQPSLTAYECVVESRNASLNLMAGTILASSPHYFSAVEDYHACLMKNWLALATLRSKQNLPQSHCLYEQTNFVQPAYVEKIRYSFYANRLVTSMY

SEQ ID NO: 216227 - protein, 48 aa, Glycine max
  Coding DNA Sequence Number=SeqID_99449
EKLLNLRILTEGTEAYTVTEECLGIARSYIGQPTIGHKSRRRWHIDSH

SEQ ID NO: 216228 - protein, 66 aa, Glycine max
  Coding DNA Sequence Number=SeqID_99450
MYRRPLPTQGRRFPSSAPMSIDPMLQASWENFAFFCALTGLLAIFSERRLEGRKEVKGVNARVMEV

SEQ ID NO: 216229 - protein, 83 aa, Glycine max
  Coding DNA Sequence Number=SeqID_99451
MPRNFTDSLTMGVKYLEAVKRRLHASKQWSSDEIRDFNVLHFMFYKTSTSSVWSSRTSMSFCFFGFTSFVVSSVQFWIARSLI

SEQ ID NO: 216230 - protein, 109 aa, Glycine max
  Coding DNA Sequence Number=SeqID_99452
MASANTLITEAITTIHTENEPSINVEHFFDIQELEKKTIASKVLGVKVILSCDTIVKATRCLCEGSTYQEGWEKSYNSHVTRALYCDNTDKAGDPKTIVYNLMCEKAKI

SEQ ID NO: 216231 - protein, 162 aa, Glycine max
  Coding DNA Sequence Number=SeqID_99453
MEIQKYKNNIIHCIGNTKIAELIQENIGLDFIVHALSILIRLTKHKTNKRNDEGSDPRSQIYSASAPLLLFSFLLKSHPMQGELAQASFLLWLKGINLPRFKGSLQENYYGERISANNLIPETTEIWHVSTPPNLESCLSSSNKIRGNTGCIQAEENLIKGV

SEQ ID NO: 216232 - protein, 86 aa, Glycine max
  Coding DNA Sequence Number=SeqID_99454
MIHHSSSVNGEGTSHKDPLSIILDKLSSLKLWKEKLERKEKGKEREGIGHILDLTPIGEKRKESFKRLTLNSHTSIPKDNVEAYLD

SEQ ID NO: 216233 - protein, 191 aa, Glycine max
  Coding DNA Sequence Number=SeqID_99455
  Subcellular localization annotation: CTP_CleavageSite=97; ConfidenceScore=5.82e-01
MKTHNNMSSTSSKHLLYVSPSPNVINGSSNNSSSDSSGTGNPQPPPHPPPSSSSSVQKQREISYFTSKRMGCLFGSGGFRWRVVKEEVTMQGSLGLVVAAEGGYDGGVVMRRMEMMHVVIVSENHNASDLEGIRRCHNTNRKRNNQIGVFGKAGGWWLSVSRSRSTLKSKGRLCCQRRKCRKEKEKEKVMT

SEQ ID NO: 216234 - protein, 174 aa, Glycine max
  Coding DNA Sequence Number=SeqID_99456
MTSPHLGEANIGKIGQSLSPKVSNKRAHDPNTSKSEYKRERRPLLLMERKEPIDFSSHFYFEASGDSEEADFDPTFACEMAKADGGDVDDALSCNYDGSGACNVAEFDGCDESCDEHDGGVEKKEDDGVFGMSYCEDDEMQEEQMKSYVSFESGQESLDEMEKNRLFWEACLAS

SEQ ID NO: 216235 - protein, 325 aa, Glycine max
  Coding DNA Sequence Number=SeqID_99457
  Gene Ontology: Mol. function=peroxidase activity; Cellular component =vacuole; Biological process=response to oxidative stress
  Homolog annotation: Hit_ID=Q40487; Match level="QueryCoverage=91%, HitCoverage=90%, E-value=1e-98, Identity=59%"; Hit description =Cationic peroxidase isozyme 40K precursor
  Pfam annotation: Domain name=peroxidase; Domain location=42-289; Score=447.4; E_value=1.9e-131; Accession=PF00141.13; Description =Peroxidase
MLHPMIEEMHEIIVAQARAPPAGGSLRKKFYKDSCSQAEDIIKSKTQQHVSANPDLPAKLLRMHFHDCFVRGCDASVLLNSTANNTAERDAIPNLSLAGFDVIDDIKSELEAKCPKTVSCADILALAARDAVSVQFNKSMWEVLTGRRDGTVSNSNEALANIPAPFFNFTQLKQNFASKGLTLHDLVVLSGAHTIGIGHCNLFSNRLYNFTGKGDQDPSLNSTYAEFLKTKCQSLSDTTTTVEMDPGSSTNFDSDYYPNLLQNKGLFQSDAALLTEEQSEDIAKELVDQDKFFTEFAQSMKRMGAIDVLTDSAGEIRNKCSVVNS

SEQ ID NO: 216236 - protein, 157 aa, Glycine max
  Coding DNA Sequence Number=SeqID_99458
MVMPCHRQVQQTRHIIQSDVISLTGRSKHGQHNGPYKAKKGTNQLELLEMELVVAAIARQQGGHVLTQSLYDAFLQHLPLLTRCLHGEDGLHPKMKKGWEGKEGGRMGRRGLGNGLEGKEKGGSLCAKKGKRRREVLGKVGGKGRGKEEEGWVRNLN

SEQ ID NO: 216237 - protein, 127 aa, Glycine max
  Coding DNA Sequence Number=SeqID_99459
  Homolog annotation: Hit_ID=O80783; Match level="QueryCoverage=58%, HitCoverage=61%, E-value=1e-12, Identity=50%"; Hit description =Expressed protein
  Pfam annotation: Domain name=DUF584; Domain location=4-126; Score =62.6; E_value=1.3e-15; Accession=PF04520.4; Description=Protein of unknown function, DUF584
MKMLIEAIHMFEPMETIQRDTKVCIYKASHDWVVELAPPRRERENCRRRAANSMPVSISERTGRRQWGSTEEEAEEEEMTPSHEIVKRRVAAKMTFSVCMGNGRTLKGRDLSQVRNSILRLTGFLEA

SEQ ID NO: 216238 - protein, 640 aa, Glycine max
  Coding DNA Sequence Number=SeqID_99460
  Gene Ontology: Mol. function=phosphoprotein phosphatase activity; Cellular component=nucleus; Biological process=translation
  Homolog annotation: Hit_ID=Q8L7U5; Match level="QueryCoverage=98%, HitCoverage=70%, E-value=0.0, Identity=63%"; Hit description =Serine/threonine-protein phosphatase BSL1
  Pfam annotation: Domain name=Metallophos; Domain location=324-545; Score=118.8; E_value=1.6e-32; Accession=PF00149.18; Description =Calcineurin-like phosphoesterase
MEFIAKRSSKVFVGARLHVTGGVLRGGRSVEGEASIAVLDTAAGVWLDRNGIVSSSRSNKGHDYDPSLELMRRCRHAAAAVGVHIFIYGGLRGGSCGGGVLESSILPASIVRVWQTVVEVECWKVPHRLPQLLGCDILLDDFLVAENSPLQPDINSPERASPVTSSKQNQSNLNYNVTTPNLDGGPDIPSSGGSGMDKNSLEKLREASAAEAEAASAVWQAVQAISSNPAEETSVSDDNSQAVETVSDGSDTEGDVRLHPRAVVVAKEALGNLGGMIISTLLRPRNWKAPANRRFFLDSYEVGELCYAAEQIFMHEPTVLQLKAPVKVFGDLHGQFGDLMRLFDEYGFPSTAGDITYIDYLFLGDYVDRGQHSLETITLLLALKAGLFNFTLFNYLIEYPENVHLIRGNHEAADINALFGFRIECIERMGENDGIWAWTRFNQLFNYLPLAALIEKKIICMHGGIGRSINSVEQIEKLERPITMDTGSITLMDLLWSDPTENDSVEGLRPNARGPGLVTFGPDRVTEFCKKNKLQLIIRAHECVMDGFERFAQGQLITLFSATNYCGTANNAGAILVVGRGLVVVPKLIHPIPPPLQSPETSPERVMDETWMQELNIQRPPTPTRGRPQPDLDRGSLAYI

SEQ ID NO: 216239 - protein, 112 aa, Glycine max
  Coding DNA Sequence Number=SeqID_99461
MNKEYKTKHRLLFDMNRTDPKGCEQGRDHRTVCQSSTESGLTGYCAMGWLETPPTCHELAGNAAESSGSQIVCVEERRDQHYLALKRTSCNATGFHEHPIAMTLHNTSVAAL

SEQ ID NO: 216240 - protein, 455 aa, Glycine max
  Coding DNA Sequence Number=SeqID_99462
  Gene Ontology: Mol. function=structural molecule activity; Cellular component=basolateral plasma membrane; Biological process=protein amino acid phosphorylation
  Homolog annotation: Hit_ID=Q6AT64; Match level="QueryCoverage=94%, HitCoverage=84%, E-value=8e-39, Identity=31%"; Hit description =Putative ankyrin
  Pfam annotation: Domain name=Ank; Domain location=155-187; Score=7.3; E_value=2.8; Accession=PF00023.20; Description=Ankyrin repeat
  Pfam annotation: Domain name=Ank; Domain location=212-247; Score=2.2; E_value=15; Accession=PF00023.20; Description=Ankyrin repeat
  Pfam annotation: Domain name=Ank; Domain location=248-280; Score =31.1; E_value=3.8e-06; Accession=PF00023.20; Description=Ankyrin repeat
  Pfam annotation: Domain name=Ank; Domain location=281-313; Score =31.0; E_value=4.1e-06; Accession=PF00023.20; Description=Ankyrin repeat
  Pfam annotation: Domain name=Ank; Domain location=374-406; Score =41.6; E_value=2.7e-09; Accession=PF00023.20; Description=Ankyrin repeat
  Pfam annotation: Domain name=Ank; Domain location=407-439; Score =29.3; E_value=1.4e-05; Accession=PF00023.20; Description=Ankyrin repeat
  Pfam module annotation: Pfam domain module=Ank::Ank::Ank::Ank::Ank::An k; Domain location=155-187::212-247::248-280::281-313::374-406::407 -439
  Subcellular localization annotation: CTP_CleavageSite=89; ConfidenceScore=5.30e-01
MDRLVKADTKEVEMIFLKGQKCSSSFKLTNLMHTMSVAVSLTTTNSSLFSINKPFSTIPPLSTASYKLQLSQPSDQPPLSDPPDAITVRATMLPTGKATAADLRRFFSKPGPHVFRDAVLTVSLVGPHVAEFLISQTPQSRNLFAKSISACTKPQLMRLLKPAVECGSTDAVADLLNAGADATATTESLMPLAIRVGNLHAVKLLEASGCKIDGSSLHEAAAMDRIDAMEFLLARYDGELDVDAVDSEGRTAIHVAAREGHARVIQFCVAMGGNPNRVDSKGWTPLHYAAWKGHVKAAECLLECSNVKCARDREGRTAFSVAAESEHEQSHARTRLVDLLGWGDALLRAVRVDDVHGVKKCLGEGVSVNGRDQNGWTPLHWAAFKGRIKSLKVLLEHGAEVETVDDAGYTPLHCAAQAGHLQVALYLIAHGASQPNLKSFPHLAHPFQNHSFTLI

SEQ ID NO: 216241 - protein, 271 aa, Glycine max
  Coding DNA Sequence Number=SeqID_99463
  Gene Ontology: Mol. function=DNA binding; Cellular component =cytoplasm; Biological process=rRNA processing
  Homolog annotation: Hit_ID=Q8LH68; Match level="QueryCoverage=95%, HitCoverage=50%, E-value=1e-43, Identity=39%"; Hit description =Transducin /WD-40 repeat protein family-like protein
  Pfam annotation: Domain name=WD40; Domain location=117-156; Score =20.8; E_value=0.0048; Accession=PF00400.22; Description=WD domain, G- beta repeat
  Pfam annotation: Domain name=WD40; Domain location=160-199; Score =38.6; E_value=2.1e-08; Accession=PF00400.22; Description=WD domain, G-beta repeat
  Pfam annotation: Domain name=WD40; Domain location=204-241; Score =28.4; E_value=2.5e-05; Accession=PF00400.22; Description=WD domain, G-beta repeat
  Pfam annotation: Domain name=WD40; Domain location=75-113; Score =12.2; E_value=1.4; Accession=PF00400.22; Description=WD domain, G -beta repeat
  Pfam module annotation: Pfam domain module=WD40::WD40::WD40::WD40; Domain location=117-156::160-199::204-241::75-113
  Subcellular localization annotation: CTP_CleavageSite=17; ConfidenceScore=5.06e-01
MEEARVQKNFPVKPKLKSMARTPKQTPESKYWSSFKTQQIPNLISVPSLTFSPTPPHSFAAAHSASLTLYSSQTLSPAATISSFSDAVSCASFRSDSRLLAASDLSGLVQVFDVKSRTALRRLKSHFRPVRFVHFPRLDKLHLISAGDDALVKLWDVAEETPVSEFLGHKDYVRCGDSSPVNSEIFVTGSYDHVVRLWDARVRDSKSSVQVNHGAPVEDVVFLPSGGMVATAGGNSVKIWDLIGGGKLVYSMESHNKTVTSICVGRIGKDY

SEQ ID NO: 216242 - protein, 50 aa, Glycine max
  Coding DNA Sequence Number=SeqID_99464
MEYARISSNVMKSASLLVTRYGLMDGGVPYFSTIFCCLMIVFGSSHAFIP

SEQ ID NO: 216243 - protein, 319 aa, Glycine max
  Coding DNA Sequence Number=SeqID_99465
  Homolog annotation: Hit_ID=O24467; Match level="QueryCoverage=80%, HitCoverage=69%, E-value=1e-31, Identity=54%"; Hit description =LEC14B homolog
  Pfam annotation: Domain name=WD40; Domain location=144-183; Score =0.7; E_value=30; Accession=PF00400.22; Description=WD domain, G-beta repeat
  Pfam annotation: Domain name=WD40; Domain location=255-293; Score =33.4; E_value=8.2e-07; Accession=PF00400.22; Description=WD domain, G-beta repeat
  Pfam module annotation: Pfam domain module=WD40::WD40; Domain location=144-183::255-293
MQMFFSRKDLNFLRFRTRRFYEHFAGDKMHQHYKILRASVNSYGSHIRIYNVDRGWKVQKNILAKNLRWTITDTSLSPDQRYLVYASMSPIVHIVNAGSAETESLANVTVITTNATPPAPTNSINIAIALNATKYYRAIDIKKLDFHDMCQSFLSDVNTVRFADETSHLIYSGSDDSFCKFGYFTHKYGRSIQRVSLLVQELMSIAMLLIYNKIQIQLCPHFHKGGRIKTSCVSYYCSSIVSMLYNWENIIQVSGAQVATLKHHKSPLRDCSWHPFHTTLVSSSWDGDVVKWEFAGSGDTPASSTKKRVWTRHFYEHYL

SEQ ID NO: 216244 - protein, 47 aa, Glycine max
  Coding DNA Sequence Number=SeqID_99466
MCAPPSELFVRLRTRKDVWKVWAKIKVGFVEILQDIILKFNRDCLNL

SEQ ID NO: 216245 - protein, 53 aa, Glycine max
  Coding DNA Sequence Number=SeqID_99467
MEQRKAGEKTVERREQRRNHKRMFYLASPLQQTTIIAIFNVVPLLVTIYSGYR

SEQ ID NO: 216246 - protein, 63 aa, Glycine max
  Coding DNA Sequence Number=SeqID_99468
MVLKTRMDKETVGVEDGSKTVLSVAGPTLTLPQYFIIYCLFSHGHRICFLEFEVVYPKHKTVF

SEQ ID NO: 216247 - protein, 167 aa, Glycine max
  Coding DNA Sequence Number=SeqID_99469
  Gene Ontology: Mol. function=protein serine/threonine kinase activity; Biological process=protein amino acid phosphorylation
  Homolog annotation: Hit_ID=Q8LI83; Match level="QueryCoverage=83%, HitCoverage=22%, E-value=1e-12, Identity=33%"; Hit description =Receptor protein kinase PERK1-like protein
MVKNKKGKGREQNLFSLGGGIVVVRGELKGEQALGGAGVGGAEAVGESGGVDKSVVGAVGEVSDGVSQWRERGKRRGAEGAGGVVLERLVAVVTDVLEGWLRDQGLEVLFGGDVVAALGDPRGLETAGGGDIVGWVEVVNVGLEVGPACVGGVEGREEEAAAAEVVG

SEQ ID NO: 216248 - protein, 144 aa, Glycine max
  Coding DNA Sequence Number=SeqID_99470
  Gene Ontology: Mol. function=RNA-directed DNA polymerase activity; Biological process=RNA-dependent DNA replication
MMRKLRQGGCFWEIFGGCLEDMNLFYNKKSRFKWSKKGNGNTKFYHSMVKWRRKQCEVKGLEIEGVWEEDPSKVKKDINEFFQNKFKKSVMSRPTLDGVDFESIGESENQSLCARFSEEEFYDNDGRIVQADETSGEDSKLPRV

SEQ ID NO: 216249 - protein, 367 aa, Glycine max
  Coding DNA Sequence Number=SeqID_99471
  Gene Ontology: Mol. function=protein serine/threonine kinase activity; Cellular component=membrane; Biological process=protein amino acid phosphorylation
  Homolog annotation: Hit_ID=Q8LI83; Match level="QueryCoverage=91%, HitCoverage=53%, E-value=1e-134, Identity=67%"; Hit description =Receptor protein kinase PERK1-like protein
  Pfam annotation: Domain name=Pkinase; Domain location=22-296; Score =130.2; E_value=5.7e-36; Accession=PF00069.15; Description=Protein kinase domain
  Pfam annotation: Domain name=Pkinase_Tyr; Domain location=22-296; Score=86.7; E_value=7.2e-23; Accession=PF07714.7; Description =Protein tyrosine kinase
  Pfam module annotation: Pfam domain module=Pkinase::Pkinase_Tyr; Domain location=22-296::22-296
MEQSTTLIRFTFDDIKKATKNFSRDNIVGRGGYGNVYKGLLPDGSEVAFKRFKNCSASGDASFTHEVEVIASVRHVNLVALRGYCSVTTRLEGYQRIIVCDMVKNGSLHDHLFGSNGMKLSWPIRQKIALGTARGLAYLHYGAQPAIIHRDIKASNILLDDKFEAKVADFGLAKFNPEGMTHMSTRVAGTMGYVAPEYALYGQLTERSDVFSFGVVLLELLSGRKALQMNNDGQPSALTDWAWSLVRTGKALSVIEDGMPQPGSEQVLEKYVLIAVLCSHPQLYARPTMDQVVKMMETDESVPSIPERPIPLVAGRLDIERSVSSSGSGQLSSPTGYQSYTIESDRQSSNSRDERSSSSSSRILSTD

SEQ ID NO: 216250 - protein, 100 aa, Glycine max
  Coding DNA Sequence Number=SeqID_99472
  Homolog annotation: Hit_ID=Q1SKD7; Match level="QueryCoverage=97%, HitCoverage=28%, E-value=2e-08, Identity=32%"; Hit description =Ankyrin
MAPKKLSAKRSRRDAAAEGTSAAPEFDSHRFRSIEHQQCFEAIKGWDDEYTDFQEEIARRNWTSLVTPMAKFDPDIVLEFYANAWPVEEGVRDMRSWVRG

SEQ ID NO: 216251 - protein, 1010 aa, Glycine max
  Coding DNA Sequence Number=SeqID_99473
  Gene Ontology: Mol. function=protein kinase activity; Cellular component=cytoplasm; Biological process=protein amino acid phosphorylation
  Homolog annotation: Hit_ID=Q1L881; Match level="QueryCoverage=78%, HitCoverage=74%, E-value=2e-72, Identity=28%"; Hit description=Novel protein
  Pfam annotation: Domain name=HEAT; Domain location=542-578; Score =13.2; E_value=0.96; Accession=PF02985.12; Description=HEAT repeat
  Pfam annotation: Domain name=HEAT; Domain location=581-618; Score =3.9; E_value=14; Accession=PF02985.12; Description=HEAT repeat
  Pfam annotation: Domain name=Pkinase; Domain location=39-342; Score =11.2; E_value=3.1e-09; Accession=PF00069.15; Description=Protein kinase domain
  Pfam annotation: Domain name=Pkinase_Tyr; Domain location=39-342; Score=-158.3; E_value=0.0092; Accession=PF07714.7; Description =Protein tyrosine kinase
  Pfam module annotation: Pfam domain module=HEAT::HEAT::Pkinase::Pkinas e_Tyr; Domain location=542-578::581-618::39-342::39-342
MSLNMKTLTQALAKTAAVIEKTVQTTVQEVTGPKALQDYELLDQIGSAGPGLAWRLYSGRARDPSRQHQYPVVCVWVLDKRTLSEARMRAGLTKAAEDSFLDLIRMDASKLVRLRHPGVVHVVQALDESKNAMAMVTEPLFASAANTLGIVDNILNLPKDLRGMEMGILEVKHGLLQIAESLDFLHNHAHLIHRSISPENILITLSGAWKLAGFGFAVSATQTSGDSSNLQPFHYAEYDVEDSILPLQPSLNYTAPELVRSTVSSAGCSSDIFSIGCLAYHLIARKPLFDCHNNVKMYMNTLTYLSSDAFSSIPSELVPDLQRMLSPNESSRPTAMDFTGSVRPKELRHPAAPQRAIMPGLSGVGKSRCTAILTSVPLMAALASSCSEKRDDQNHSPNRPNPKRQSFYEPAGLTKPSGHTGSVHYKDWKCIRITVTWVEMEWERDNMQKSEFLKALSDMWKDFDSRVLRYKVLPPLCAELRNVVIQPMILPMVLTIAESQDKNDFEQSTLPALVPVLSSAAGETLLLLVKHAELIINKTSQEHLVSHVLPMIVRAYDDTDARLQEEVLKKSVSLVKQLDAQLVKQVVLPRVHGLALKTTVATVRVNALLCLGDMVNQLDKHAVLDILQTIQRCTAVDRSPPTLMCTLGVANSIFKQYGVEFVAEHVLPLLIPLLTAQQLNVQQFAKYMLFVKDMLHKIEEKRGVAVTDSGTPEIKLSPVVNGLQSEATRTSSSSVPASTKNSSWDEDWGPKPKGTASSIQNSIDATSQSMAGNPVDQVTSLQKHLSLAALSAKQTAKSCPSVDVEWPPRASSGVTPQFGDTERQTIAAGTSSTSNLESDDPFADWPPHPNGSVSGGSGISNNGTLGMPLNKVGFNSMTSTSSNMAPQTSNSWPVNSQSSAESISLNSRSASSTTGSLNTGGLGQQKSLGFLKQSQAFPASNVSYNNVQSTATDLGSIFSSNKNEQIAPKLAPPPSTTVGRGRGRGRGAASTTRSSHTKSHAEQPPLLDLL

SEQ ID NO: 216252 - protein, 88 aa, Glycine max
  Coding DNA Sequence Number=SeqID_99474
  Gene Ontology: Mol. function=ribonuclease activity
  Homolog annotation: Hit_ID=Q9LZA0; Match level="QueryCoverage=94%, HitCoverage=10%, E-value=3e-19, Identity=57%"; Hit description =Ribonuclease II-like protein
MPFDIYMHVKAFLRGKPPPFTAGKLEGIAAVVNENVRTVRKLCSSSLRYWILEYLRRQPKERTYRALVLRFLKDRIAALLLLEISGEM

SEQ ID NO: 216253 - protein, 275 aa, Glycine max
  Coding DNA Sequence Number=SeqID_99475
  Gene Ontology: Mol. function=translation initiation factor activity; Cellular component=membrane; Biological process=translational initiation
  Homolog annotation: Hit_ID=Q6YVX8; Match level="QueryCoverage=92%, HitCoverage=42%, E-value=1e-99, Identity=72%"; Hit description =Putative Ligatin
  Pfam annotation: Domain name=SUI1; Domain location=182-265; Score =104.2; E_value=3.8e-28; Accession=PF01253.13; Description =Translation initiation factor SUI1
MAEHGRRPKIRHISMPLHLMISVKEDKHKEEVMLFSVNRKHADYSSFKPEKRRVEKSEQHSVQSANEIRSSKTLEVAEIYKPSVHVNSIFSPVGADTGKLFSASEATDIVFKYVEKENLVKPTNKSVVVLDVILCDALFKGAIKKGTTYPTEIHKKDLGSTFVSRMQPHHVVTRGNESVVCKGALKTIQLLTERRQGNKKVTKLSGMESFLIDAEALASELQKKFACSTTVAELPGKKGHEVLVQGGVIDDLARHLIEQYGVPKRYIEVLDKTKK

SEQ ID NO: 216254 - protein, 221 aa, Glycine max
  Coding DNA Sequence Number=SeqID_99476
  Gene Ontology: Mol. function=ribonuclease activity; Cellular component=nucleus; Biological process=regulation of transcription, DNA-dependent
  Homolog annotation: Hit_ID=Q9LZA0; Match level="QueryCoverage=97%, HitCoverage=25%, E-value=5e-64, Identity=61%"; Hit description =Ribonuclease II-like protein
  Pfam annotation: Domain name=RNB; Domain location=60-221; Score=52.1; E_value=4.9e-15; Accession=PF00773.9; Description=RNB-like protein
MGLAKTASSAVKLLIDIGYFPVHINLDLLKLGIPTDHSDEIISAAQSLLLDSSDPDEIDRKNLTDLKVYAIDVDEADELDDALSATKLQDGRIKVWIHVADPTRYVQPGSIVDREAMRRGTSVFLPTATYSMFPENLAMGGMSLRQGELCNAVTVSVVLHNDGSIAEYSVFNSVIKPTYMLTYESASELLHLNLQEEGELRILSEAANLRSNWRRQQISKL

SEQ ID NO: 216255 - protein, 289 aa, Glycine max
  Coding DNA Sequence Number=SeqID_99477
  Homolog annotation: Hit_ID=Q513P3; Match level="QueryCoverage=91%, HitCoverage=40%, E-value=5e-08, Identity=21%"; Hit description=Viral A-type inclusion protein repeat, putative
MEEYLQHMKALRFQMNDVEDEAAKISVEEEMQLTNIRTLENDFQFAKSGITKLNEDTEKMKAAKGEICSKILDKQKRIATLESDTTKLSQTLELIQQERVGLAAKLSEKRAYYNKVAEDMNAKLQKQQEWNNSKKISRERKKRDLVTEKAAGQRSKVEGMALNFRKDGADGNLVMDNMGSDVRKDLIIELDNAKATLDGILALKAKVLTENNKIKRAIEDVKCRENEFKPELKAADITALEEECTALISDKAGEAEYLQSLEKQVEKLEQIRHVVKCACGEEYTVAVNM

SEQ ID NO: 216256 - protein, 832 aa, Glycine max
  Coding DNA Sequence Number=SeqID_99478
  Gene Ontology: Mol. function=transferase activity, transferring phosphorus-containing groups; Cellular component=endoplasmic reticulum; Biological process=two-component signal transduction system (phosphorelay)
  Homolog annotation: Hit_ID=O81122; Match level="QueryCoverage=84%, HitCoverage=97%, E-value=0.0, Identity=81%"; Hit description =Ethylene receptor
  Pfam annotation: Domain name=GAF; Domain location=140-289; Score =84.4; E_value=3.5e-22; Accession=PF01590.16; Description=GAF domain
  Pfam annotation: Domain name=HATPase_c; Domain location=437-567; Score=129.4; E_value=9.8e-36; Accession=PF02518.16; Description =Histidine kinase-, DNA gyrase B-, and HSP90-like ATPase
  Pfam annotation: Domain name=HisKA; Domain location=325-390; Score =84.7; E_value=2.9e-22; Accession=PF00512.15; Description=His Kinase A (phosphoacceptor) domain
  Pfam annotation: Domain name=Response_reg; Domain location=595-706; Score=39.9; E_value=8.5e-09; Accession=PF00072.14; Description =Response regulator receiver domain
  Pfam module annotation: Pfam domain module=GAF::HATPase _c::HisKA::Response_reg; Domain location=140-289::437-567::325 -390::595-706
MESCNCIDPQVPADDLLMKYQYISDFFIALAYFSIPLELIYFVKKSAVFPYRWVLVQFGAFIVLCGATHLINLWTFRIHSRTVAVVMTTAKVLTAVVSCATALMLNKAAELDREMGLIRTQEETGRHVRMLTHEIRSTLDRHTILKTTLVELGRTLALEECALWMPTRTGLELQLSYTLRQQNPVGYTVPIHLPVINQVFSSNRAVKISPNCPVARLRPYAGKYMPGAVVAVRVPLLHLSNFQIYDWPEVSTRSYALMVLMLPSDSARQWHVHELELVEVVADQVAVALSHAAILEESMRARDQLIEQNVALDLARREAETAIRARNDFLAVMNHEMRTPMHAVIALSSLLQETDLTAEQRLMVETILKSSNLLATLINDVLDLSRLEDGSLQLEAATFNLHSLFREVLNLIKPVASVKKLSLTSHVASDLPMYAIGDEKRLMQTILNVVGNAVKFSKEGCISITAFVAKPESFRDARIPDFLPVPSDNHFYLRVQVKDSGSGINPQDIPKLFTKFAQNQSLTRNPAGSGLGLAICRRFVNLMEGHIWVESEGIGKGCTVTFIVKLGIPDRSNEFKLPFVPKVPGNHGSTNFAGLKVLVMDDNGTVTKGLLMHLGCDVTTASSSEECLRVVSLEHEVVFMDVCTGLDGYELAVRIHEKFTKHQDRPLIVALTGNTKKVTKENCMRVGMDGLILKPVSVDKMRGDVNVCADELGVLQPHKSQIQNSDVAFAELLFKMIDSTEAISKERAAMEPMLEENSVTDTTVVHHDGDMFIQDWSKAKNLDRDINQPQQRILQDRWSPPQEDNFKFNIDASFYSEERTALLWVLAFEQFG

SEQ ID NO: 216257 - protein, 698 aa, Glycine max
  Coding DNA Sequence Number=SeqID_99479
  Gene Ontology: Mol. function=solute:hydrogen antiporter activity; Cellular component=integral to membrane; Biological process =regulation of pH
  Homolog annotation: Hit_ID=Q1SU06; Match level="QueryCoverage=77%, HitCoverage=97%, E-value=0.0, Identity=66%"; Hit description =Sodium/hydrogen exchanger
  Pfam annotation: Domain name=Na_H_Exchanger; Domain location=25-329; Score=-17.3; E_value=0.0014; Accession=PF00999.11; Description =Sodiumhydrogen exchanger family
  Subcellular localization annotation: CTP_CleavageSite=29; ConfidenceScore=5.02e-01
MDATHSMFCNNDLVNPLSSMGMQVSCILVVSHVFNVVFRTVGQPGPIAQILAGLVLGPMSHIEYIKATFFPASSINYYEVVSYFCRIHFMFLFGLEMNIHYTMRNLRIVSLVACGGAIMGGVFGLSVSFYLHQQLNTIDNAPLYYFCMIIMLVVSYTSSPMVIRLAAELRYLAVWLNTRNTNQKYLKAPELMLILLLLLTCSMIIEIWGYNSIISCFIIGLLFPKEGLQCDLINVFKSLERAINMAILILLSIGSKLGGTLIVCRYLKIPTSEGIFLGFILNTRGYADLLFIGAAAKQTFDSEAYNVLLVSIVLNTIISGVIVAFLVRGEEKMFANNHTAIEPQQMEDELRILACVYDPRQVSAILATVLAIHGSRVSPSTTYLMHLIELVKKIKSNLLYHEKENADLSDDEDYGGNDVVEINNALDNFTAETKILVQQRRAVSPFPSLYEDVCNEAEDLQVSIILLPFHKHQRIDGKLESGKEGIRITNQKVLRHAPCSVGIIVERGLARVPGFSQLVASEAIQNVATLFFGGPDDREAIAWSLRISGSPRVNLTIIRFLLSSSSQNEIIESGESEDKEILMSLSGEETVNEIDNTFMVDFYNRYVTSGQIGYVEKFVKDGAQTVESLKEIGDMYSLFIVGKGGRGQSSLTIGMSDWEECPELGTVGDVLASSDFDIHGSVLIVQQHRDAKKALLHA

SEQ ID NO: 216258 - protein, 272 aa, Glycine max
  Coding DNA Sequence Number=SeqID_99480
  Gene Ontology: Mol. function=ribonuclease activity
  Homolog annotation: Hit_ID=Q9LZA0; Match level="QueryCoverage=95%, HitCoverage=29%, E-value=5e-76, Identity=56%"; Hit description =Ribonuclease II-like protein
MGLLNEELAEDRLVNHSLQKGLLLEFKKDSDRVLLAVAQRPDGKKNWMVSDQNGFTSSIKPQQVTYIVPGIDNFDQADIADFAQKAQDNMDPSLLEFAWVELLEKNKSVTVEELAEIIFGSTEALESYSAHLLLSKDEVYFTVLETKGFRSVYGPRPSGQGKKRVPYPPKFMIIYFFHDCFRKRGKLLWVEELIHQKLAKEAVEKEFQEFIELLASVKSMSSQDKPPKHSWTKDERIWSRIESLEAYAIDACKNDEQRKTAGMVTFSLKALF

SEQ ID NO: 216259 - protein, 301 aa, Glycine max
  Coding DNA Sequence Number=SeqID_99481
  Gene Ontology: Mol. function=DNA binding; Cellular component=nucleus; Biological process=regulation of transcription, DNA-dependent
  Homolog annotation: Hit_ID=Q8H0H3; Match level="QueryCoverage=97%, HitCoverage=92%, E-value=5e-60, Identity=45%"; Hit description =Hypothetical protein B25
  Pfam annotation: Domain name=Myb_DNA-binding; Domain location=10-57; Score=38.5; E_value=2.3e-08; Accession=PF00249.21; Description=Myb -like DNA-binding domain
  Pfam annotation: Domain name=Myb_DNA-binding; Domain location=64-109; Score=49.3; E_value=1.3e-11; Accession=PF00249.21; Description=Myb -like DNA-binding domain
  Pfam module annotation: Pfam domain module=Myb_DNA-binding::Myb_DNA -binding; Domain location=10-57::64-109
MERELLEIKKGPWSSDEDEVLLRHVSKYGPREWSSIRSKGLLSRTGKSCRLRWVNKLRPNLKTGCKFTAEEERLVVELQAQFGNKWAKIATYLQGRTDNDVKNFWSSRRKRLERMLQKPPTSKPHKNNGKTHINQVEEMVPPCSSNQVEEILSYSTSYMGNTQVFEMINLPDLIKPNYQQLENDYLSAVEVEATPLHTVPSFESSLGYNFPLLPEPDPLMDCPLFPECQDLVPEPFDPIFVDGFKEKKCSECVCSSQKLGTRLPTFGLEGNSQSASSNGFFKDFPSEIFEYFEHIPTSSDQ

SEQ ID NO: 216260 - protein, 109 aa, Glycine max
  Coding DNA Sequence Number=SeqID_99482
MPMEDEMVAAPHCFAKVRGRIIIRHLSFAYIKKLFLNSNRVLHVLGVDSSNKGKNVEVVTKLDEEDTIKHNGIGGVEGVEGEKWWMRSHRLIFPFIQSLCNVRVLDEWQ

SEQ ID NO: 216261 - protein, 102 aa, Glycine max
  Coding DNA Sequence Number=SeqID_99483
  Gene Ontology: Mol. function=oxidoreductase activity
  Homolog annotation: Hit_ID=P93619; Match level="QueryCoverage=97%, HitCoverage=91%, E-value=1e-11, Identity=79%"; Hit description=Ted2 protein
MWKSESRVRNKAVGVNFIDVYFRTGVYKVPSLPYTPGPYSLAYFIDYDLTDIGEPRGYMVFAKVASGVLKVWANRTYPLSEAAKAHEDLENQKTMGSVVLLP

SEQ ID NO: 216262 - protein, 73 aa, Glycine max
  Coding DNA Sequence Number=SeqID_99484
MTAGDPPQQKTSQGNEKKKEDENITQGDPPQEERSPRIEIEEELKNITEGDPPKQKRSQGNEKKIEDDNITQG

SEQ ID NO: 216263 - protein, 50 aa, Glycine max
  Coding DNA Sequence Number=SeqID_99485
MVSKQKTEVAASREQKEVIRECRKQDAVGVHVGEALITLGMSSYAATQII

SEQ ID NO: 216264 - protein, 102 aa, Glycine max
  Coding DNA Sequence Number=SeqID_99486
  Gene Ontology: Mol. function=metalloendopeptidase activity; Cellular component=membrane; Biological process=proteolysis
  Homolog annotation: Hit_ID=Q0VJ93; Match level="QueryCoverage=58%, HitCoverage=15%, E-value=2e-09, Identity=49%"; Hit description=CAAX peptidase
MVTHGTATTLNLQALAEEIKARYDKAAVKVVDLILTLLQFGGYTLVQNSVDLYRSFGFDTQPVLIGLIIFQNVSELCIDDWVGHGFEYGNNLFVYARIRVHK

SEQ ID NO: 216265 - protein, 110 aa, Glycine max
  Coding DNA Sequence Number=SeqID_99487
MEKIIVSVQMHERCDGTQEISGYRTYLYLFQHGLHWLGVMMVQAGASHIVGWVGWSTSNPIGKVLALKVVRYCSAVVLICGGACVSDMSKGGVSLGIAMHACLSKSTGAF

SEQ ID NO: 216266 - protein, 106 aa, Glycine max
  Coding DNA Sequence Number=SeqID_99488
MTGNITKGHLLHVNKEIVGVNLKNIVQDVKSSCYANLTQFHEDILIDGGFRIENSIAQQQRDIVGVNLENIVQDVKCSRYANLAQFHEDTLTDEGVYVDNCVAQQK

SEQ ID NO: 216267 - protein, 853 aa, Glycine max
  Coding DNA Sequence Number=SeqID_99489
  Gene Ontology: Mol. function=zinc ion binding
  Homolog annotation: Hit_ID=Q9ZT97; Match level="QueryCoverage=92%, HitCoverage=96%, E-value=1e-113, Identity=34%"; Hit description =Putative inhibitor of apoptosis
  Pfam annotation: Domain name=zf-C3HC4; Domain location=799-838; Score= 6.3; E_value=0.036; Accession=PF00097.15; Description=Zinc finger, C3HC4 type (RING finger)
METMRASGLLSEFQILEIPHFALSLAVLGRDRELIGKGFVGFSVIVPEMDKTDDGEDRQDKGCKNKRKLTHPSILPASFPSSLIEFPRYQLPVPQSGLNGFSPSELWAELFREDEPELYMHELVDWNDPIASQLEELLLSNLQAIFSGALKRVVELGFDARLVEMSLSRKALYIEEGDPVSNIVHQTVNVLKGEDDTITDFIFDNFQHLLHYTMVEMISVVREVRPSLTVGEAMWLLLICDLNLSLACAVEDRLSVVCNGENSTSSSSPQSNCSSPTFQKDLSTNHQNQKSEEPKFGSFQNSANNQGPHASGGVKIKAENASLPITAETSSGTSGIPAHECKSGPCSKRHNRKEIAALRQRFLHMEKTYRSCGKGSFKSGKVTNVSSLVVEKRLKPPSEIPNQQMKCGSSNMISTKGVRSANVACHVSNNDASVLPAGGKSGTLPAKDTISTSRMVNANTSTPGNMSKPKSELSFSVKILDYCADIPFDEALGKYVPRDEKDRLILKLITRVQELQNELHGWNNWTNQKVMQVTNRLGKLQAEFKTLRKEKQDAELLKKDKKIVEENAVKRISEMENAMENTKKQIESAASATLVLEAENSLLKKELDAAKLWVVKSMTSHQQALEREQMALKQAQILESQNSLLRDELEREKHKLFNLQQELHKETNLQAKVEGRLAKERAAKEKLLAQAASIKKEREQLEQHMKSEEDMARKKAATDLQKYVEDIGKLEKELVDLKLKSDSEKIAALRRCVDVRNDSFSRTKSAPNMKGNKKSDTSQTLVSYQDKLAAGSLRREQECVMCLSEEMSVVFLPCAHQVVCPECNELHEKQGMKECPSCRAPIQRRIHARFARH

SEQ ID NO: 216268 - protein, 70 aa, Glycine max
  Coding DNA Sequence Number=SeqID_99490
  Subcellular localization annotation: CTP_CleavageSite=34; ConfidenceScore=5.11e-01
MSRQPLFQDLQWKPKTTSSLPSRLPKPPNPKFMKASIERFLLDGSDTHDAFRQYVIFVGYGDLRLGFMDA

SEQ ID NO: 216269 - protein, 369 aa, Glycine max
  Coding DNA Sequence Number=SeqID_99491
  Gene Ontology: Mol. function=DNA topoisomerase (ATP-hydrolyzing) activity; Cellular component=integral to membrane; Biological process=DNA topological change
  Homolog annotation: Hit_ID=Q017L1; Match level="QueryCoverage=84%, HitCoverage=13%, E-value=2e-24, Identity=28%"; Hit description=[S] KOG1893 Uncharacterized conserved protein
MTKCCNGICLFFVLICVIWAPMLGLDFFQYTPSHLDTSWAWCVDNNGFYYPMFLVVPLMYSSGNPTNIANPIKDASFQVDIKTVSGRLNLYQTTLCERLRWDLLNSNANPDPYGYLDAYNKNDIQLICCQADASTLWLVPLVVRTRLIHSLEWNTDMEIFFTWIFSRDRPKGKEVVKYEKAVDPQYLPTQSDVQKVLNGSMNSFRIYNVYPRYFRVTGSGDVRPLEEDNALSADLILNREQFEWWAFRDFNPSNLSGLCGGLTGPMAIIISEETPPQGILGDTLSKFSIWGLYITFVLAVGRFIRLQCADLRMRIPYENLPSCDRLIAICEDIYAARAEGELGIEEVLYWTLVKIYRSPHMLLEYTKPD

SEQ ID NO: 216270 - protein, 672 aa, Glycine max
  Coding DNA Sequence Number=SeqID_99492
  Homolog annotation: Hit_ID=Q017L1; Match level="QueryCoverage=34%, HitCoverage=9%, E-value=6e-08, Identity=20%"; Hit description=[S] KOG1893 Uncharacterized conserved protein
  Subcellular localization annotation: CTP_CleavageSite=41; ConfidenceScore=5.24e-01
LIVDDPRMLISYFVVFMLACFKLRADRLPSFSGSSTYRQIMSQRRNTFVWRDLSFETKSMWTFVDYLRLYCYCHLLDLVLILILITGTLEYDILHLGYLAFALIFFRMRLEILKKKNKIFKFLRIYNFAVIIISLAYQSPFIGGPSAGKCETANNIYEMIGFYKYDYGFRITARSAIVEIIIFVLVSLQSYMFSSQEFDYVCRYLEAEQIGAIVREQEKKAAWKTAQLQQIRESEEKKQQRNMQVEKMKSEMLNLQTQLHSMNTSTNCIDGFSHNNEGLRRRRSVSLASNNDIGIPDKEDQVLGRLDHTIREDSVYPINLHEPSVCTNVETPSTEEYMKHSVDSDFCEITEVDIDTTSSDSGKREKFKGQAKENPLKSAVQLIGDGVSQVQFIGNQAVNNLVSFLNISPEDSDSNEHSNIEDSIYDEMESQKTQHIYMDRSSSVQSDKSSDAARLQLGRIFRYIWHQMCSNNDVFKRTDLHAKDDRTSYNWQDRAWDLLNQVSMDVNFWPEDGIQPERIESGINQVLRIVHNDKCKAKNPNLCSFASRVVYASPVIDCSSTEWNKSLTPASDVAKEILKAQRAGFVEEMGFPYRILSVIGGGKREIDLYAYIFCADLIVFFLVAIFYQSVIKNKSEFLEVYQLEDQFPKEYVFMLMLKLLELLVPDVVLEVL

SEQ ID NO: 216271 - protein, 224 aa, Glycine max
  Coding DNA Sequence Number=SeqID_99493
MWLSKLIDLYFYLGYDSKASSFDNVWESLAVLIVMQLYSYERRKNKQNRQDHLDQLEPGALGFIRRFIIWHSQKILFIALFYASLNSISAFGFLYLVGLIFCSILPKTSSIPSKSFLAYTGFLVTAEYVFQMWGKQAKMFPGQKYSDISLFLGFHVFQPGFWGLESGLRGKVLVIVACTLQYNVFRWLERMPNTVLSKGQWEEPCPLFVPTEDVFIDDAMCNEE

SEQ ID NO: 216272 - protein, 103 aa, Glycine max
  Coding DNA Sequence Number=SeqID_99494
MGGGGSIFLAGLLLEELGGNLLPFFPINRLRGAVLRVPDPPGDVFQLFWVKKNCFREENPSRGASVMFPRCFCKQIREGFPPLFTVLHPFFVLQRVSFQIRDF

SEQ ID NO: 216273 - protein, 175 aa, Glycine max
  Coding DNA Sequence Number=SeqID_99495
MGKFLAGFVLPSLLLSAALINWSLISLIDLIAFLLILYNVSQLGFHIHRRFLLLWPIVIFSVVAILSQVTYLVIWAVKPMPWSTPDASWAKLIGFMIVQTWKSPYVIYFLVIQLLALLVALVDIYGKRDFLKTWQDPSWGHFISIMEHLVFSLLCVFISYAPGVDMQYEMSTVGI

SEQ ID NO: 216274 - protein, 181 aa, Glycine max
  Coding DNA Sequence Number=SeqID_99496
  Gene Ontology: Mol. function=metal ion binding; Cellular component =endoplasmic reticulum lumen; Biological process=auxin mediated signaling pathway
  Homolog annotation: Hit_ID=Q49RB8; Match level="QueryCoverage=87%, HitCoverage=82%, E-value=2e-80, Identity=83%"; Hit description=Auxin- binding protein 1
  Pfam annotation: Domain name=Auxin_BP; Domain location=14-181; Score =402.2; E_value=7.7e-118; Accession=PF02041.7; Description=Auxin binding protein
  Pfam annotation: Domain name=Cupin_2; Domain location=60-140; Score =37.4; E_value=4.8e-08; Accession=PF07883.2; Description=Cupin domain
  Pfam module annotation: Pfam domain module=Auxin_BP::Cupin_2; Domain location=14-181::60-140
MSVLSSFHAVHAVDSRPCSGWLPLVRNISEIPQDNYGRAGLSHMTVAGSLLHGMKEVEVWLQTFSPGTHTPIHRHSCEEVFIVLKGSGTLYLASDSHGRYPGKPQEHFIFPNSTFHIPVNDAHQLWNTNEHEDLQVLVIISRPPVKVFVYEDWSVPHTAAKVKFPYYWDEQCYQEPPKDEL

SEQ ID NO: 216275 - protein, 84 aa, Glycine max
  Coding DNA Sequence Number=SeqID_99497
MHTCACTGISCDSKEQNRLRPRSEVKTSQWQKSTKVLREGGEWRIGSRPTNRHPFPVLGQRRTSLQGSPVSFEFAVFYYYCLFF

SEQ ID NO: 216276 - protein, 47 aa, Glycine max
  Coding DNA Sequence Number=SeqID_99498
MGIEEVRDADACIPIPTKEDKQVPKGPMKLVDRPDNDPIYQMTLMIP

SEQ ID NO: 216277 - protein, 204 aa, Glycine max
  Coding DNA Sequence Number=SeqID_99499
  Subcellular localization annotation: CTP_CleavageSite=15; ConfidenceScore=5.25e-01
MTTPPSFPPPESAPSLSMLKRTRKVTQLRSLSVRPAGVERPLVHMDPTTGKADGPHKKKIRTYLGVIAWDKSDLTSKWALAEGKKGDDDKVCEKYGFSKEKWNQFCQSHKDPSWEDVRKNAQSIQKQSTIPHMLSHEEHPDHVRATGAGVTIRQYFGPSSAGSHTLLVSAEREAVLTSQGWTHTWLHQIGMGRMLMTILPPGCP

SEQ ID NO: 216278 - protein, 110 aa, Glycine max
  Coding DNA Sequence Number=SeqID_99500
MDAEFMERCIPRSLVEWDNVVTWLCSLRNNLNNYLKGMINSALKGFNDNDGSKSKATAKWIPIKNHQKRAGGVLSKNGGANSNHAHLDPPEDFSRRLLLLEEATLLAWAS

SEQ ID NO: 216279 - protein, 831 aa, Glycine max
  Coding DNA Sequence Number=SeqID_99501
  Gene Ontology: Mol. function=protein serine/threonine kinase activity; Cellular component=cell surface; Biological process =protein amino acid phosphorylation
  Homolog annotation: Hit_ID=Q0ZCC5; Match level="QueryCoverage=87%, HitCoverage=35%, E-value=1e-170, Identity=45%"; Hit description=CCHC- type integrase
  Pfam annotation: Domain name=B_lectin; Domain location=82-204; Score =33.6; E_value=7.1e-07; Accession=PF01453.15; Description=D-mannose binding lectin
  Pfam annotation: Domain name=Pkinase; Domain location=535-805; Score =163.3; E_value=6.2e-46; Accession=PF00069.15; Description=Protein kinase domain
  Pfam annotation: Domain name=Pkinase_Tyr; Domain location=535-805; Score=130.9; E_value=3.5e-36; Accession=PF07714.7; Description =Protein tyrosine kinase
  Pfam module annotation: Pfam domain module=B_lectin::Pkinase::Pkinase_ Tyr; Domain location=82-204::535-805::535-805
  Subcellular localization annotation: CTP_CleavageSite=64; ConfidenceScore=5.60e-01
MASSTFLHSYSLLLLIILPFLPSVFSATSSNCSANSIHLNSTLVTNHTWNSPSGLFAFGFQNVLSNKEFMSVLAVWFPKDPHRTIVWYAKYKQTSDLGTMHAVSSMQKSLAFPSDSTVKLTNKGIVLYDQNGQEMWHRPKNNSIALVRCASMLDSGNFVLLDETGKHVWESFEEPTDTFLPGQILAKPKSFRARHSNTSFYDGSFELAWQSDYNFVLYYSPQSSVTREAYWATQTNSYDESLLVFNESGHMYIKRSNTGKVIREVLYGGSEEFLYMARIDPDGLFRLYRHRKDDDTIADSCSSGWWSVVDRYPKDICLSITMQTGNAICGYNSYCITINGNPSCECPDIFSSFDHDNNLKTCRPDFPLPSCNKDGWEQNKDLVDFKEYQNLDWPLSDYDKLVGTAMDKDMCRQKCLEDCFCAVAIYGEGQCWKKKYPLSNGRKHPNVTRIALVKIPKTGLNKDGTGSLGNGREQSTIVLVISILLGSSVFLNVILLVALFAAFYIFYHKKLLNSPNLSAATIRYYTYKELEEATTGFKQMLGRGAFGTVYKGVLKSDTSRYVAVKRLDKVVQEGEKEFKTEVSVIGQTHHRNLVRLLGYCDEEEHRLLVYEYMNNGSLACFLFGISRPHWNQRVQIALGIARGLTYLHEECSTQIIHCDIKPQNILLDELFTPRIADFGLAKLLLAEQSKATKTGLRGTVGYFAPEWFRKASITTKVDVYSFGVVLLEIICCKSSVSFAMASEEETLIDWAYRCYSQGKVAKLVENDEEAKKDIKRVEKHVMVAIWCIQEDPSLRPSMKKVTQMLEGVTTVSLPPRPAIFSSSSFETSFTL

SEQ ID NO: 216280 - protein, 130 aa, Glycine max
  Coding DNA Sequence Number=SeqID_99502
MWKLGEKAQRQGGWRMKPFMPKTRCDNRTWKCNKRPTKPKQLSRLKRKISGIWRGKSQWSSQGISTLHDGHVEHGSEPFDPKDTTIQRGFSDNYIARFDHFSYAFVAQFAANKEKTLLTVNLFDVPKQSG

SEQ ID NO: 216281 - protein, 516 aa, Glycine max
  Coding DNA Sequence Number=SeqID_99503
  Homolog annotation: Hit_ID=Q680Q1; Match level="QueryCoverage=83%, HitCoverage=96%, E-value=1e-101, Identity=48%"; Hit description=MRNA, complete cds, clone: RAFL22-41-F10
  Pfam annotation: Domain name=ENT; Domain location=62-135; Score =152.7; E_value=9.6e-43; Accession=PF03735.5; Description=ENT domain
MVIFASQIQGLDLVVMIAGTDDDLPPTHQNRISRGGGGRLAGNGRSAVASIPYPRMYGEIDMETQIHQLEQEAYSSVLRAFKAQADAITWEKESLITELRKELRLSNEEHRELLGRVNADDVIRRIREWRQAGGHQPGVLSTGQGLHDSIPSPTVSASRKKQKITPSVPPSRSFGGPSPPFHPQTVTAPHQPSSSAAKRGSAPGSKGKKHKPGQILPGVSSMKQYPSSGPGGRNQVSNRAVMGEHAEGASFDSLVGRRVRTRWPDDNNFYEAVITNYNPADGRHNLVYDMGSANETWEWVNLSEFVIKCSEVSISLFGKWMGMISPEDIQWVGEDPGINHRGGFGGPGHGMNRSVGRDGVPGAGRGRGAAKGQSRKDFLSSQNGLGKKVHDDIQILHTDTLIKEVERVFSANHPDPLEVEKAKKVLKDHEQALIDAIAKLNDLSDGESGTSQFQYLIALCGVVDSKIATVILFVGIWGCNNLAYVARRVGKTGNCRSKNKNGGKTGNVGGEHPSDD

SEQ ID NO: 216282 - protein, 369 aa, Glycine max
  Coding DNA Sequence Number=SeqID_99504
  Gene Ontology: Mol. function=zinc ion binding
  Homolog annotation: Hit_ID=Q1SJ34; Match level="QueryCoverage=99%, HitCoverage=91%, E-value=3e-72, Identity=42%"; Hit description=Zinc finger, RING-type
  Pfam annotation: Domain name=zf-C3HC4; Domain location=94-134; Score =17.6; E_value=0.0024; Accession=PF00097.15; Description=Zinc finger, C3HC4 type (RING finger)
DRIRRLEAITSRTRQYSSWPLFHTPIQITNSTGQTSALADAREEEMPSREVEERVVESGRGFKRKGAHLVAKALGRIETDANKEGGSTGNFYDCNICLDRARDPVLTCCGHLFCWPCFYQVQIVYSNARECPVCKGEVTETGIFPIYGNSSADGSCESGLKGAGLRIPPRPAAPRIESFRQQLISQGASSSVILNIRRFHHLIGGLGARVQSQNPNAATDRNNGLLAQSRPPSSNDRGTGSSQTPISTLLVQGAASFSSLSSALNSAMDSAERLVEDLESYFHNHQTNGVNTSSTHNGNVAATDSTPAASTSPFSRNVDTTANIGSEIQTTDNNIQTETSTLDPSSSRRGSTRVSTSRQVTNDRRRRSR

SEQ ID NO: 216283 - protein, 1394 aa, Glycine max
  Coding DNA Sequence Number=SeqID_99505
  Gene Ontology: Mol. function=transmembrane receptor activity; Cellular component=membrane; Biological process=defense response
  Homolog annotation: Hit_ID=Q1T2S2; Match level="QueryCoverage=94%, HitCoverage=96%, E-value=0.0, Identity=50%"; Hit description=TIR; Disease resistance protein; AAA ATPase; Tumor Necrosis Factor
  Pfam annotation: Domain name=LRR_1; Domain location=568-593; Score =6.5; E_value=17; Accession=PF00560.23; Description=Leucine Rich Repeat
  Pfam annotation: Domain name=LRR_1; Domain location=634-653; Score =9.4; E_value=4.9; Accession=PF00560.23; Description=Leucine Rich Repeat
  Pfam annotation: Domain name=LRR_1; Domain location=657-679; Score =8.4; E_value=7.6; Accession=PF00560.23; Description=Leucine Rich Repeat
  Pfam annotation: Domain name=LRR_1; Domain location=681-700; Score =3.3; E_value=69; Accession=PF00560.23; Description=Leucine Rich Repeat
  Pfam annotation: Domain name=LRR_1; Domain location=704-726; Score =2.3; E_value=1e+02; Accession=PF00560.23; Description=Leucine Rich Repeat
  Pfam annotation: Domain name=LRR_1; Domain location=751-772; Score =4.9; E_value=35; Accession=PF00560.23; Description=Leucine Rich Repeat
  Pfam annotation: Domain name=LRR_1; Domain location=805-828; Score =1.0; E_value=1.9e+02; Accession=PF00560.23; Description=Leucine Rich Repeat
  Pfam annotation: Domain name=LRR_1; Domain location=830-851; Score =12.8; E_value=1.2; Accession=PF00560.23; Description=Leucine Rich Repeat
  Pfam annotation: Domain name=LRR_1; Domain location=853-874; Score =13.6; E_value=0.74; Accession=PF00560.23; Description=Leucine Rich Repeat
  Pfam annotation: Domain name=NACHT; Domain location=205-360; Score= -18.3; E_value=0.0015; Accession=PF05729.3; Description=NACHT domain
  Pfam annotation: Domain name=NB-ARC; Domain location=164-458; Score =97.9; E_value=3e-26; Accession=PF00931.13; Description=NB-ARC domain
  Pfam annotation: Domain name=TIR; Domain location=17-143; Score=85.8; E_value=1.3e-22; Accession=PF01582.10; Description=TIR domain
  Pfam module annotation: Pfam domain module=LRR_1::LRR_1::LRR_1::LRR _1::LRR_1::LRR_1::LRR_1::LRR_1::LRR_1::NACHT::NB-ARC::TIR; Domain location=568-593::634-653::657-679::681-700::704-726::751-772::805 -828::830-851::...
  Pfam module annotation: Domain location=853-874::205-360::164-458::17- 143
MAISGYAPMFSDFSYDVFLSFSGGTSNPFVDPLCRALRDKGISIFRSEDGETRPAIEEIEKSKMVIVVFCQNYAFSTESLDELVKIREYVDNRRKQVWTIFYIVEPSDVRKQRNSYKDAMNGHEMTYGKDSEKVKAWREALTRVCDLSGIHCKDHMFEAELQKIVEAASCKLFRVPGQMNHAVGLDDHFEQVKAFIDVESNDKVGVLGIYGGGGIGKTTFAVYLYEKIRHYYFEAASFLIKVREQSKESKNHLEDLQNRLLSQLGVDTGTMIGSTNKGELEIKHRLGHRRVLLVLDDVDSKEQLELLAGKHDWFGSGSRIIITTRDEAVLDYGVKVKKYKMTELNDRHSLELFCQNAFDKPEPAKNFESISHRAIGYAKGVPLALQVIGSNLKGRSIEEWEIELGKYRKVPNAKIQGVLKLSFDSLPETEMGIFLDIACFFKGEKWNYVKRILKASDISFKVLASKCLIMVDRNDCLEMHDLIQDMGREIVRNQSPSNPGDRSRLWSHEDVLEVLKKDSVTILLSPIIVSITFTTTKGSITIEGIMLHPPKLEVVDKWTDTAFEKMKNLRILIVRNTKFLTGPSSLPNKLQLLDWIGFPSESFPPKFDPKNIVDFKLSHSSLVSIKPPQKVFQNLTFVNLSQCHFITKIPDMFEAKNLRVLTIDKCPKLEGFHPSAGHMPNLVYLSASECTMLTSFVPKMNLPYLEMLSFNFCSKLQEFPEVGGKMDKPLKIHMINTAIEKFPKSICKVTGLEYVDMTTCRELKDLSSFVSLPKLVTLKMNGCSQLAESFKMFRKSHSEANSCPSLKALYLSKANLSHEDLSIILEIFPKLEYLNVSHNEFESLPDCIKGSLQLKKLNLSFCRNLKEIPELPSSIQRVDARYCQSLSTKSSSVLLSKIYKEREKIQVVMPETEIPKEFDSKDVLLFWARRKFPVVAFVFVFEEVKKNDDIQMDTSELFPGVVSAEESYTVGLNLFIDGKEICRKDHHYWSIGDQHLLVCDLQVLFKNEEWQDLGDDWKAFQIQCESTLTLSHQEVYVDKQKTNTDDIQYISPNLTGLVPKTSPHKKTRHGQNCDVIEKFGQNLLIQTTSVANVLLSWWRNAKADIRGEVSASTYEASSLQEHEDVVWDVAQILEMLLENLPQHITDSEVQRTGLLAVESLIARAQHKKEYGHEKLHINLTMPIVLVECRCHPHKELEGAQNLRYWGSVELEEGDPRVWKIWKSNEAFKERLNYTVLLKCEHHSREEASKSDHGESLEEEHKGSELQALMRRIEEDTIRLNKSYGKLKASIVPMDVLVSDKYLLETAIIRGLERLGRLGSNFNKTEYGKLRVEHHAHSITHMEHELRMEQDAQSSTQNQERHELGVEHDAQSSTQEKNKLGWIRSLLGGFGRQSR

SEQ ID NO: 216284 - protein, 555 aa, Glycine max
  Coding DNA Sequence Number=SeqID_99506
  Gene Ontology: Mol. function=nucleotide binding
  Homolog annotation: Hit_ID=Q1T2S1; Match level="QueryCoverage=99%, HitCoverage=100%, E-value=0.0, Identity=67%"; Hit description=H+ -transporting two-sector ATPase, delta (OSCP) subunit; Hypothetical plant protein
  Pfam annotation: Domain name=DUF246; Domain location=168-510; Score =630.1; E_value=1.8e-186; Accession=PF03138.5; Description=Plant protein family
  Subcellular localization annotation: CTP_CleavageSite=50; ConfidenceScore=5.56e-01
MAKSKNNAKKLSYISVPSQIINSISSSSLQSLLESPKKCARHSKFFTFVKCMRPRLFFLFTLFFLAFFAMLKFGLNLDTPFPPFPCAPSIGPTKSNLGALDGGDVSVSEAMISSVQLHGAQVPSGVVEDKSEFWEQPDGLGYKPCLDFSREYRRESEGVVMNRRRYLMVVVSGGMNQQRNQIVDAVVIARILGASLVVPILQVNVIWGDESEFADIFDLEHFKSVLVNDVRVVSALPSTHLMTRPVEGSPLPHATPSWIRSHYLRRFNREGVLLLRGLDSRLTKDLPPDLQKLRCKVAFQALRFAKPVQELGNDIAEQMKSKGPYLALHLRMEKDVWVRTGCLPGLSPEYDEIVNNERIKRPELLTAKSNMTYHGRKLAGLCPLNALEVTRLLKGLGAPKNARIYWAGGQPLGGKEALQPLINEFPHLYSKEDLALPGELEPFANKASLMAAIDYIVSEKSDVFMPSHGGNMGHALQGHRAYAGHKKYITPNKRQMLPYFLNSSLPEKEFNRIIKELHQDSLGQPELRTSKSGRDVTKYPVPECMCNDDSHHHSS

SEQ ID NO: 216285 - protein, 1025 aa, Glycine max
  Coding DNA Sequence Number=SeqID_99507
  Gene Ontology: Mol. function=nucleoside-triphosphatase activity; Cellular component=membrane; Biological process=defense response
  Homolog annotation: Hit_ID=Q1SVC8; Match level="QueryCoverage=96%, HitCoverage=93%, E-value=0.0, Identity=39%"; Hit description=TIR; Disease resistance protein; AAA ATPase
  Pfam annotation: Domain name=LRR_1; Domain location=562-584; Score =3.2; E_value=73; Accession=PF00560.23; Description=Leucine Rich Repeat
  Pfam annotation: Domain name=LRR_1; Domain location=606-626; Score =2.3; E_value=1.1e+02; Accession=PF00560.23; Description=Leucine Rich Repeat
  Pfam annotation: Domain name=LRR_1; Domain location=639-660; Score =2.9; E_value=83; Accession=PF00560.23; Description=Leucine Rich Repeat
  Pfam annotation: Domain name=LRR_1; Domain location=662-684; Score =9.3; E_value=5.1; Accession=PF00560.23; Description=Leucine Rich Repeat
  Pfam annotation: Domain name=LRR_1; Domain location=709-731; Score =6.8; E_value=15; Accession=PF00560.23; Description=Leucine Rich Repeat
  Pfam annotation: Domain name=LRR_1; Domain location=733-754; Score =6.9; E_value=15; Accession=PF00560.23; Description=Leucine Rich Repeat
  Pfam annotation: Domain name=LRR_1; Domain location=756-778; Score =5.8; E_value=24; Accession=PF00560.23; Description=Leucine Rich Repeat
  Pfam annotation: Domain name=NACHT; Domain location=216-370; Score= -22.1; E_value=0.003; Accession=PF05729.3; Description=NACHT domain
  Pfam annotation: Domain name=NB-ARC; Domain location=179-472; Score =149.4; E_value=9.7e-42; Accession=PF00931.13; Description=NB-ARC domain
  Pfam annotation: Domain name=TIR; Domain location=20-153; Score =161.3; E_value=2.4e-45; Accession=PF01582.10; Description=TIR domain
  Pfam module annotation: Pfam domain module=LRR_1::LRR_1::LRR_1::LRR _1::LRR_1::LRR_1::LRR_1::NACHT::NB-ARC::TIR; Domain location=562 -584::606-626::639-660::662-684::709-731::733-754::756-778::216 -370::179-472::20-153
MIKQPTPSLCSFTCGWTYDVFLSFSGIDTRHSFTDNLYNSLKQRGIHAFIDDEGLRRGEEITPTLLKAIRESRIGIIVFSKSYASSTYCLDELVEILECLKVEGRLVWPVFYDVDPSQVRYQTGTYAEALAKHKERFQDDKGKVQKWRKALHEAANLSGWHFQHGSESEYKFIKKIVDEASKKINRTPLHVADNPVGLESSVLEVMSLLGSGSEVSMVGIYGIGGIGKTTVARAAYNMIADQFEGLCFLADIREKAISKHRLVQLQETLLSDILGEKDIKVGDVSRGIPIIERRLRKKKVLLILDDVDKLVQLQVLAGGYCWFGSGSKIIITTRDKKLLATHGVVKLHEVKQLNDEKAFELFSWHAFKRNKFDPSYVDILNRAVFYACGLPLALEVIGSHLFGKSLDECNSALDKYERIPHRGIHDILKVSYDGLEEDEKGIFLDIACFFNTCNMRFVKQMLHARGFHAEDGIRVLSDKSLIKIDESGCVKMHDLIQHMGREIVRQESKLKPRKRSRLWLDEDIVRVLEENKGTDKIEAIMLNVRDKKEVQWSGKAFKKMKNLKILVIIGQAIFSSIPQHLPNSLRVLEWSSYPSPSLPPDFNPKELEILNMPQSCLEFFQPLKACISFKDFSFNRFESLISVNFEDCKFLTELHSLCEVPFLRHLSLDNCTNLIKVHDSVGFLDNLLFLSAIGCTQLEILVPCIKLESLEFLDLTECFRLKSFPEVVGKMDKIKDVYLDKTGITKLPHSIGNLVGLERLYLRQCTQLYQLPISIHILPNVEVITDYGKRGFQLFEGYHEDKEKVSSEKSPSAMVDYNEGSFIYLDLCFPYISFHNVIEVCSPNPLECHNFGFLFKLLQAGSLNWYKPGSRTSSMQFWFRKKFPKIALCFSVEAYINRASWVLDFEFTLLINGTKQFSSSCNYITCKWNPILWCDLQCKEEGVFSKHEWNEVEILCDVKYPIPCGERVMVTARNKIGSLNWSLIYVYEEGNNMEDVEFKSSMLSFPFFGVKPMSSLPGCLYYQVV

SEQ ID NO: 216286 - protein, 156 aa, Glycine max
  Coding DNA Sequence Number=SeqID_99508
  Gene Ontology: Mol. function=oxidoreductase activity; Cellular component=chloroplast; Biological process=electron transport
  Homolog annotation: Hit_ID=Q5SGC9; Match level="QueryCoverage=50%, HitCoverage=12%, E-value=1e-19, Identity=61%"; Hit description =Zeaxanthin epoxidase
MVMFFNSFHLAGLPPPQEVLALAAKHKGYEVKVFEKDVSTFRGEGRHRGPIQPLSGALAVLEAIDQSVARQIMEDGSVTANRTNGLANGVSGDRYKVFLGLNQYFVASDVSQGKKRLLDLSLRDICDRGMINTWGIGRVTLLGDAAHPMQPNQSIF

SEQ ID NO: 216287 - protein, 1381 aa, Glycine max
  Coding DNA Sequence Number=SeqID_99509
  Gene Ontology: Mol. function=transmembrane receptor activity; Cellular component=membrane; Biological process=defense response
  Homolog annotation: Hit_ID=Q1T2S3; Match level="QueryCoverage=95%, HitCoverage=97%, E-value=0.0, Identity=51%"; Hit description=TIR; Disease resistance protein; KRAB box; Calcium-binding EF-hand; Tumor Necrosis Factor
  Pfam annotation: Domain name=LRR_1; Domain location=558-583; Score =7.3; E_value=12; Accession=PF00560.23; Description=Leucine Rich Repeat
  Pfam annotation: Domain name=LRR_1; Domain location=623-644; Score =8.1; E_value=8.8; Accession=PF00560.23; Description=Leucine Rich Repeat
  Pfam annotation: Domain name=LRR_1; Domain location=646-668; Score =7.3; E_value=13; Accession=PF00560.23; Description=Leucine Rich Repeat
  Pfam annotation: Domain name=LRR_1; Domain location=693-712; Score =8.1; E_value=8.8; Accession=PF00560.23; Description=Leucine Rich Repeat
  Pfam annotation: Domain name=LRR_1; Domain location=740-767; Score =8.1; E_value=8.8; Accession=PF00560.23; Description=Leucine Rich Repeat
  Pfam annotation: Domain name=LRR_1; Domain location=794-817; Score =7.3; E_value=12; Accession=PF00560.23; Description=Leucine Rich Repeat
  Pfam annotation: Domain name=LRR_1; Domain location=819-840; Score =3.9; E_value=54; Accession=PF00560.23; Description=Leucine Rich Repeat
  Pfam annotation: Domain name=LRR_1; Domain location=842-863; Score =12.9; E_value=1.1; Accession=PF00560.23; Description=Leucine Rich Repeat
  Pfam annotation: Domain name=LRR_2; Domain location=794-818; Score =16.3; E_value=0.093; Accession=PF07723.3; Description=Leucine Rich Repeat
  Pfam annotation: Domain name=NACHT; Domain location=214-365; Score= -17.9; E_value=0.0014; Accession=PF05729.3; Description=NACHT domain
  Pfam annotation: Domain name=NB-ARC; Domain location=176-470; Score =75.6; E_value=1.5e-19; Accession=PF00931.13; Description=NB-ARC domain
  Pfam annotation: Domain name=TIR; Domain location=18-151; Score =124.6; E_value=2.7e-34; Accession=PF01582.10; Description=TIR domain
  Pfam module annotation: Pfam domain module=LRR_1::LRR_1::LRR_1::LRR _1::LRR_1::LRR_1::LRR_1::LRR_1::LRR_2::NACHT::NB-ARC::TIR; Domain location=558-583::623-644::646-668::693-712::740-767::794-817::819 -840::842-863::...
  Pfam module annotation: Domain location=794-818::214-365::176-470::18- 151
MANLNHGATFRDDFFYDVFLSFRGGTRYGFTNRLYNALRQKGIYTFRDTEELRIGADIRPALLKAIENSRMSMVVLCEDYASSTWCLDELAKIIQCYHANKPKQVLLIFYKVQPSDVWDQKNSYAKAMADHENRFAKQPEKVKNWRKALSQLRHLTREYCKDDGYEAELIKKIVKDTSAKLPPIPLPIKHVVGLDSRFLDVKSMIHIESHDTVLILEIYGAGGIGKTTFALDIYNNIRHEFEAASFLANVREKSNKSTEGLEDLQKTLLSEMGEETEIIGASEIKRRLGHKKVLLVLDDVDSTKQLESLVGGGDWFGSRSRIIITTRDTTLLDEHVIDDVVIETYEMKALNYGDSLELFCWHAFNMSKPAENFEGVSNDAVRYAKGHPLALKVIGSNLKGGSLKDWEMELEKYKMIPNAKIQEVLEISYHSLDVLDQKIFLDIACFFKGERRGYVERILKACDFCPSIGVFTAKCLITIDEDGCLDMHDLIQDMGREIVRKESSINAGDRSRLWSHEEVLRVLIENSGSNRIEGIMLDPPSHEKVDDRIDTAFEKMENLRILIIRNTTFSTAPSYLPNTLRLLEWKGYPSKSFPPDFYPTKIVDFKLNHSSLMLEKSFKKYEGLTFINLSQCQSITRIPDVSGAINLKVLTLDKCRKLKGFDKSIGFMRNLVYVSALRCNMLKSFVPSMSLPSLEVLSFSFCSRLEHFPDVMEEMDRPLKIQLVNTAIKEFPMSIGKLTGLEYLDISGCKKLNISRKLFLLPKLETLLVDGCSHIGQSFKRFKERHSMANGCPNLRTLHLSETNLSNEELYAILKGFPRLEALKVSYNDFHSLPECIKDSKQLKSLDVSYCKNLSSIPELPPSIQKVNARYCGRLTSEASNSLWSKVNEEKERIQFVMAETDIPDWFEFDCVGGSDSPTPLMLARNKFPIIAVAFALGKAKSGYSETELSRTLGLHVFVGDGYPKRELSYTAAVHLYIGGKEICRKEYHYCCVGEEHVLLCDLMVLFSDQEWEGLDAHFTGDDEWRVIQVQCESDLPLSQWGVFVYKQKTNTDDILFTNTRHNCLLTNLVQKETPWKSEQRRRHFFNNFNLREIYGDRLTLYGESLDQCQLFSSNMVFRHILADIIKGKLVSACDYGASLMQAHDESSGDVKHTMKIYKERLDDTQATYGLMELGLEAREELSWAEGEDRLVVEFAIILEEEDGNRRYWGTLKLKAGEAGFDEMERKELQFLCLRRAFMSYTSAQKESMLVVLLKREEASTSGQGEEEGEWQEYDPILEELMSEIAEDATRLSKSYGKLKASIVPVTSDNLVSDKYSLEGIFLNAIVKLEDGKWGPTKIQLGYAVIRMLICGQCPPGLFGTKELDFSGDVMTDLAAQTSPS

SEQ ID NO: 216288 - protein, 479 aa, Glycine max
  Coding DNA Sequence Number=SeqID_99510
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q1T2S0; Match level="QueryCoverage=95%, HitCoverage=95%, E-value=0.0, Identity=75%"; Hit description =Glycoside hydrolase, family 1
  Pfam annotation: Domain name=Glyco_hydro_1; Domain location=24-477; Score=549.5; E_value=3.4e-162; Accession=PF00232.9; Description =Glycosyl hydrolase family 1
  Subcellular localization annotation: CTP_CleavageSite=20; ConfidenceScore=5.25e-01
MWVKVVFILLAALSLFHSAAASLNRSSFPADFFFGTASSAYQVGSYLHFWVLCTWDMKYEGAAREGGKGPSIWDTFTHSHPDRISDHSNGDVAIDSYHRYKGGVNREGITYYNNLINELIANGQQPFITLFHSDFPQALEDEYGGFLSPKIEQDFANYAEVCFREFGDRVKHWITLNEPVLYSTGGYASGGSPPNRCSKWFANCTAGDSTTEPYVVTHHLILAHAAAVKVYREKFQASQKGQIGVTLNSAWVVPLSQSKEDREAAYRGLAFMYDWFMEPLYSGTYPAVMVNRVGGRLPKFTRREYLMVKGSYDFIGLNYYTSTYATSSPCPRQRPTAFTDACVRFTTVRNGLLIGPKAASDWLYVYPPGIQGLLEYTKEKFNNPIIYITENGIDEVNDGKMLLNDRTRIDYISHHLLYLQRAIRNGVRVKGYFAWSLLDNFEWNAGYSLRFGLVYVDYKNGLKRHRKRSALWFKIFLHQ

SEQ ID NO: 216289 - protein, 389 aa, Glycine max
  Coding DNA Sequence Number=SeqID_99511
  Gene Ontology: Mol. function=nucleic acid binding; Cellular component= spliceosome; Biological process=nuclear mRNA splicing, via spliceosome
  Homolog annotation: Hit_ID=Q7XDP6; Match level="QueryCoverage=82%, HitCoverage=81%, E-value=1e-123, Identity=72%"; Hit description =Splicing factor 3B subunit 4, putative, expressed
  Pfam annotation: Domain name=Extensin_2; Domain location=104-389; Score=-120.5; E_value=0.013; Accession=PF04554.4; Description =Extensin-like region
  Pfam annotation: Domain name=RRM_1; Domain location=139-211; Score =99.9; E_value=7.7e-27; Accession=PF00076.12; Description=RNA recognition motif. (a.k.a. RRM, R
  Pfam annotation: Domain name=RRM_1; Domain location=27-98; Score =93.3; E_value=7.1e-25; Accession=PF00076.12; Description=RNA recognition motif. (a.k.a. RRM, R
  Pfam module annotation: Pfam domain module=Extensin_2::RRM_1::RRM_1; Domain location=104-389::139-211::27-98
MTTRIAPGVGANLLGQHAAERNQDATAYVGNLDPQICEELLWELFVQAGPVVNVYVPKDRVTNQHQGYGFVEFRSEEDADYAIKVLNMIKLYGKPIRVNKGGSLWRAYVTEFWHSAFDNLGARYNASQDKKSLDVGANLFIGNLDPDVDEKLLYDTFSAFGVIVTNPKIMRDPETGNSRGFGFISYDSFEASDSAIEAMNGQYLCNRQITVSYAYKKDTKGERHGTPAERVLAASNPTTQKSRPHTLFASGPPTLPSAPQANGVAPVPPRPFVNGVAPAAIPTLRPPPPQAAAFQPMPVPGQPAWHQQQPGQTMLSPAMPPPQIQQFRPPHPGMQQMPPPPQAPPRPLPPPSVMASQPPPVWRPPPPQQQGGRPLPYPQSAMLPPPPPQ

SEQ ID NO: 216290 - protein, 108 aa, Glycine max
  Coding DNA Sequence Number=SeqID_99512
MAKLWSRTNKMPHVPFLSSSKFIVASADLKEAFVIFNIQNYQHAKRSNSAKARINRKRIMQQKRHPHAQSSSQPTMNCTSEYDSSGSNFLSAYEDCQSPTNHLVINTE

SEQ ID NO: 216291 - protein, 982 aa, Glycine max
  Coding DNA Sequence Number=SeqID_99513
  Gene Ontology: Mol. function=transferase activity; Biological process= response to oxidative stress
  Homolog annotation: Hit_ID=Q1RSQ4; Match level="QueryCoverage=99%, HitCoverage=82%, E-value=0.0, Identity=79%"; Hit description=C2
  Pfam annotation: Domain name=C2; Domain location=246-327; Score=92.2; E_value=1.5e-24; Accession=PF00168.20; Description=C2 domain
  Pfam annotation: Domain name=C2; Domain location=409-491; Score=75.4; E_value=1.8e-19; Accession=PF00168.20; Description=C2 domain
  Pfam annotation: Domain name=C2; Domain location=573-667; Score=80.1; E_value=7e-21; Accession=PF00168.20; Description=C2 domain
  Pfam annotation: Domain name=PRT_C; Domain location=830-982; Score =409.8; E_value=3.8e-120; Accession=PF08372.1; Description=Plant phosphoribosyltransferase C-terminal
  Pfam module annotation: Pfam domain module=C2::C2::C2::PRT_C; Domain location=246-327::409-491::573-667::830-982
STEEAEVYSVAEAQSISVDIDQEPKKESREAVIETVQQLNKHQVLQPQIISIKRRPQGTPSTMHSVDPQVQSSHHKNYNHNDTNQQPRISIKRRPQAQGTPFTMHSVDPQVQPSHGESYNHNDTNMQPRISIKRRPRGPGTPSPMHSFNPQVHASHNESYNNLMGTNPQQPRILVEKQPQNTPLTTHQVSPQVPTSNDENYNLSDTNVQQLDKRWPSDRAYGRRGWVSGSDRFTSTYDLVEQMFYLYVRVVKAKVLPPSTITSSCDPYVEVKLGNYKGRTKHFEKKLNPEWNQVFAFSKDRIQSSVLEVFVKDKAMVGRDDYLGRVVFDLNEVPTRVPPDSPLAPQWYRLEDWCEEGKVRGDIMLAVWMGTQADEAFSEAWHSDAATVYGEGVFNIRSKVYMSPKLWYLRVNVIEAQDVIPGDRNRLPEVFVKAQVSCQVLTTKICPSRTTTPFWNEDLIFVACEPFEEQLTITVEDRVHPSKDEVLGKISLPMTLFEKRLDHRPVHSRWFNLEKFGFGMLEGDRRNELKFSSRIHMRICLEGGYHVLDESTLYTSDQRPTSRQLWKQPIGILEVGILGAQGLLPMKMRDGRGSTDAYCVAKYGQKWVRTRTLLDTFSPKWNEQYTWEVYDPCTVITLGVFDNCHLGGGEKAPGGSAARDSRIGKVRIRLSTLEANRIYTNSHPLLVLHPHGVKKMGELQLAVRFTALSLANMVHIYGQPLLPKMHYLHPFTVNQIDNLRYQAMNIVAVRLGQAEPPLRKEVVEYMLDVDSHMWSMRRSKANFFRIMSLFSGMITMGKWCSDVCLWKNHVTSVLVHILFLILIWYPELILPTMFLYMFLIGLWNYRFRPRHPPHMDTKLSWAEAIHPDELDEEFDTFPTSRSHDVVRMRYDRLRTVAGRIQTVVGDIATQGERFQSLLSWRDPRATSLFVVFSFCAAVVLYATPFRVVALVTGLYFLRHPKFRSKTPSIPSNFFKRLPARTD

SEQ ID NO: 216292 - protein, 86 aa, Glycine max
  Coding DNA Sequence Number=SeqID_99514
MDSTPSSVSALTHWTTALMPLMHVDCHHQKGGDCGSNAFQDYFDNAKDSSQESRVKQVSRIKESFNQRKFQESKSRSSFNQDSRLK

SEQ ID NO: 216293 - protein, 54 aa, Glycine max
  Coding DNA Sequence Number=SeqID_99515
MRIKIHETQCGPPWVRRTNRKAWFKQNRGDACRAARPGEPGCFLQKQQPSGGIF

SEQ ID NO: 216294 - protein, 250 aa, Glycine max
  Coding DNA Sequence Number=SeqID_99516
  Gene Ontology: Mol. function=heat shock protein binding; Cellular component=mitochondrion; Biological process=protein folding
  Homolog annotation: Hit_ID=Q1RSQ5; Match level="QueryCoverage=92%, HitCoverage=52%, E-value=1e-100, Identity=75%"; Hit description=DnaJ central region
  Pfam annotation: Domain name=DnaJ_C; Domain location=171-250; Score =47.8; E_value=3.6e-11; Accession=PF01556.9; Description=DnaJ C terminal region
  Pfam annotation: Domain name=DnaJ_CXXCXGXG; Domain location=78-158; Score=95.6; E_value=1.5e-25; Accession=PF00684.9; Description=DnaJ central domain (4 repeats)
  Pfam module annotation: Pfam domain module=DnaJ_C::DnaJ_CXXCXGXG; Domain location=171-250::78-158
MAHLCFALEDNKSILLSLLGHDAYVNQQSTGSGGEGGFNPFEQIFRDHDFVKSFFHQNIGGEDVKTFIELSFMEAVQGCTKTLTFQTDVLCNACGGSGVPPGTRPETCKRCKGSGVLFVQAGIFRMESTCGTCKGTGKIVSNYCKSCRGAKIVKGTKSVKLDIMPGIDSNETIKVFRSGGADPDGDHPGDLYVTIKVREDPVFRREGSDIHVDAVLSITQAILGGTIQVPTLTGDVVLKVRPGTQPGQKV

SEQ ID NO: 216295 - protein, 227 aa, Glycine max
  Coding DNA Sequence Number=SeqID_99517
  Gene Ontology: Mol. function=chitin binding; Cellular component =extracellular region; Biological process=chitin metabolic process
  Homolog annotation: Hit_ID=UPI000044A8F0; Match level="QueryCoverage =86%, HitCoverage=99%, E-value=8e-28, Identity=28%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=8; ConfidenceScore=5.26e-01
MDPSNPYTGAMKGPMHNPQTNLGADQNTLTFRGLHALTFRGLHVLTFRGLHAFTFRGLHVLAFRGLHAFTFRGLHLLAIRGLHILAFRGLHFLPFRGLLALALVGLHALTFRGLHVLTFRGLHAFAFRGLHVLTFRGPNILIFKGLHVLIFRGLHTLTFKGLHVLAFRGLHVLAFRGLHVLAFRRLHILAFRGLHVLHFRGLHVLAFRGLHILAFRGLHILAFRGLH

SEQ ID NO: 216296 - protein, 102 aa, Glycine max
  Coding DNA Sequence Number=SeqID_99518
MSEHNLHVFVCWMWRVTLWRRMLLEMLSDTRVFSNVKFVNCVDPFHEIKDPIDSRSRGSGTDNTSSRGGTGRYGGRGGANQFSNNGMQMMGVELICCSGMYI

SEQ ID NO: 216297 - protein, 52 aa, Glycine max
  Coding DNA Sequence Number=SeqID_99519
MAPPKEIVTVIDYYGHIVDDPVLGSGQTCYISAQLLDNDDLRGAMETILQNP

SEQ ID NO: 216298 - protein, 81 aa, Glycine max
  Coding DNA Sequence Number=SeqID_99520
MSDIPVDSISFTWIVDNAIIFIVMHCSHFESDSNYQRPMKAAKSYEYRLGVVLLELFTGKEAIFKYGRHHIKCGGLCGAVP

SEQ ID NO: 216299 - protein, 298 aa, Glycine max
  Coding DNA Sequence Number=SeqID_99521
  Homolog annotation: Hit_ID=Q7XH72; Match level="QueryCoverage=94%, HitCoverage=54%, E-value=2e-20, Identity=25%"; Hit description =Hydroxyproline-rich glycoprotein family protein, putative, expressed
MVPPPMLVSDSFAKDAILAWFRGEFAAANAIIDALCAHLSASSAHDYDAVFTAIHRRRLNWIPVLQMQKYHSIADVTLELARLADRNHNSAAAEHETDDKTTPSESVGNGGGGDEHEEYESPESEITDSGSQEMQASPMNVNICSNHEECEGRSSQFKLTKGFAAKESVKGHMARLKLYEDIFTDSELCKLTDFVNEIHAAGQNGELSGNIEPIPVLLQGVIDHLIQWQLLPEYKRPNGCIINFFEKGEFSQPFLKPPHLDQPVSTLLLSESAMAFGRILMSENDGNYKGPLTLSLKQ

SEQ ID NO: 216300 - protein, 44 aa, Glycine max
  Coding DNA Sequence Number=SeqID_99522
MATYGDFLASPVSFVCGYPTACTHAVFLSQPLNGATSISAWLGL

SEQ ID NO: 216301 - protein, 71 aa, Glycine max
  Coding DNA Sequence Number=SeqID_99523
MEIFNHGDAAEDKGKERNIPRICQRQLRIFQEYAKGILEYSKNMPKEYSKDMPKEYSKNMPKGGKLHTPLQ

SEQ ID NO: 216302 - protein, 118 aa, Glycine max
  Coding DNA Sequence Number=SeqID_99524
MVSEIYPEVHENPRVFFSNSSSILLEPLAHGSGDWSLPRGDFIKKGNVSTKRLGIREATKKKEKDKVISSPTTEGFVSEMENEKVGDHNQDIHPSEGAKAVKAQNNASFEPVQEDLNV

SEQ ID NO: 216303 - protein, 164 aa, Glycine max
  Coding DNA Sequence Number=SeqID_99525
MALLPQKEEEEEEEEPFEKVEKVEVVVETAHNVLEVTGGGRTLVGYVKDSLFNTKNMQNLFNSPIFDTSVKIACGIDPLHGEPSTLSISFPHELATTKPSMVQEEVHFIHISSPQPVVEPSTRELMQSYLPRALDRRLQEDWAKDAGEGPRVIMSLRVDFGPMG

SEQ ID NO: 216304 - protein, 204 aa, Glycine max
  Coding DNA Sequence Number=SeqID_99526
  Homolog annotation: Hit_ID=Q9S826; Match level="QueryCoverage=24%, HitCoverage=18%, E-value=2e-12, Identity=71%"; Hit description =Putative U3 small nucleolar ribonucleoprotein protein; 73469-75667
MKDHTSYLRPFTGKESPSSVERIGETQALLRVQAQIHAGRAQILHSPSSIAHLHGPATPDKFEIPIRSESMKNDQYSSPLLKRNSSKSRVQINGSNRERCSMDEERSVRIMDSGVRKPAGSGMKIIDSGCSHGDSFHYKATIEFGILSSRTHIDDEYAYAVEKDPKILLTWDPSAPLQQFVKELSFVFPNVQRMNRGGQVGAFT

SEQ ID NO: 216305 - protein, 153 aa, Glycine max
  Coding DNA Sequence Number=SeqID_99527
MGDQEEVQEQMRADMSALKEQMASMMDAMLGMRQLMEKNAAITAIVSSAAEADPTLPAIAHHPDVVGQERSILGNISNPHLGYNRVAYPYGLPLNYTPTVIRDDAGRVPPPILEGEPPRQSDKVHEDCWELAQGDIDSHSMFPAKGPAPNALP

SEQ ID NO: 216306 - protein, 185 aa, Glycine max
  Coding DNA Sequence Number=SeqID_99528
  Homolog annotation: Hit_ID=Q1SIG7; Match level="QueryCoverage=26%, HitCoverage=51%, E-value=5e-18, Identity=96%"; Hit description=Like -Sm ribonucleoprotein-related, core
  Pfam annotation: Domain name=LSM; Domain location=37-83; Score=26.4; E_value=0.0001; Accession=PF01423.12; Description=LSM domain
MVSFLLYSASAQPHHTKKIHFFCVWSHDQSGRKETVLDLAKFVDKGVQVKLTGGRQGTLKGYDQLLNLVLDEAVEFLRGWLSHWEKWKLMLEPEFLTTVRMLDKGCSDANMCASLLLGIKTILNMDRDVQWCHVVRESNSFAHGHAKCGLRVNDDLVVFHSLPPSISVAFNADVMKTLMDGVVRM

SEQ ID NO: 216307 - protein, 206 aa, Glycine max
  Coding DNA Sequence Number=SeqID_99529
  Gene Ontology: Mol. function=protein binding; Cellular component =apoplast; Biological process=response to biotic stimulus
  Homolog annotation: Hit_ID=Q9ZP52; Match level="QueryCoverage=97%, HitCoverage=95%, E-value=6e-63, Identity=58%"; Hit description =Thaumatin-like protein SE39b
  Pfam annotation: Domain name=Thaumatin; Domain location=26-191; Score= 115.6; E_value=1.4e-31; Accession=PF00314.8; Description=Thaumatin family
MALKQLSLLVMLFSLGVDATVLTLQNKCRDIVWPGILTGAGRPELIDDGAELTPGKAINITAPKGWSGRIWGRRGCTFHSYGSGTCITGDCGGKLKCDGVGGAPPASLAEFTLDSQEGGFYDVSLVNGYNLPVSIFPTGGSGQCKAVTCQSDLNRNCPNGLEVTSVTRGSVSQQAIPRCSRLRVLRLIAMPMMMQPALSLAKEQTT

SEQ ID NO: 216308 - protein, 84 aa, Glycine max
  Coding DNA Sequence Number=SeqID_99530
  Homolog annotation: Hit_ID=Q1SPZ8; Match level="QueryCoverage=76%, HitCoverage=6%, E-value=3e-10, Identity=52%"; Hit description =Leucine-rich repeat; Leucine-rich repeat, cysteine-containing type
MCLKLIREDSSAIIGKNYLFVYFINMSFNDLLGPTQQNKQFSAFQDSSFEGNQELYGNLLSKKCEDDAGSPFAPPLACEDNQDS

SEQ ID NO: 216309 - protein, 60 aa, Glycine max
  Coding DNA Sequence Number=SeqID_99531
MVCVDSRISLIFRLCPSAANLGEILCSLNFATRDSGIKNQNGPELAIASRSQSCLSTSKS

SEQ ID NO: 216310 - protein, 222 aa, Glycine max
  Coding DNA Sequence Number=SeqID_99532
  Homolog annotation: Hit_ID=Q9AVH2; Match level="QueryCoverage=21%, HitCoverage=16%, E-value=8e-20, Identity=97%"; Hit description =Putative senescence-associated protein
MTEGCGEGLCLANLPGDAFSLWGNFFEAKKQMMADAKFAGLLGLAVGRVGGAGLWPRAKFRIGWPPPPPRDQFCCFWGGGVWLAPRWLSLCLGGGSSWEGRIKATRAESQWIVAARPLCHLQYPVAYLSRLQRILPAARWELRFKASRRANPPHEGHQRHVPLGGRGPLLLVGKRTAGARVASSPDSDLEAFSHNPTHGSFAPLAFQPSAMTNCANQRFLSY

SEQ ID NO: 216311 - protein, 116 aa, Glycine max
  Coding DNA Sequence Number=SeqID_99533
  Gene Ontology: Mol. function=phosphoenolpyruvate carboxylase activity; Biological process=carbon utilization by fixation of carbon dioxide
  Homolog annotation: Hit_ID=Q6Q2Z9; Match level="QueryCoverage=92%, HitCoverage=10%, E-value=3e-43, Identity=81%"; Hit description =Phosphoenolpyruvate carboxylase
MEDLAEMLEKQLASELSKMTLEEALPLARAFSHHLTLMGIAETHHRVRKGGNMVLAAKSCDDIFNNLLQDGVSPVELYKTVFKQEVEIVLTAHPTQINHRTLQYKHLKIAVSCSLF

SEQ ID NO: 216312 - protein, 152 aa, Glycine max
  Coding DNA Sequence Number=SeqID_99534
  Gene Ontology: Mol. function=transcription corepressor activity; Cellular component=nucleus; Biological process=regulation of transcription, DNA-dependent
  Homolog annotation: Hit_ID=Q1EPA1; Match level="QueryCoverage=92%, HitCoverage=10%, E-value=5e-37, Identity=52%"; Hit description =Paired amphipathic helix repeat-containing protein / transcription regulator-related
  Pfam annotation: Domain name=PAH; Domain location=18-64; Score=57.2; E_value=5.4e-14; Accession=PF02671.11; Description=Paired amphipathic helix repeat
  Pfam annotation: Domain name=PAH; Domain location=97-143; Score=35.1; E_value=2.4e-07; Accession=PF02671.11; Description=Paired amphipathic helix repeat
  Pfam module annotation: Pfam domain module=PAH::PAH; Domain location =18-64::97-143
MDALQYIKEVQCAFHDSREKFDKFMDVMKDYKFHRIDVGIVVEKMEEILKDHRDLILGFNKFLPKGYEILLLDEGEDGFGNASKYLKKIQDRFENKDHVYKSFLNILLKYKNNGVTLYDTYHEVATLFEGHRDLVRDFTKFLPSVHLRGKYT

SEQ ID NO: 216313 - protein, 201 aa, Glycine max
  Coding DNA Sequence Number=SeqID_99535
  Gene Ontology: Mol. function=chitin binding; Cellular component =extracellular region; Biological process=chitin metabolic process
  Homolog annotation: Hit_ID=UPI0000612705; Match level="QueryCoverage =94%, HitCoverage=92%, E-value=2e-23, Identity=28%"; Hit description =UPI0000612705 related cluster
MSSPSEGCMLSPLEDSTSSPLEGYTPSPSEDYTSLPSEGCTPSPSEDYTSSPSKDHTSSPLEGCTPSPSKDYKSSPSKDYRSSPSEDCTSSPLEGCTLSPSEDYTGLHALTLRGLHALTFRGLHVLTFRGLHVLAFRGLHAHAFRGLHVLTFRGLHVFSFKGPHALNLRGLHVFTFRGLHSLAYRGLHAVAFIGLRALAFR

SEQ ID NO: 216314 - protein, 102 aa, Glycine max
  Coding DNA Sequence Number=SeqID_99536
MRLPGKEESADETPITINEILDVSISFLNDHLEETLGSTKIEEIHSKCINLAQDFPWEWVLLVGFSAFACFWPFPFLFWFCVRRTSHRRAGFWLVIKGRRPP

SEQ ID NO: 216315 - protein, 286 aa, Glycine max
  Coding DNA Sequence Number=SeqID_99537
  Gene Ontology: Mol. function=transcription factor activity; Cellular component=membrane; Biological process=regulation of transcription, DNA-dependent
  Homolog annotation: Hit_ID=Q0K419; Match level="QueryCoverage=63%, HitCoverage=55%, E-value=3e-49, Identity=54%"; Hit description =Transcriptional regulator, LysR-family
  Pfam annotation: Domain name=HTH_1; Domain location=112-172; Score =62.4; E_value=1.4e-15; Accession=PF00126.17; Description=Bacterial regulatory helix-turn-helix protein, lysR family
DGLIDQIFKAAAPGADNQLVGGHGIPCAQNSRGVTAILPLAAAAVKQPFPRRCIGISDAKKVAALRRIFLSLSEAEANGREGSGRGLCCYSLSGMINAWKQGRICMLSRITQRQLEYFVASGEAGSIIGASERIHVSSPSISAAITHIESELGVQLFVRHHAQGVSLTAIGHQVLKEAKLILEQMSNLYTIASESLNNVRGPLRVGCLDTLAPMLTPELVFGFGRAFPGVRITLVEGNHEQLLKQLRAADIDIALTYDLVPASDIAFQSLAQLPPYVMVGEHHPFA

SEQ ID NO: 216316 - protein, 56 aa, Glycine max
  Coding DNA Sequence Number=SeqID_99538
MRLHMLRERSIRNVEQGPQQHQDMQGPRQHQQGKKKLPASACTASWSYGQIETRSK

SEQ ID NO: 216317 - protein, 58 aa, Glycine max
  Coding DNA Sequence Number=SeqID_99539
  Homolog annotation: Hit_ID=O48937; Match level="QueryCoverage=64%, HitCoverage=5%, E-value=8e-08, Identity=70%"; Hit description=NADPH cytochrome P450 reductase
LTAVLKVTHFAHAIVATIGLEGSEKGEGWLQNLHYGVFGLGNRQYEHFYKVAKVGVAD

SEQ ID NO: 216318 - protein, 246 aa, Glycine max
  Coding DNA Sequence Number=SeqID_99540
  Gene Ontology: Mol. function=phosphoribosylaminoimidazole carboxylase activity; Cellular component=phosphoribosylaminoimidazole carboxylase complex; Biological process=purine nucleotide biosynthetic process
  Homolog annotation: Hit_ID=Q7WB10; Match level="QueryCoverage=99%, HitCoverage=61%, E-value=8e-86, Identity=67%"; Hit description =Phosphoribosylaminoimidazole carboxylase ATPase subunit
  Pfam annotation: Domain name=ATP-grasp; Domain location=2-141; Score =119.9; E_value=7.2e-33; Accession=PF02222.12; Description=ATP-grasp domain
VARLGYDGKGQARIDSREAALAAFAEFGGVACVLEALMPLDYEISVVIARGFDGASVVFPVARNVHRDGILAVSTAAPVKLDAAHAERQAQATAAAQAIAQGLGYHGVLCVELFVLQDGSLIVNEIAPRPHNSGHYTMDACVTSQFEQQARAMAGLPLGSTDLLAPAVMLNLLGDIWYPSATGDTQREPDWAAALAVPTAKLHLYGKREARRGRKMGHVTIVAPTLQQARADAARVAAALGMQAPE

SEQ ID NO: 216319 - protein, 84 aa, Glycine max
  Coding DNA Sequence Number=SeqID_99541
MSIEKGGGEDRTNEVAVNKKEKGASSKWKIKTSWKKQIKEGLLVGHDIKGKVEKFRHMGDDTILDYGVKQEMKELFCKVGDLDS

SEQ ID NO: 216320 - protein, 130 aa, Glycine max
  Coding DNA Sequence Number=SeqID_99542
MAARSGHRWLWVVDEEFLGTSPIGLEFALSATFCVERNSCRVEIALNATQYNYYHKKYVFFSRLLPQTLIQHLKPLPPPPTIISGRHEPPLLAAGPLQGEEHFDWSRIFIIHLKKSVENGALNPSFMVSS

SEQ ID NO: 216321 - protein, 183 aa, Glycine max
  Coding DNA Sequence Number=SeqID_99543
  Gene Ontology: Cellular component=integral to membrane
  Homolog annotation: Hit_ID=Q93PD4; Match level="QueryCoverage=64%, HitCoverage=93%, E-value=9e-44, Identity=69%"; Hit description =UPF0188 membrane protein YPTB2324
VPETGGALLGTGGRGAAEADTALVGAGGAAAGAGHGGVAQCAATPAAQPGLPDAQPELCDACIHEGLCLGRRQRVAGDVGAVADEVGHGANPADVVRRRLVGADRRLLAAAVGGGRRHLRLCAVDAVLVLCAAPPAVKPRLSSVERQLCAGLSGGGDPAVVQRVRYAAENAGHAVYSVRRLAD

SEQ ID NO: 216322 - protein, 158 aa, Glycine max
  Coding DNA Sequence Number=SeqID_99544
  Gene Ontology: Mol. function=hydrolase activity; Cellular component =membrane; Biological process=cell wall catabolic process
  Homolog annotation: Hit_ID=Q6D653; Match level="QueryCoverage=91%, HitCoverage=94%, E-value=1e-63, Identity=77%"; Hit description =Probable lipoprotein
MPAMIHQINGLRLNASRLPVHPLPVDVIERGADHPAAGRRVDKLVVGIVNADVQAVLTAAGFEKHQIARHQLIARDLGAQRGLFFGRTRQLHVKTIAERAVNKAGTIYPAPIQAAVTVWRAVPLAQLLIELGHHHDRVRQAAAGRRRMAAAPGEDQTG

SEQ ID NO: 216323 - protein, 60 aa, Glycine max
  Coding DNA Sequence Number=SeqID_99545
MKDDMEAMKEQMTIMMEAMMSMRKMMVVNIATIVAVSTTTEVNLTHPSRPNQVNNPVSDM

SEQ ID NO: 216324 - protein, 54 aa, Glycine max
  Coding DNA Sequence Number=SeqID_99546
MEACQAIAERLERLFNLRIVTEGTEAYNVMEDCLRIAKGVTADCNVSLFTLTPC

SEQ ID NO: 216325 - protein, 153 aa, Glycine max
  Coding DNA Sequence Number=SeqID_99547
MEWNLRITFLYVAFLFEVMGVHALLQGLTFYNILVLDGMQSEKYKCLGCSVWYAVIWVLWENRNQIIFSNKKQDAAEMFQPIQLFSWKWASDKLQFLYPFSCWCGDTSSCWNTHCSSLNCKRCNLLPLTFTRVSLTVFKQRITHLHTRNSIRD

SEQ ID NO: 216326 - protein, 69 aa, Glycine max
  Coding DNA Sequence Number=SeqID_99548
MASIRKSYLVIASTKKSKECPENKANNPYAKYALVSMEWLQGKQRTSFRDNGSNEMNFFEATQLTKTWW

SEQ ID NO: 216327 - protein, 69 aa, Glycine max
  Coding DNA Sequence Number=SeqID_99549
MAEPSKKRKGSSSRSQWHSEVQDTPIPSSISSSSLFSSEEQRIRDLLSGNRLPEDVIDYQWPKMIYNSY

SEQ ID NO: 216328 - protein, 107 aa, Glycine max
  Coding DNA Sequence Number=SeqID_99550
MTIGTSTKGLNLMRKQEVDSLRWPLILNLKDRTLDLGNWSRYLGSRICLEEKRDEYHRRCSSDKNSVDDENDGGIDVGGAPVAPRHQIIVAEAEVYEPLRFLDDSTI

SEQ ID NO: 216329 - protein, 519 aa, Glycine max
  Coding DNA Sequence Number=SeqID_99551
  Gene Ontology: Mol. function=binding; Cellular component =intracellular; Biological process=metabolic process
  Homolog annotation: Hit_ID=Q67UW7; Match level="QueryCoverage=91%, HitCoverage=87%, E-value=1e-100, Identity=29%"; Hit description =Putative pentatricopeptide (PPR) repeat-containing protein
  Pfam annotation: Domain name=PPR; Domain location=131-165; Score =29.1; E_value=1.6e-05; Accession=PF01535.11; Description=PPR repeat
  Pfam annotation: Domain name=PPR; Domain location=241-275; Score =38.2; E_value=2.9e-08; Accession=PF01535.11; Description=PPR repeat
  Pfam annotation: Domain name=PPR; Domain location=276-310; Score =18.5; E_value=0.023; Accession=PF01535.11; Description=PPR repeat
  Pfam annotation: Domain name=PPR; Domain location=359-393; Score=8.3; E_value=0.78; Accession=PF01535.11; Description=PPR repeat
  Pfam annotation: Domain name=PPR; Domain location=74-108; Score=19.6; E_value=0.011; Accession=PF01535.11; Description=PPR repeat
  Pfam module annotation: Pfam domain module=PPR::PPR::PPR::PPR::PPR; Domain location=131-165::241-275::276-310::359-393::74-108
MGRFGLFSDGKEKFAILCSNGHLREAFESFLSEIWAKPRLFSNLLQACIPLKYVSLGKQLHSLILTSGCSSDKFISNRLLNLYSKFGELRAAVALFDRMPRRNIMIKACLEMGNLQSAKHLFEEMPERNVATWNAMVTELTKFEMNEESLLLFSRMSELGFMPDEYSIGCVLRGYAHLGALLTGQQLAFLGQGKQIHAEAVKAGAISEVSVIGSLVSMYSRCGCLQDSIKAFLECKERDVVLWSSMIAACGFHGQGEEAIKLFNQMERENLPGNEVTFLSLLYACSNCGLKDKGLDFFDMMVKKSGCLEEAEAMIRSMPVKADVIIWKTLLSACKIHKNADIARRVAEEVLRIDPQDSVTYVLLANIYSSANRWQNVSEVRRAMKDKMVKKEPGISWVEVRNQVHQFHIGDECHPKHVEINQYLEELTSEMKKRGYVPDTSYVLHDMDNEEKEHNLRHHSEKLAIAFALMNTPEGVPIRVMKNLRVCSDCHVAIKYISEIKNLEIIVRDSSRFHHFEGR

SEQ ID NO: 216330 - protein, 87 aa, Glycine max
  Coding DNA Sequence Number=SeqID_99552
MEGTSLVDLWLVKDFTRLKEISRIVGCLGTGCRHGFLKFKLKFLKVFTNNFNFWKPSDECGLTWVLDLLLELGHENGVKERCKDPSE

SEQ ID NO: 216331 - protein, 122 aa, Glycine max
  Coding DNA Sequence Number=SeqID_99553
  Subcellular localization annotation: CTP_CleavageSite=58; ConfidenceScore=5.59e-01
MWPLRSQKNSTTTVKMQHESATTNTVATKSLISTCHCCCLVTKLMTKLKRRGRTLRPKSASRQGSFQCRYDPLSYSLNFDTTGCGSLMDEDYYKFYAFSSRFLANPRTPCPIVQVQGTPINQ

SEQ ID NO: 216332 - protein, 387 aa, Glycine max
  Coding DNA Sequence Number=SeqID_99554
  Gene Ontology: Mol. function=transcription regulator activity; Cellular component=integral to membrane
  Homolog annotation: Hit_ID=Q94IK2; Match level="QueryCoverage=79%, HitCoverage=81%, E-value=2e-20, Identity=27%"; Hit description =Storekeeper protein
  Pfam annotation: Domain name=DUF573; Domain location=171-268; Score =126.9; E_value=5.5e-35; Accession=PF04504.5; Description=Protein of unknown function, DUF573
MMSSDRITLKIGPPLLFSFPGEVRGFYLVSAFLHQKQLPPPIEASSDEEQRPSSKQHTEEGVSSSEEASSQEEDDDDQPPTLPLASANPHPKPSSSDSDTDFEPTKVKPKPTDQAQKPQPSPAPPKWGSKRPAQNNAPATDPKRAKKKLTNSSSAAAAHETEEKSGGGQAKLSQRLFSKEDELAILKGMAEFISKTGQDPYKYADAFQNFVKNSLRVEASSNQIKEKIRRLKKKFETKAQRAKKWEDPEFSKFHDRTVFELSKKVWGEGANGLVEKPKPNNGKRKTAKTPKKDATSRNVVAKSETTTLLESMELEECGNVNLLYREVSGFKELNEDEMKRGLALIGESKRKELEGKWRKLRLAEMELVANRSLLIGEQIKLIFEALQ

SEQ ID NO: 216333 - protein, 324 aa, Glycine max
  Coding DNA Sequence Number=SeqID_99555
  Gene Ontology: Mol. function=chitin binding; Cellular component =extracellular region; Biological process=chitin metabolic process
  Homolog annotation: Hit_ID=UPI000044A8F0; Match level="QueryCoverage =94%, HitCoverage=99%, E-value=1e-44, Identity=29%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GGPLGTSTLTFRGLHVLTFRELHTLNFRGLHALTFRRLHVLAFRGLHVLAIRGQHVLAFRRLHVLAIRGLHVLAIRGLQALAYRGLHVLLAFRGLHVFSFRGLHVLAFRGLHALAFRGLHVLAFRGLHALTFRGLHVLTFRGLHALPIRGLHILAIRGLHTLTFRGLHILTFRGLHILTFRGLHVLTFRGLHVLTFRGLHVLAVRGLHVLAFSGLHVLTFRGLHALASRGLHTLTFRGLHVLAIRELHAITFRGLHLLTFKGLHTLTFRGLHVLAIRGLHTLTFRGLHILTFSGLDVLAFRGLRVLTFSGLHSHTLREFKVLCP

SEQ ID NO: 216334 - protein, 188 aa, Glycine max
  Coding DNA Sequence Number=SeqID_99556
  Homolog annotation: Hit_ID=Q1S0F5; Match level="QueryCoverage=75%, HitCoverage=30%, E-value=8e-11, Identity=28%"; Hit description=IMP dehydrogenase/GMP reductase
MGQLQQQAFRKAYGKIWDLATIEVSVEVIASLTQYYDQPLRCFTFEDFQLVPTMEEFEEILGCPLGGRKPYLFSGFYPSIARATKVVKISAQELDRVKQNRNGVVKVPRRCLEEKAKALENQGEWTSFIDILALLIFGFILFPNVEGLVDLALLTLSSPFTIARKARSSPFWPTWMTRLTGGVKRAAQ

SEQ ID NO: 216335 - protein, 322 aa, Glycine max
  Coding DNA Sequence Number=SeqID_99557
  Homolog annotation: Hit_ID=Q1S0F5; Match level="QueryCoverage=31%, HitCoverage=20%, E-value=1e-07, Identity=36%"; Hit description=IMP dehydrogenase/GMP reductase
HRKQVENGVVGIPRKCLEAKARILAGRGEWAPFIDILVLLIFGGVLFPNVDGLVDLAAIDDFLAYHDRKESPVVAILADLHDTFDRRCEKSSTRIVCCTSALYVWGCISYNPVLAIRQLGYPMRGAPLEEELTPIIAGGFNKTNVEALQKVRKAWEMVQKKDKELRGSNNGPIGGYCKWLKAHMQGLDWLSSLRTTKGEEVDALEEDEEVQALRAELEQAQIVKERFKSAALKIRKENAELRDVNVATTKALEQETKMAHREEHDRNKFRGALWGSNSELKLRREERDQSRETNIFAIVSKYQEELNLATAHEHKVVDEYAR

SEQ ID NO: 216336 - protein, 73 aa, Glycine max
  Coding DNA Sequence Number=SeqID_99558
MMHKLFIKEIATWRREGDIFGSDTLGMTLGEIEGKIESDPTSHHKHSAIFNGDDATRVYQNSDGVKPAATDGE

SEQ ID NO: 216337 - protein, 311 aa, Glycine max
  Coding DNA Sequence Number=SeqID_99559
MAPIELVAYRSRCVVLSRPTVPAARIRADQDTGCLVRLITRASREEVEKATSVNERLNDSLCRLFPRKDRTMNRHRTRTAHPHQRPLARGIVLALCMLPLAGAWAGDLDGTVGLVNNGDPIEEWTLRNNAVLTVVGGQTNSIRAVDSLVYMSDATINRSGSYQRAVELDGTASLQSERSTLRGGGILVQGSSSAHLIGSRILVTAADGLLPGNPLSIGLTLGSTPGGIPLPGAWSILDSTYVRVEDTAGGSDIASGLGVRMENGRVDIVNGSEIDADNVGVLMYGSIHTPDTLRLGIDGSTIRSGRGAAIR

SEQ ID NO: 216338 - protein, 173 aa, Glycine max
  Coding DNA Sequence Number=SeqID_99560
MARAASDRLGEMSSKSHLKYRSASKQDMEMEMEDRHTGGACHAVLVEHWIQKAVMKRGLKGGEEAEEEGCSREVGECLEVVEKDHRWHRRWRAYGSIAPVGHFTHFMFIAAHTQSFFNTSNVVTNGAKIIAMPRWWFITDAENEQEHDDAVDGDQARGRLLTNARPTQMSRVN

SEQ ID NO: 216339 - protein, 119 aa, Glycine max
  Coding DNA Sequence Number=SeqID_99561
MAMTTRGVNLYHKRECPWGLFYSGSCRWGIFPYRNENGINISPWARQGNGDEDYSPIPPCCTVHFSPDCTVTIQSRHHLLLVTSEWSHEGQKWGKKFSTTRIRDGDGEQGSTFCPALSR

SEQ ID NO: 216340 - protein, 34 aa, Glycine max
  Coding DNA Sequence Number=SeqID_99562
METRNRLLNPALPIAIRINEMPTTACKGKKIQTR

SEQ ID NO: 216341 - protein, 126 aa, Glycine max
  Coding DNA Sequence Number=SeqID_99563
MSAHSGYGIGAKRIKLPASQRAEDLESWYGSRREMEERVNMGTTAVPAVDHARLRIASQFAEMDDLVLETARGSAPSLECTDWLFSAWKNRFRATILRQCARTNYLRSAQFQIATMLSGNRVRRTR

SEQ ID NO: 216342 - protein, 207 aa, Glycine max
  Coding DNA Sequence Number=SeqID_99564
MGCWFNPKLGWVIPDYTSNLLRRRRHREEENLSHSAWCLPLLNDLTILPFFWALLPLVPLDAATGVLLADLEKSCPTAVGGRVGLVVNKEGDDNNVGMNGGGGVGDGVDMSGGVGMGMCARSAFAEEEDGVVVEEEVKGEAAMGGGDGKRRREVAGWCGLRQMMNERIDFLHELLNSVSEIKLVSGELGKSILQSIRSSCGSRGFRH

SEQ ID NO: 216343 - protein, 49 aa, Glycine max
  Coding DNA Sequence Number=SeqID_99565
MNSQKISIQNNLAPVTRPPPKGPNSKPQTGTKLPTTQQVDVYKLDQYWS

SEQ ID NO: 216344 - protein, 262 aa, Glycine max
  Coding DNA Sequence Number=SeqID_99566
  Gene Ontology: Mol. function=nucleoside-triphosphatase activity; Cellular component=integral to membrane; Biological process=transport
  Homolog annotation: Hit_ID=Q7PC87; Match level="QueryCoverage=60%, HitCoverage=12%, E-value=1e-24, Identity=41%"; Hit description =Pleiotropic drug resistance protein 6
HCLGVGTRYEALVVLSRRERQAGIKPDPEIDAIHEGYSIVRSQNQFGNRLCSQAVKLCLGDLLVMGSNPETASLHMQGASPGAAVKLCLGDLLVMGSNPETVSLHMQGIGQFHHFSDMQVHEANEGQIAYQGSRENVLEFFEHMGFECPERKGVADFLQERPATILDFKLYYDAKFGRKKVAENGDTATDKAVSNGNSVTVTIVSNGNKRASEMAVYEQFRGEGLNQIHTNGFVPTIVDERPYDSLIHHFVFLDFVITTYSL

SEQ ID NO: 216345 - protein, 316 aa, Glycine max
  Coding DNA Sequence Number=SeqID_99567
  Homolog annotation: Hit_ID=Q6AB56; Match level="QueryCoverage=18%, HitCoverage=10%, E-value=2e-30, Identity=100%"; Hit description =Conserved protein, DUF885
MVKVGTSYVPINVSFRQKLAQGFPVLQWLLFLSAVPPVQLLTGWCVTAKAPPDISAGKCSGHAARRVPFAIQAAQLLGRAIGAGLFAITPAGERGMCCKAIKLGNARVFPEFDDDPGHFMGLLDGQSMRAARVVLDIGLHCQFEAPEEMGGGEWNWDKAWAFFNNHVSMDEGSARYQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 216346 - protein, 58 aa, Glycine max
  Coding DNA Sequence Number=SeqID_99568
MIGDVGWHLGNCHSIKIKLQDHGNHFVHFGLERRSSNQKHKEMLMLLLRYGVYTFGVL

SEQ ID NO: 216347 - protein, 83 aa, Glycine max
  Coding DNA Sequence Number=SeqID_99569
MKLASTCLLIKVIRPPINRAFIKKYCAPRQVQGEAPQQLGDDVKKALLGGNLELATKKLPAKRFRNGTIEVGSSVAPQADTSF

SEQ ID NO: 216348 - protein, 270 aa, Glycine max
  Coding DNA Sequence Number=SeqID_99570
ITLGCLRMLPNFSQVGVAEMCLYRKPLGYFCLPPNSWVRISRCCLCMDNRWVYPPAACLKGLVDVVFVRITTWGTSACHLAHGSGLADVVFVWITAGYIRLPPDSRMLCLYGLPLGISTCRLSQGSRSTDVVFVQITAGYIRLLPDSRMLCLYGLPLGISAYRLTQGSGSTDVVFVWITAGYIRLSPDSRMLCLYGLPLGISACRLTQGSGSADVVLGADNPWKVASAQDFGWRSKGKDHFRARMEILTLGQGLWDKGMSYIISMTCVQQ

SEQ ID NO: 216349 - protein, 160 aa, Glycine max
  Coding DNA Sequence Number=SeqID_99571
  Gene Ontology: Mol. function=hydrolase activity, hydrolyzing O -glycosyl compounds; Cellular component=lysosome; Biological process =carbohydrate metabolic process
  Homolog annotation: Hit_ID=Q8PI23; Match level="QueryCoverage=75%, HitCoverage=13%, E-value=9e-29, Identity=48%"; Hit description=Beta -mannosidase
  Subcellular localization annotation: CTP_CleavageSite=61; ConfidenceScore=5.53e-01
MPGGKTGASRASPSPRCPPAPAADRGLRLPGNCGATTGTVGIPHAARRRAGRRPPGSAAMACGHGAGQRAHRPAGACVDPRPVRGCARSRAAMDRLGGLGVPRALRRGCGDAGQAQCRTALRRAGHLCRSQPQRQAAAACGQRAPHVACARGWAPARERQ

SEQ ID NO: 216350 - protein, 195 aa, Glycine max
  Coding DNA Sequence Number=SeqID_99572
MNVGYLISHQISLIAQDDTSRLGFSALIIALCKARGVQSDLRSLESLSPTINLAYIKKNCWNLVDPIVTFRGPRKARGKRSEAPSTSASSKAPVPSSSTLPPSSSTEILVIPPAPLEIPLPAPISTGPVDFIFTPQMLHSMLQSIHRGQSIIMQSLQGLGLPFIMNMEEFDAQCPGPGDQPSSSGGGGASTAQSL

SEQ ID NO: 216351 - protein, 106 aa, Glycine max
  Coding DNA Sequence Number=SeqID_99573
  Gene Ontology: Mol. function=RNA-directed DNA polymerase activity; Biological process=RNA-dependent DNA replication
MEKAEYWWENTGQCLEAKGQVVTWEVFKRVFLEKYFAEDVRNKKKMEFLQLKQGNMNVAEYATKFKKLVRYYPHYQGIDGKSSKCVKFLNDLLPEVKQAMNYQGIH

SEQ ID NO: 216352 - protein, 85 aa, Glycine max
  Coding DNA Sequence Number=SeqID_99574
MRIKRSFEVVMGPRTRLVVSLKTRKGKQGSKGLSKELIQGKSIWLEAYKNKIASIISKYACELGSINKNQAKAIVQAINGAKHTN

SEQ ID NO: 216353 - protein, 55 aa, Glycine max
  Coding DNA Sequence Number=SeqID_99575
MALCSVFLNLHLLLFVCLTIEALGVAKPSVASYLSQEILAEQEVDRAHGLPAQPP

SEQ ID NO: 216354 - protein, 306 aa, Glycine max
  Coding DNA Sequence Number=SeqID_99576
  Homolog annotation: Hit_ID=Q1S9I6; Match level="QueryCoverage=58%, HitCoverage=22%, E-value=4e-07, Identity=23%"; Hit description =Chromogranin/secretogranin
MEFFSDETFDCIQAFQNLGLIPFMSLQLPIYPELVKAFYCNLEIQDSTLISEVFGIKMVIDQSLFHDLTSDSVPFEGTLNDDWKFDFSAHDARQLVCTNNADMTGRLLAGSLAFESRILHYLIVRILLPRSSNLAQVSEEDLIIMWAFHTGRQLDWAHLVKYRMHKALRFNAPLPYPQLVTLFLRHFGIPLDSESYIPIKRSFLIGAAVIASFGYRKERDGSWVKKDVPPVDDEGHLPVEDNSTLLQRLMDKFDGLQTFVGDKFDAMELQVDMRFDAMESRITRVEEDVSFIRTCFDPPPPPPSSS

SEQ ID NO: 216355 - protein, 166 aa, Glycine max
  Coding DNA Sequence Number=SeqID_99577
  Homolog annotation: Hit_ID=Q1RT73; Match level="QueryCoverage=78%, HitCoverage=19%, E-value=3e-54, Identity=77%"; Hit description=IMP dehydrogenase/GMP reductase
MFRCLQKLVLKLQQNWKVKRQRQAAIVPGNEGFTFDLFDNSYDQAAIIRSLSMSTVRVNHDAVGMLAINVSPDLCHSLQLGFVGVQSDDTRRKSNENKSQFSGEHNLGETSEESLSDEECVKKTHSLLREVHEAIFNEQFVQYPHLNISWWWFVAFDSYASRCLIW

SEQ ID NO: 216356 - protein, 92 aa, Glycine max
  Coding DNA Sequence Number=SeqID_99578
MTGEMKEKEELVLVGHRRFYGGGGLQWWWWRRIPFVLFEDSSIEVLGRLGTVKEKGRNEGLRKERENESCVIDYILLFYGNRLQGVVIDYQT

SEQ ID NO: 216357 - protein, 271 aa, Glycine max
  Coding DNA Sequence Number=SeqID_99579
  Gene Ontology: Mol. function=oxidoreductase activity; Cellular component=cytoplasm; Biological process=cell redox homeostasis
  Homolog annotation: Hit_ID=Q5PCC9; Match level="QueryCoverage=100%, HitCoverage=61%, E-value=6e-87, Identity=60%"; Hit description =Probable pyridine nucleotide-disulfide oxidoreductase
  Pfam annotation: Domain name=3HCDH_N; Domain location=73-195; Score= -86.9; E_value=0.00046; Accession=PF02737.8; Description=3 -hydroxyacyl-CoA dehydrogenase, NAD binding domain
  Pfam annotation: Domain name=Pyr_redox; Domain location=75-166; Score= 105.2; E_value=2e-28; Accession=PF00070.17; Description=Pyridine nucleotide-disulphide oxidor
  Pfam annotation: Domain name=Pyr_redox_2; Domain location=75-213; Score=13.9; E_value=3.6e-05; Accession=PF07992.4; Description =Pyridine nucleotide-disulphide oxidor
  Pfam module annotation: Pfam domain module=3HCDH_N::Pyr_redox::Pyr _redox_2; Domain location=73-195::75-166::75-213
LAAIAQVDVIDGEAEFVDAHTLKITSSQQVSQIHAERIFINSGAEAVFPALEGLVAGPRVVDSSGILNLTQLPQRLGILGGGYIGVEFASMFAGFGSEVTLFESAPQFLAREDDDISAAIAGILQEQGVKIELNTALQRVTSGHDSVTLHTAQGDREVDVLLVATGRRPATKALKLENAGVVTNARGAVRVDKQLKTSVDHIWALGDVTGGPQFTYISLDDFRIVYDQLLGKGTRTTEDRVNIPYSVFMTPVLSRIGLTEAQARAQGRDIQ

SEQ ID NO: 216358 - protein, 187 aa, Glycine max
  Coding DNA Sequence Number=SeqID_99580
MPPTKHPLDPDKSSRALGFPALITGLCQSFGVPVTPTKVIRPPITKAFIEKYCTPRQAQGDAPQAADAPPPPHQADPAGSLGMERYLYTWFASRRPTTGGRCRYMSVSTGSASVNRGRVSLLLHALLHSSLGLRSHGPEINPRPRQGRSPQDPLVRQREIFGVMALNYFVTVFATCHFIRSFHLPCG

SEQ ID NO: 216359 - protein, 70 aa, Glycine max
  Coding DNA Sequence Number=SeqID_99581
  Homolog annotation: Hit_ID=Q84K37; Match level="QueryCoverage=67%, HitCoverage=22%, E-value=2e-08, Identity=56%"; Hit description =Pectin methylesterase
MNIYLVLAVSFLGGTILAESGDCGGKDISATITVGRQGNFTFGSIQAAIDSIKTNNDRWIKIHIEAGLYM

SEQ ID NO: 216360 - protein, 163 aa, Glycine max
  Coding DNA Sequence Number=SeqID_99582
MDFLKKKIIGKYDEDLDVDTKDVMVVVIDLAVVCTGCILDIQGLIVKGRANLMRIGDTFRVADVVDEGRGGIIDFVVGELDTRHNAFVVWLLLLLVVVLIGTTTFNVRIDLRIKVLGETNGRREWGQSGDESMIIVWFVVLVVALVIAEEKTNLHSQMTMLLF

SEQ ID NO: 216361 - protein, 258 aa, Glycine max
  Coding DNA Sequence Number=SeqID_99583
  Gene Ontology: Mol. function=calcium ion binding; Cellular component =integral to membrane; Biological process=protein transport
  Homolog annotation: Hit_ID=P93484; Match level="QueryCoverage=66%, HitCoverage=28%, E-value=1e-45, Identity=55%"; Hit description =Vacuolar sorting receptor 1 precursor
  Pfam annotation: Domain name=CBFD_NFYB_HMF; Domain location=65-129; Score=80.6; E_value=4.8e-21; Accession=PF00808.13; Description =Histone-like transcription factor (CBFNF-Y) and archaeal histone
MEEKEKGEKTKEEKEESEAGEGFGRGRQRVPATMFNAPASPCGSGRGNHESSEHSPRSYFREQDCFLPIANISCIMKKMLPSNRKIAKDAKETLQECVSEFISFVTCEVSDKCQGEKRKTINDDCNRTVTVLKKEEGLNIEKIEKCMGDPDADTDNPILKEEQDAQVLDREVMIPYCLLLLSIIDNIEKGDVLKAICYGFEETTEPSTNECLTNNGGCWQDKVANIIACKDIFRGRVCECPLVDGVQFKGDGYTTCEG

SEQ ID NO: 216362 - protein, 139 aa, Glycine max
  Coding DNA Sequence Number=SeqID_99584
  Subcellular localization annotation: CTP_CleavageSite=24; ConfidenceScore=5.17e-01
MSSPWRVGFFTMKLFGGTGKLEASLSELGSRKPRKRPFFPLLVKKRLSFELQKVAVGLSTYPPLSAASEHLAQRRIWMSIDIIGARYVRNQCAKRNRCLQPGYARHWRSAQFHLLALSAKVALSTTLRIRVQCPGHRIP

SEQ ID NO: 216363 - protein, 842 aa, Glycine max
  Coding DNA Sequence Number=SeqID_99585
  Gene Ontology: Mol. function=protein binding; Cellular component =integral to membrane; Biological process=defense response to fungus
  Homolog annotation: Hit_ID=Q1S5Q9; Match level="QueryCoverage=96%, HitCoverage=99%, E-value=1e-167, Identity=40%"; Hit description =Leucine-rich repeat
  Pfam annotation: Domain name=LRRNT_2; Domain location=17-56; Score =44.1; E_value=4.9e-10; Accession=PF08263.3; Description=Leucine rich repeat N-terminal domain
  Pfam annotation: Domain name=LRR_1; Domain location=118-141; Score =4.4; E_value=43; Accession=PF00560.23; Description=Leucine Rich Repeat
  Pfam annotation: Domain name=LRR_1; Domain location=170-190; Score =6.3; E_value=19; Accession=PF00560.23; Description=Leucine Rich Repeat
  Pfam annotation: Domain name=LRR_1; Domain location=195-217; Score =11.2; E_value=2.2; Accession=PF00560.23; Description=Leucine Rich Repeat
  Pfam annotation: Domain name=LRR_1; Domain location=220-242; Score =13.6; E_value=0.73; Accession=PF00560.23; Description=Leucine Rich Repeat
  Pfam annotation: Domain name=LRR_1; Domain location=244-266; Score =12.1; E_value=1.5; Accession=PF00560.23; Description=Leucine Rich Repeat
  Pfam annotation: Domain name=LRR_1; Domain location=268-290; Score =11.6; E_value=1.9; Accession=PF00560.23; Description=Leucine Rich Repeat
  Pfam annotation: Domain name=LRR_1; Domain location=292-314; Score =4.5; E_value=40; Accession=PF00560.23; Description=Leucine Rich Repeat
  Pfam annotation: Domain name=LRR_1; Domain location=363-385; Score =4.1; E_value=48; Accession=PF00560.23; Description=Leucine Rich Repeat
  Pfam annotation: Domain name=LRR_1; Domain location=387-409; Score =3.2; E_value=73; Accession=PF00560.23; Description=Leucine Rich Repeat
  Pfam annotation: Domain name=LRR_1; Domain location=412-435; Score =2.7; E_value=88; Accession=PF00560.23; Description=Leucine Rich Repeat
  Pfam annotation: Domain name=LRR_1; Domain location=454-477; Score =9.7; E_value=4.5; Accession=PF00560.23; Description=Leucine Rich Repeat
  Pfam annotation: Domain name=LRR_1; Domain location=482-503; Score =6.1; E_value=21; Accession=PF00560.23; Description=Leucine Rich Repeat
  Pfam annotation: Domain name=LRR_1; Domain location=506-528; Score =12.3; E_value=1.4; Accession=PF00560.23; Description=Leucine Rich Repeat
  Pfam annotation: Domain name=LRR_1; Domain location=530-552; Score =5.8; E_value=24; Accession=PF00560.23; Description=Leucine Rich Repeat
  Pfam annotation: Domain name=LRR_1; Domain location=554-573; Score =7.0; E_value=14; Accession=PF00560.23; Description=Leucine Rich Repeat
  Pfam annotation: Domain name=LRR_1; Domain location=576-598; Score =6.7; E_value=16; Accession=PF00560.23; Description=Leucine Rich Repeat
  Pfam annotation: Domain name=LRR_1; Domain location=600-623; Score =16.0; E_value=0.13; Accession=PF00560.23; Description=Leucine Rich Repeat
  Pfam annotation: Domain name=LRR_1; Domain location=61-83; Score=2.7; E_value=90; Accession=PF00560.23; Description=Leucine Rich Repeat
  Pfam annotation: Domain name=LRR_1; Domain location=652-674; Score =12.8; E_value=1.1; Accession=PF00560.23; Description=Leucine Rich Repeat
  Pfam annotation: Domain name=LRR_1; Domain location=676-698; Score =10.5; E_value=3.1; Accession=PF00560.23; Description=Leucine Rich Repeat
  Pfam annotation: Domain name=LRR_1; Domain location=700-722; Score =23.6; E_value=0.00068; Accession=PF00560.23; Description=Leucine Rich Repeat
  Pfam annotation: Domain name=LRR_1; Domain location=724-745; Score =8.8; E_value=6.4; Accession=PF00560.23; Description=Leucine Rich Repeat
  Pfam annotation: Domain name=LRR_1; Domain location=85-108; Score =8.7; E_value=6.7; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR_1::LRR_ 1; Domain ...
  Pfam module annotation: Pfam domain module=location=17-56::118 -141::170-190::195-217::220-242::244-266::268-290::292-314::363 -385::387-409::412-435::454-477::482-503::506-528::530-552::554 -573::576-598::600-623::61-83::...
  Pfam module annotation: =652-674::676-698::700-722::724-745::85-108
MTLHKGICGANTKLSCNGKDRSALLLFKHGVKDGLHKLSSWSNGEDCCAWKGVQCDNMTGRVTRLDLNQQYLEGEINLSLLQIEFLTYLDLSLNGFTGLTLPPILNQSLVTPSNNLSNLVYLDLSFNEDLHLDNLQWLSQLSSLKCLNLSEINLENETNWLQTMAMMHPSLLELRLASCHLVDMSPLVKFVNFTSLVTLDLSGNYFDSELPYWLFNISSDISHIDLSFNNLQGQVPKSLLNLRNLKSLRLVNNELIGPIPAWLGEHEHLQTLALSENLFNGSFPSSLGNLSSLIELAVSSNFLSGNVTSTIGQLFNLRALFIGGSLSGVLSVKHFSKLFNLESLVLNSAFSFDIDPQWIPPFQLHEISLRNTNLGPTFPQWIYTQRTLEVLDTSYSGLSSIDADKFWSFVAKIRVINLSFNAIRADLSNVTLNSENVILACNNFTGSLPRISTNVFFLNLANNSLSGPISPFLCHKLSRENTLGYLDVSYNFFTGVIPNCWENWRGLTFLYIDNNKLGGEIPPSIGLLDEIVEMDFHKNNLSGKFSLDLSNLKSLVFINLGENNFSGVVPKKMPESMQVMILRSNKFSGNIPTQLCSLPSLIHLDLSQNKISGSIPPCVFTLMDGARKVRHFRFSFDLFWKGRELEYQDTGLLRNLDLSTNNLSGEIPVEIFGLTQLQFLNLSRNHFMGKISRKIGGMKNLESLDLSNNHLSGEIPETFSNLFFLSFLNLSYNDFTGQIPLGTQLQSFDAWSYVGNPKLCGLPLPKNCSKQNIHDKPKQGGANESLFLGMGVGFVVGLWGVWGSLFLNKAWRHKYYRIVGHVEDWLYVFIALKFKKFAELRA

SEQ ID NO: 216364 - protein, 97 aa, Glycine max
  Coding DNA Sequence Number=SeqID_99586
MGKQLVSRRAEILEYDSEIERACGKNNADTRRRRMAKENARNSGNGGNVGNEVDPQECTLQDYFTPMVEVTSSILLPNLGEQNCKLRHGLINMIEKM

SEQ ID NO: 216365 - protein, 202 aa, Glycine max
  Coding DNA Sequence Number=SeqID_99587
MTMEHMTNSGERIRTLESIISNLVTLMSQSPKENVKAVSTRSGNPHVEVKKKEKTTPPPPEKEALTREKLEGEKETLTEKSLEVEKENEVLTPPKKIGIRETQPINITLQLVDRSISIPNDIVDDVLVKVDKFIFQADFVVLDMEEDENVPITLGWPFLNTCDIASFPSVGMEEPLERVLTNEELHWELSIDEEEIMMFLQA

SEQ ID NO: 216366 - protein, 281 aa, Glycine max
  Coding DNA Sequence Number=SeqID_99588
  Gene Ontology: Mol. function=RNA-directed DNA polymerase activity; Cellular component=intracellular; Biological process=RNA-dependent DNA replication
MEEGQEPKWLPWRRLNPNMMEVVKGEVLKLLDANIMYLMSDYKWVSLIQYVPKKKGTIVMENEQKKLIAIRKIIGWQMCIDVVLKKVQGDKIGVKLEKVLVHGALVRCAMTQGVLYWHFGGSHHDEDHLSRLDPFVRQPTNDGAIHETFPNEHLLGVAILPRAPWYAGIVNYLSCKAFPPKFKFQEKKRFMVEAKQYFGDDRYLYKVCGDDVVRRCVPYEELVLILRLLLPVILNQVVKLSDGILPRKGPVTRTMSKRLQEDWARAAEEGNRVLMNLRVDF

SEQ ID NO: 216367 - protein, 84 aa, Glycine max
  Coding DNA Sequence Number=SeqID_99589
MAIELIIMRRHCFKCTTLCISKSEFSPLTRQDQDVKQAFPKRQLVGSSNPPFISETQVILARAPEAQNQHKVLEGEIVKIEDKS

SEQ ID NO: 216368 - protein, 50 aa, Glycine max
  Coding DNA Sequence Number=SeqID_99590
MADKGVGEGNAVEELAEVLDKGQQFKQNPYKQSQVIYSFHPGKRDLGTQH

SEQ ID NO: 216369 - protein, 540 aa, Glycine max
  Coding DNA Sequence Number=SeqID_99591
  Gene Ontology: Mol. function=DNA binding; Cellular component =chromatin; Biological process=DNA integration
  Homolog annotation: Hit_ID=Q1SAI8; Match level="QueryCoverage=99%, HitCoverage=41%, E-value=1e-100, Identity=69%"; Hit description =Integrase, catalytic region
MASNKTSFHSALAVSNIRNHVSIVLEMENVQYSTWAELFKIHARSTKVLDHIIPPANGTGMVPSTEEERELWSTLDATVLSWIYATISSDLLHTIIEPDSTAMEAWDRLRDIFQDNKHSHDVALEQEFSATSMENFPNVSSYCQRLKSLANQLKNVGALVSNSRLVLQLVEGLTQPYRGVGMLIRQSNPLPPFYKARSMLTLEEAGMAKEHSKGKNGAQHSGGGRRNNGGGRKNAGSGGGRNSTGGKGGGRGQSSGGHGWARPNTPQQRQVGLLSPKPPQQAYVHQATSPNPHGQSGSYAPTDIEAAMHTMSLNQPDPSWYMDTGATSHMTSSTDNLSSYFNLSNHPNTNIIVGNGHTIPILGYGHTNLSSPCQSLSLNNVLYAPKLIKNLVSVRKFTKDNSVSVEFNPFGFSVKDYWTGMSIMRCDSRGDLYLISYSLNNQASSSTFAAISPKLWHDRLGHPGSPIFNVLRKNKSIDCNKLSSSSICGSCVLGKHIKLPFVSSSLNTTMPFDILHSDLWTSPVLSSLGHRYYVLFLDDF

SEQ ID NO: 216370 - protein, 708 aa, Glycine max
  Coding DNA Sequence Number=SeqID_99592
  Gene Ontology: Mol. function=DNA binding; Cellular component =chromatin; Biological process=DNA integration
  Homolog annotation: Hit_ID=Q1RSZ9; Match level="QueryCoverage=85%, HitCoverage=54%, E-value=0.0, Identity=57%"; Hit description =Polynucleotidyl transferase, Ribonuclease H fold
MSRTLPAHASLPPSFWHHALQMATYLLNVLPSKLLGNKSPLEVLYTRVPSYDHIQVFGCLCYPFIPSTTINKLQPRSTPCVFLGYPTHHRGYKCYDLSSHKIIICRHVLFDEHTFLLASLHSPKSHTYDFLDEGLSPYVIHHLHQPTPTPSSQPNVPSEPNSSLPDLISSQITPAQTQIDPSPTNSPIQQPRVVTRSKHGIYKPNKKYSMHTTVERSPLPRNPIAALRDPNWKMVMDDEYDALCDGKTQHVGIDCGETFSPVAKPATICTVLSLSLSKAWPNHQLDVKNDFLHGKLQEIVFMHQPLGYRDRDHPDYVCLLRKSLYGLKQAPRAWYKHFADYVLSIGFLNSKCDNSLFIFSKGSSVAYILLYVDDIILIASSYALRCFIMDLLSSKFAMKDLGPLNYFLGIAVTRHKGRMFLSQRKYAEEIIARAGMTSCKPSKTPVDTKSKVSATSGAPFDDPTLYRSLAGALQYLTFTRPDISYVVQQVCLHMHDPRVDHMSALKRIIRYVQGTLDFGLYLYSSSTSTLVSYTDADWGGAEAKYRGVANVCLVPKATLVYCDNVSAIYLTRNPVQHQRTKHIEMDIHFVREKVARGHSQRPKASRYDCGVGGGTYKKDSDEQVSGALRLHHAQSYVGQPPLYVSCQEMVETHHVSSLWVVQYISPPSSEFLTNDKVSCGDLRLAVFYELVPSLWCVRYTSPQAHTSS

SEQ ID NO: 216371 - protein, 122 aa, Glycine max
  Coding DNA Sequence Number=SeqID_99593
MATQLKSMKFELGKTKELNLELAKIDDLEKQVKDISVRVEELTFEKMVEENLTTAEDKVVDLEKKIEDLKCELLKKEEAKFVLSTELDKAKRWIILNHREDSRRLNIKSKCFYPLSIPCNST

SEQ ID NO: 216372 - protein, 77 aa, Glycine max
  Coding DNA Sequence Number=SeqID_99594
MEESVVVVVVVCRFAFLEAFECILRRRRRCDRVKEGLASETKTRGRMHTWQRLRWCVVLFLSPPPTLVLKVLAESRV

SEQ ID NO: 216373 - protein, 182 aa, Glycine max
  Coding DNA Sequence Number=SeqID_99595
  Gene Ontology: Mol. function=RNA-directed DNA polymerase activity; Cellular component=mitochondrion; Biological process=RNA-dependent DNA replication
  Pfam annotation: Domain name=RnaseH; Domain location=84-182; Score= -34.3; E_value=0.089; Accession=PF00075.14; Description=RNase H
MERYATISIRIRDLDPGVTLPSKIMTLKLGSFTNSLCRKQPKYLNELRAKAAGYIQMEELFAFRNQIRRKKVDVDLLHQLSTLRNDEASNSKGSNVGVILEGLDNIFIKQSVKFDWKASNNQAEYEALIMFLKLAIKVGIKKFRCRSDSKLVTKQVNEVFQARETQMQKYYHLIKQILEHSK

SEQ ID NO: 216374 - protein, 891 aa, Glycine max
  Coding DNA Sequence Number=SeqID_99596
  Gene Ontology: Mol. function=nucleotide binding; Cellular component =endoplasmic reticulum; Biological process=response to stress
  Homolog annotation: Hit_ID=Q6ZFX8; Match level="QueryCoverage=92%, HitCoverage=91%, E-value=0.0, Identity=63%"; Hit description =Putative growth regulator
  Pfam annotation: Domain name=HSP70; Domain location=24-739; Score =196.7; E_value=5.5e-56; Accession=PF00012.10; Description=Hsp70 protein
  Subcellular localization annotation: CTP_CleavageSite=53; ConfidenceScore=5.49e-01
MASKVALMALFSVALLFSPSQSAVFSVDLGSESVKVAVVNLKPGQSPISVAINEMSKRKSPALVSFHDGDRLLGEEAAGLAARYPQKVYSQMRDLIAKPYASAQRILDSMYLPFDAKEDSRGGVSFQSENDDAVYSPEELVAMVLGYTVNLAEFHAKIQIKDAVIAVPPYMGQAERRGLLAAAQLAGINVLSLINEHSGAALQYGIDKDFSNESRHVIFYDMGASSTHAALVYFSAYKGKEYGKSVSVNQFQVKDVRWDPELGGQHMELRLVEYFADQFNAQVGGGIDVRKFPKAMAKLKKQVKRTKEILSANTAAPISVESLHDDVDFRSTITREKFEELCEDIWEKSLLPVKEVLENSGLSLEQIYAVELIGGATRVPKLQAKLQEFLRRKELDRHLDADEAIVLGAALHAANLSDGIKLNRKLGMIDGSLYGFVVELNGPDLLKDESSRQLLVPRMKKVPSKMFRSINHNKDFEVSLAYESENHLPPGVTSPEIARYQISGLTDASEKYSSRNLSSPIKTNIHFSLSRSGILSLDRADAVIEITEWVEVPRKNLTIENSTVSSNVSAESAAGNSSEENNESVQTDSGINKTSNISSEEQAAAEPATEKKLKKRTFRVPLKIVEKITGFGMSLSQDFLAEAKRKLQVLDKKDADRKRTAELKNNLEGYIYTTKEKIETLEEFEKVSTSEERQSFIEKLDQVQDWLYTDGEDANATEFQERLDQLKAVGDPIFFRLKELTARPAAVEHANKYIDELKQIVEEWKAKKSWLPQERVDEVIKSSEKLKNWLDEKEAEQTKTSGFSKPAFTSEEVYLKVLDLQTKVASINRIPKPKPKVQKPVKNETESSEQNTENSDSNSADSSSSSDSSVNSSEGTSEETVTEQTEGHDEL

SEQ ID NO: 216375 - protein, 235 aa, Glycine max
  Coding DNA Sequence Number=SeqID_99597
MPTVITIGSSCLGLTPTKSVSVNVISWIDFLELAMEIWFMLLMGRKCLFSLLCQTLLVNDPSLSVMILDGSVTPGSRSLILMEIVAYLSIKDYNDSSLAWQRLTRVVNVGGRKDLAYHGVIIEIQVDLHAECIKCSTGSEVPSYHSMFRGFQVMGRGVACGDCMSKVECDFPRYVSRHRWVVGTGTEVEIVVVGVAEEKLSPVPRRAPNVPTEFQRGPTNLLGPLLLSGIFDLRR

SEQ ID NO: 216376 - protein, 914 aa, Glycine max
  Coding DNA Sequence Number=SeqID_99598
  Gene Ontology: Mol. function=transferase activity; Biological process= response to oxidative stress
  Homolog annotation: Hit_ID=Q9FJG3; Match level="QueryCoverage=99%, HitCoverage=97%, E-value=0.0, Identity=66%"; Hit description =Phosphoribosylanthranilate transferase-like protein
  Pfam annotation: Domain name=C2; Domain location=292-369; Score=19.6; E_value=0.0045; Accession=PF00168.20; Description=C2 domain
  Pfam annotation: Domain name=C2; Domain location=443-527; Score=19.3; E_value=0.0048; Accession=PF00168.20; Description=C2 domain
  Pfam annotation: Domain name=C2; Domain location=601-688; Score=75.6; E_value=1.5e-19; Accession=PF00168.20; Description=C2 domain
  Pfam annotation: Domain name=C2; Domain location=7-98; Score=84.7; E _value=2.8e-22; Accession=PF00168.20; Description=C2 domain
  Pfam annotation: Domain name=PRT_C; Domain location=809-906; Score= -40.3; E_value=3.5e-05; Accession=PF08372.1; Description=Plant phosphoribosyltransferase C-terminal
  Pfam module annotation: Pfam domain module=C2::C2::C2::C2::PRT_C; Domain location=292-369::443-527::601-688::7-98::809-906
MGSVRKLIVEVVDAHNLVPKDGHGTSSPYVVVDFHGQRRKTRTAVRDLNPVWKETLSFNVDNVNSQSSQIFGDTLELDVYHDKSYGSTRRHNSLGRIRLSSAQFVNKGEEALVYYVLEKKYLLSMIQGEIGLKIYYVDEEKVLKIEEAPPPPPPPQKEAEITEPEKVEETPPPQPPEGEKPKEEEMKEKEKENAEPPPPPAPAAATEKPPPEAEQDYQPLDPLLDVKAASVSRSNSEIRFNGTNNGPAPPQPMRRSASTASFAASEASSETSSMMTMMERSSFDLVEKMHYLFVHVVKARYLPTNGNPVVKIAVSGQHHVTSMPARKSTVLFEWNQTFAFARDAPDSSSVLEVSAWDPQASEALLGGVCFDVNEIPVRDPPDSPLAPQWYRLEGGGALHGDLMIATWMGTQADESFPDAWKSDTFAHVNSRAKVYQSPKLWYLRATLLEAQDVFLLPLTSSKESCFRVKAKLGFQVLKSKTVVTRNGTVSWNNEDFIFVVAEPVSDHLMFTLENRQPDAPVTIGVLRIPLLAIERRVDDRSVASRWFTFDNESDDKASSRPRVHLRLCFDGGYHVMDEAAHVCSDYRPTARQLWKPPVGTVELGIIGCKNLLPMKTVNGKSSMDAYCVAKYGSKWVRTRTVSDNMEPKWNEQYTWKVYDPSTVLTIGVFDSSLLDMDNDKNTLIGKVRVRISTLHTGRVYKNTYPLLVLSPVSGLKKMGEIEIAIRFPPRVLAADAAVDAPCQAAGGGAAGGAAEHHGEDGGGTPVQGRTAAEEGGGVLHAGRGLTQLQHEETHAGMEESNRNHIGARAVSDVGAWNYRFRARDPLPHFDPKISLAEVVDREELDEEFDTVPNGAGGFGDARGARPGAGDVAGPTRHGNICVLVLDCGVHAVSCAFKDGGDGFRVLLSQAPYLP

SEQ ID NO: 216377 - protein, 272 aa, Glycine max
  Coding DNA Sequence Number=SeqID_99599
MEEAEEDQRRRLKLEEALEIQSLRRIISAYLNYPDAAEEDVRRNERSYRKLPPSHKLFLACVFLSLSKMDTLWPIQTVWIEILEALLSQYPQKFQRLRWCISMNTHFIFSMLQAFEPPLDMSQDADFSEDPHPESAQKDHLVSEGISACSCESAPEVGIESRHQSNTGNHSPRLIHTKETREYCGSPIADSKGNVPDTSSQQQWLAPSLKLNVPLVDADKDYGKVRCIIRNIVRDWAAEGKKERDQCYNPILEELNMLFPNRSKERIYQSGK

SEQ ID NO: 216378 - protein, 100 aa, Glycine max
  Coding DNA Sequence Number=SeqID_99600
MASYGGEILLDSSFPRSGVSHNFSSISIPLPLIFNKQRIPLMKKIQGLQAPHGATSPYYDVTSKEYVTCGLYGLGGGPKDEIQPLAFYLCNGIWGHYTSQ

SEQ ID NO: 216379 - protein, 237 aa, Glycine max
  Coding DNA Sequence Number=SeqID_99601
  Gene Ontology: Mol. function=transition metal ion binding
  Homolog annotation: Hit_ID=Q0VGS6; Match level="QueryCoverage=46%, HitCoverage=49%, E-value=2e-13, Identity=32%"; Hit description =Cyb5d2 protein
MATALRDKIMWTTSPVTTKAESGAEADHFKWIKIGAQLYSVIKSNPLFILPLSRFFVFMTLAGLSGSKPLISTTIILNVVMYSQNLMTWTNFCFLLTPFPRSFNYTNLFHVVGFVWAAWHSIPWYVGKLVGRYYDSQGNPTKYLKGVEAKAARGAQLLEKQKIEEAKLPSCNSRWSQDEGGEVWCDVGYPRLVQRPLEIALTGKMSKRCACFEDSQLDQPGLEVYEGCDYHATRCKV

SEQ ID NO: 216380 - protein, 128 aa, Glycine max
  Coding DNA Sequence Number=SeqID_99602
  Gene Ontology: Mol. function=transition metal ion binding
  Homolog annotation: Hit_ID=Q6T7C7; Match level="QueryCoverage=67%, HitCoverage=53%, E-value=3e-13, Identity=58%"; Hit description=Fiber protein Fb38
MSLKTLTTSPLSGITVLVLLLALLLRFYIKFDTAERLFSAEELSLLNGTDEGLPILLGILGENLIMVQEGDTIILLAGMLLAHLSLEISQNWGHSTTNVENCIFPIDYGEMREFVMFYMQCRENLDFT

SEQ ID NO: 216381 - protein, 654 aa, Glycine max
  Coding DNA Sequence Number=SeqID_99603
  Gene Ontology: Mol. function=RNA-directed DNA polymerase activity; Cellular component=chromatin; Biological process=chromatin assembly or disassembly
  Pfam annotation: Domain name=Chromo; Domain location=581-632; Score =31.3; E_value=3.4e-06; Accession=PF00385.14; Description='chromo' (CHRromatin Organisation MOdifier
  Pfam annotation: Domain name=rve; Domain location=312-434; Score =34.7; E_value=3.2e-07; Accession=PF00665.16; Description=Integrase core domain
  Pfam module annotation: Pfam domain module=Chromo::RVT_1::rve; Domain location=581-632::12-201::312-434
MVSSGMIKLSHGAFSSPVLLVKKKDRSWHFCVDYRALNSITVKDRFPMPTIDELLDESGNASWFSKLDLRQGFHQILLDENDTPKMAFCTHQGHYEYREYLGHIVSQKGVAPKPSKIQAMDFTENSFKLKRAMTRAPVLALPDFFIPFTLETDASGLAMGAVLMQRGHPIAYHKSLKELMSQIIQTPKQQVYLSKLLGYNYFIQYKIGKSNLVADALSRISDTQQGHYFVVSLPNFTILDALRNTLYDSDAFKTLLQQVQTDPSSHPDFKLHNSKFNPFRSVLMEEYHKTPLGDHMGFAKTLHRLHENFYWPTMRKEEDLSLDFITGLPPSHGYTAILVAVDRFSKGAHFDPTFVSQFWRESFKLCGTKLRMSTSYHPETDGQTEVLNRILEQYLWSFVHDQPSKWYKFLSLAEWSYNTSIHSTTGLTPFEATYGKPPTSIPQYLMGSSQVEAVDNFLSSRQDMLTTLKTRLLKAQNAMKSQADDKRHDVSYHIGDWVYVKLRPYRQTSVSLANYNKLSKRFYGPFQISEKIGVVSYHLDLPPTSKIHNVFHYSLLKPHQGPLVHVIDPLPPNSYDKHPLIKPLAILDSKWDNATSPPTLLVLVQWCGLAPEDTTWEKWDDLQLMFHLEDKVSLPAVGDDSNTMIPFPRIAACQ

SEQ ID NO: 216382 - protein, 77 aa, Glycine max
  Coding DNA Sequence Number=SeqID_99604
  Homolog annotation: Hit_ID=Q8GUS1; Match level="QueryCoverage=48%, HitCoverage=5%, E-value=1e-13, Identity=86%"; Hit description =NADPH:P450 reductase
MEAKKTPGAFRELKTIAGCTSNNAGAPSITLDAFGPDMVDMEMESQLTMLQDFTNGLLRLKTTGVPGFNSSHMVFLA

SEQ ID NO: 216383 - protein, 105 aa, Glycine max
  Coding DNA Sequence Number=SeqID_99605
  Subcellular localization annotation: CTP_CleavageSite=61; ConfidenceScore=5.15e-01
MGIAPTKTPSGPEEVQQGPGVSSSGYGPLSVLQGARTPLARDRARKTSSGPEEVQQGPRVSSSNYGPLSFLRSARRPQQVHQAPINQAFIKKYCALRQTQGETPQ

SEQ ID NO: 216384 - protein, 394 aa, Glycine max
  Coding DNA Sequence Number=SeqID_99606
  Gene Ontology: Mol. function=3-dehydroquinate synthase activity
  Homolog annotation: Hit_ID=Q9LH99; Match level="QueryCoverage=94%, HitCoverage=75%, E-value=1e-111, Identity=57%"; Hit description =Arabidopsis thaliana genomic DNA, chromosome 3, BAC clone: T19N8
  Pfam annotation: Domain name=DHQS; Domain location=14-394; Score =501.6; E_value=9e-148; Accession=PF01959.7; Description=3 -dehydroquinate synthase (EC 4.6.1.3)
MCERSHPLGHYPITSFSLGQCDVTQTDVERGWNTFVFPSHHRQLAHDWSSIAVICPLFVNEGEILDGQNKRVATIFDISTPEELEGLRPEDQKAENIVVNLLDWQVIPAENIIAAFQRSQKIVFAISNNTSEAQVFLEMVMKVEDVEPVLELKEYFERRMEESNLLSLTKATVTHIQVAGMGDRVCVDLCSLMRPGEGLLVGSFARGLFLVHSECLESNYITSRPFRVNANYLSYLHNSQQWGDSVRQAVETCLGKVGCDVFNSHHMTWINGPVHAYVAVPGGRTRYLSELKSGKEVIVVDHQGQQRIAIVGRVKIESRPLILVEAEIELDNQIISILLQNAETVALVCPPQGNTLLKTAIPVTSLKVGDEILLRVQGGARHTGIEIQEFIVEK

SEQ ID NO: 216385 - protein, 102 aa, Glycine max
  Coding DNA Sequence Number=SeqID_99607
  Gene Ontology: Mol. function=protein kinase activity; Cellular component=chloroplast; Biological process=protein amino acid phosphorylation
  Homolog annotation: Hit_ID=Q5XWQ1; Match level="QueryCoverage=95%, HitCoverage=16%, E-value=4e-33, Identity=72%"; Hit description =Serine/threonine protein kinase-like
TKHLTWPIRIKIAIGAANALAFLHEEASRPVIFRDFKTSNVLLDKDYNAKLSDFGLAQDAPVGDKSHVSTEVMGTQGYAAPEYVMTAYTITSFMKIPSPGHV

SEQ ID NO: 216386 - protein, 157 aa, Glycine max
  Coding DNA Sequence Number=SeqID_99608
MVQKLIESLIVAIAVMNAGKKITNNKDHHSETLETQRHYMQNNNNRGNSWQQIIHDAGSKFDTENLALSFFLSGLTPELERSVRVHRPKTIQEAIRIARLQEEGDQSGLQCFAIMLQPFGINIDLKEHSNRVTPKAYTPKSPSGPLPPDSGPTQKIF

SEQ ID NO: 216387 - protein, 88 aa, Glycine max
  Coding DNA Sequence Number=SeqID_99609
  Pfam annotation: Domain name=zf-CCHC; Domain location=4-21; Score =17.6; E_value=0.0012; Accession=PF00098.13; Description=Zinc knuckle
GLHVLCATCGCYGHVARACPTIPLSQLIADSQETQSKQGVGVTPNPNHNMEKVSQLAIEFDDVATHEEWMVVKHKPRKNETNQKTPIM

SEQ ID NO: 216388 - protein, 76 aa, Glycine max
  Coding DNA Sequence Number=SeqID_99610
  Homolog annotation: Hit_ID=Q1SV97; Match level="QueryCoverage=81%, HitCoverage=40%, E-value=3e-07, Identity=39%"; Hit description =Ribonuclease H
MELKFALCEWIKGLRNIICKSDSKLALQFVTEGVIQSHPYAPIVAKIREFLSYDGNLSFLHTLREGNLVSDYLAKK

SEQ ID NO: 216389 - protein, 67 aa, Glycine max
  Coding DNA Sequence Number=SeqID_99611
MEKKLSKEARMSNVKVTLGATTGSDQVCSSDSQQNHTFSAQLNASLPRENLTTDQSACKVCDGPRII

SEQ ID NO: 216390 - protein, 78 aa, Glycine max
  Coding DNA Sequence Number=SeqID_99612
MCLVLHILMLKADTAHTTTISPCPTFQLMGCICFGISADGLSIPEEEKNAYEWLQEREELEDLEVNGKMYNGPKIVES

SEQ ID NO: 216391 - protein, 194 aa, Glycine max
  Coding DNA Sequence Number=SeqID_99613
  Homolog annotation: Hit_ID=Q9SJI9; Match level="QueryCoverage=64%, HitCoverage=55%, E-value=4e-29, Identity=46%"; Hit description =Expressed protein
  Pfam annotation: Domain name=DUF1637; Domain location=30-188; Score =149.4; E_value=9.5e-42; Accession=PF07847.3; Description=Protein of unknown function (DUF1637)
KGRDFCELPRETIASSNSRRNRRRQRKKPPVQKLFETCKVVFASAGTGFVPPHEDIDELQSVLDGIKPEDVGLRPDMPYFRTSATQRVPRITYLHIYECEKFSMGIFCLPPSGVIPLHNHPGMTVFSKLLFGTMHIKSYDWVVDLPPESPTTIKPSESEYFPIFVPYPCTIHYYLERGWITLAHLPKILSEWKI

SEQ ID NO: 216392 - protein, 55 aa, Glycine max
  Coding DNA Sequence Number=SeqID_99614
MQCQNNLSDSNSANGHPEKPLKNAKQGHPIARGTRTEETGEAGIVIRGRRGAGRG

SEQ ID NO: 216393 - protein, 64 aa, Glycine max
  Coding DNA Sequence Number=SeqID_99615
MDYIFGNETEARTFSKAQGWKEMLLWEDFFNNWLSKPIEECLRMIEELGVKQPMLSSKGQAAHT

SEQ ID NO: 216394 - protein, 127 aa, Glycine max
  Coding DNA Sequence Number=SeqID_99616
  Gene Ontology: Mol. function=drug transporter activity; Cellular component=membrane; Biological process=multidrug transport
  Homolog annotation: Hit_ID=Q1SD91; Match level="QueryCoverage=68%, HitCoverage=17%, E-value=2e-28, Identity=73%"; Hit description=Multi antimicrobial extrusion protein MatE
MEGDLKQKLLRRRKEEEEEEEEELSLAKRVWNESKVMWIVAAPAIFTRFSTFGISVISQAFVGHIGSKELAAYALVFTVLIRFANGVLGSLEKEKYMKEIEVGLLRLVDLGYMNTWIVTSEVCEHML

SEQ ID NO: 216395 - protein, 229 aa, Glycine max
  Coding DNA Sequence Number=SeqID_99617
  Subcellular localization annotation: CTP_CleavageSite=67; ConfidenceScore=5.53e-01
MTAKLSLLPWRGPKTPNAQASPLLLRQPSNPTETPNQKRKQQVTALPLLLPTKPNKSAICGSNCTTTSSSVADQQSRFRKCSITDQHGTGNGACHPVDDTFSQPYGGGNGALPSVCVTFSRPYSGGSGAFHPIGVSFSQPYGAGNGGATVFMSLSQPYVVDGSQYEVIDWSGFLLKLGSKASLYLKSFPVASDLKLYVEATSDPSFNRKPEAAPAYSYQSPWTGFQFPA

SEQ ID NO: 216396 - protein, 113 aa, Glycine max
  Coding DNA Sequence Number=SeqID_99618
MGSRKEEERNEKIIRGLMKLPPNRRCINCNSLKNPHNTNTKQTKPTASYNSATAMATTNVVSIGSQPPAALLINNNTAGSAMLLINNDKRTGACHPVGVTFSPPYGAGNGACT

SEQ ID NO: 216397 - protein, 611 aa, Glycine max
  Coding DNA Sequence Number=SeqID_99619
  Gene Ontology: Biological process=regulation of GTPase activity
  Homolog annotation: Hit_ID=Q5N770; Match level="QueryCoverage=98%, HitCoverage=84%, E-value=4e-55, Identity=31%"; Hit description=ZIGA1 protein-like
  Pfam annotation: Domain name=ArfGap; Domain location=1-82; Score= -14.1; E_value=0.00041; Accession=PF01412.9; Description=Putative GTPase activating protein for Arf
MRRSPNREFTHRVKSVSMAMFTSQEVDALQNGGNQRAREIHLKNWDFQRQRLPDSSNVDKVREFIRNVYVDQRYAAAKSSDKPPRDSPIEDDTRRASSYHSYSQSPPYDYQYEDRRYGKQAAALTRKPGSDKVCYERKISSIIFSPGRFSDHAYDDRFANERSGPRISDFSMSNGGEQFKTDFQHSGTCSSKDVLPHVTNTSLETNSKRDADGIHRPQQMSIGSLLAGEIEPAIFPPFPSFLTTQPTLYHCVPCLSMTFSLVQLSGKRARDELQQYWRTTSLGSTDSNLSSLRSYSSGGLVDFFSEPFQASGPHQNKVSCTPQPSDLGSTVSSDLSEAPVAPKPFSSSASSIDLFQLPAAPSQASSVDLFQSSALSAIASFNERQPLKTSQSSSVDFMDLSQQPSAATSSEKSLELSVPENEGWATFDMPQHTSTAQVEIQPAVQEKFDPFLNLNANTLWPCFETSSASALSSVTSNLWRDVTWTREEQVSVMASNSQSWSAFKDPANSVPVDALITQGSQMHDLPSTDDQFLDLRASEGSNKDGMHRIDPVAGFDHDLSSHFVSGSPCPPSAFPPMGEVQPNEINHKSTNPFDYPFDSDVEHNNTVGHDS

SEQ ID NO: 216398 - protein, 60 aa, Glycine max
  Coding DNA Sequence Number=SeqID_99620
CQLQFLDVSSLQAALPDSQLTPTFQSGIAEPWLPQNTLNPYFSSAGQGGPSRLILEVQTF

SEQ ID NO: 216399 - protein, 98 aa, Glycine max
  Coding DNA Sequence Number=SeqID_99621
  Homolog annotation: Hit_ID=Q1SD84; Match level="QueryCoverage=49%, HitCoverage=3%, E-value=3e-07, Identity=51%"; Hit description =Integrase, catalytic region
MTKLCETELTVQRPDMRGRVCQKMLGLLGESLISQFMHTPEPKHFEAAYRIFNYLKGSPGRGLLYKKYSNSTPTKIYRDRSATAIAYNHVLYDGINWK

SEQ ID NO: 216400 - protein, 148 aa, Glycine max
  Coding DNA Sequence Number=SeqID_99622
MVGRRKRELGLEGIEVILRTGAANYSVTTMGEFKSQGSSESFSDSSYQHDSSSSSSVHHCQKGKRNPNSDKIGISFLKVVECCNQLGNFCFCTSKVFLKFTLESCLNKFWWKRNEMVFQQKCVTIEKQGSPNLLLNDENMTHRDKSAK

SEQ ID NO: 216401 - protein, 111 aa, Glycine max
  Coding DNA Sequence Number=SeqID_99623
MTTDKRRGNRGNSGEGVATTVRIDYNEFDGEDDLEHRSRIRTTPFTTSKLTSLCSFECRIHALEMELKLCKQQIAGLEKSYEYVALDDGQSSREMNFASLSSFETGKLFLP

SEQ ID NO: 216402 - protein, 72 aa, Glycine max
  Coding DNA Sequence Number=SeqID_99624
MTAANSAAKEFDVISMQSDNITYHQKGVVVSRVEMEGRDDKLVTQVSGFDAKEGVMEAMAICPFHYLWCDAG

SEQ ID NO: 216403 - protein, 133 aa, Glycine max
  Coding DNA Sequence Number=SeqID_99625
  Gene Ontology: Mol. function=transferase activity; Cellular component= membrane
  Homolog annotation: Hit_ID=Q5BM99; Match level="QueryCoverage=99%, HitCoverage=28%, E-value=2e-56, Identity=72%"; Hit description =Secondary cell wall-related glycosyltransferase family 47
  Pfam annotation: Domain name=Exostosin; Domain location=1-79; Score= -103.0; E_value=0.018; Accession=PF03016.6; Description=Exostosin family
FCLNIAGDTPSSNRLFDAIASHCVPVIISDEIELPYEDVIDYSQFCVFVRTRDALKKRYLINFIRSIGKEEWTRMWNRLKEVESFFEFQFPSKEGDAVQMIWKAVARKVPFMKLKTNRSRRFLRSLYGNHNFW

SEQ ID NO: 216404 - protein, 364 aa, Glycine max
  Coding DNA Sequence Number=SeqID_99626
  Gene Ontology: Mol. function=transferase activity; Cellular component= membrane
  Homolog annotation: Hit_ID=Q5BM99; Match level="QueryCoverage=88%, HitCoverage=62%, E-value=1e-97, Identity=57%"; Hit description =Secondary cell wall-related glycosyltransferase family 47
  Pfam annotation: Domain name=Exostosin; Domain location=121-360; Score=79.4; E_value=1.1e-20; Accession=PF03016.6; Description =Exostosin family
  Subcellular localization annotation: CTP_CleavageSite=43; ConfidenceScore=5.65e-01
MVERTVSAGSTIKVVSKKSLCGFFTMTTLLFMLSWLFVLRSTRSEASPNSNLFSSFSNSDFDQSVQQQKHMEEEVEPSNFGNRAILVNNIEATTTHDEKQQQQQQQLGVKCKAHDKAVLRVFMYDLPPEFHFGLLDWKPEENVNSVWPDIKTKAPHYPGGLNSQHSIEYWLTLDLLASELPEAEAQSNARSVIRVRNSSESDVVFVPFFSSLCYNRFSSKTNPHEKRSMNKVLQEKLVKYVTEQEEWKRSGGKDHVIVAHHPNSMLDARMKLWPGTFILSDFGRYPTNIANVEKDVIAPYKHVVGSYDNDQSSFDSRPTLLYFQGAIYRKDLQLGISVLNCSSGCITYTRAKLVSAHVKCTPCL

SEQ ID NO: 216405 - protein, 235 aa, Glycine max
  Coding DNA Sequence Number=SeqID_99627
  Homolog annotation: Hit_ID=Q8PNJ1; Match level="QueryCoverage=50%, HitCoverage=18%, E-value=5e-21, Identity=48%"; Hit description=Phage- related tail protein
VLQWLLFLSAVPPVQLLTGWCVTAKAPPDISAGKCSGRVPFAIQAAQLLGRAIGAGLFAITPAGERGMCCKAIKLGIRFVGQPGHVLLELREREEGVVVAQAVRHDDGAFLLSQQRDHLILAPVPAVYQRREARGQLGVGDVAGGSAHAVLGFSLRVIGCRRRSRQSTIKLIDTVDLEGGPVGKPVVPAALMNRPTRGERRFAYWALAECILAYYVGTDEGVSEVLHVAGEKRLH

SEQ ID NO: 216406 - protein, 193 aa, Glycine max
  Coding DNA Sequence Number=SeqID_99628
  Gene Ontology: Mol. function=cytochrome-b5 reductase activity; Cellular component=cellulose and pectin-containing cell wall; Biological process=electron transport
  Homolog annotation: Hit_ID=Q5PY86; Match level="QueryCoverage=83%, HitCoverage=57%, E-value=1e-85, Identity=93%"; Hit description =NADH:cytochrome b5 reductase
  Pfam annotation: Domain name=FAD_binding_6; Domain location=31-130; Score=169.1; E_value=1.1e-47; Accession=PF00970.14; Description =Oxidoreductase FAD-binding domain
  Pfam annotation: Domain name=NAD_binding_1; Domain location=139-191; Score=-10.9; E_value=0.025; Accession=PF00175.11; Description =Oxidoreductase NAD-binding domain
  Pfam module annotation: Pfam domain module=FAD_binding_6::NAD_binding_ 1; Domain location=31-130::139-191
MQFCGTLPPVGHLFRLNFYVKSCLDPENFKAFKLVKRAQLSHNVAKFTFALPTPTSVLGLPIGQHISCRGKDAQGEEVIKPYTPTTLDSDVGHFELVIKMYPQGRMSHHFREMRVGDYLSVKGPKGRFKYQPGEVRAFGMLAGGSGITPMFQVARAILENPNDRTKVHLIYANVTYEDILLKLSQNAHPGQFA

SEQ ID NO: 216407 - protein, 165 aa, Glycine max
  Coding DNA Sequence Number=SeqID_99629
  Subcellular localization annotation: CTP_CleavageSite=45; ConfidenceScore=5.44e-01
MNSLPSTVHVSSTIESGALRIHCLALFANSPFSTFIRRPMNSLPSAVHVSSTIESGVPRIHCLALFANSPFSTFIRRPMNSLPSAVHVSSTIESGVPRIHCLALFANSPFSTFIRRPMNSLPSAVHVSSTIDAVDVSSTHESGAPRIYCLALFANSPFSTFFGDP

SEQ ID NO: 216408 - protein, 38 aa, Glycine max
  Coding DNA Sequence Number=SeqID_99630
MLCGMGSKKYGGSDTCRRSSLLRIDESDKLHDNYINLI

SEQ ID NO: 216409 - protein, 89 aa, Glycine max
  Coding DNA Sequence Number=SeqID_99631
MVKVNERYKRKLSCHQLYMLELNEGSKNEGRSKVASTKRSEEFVCKMLVVVYLFRMAHGLTWFLLSAEQNGVSHPIPCALENTDTKTPL

SEQ ID NO: 216410 - protein, 207 aa, Glycine max
  Coding DNA Sequence Number=SeqID_99632
  Gene Ontology: Mol. function=transcription regulator activity; Biological process=regulation of transcription
MGGQVVKRRRVYSVESNQIVQPIFTRNYLNHLVPALVKIKEKGSIKEDSSSHCNDNINNAVKYEVDMAMVLSAQGFAWSNGLKVKLQSDDVHVNAAKSTRFLENEASEGSSKNNVYDKNEVVPMEYFSSNPSSRSKCKDMSEMKRDLAREDDKEAEDINNQWKRLRRMIPGGEEMCDDEQMVSELESYINCLQMQVNALQFLLPHTR

SEQ ID NO: 216411 - protein, 103 aa, Glycine max; identical to SEQ ID NO: 130349
  Coding DNA Sequence Number=SeqID_99633
  Gene Ontology: Mol. function=transporter activity; Cellular component= periplasmic space; Biological process=transport
  Homolog annotation: Hit_ID=Q5PF00; Match level="QueryCoverage=99%, HitCoverage=31%, E-value=7e-43, Identity=77%"; Hit description =Glycine betaine-binding periplasmic protein

SEQ ID NO: 216412 - protein, 79 aa, Glycine max
  Coding DNA Sequence Number=SeqID_99634
MSPFRRPHRVCRARMSLRYRWHSPCHVPVIRQTTNGIHHAADAGALPGLTGALSINPLIYSSKAGREKCLENVKINAKW

SEQ ID NO: 216413 - protein, 257 aa, Glycine max
  Coding DNA Sequence Number=SeqID_99635
  Gene Ontology: Mol. function=protein binding; Biological process =protein metabolic process
  Homolog annotation: Hit_ID=Q9LU73; Match level="QueryCoverage=36%, HitCoverage=10%, E-value=2e-26, Identity=64%"; Hit description =Arabidopsis thaliana genomic DNA, chromosome 5, P1 clone:MUL3
GHQDLFILRSDLPSQWLLFLSAVPPVQLLTGWCVTAKAPPDISAGKCSGHAARRVPFAIQAAQLLGRAIGAGLFAITPAGERGMCCKAIKLGNARVFPEFDRLQTTPSPLIHTQPSLSNALIAALKRAQAHQRRGCIEHQQQQPLLTIKVELEHLIISILDDPSVSRVMREAGFSSTAVKKSSLSIPSTSRGGPVPAFVPFSEVGKPVVPAALMNRPTRGERRFAYWALAECILAYYVGTDEGVSEVLHVAGEKRLH

SEQ ID NO: 216414 - protein, 306 aa, Glycine max
  Coding DNA Sequence Number=SeqID_99636
  Gene Ontology: Mol. function=peptidyl-dipeptidase Dcp activity; Cellular component=outer membrane; Biological process=proteolysis
  Homolog annotation: Hit_ID=P24171; Match level="QueryCoverage=85%, HitCoverage=38%, E-value=2e-74, Identity=55%"; Hit description =Peptidyl-dipeptidase dcp
MALGSQAQAAETQPHADHSALPSGQAKEANVTGEANQHDKQKTQNPFFYQSRLPFQAPPFNLIKESDYAPAIEAGIKQKREEVEKIANNPAKPNFKNTLVALEQAGSLLTRVMNVFGAMTSANTSDALQKLDEETSPKLAALNDDIMLNGKLFARIKAIYQDRDALKLDPESRRLVEVTYKNFELAGANLSDADKAKLKALNQEAATLSTQFTNKLLAASKNGALAITDQAKLDGLSEGELAAAAQAAAERKLEKQWLLVLQNTTQQPLLQSLKDRDTRQALFDASWTRAEKGDGNDTRQTISRLA

SEQ ID NO: 216415 - protein, 283 aa, Glycine max
  Coding DNA Sequence Number=SeqID_99637
  Gene Ontology: Mol. function=methyltransferase activity; Biological process=metabolic process
  Homolog annotation: Hit_ID=Q31FI3; Match level="QueryCoverage=76%, HitCoverage=81%, E-value=3e-16, Identity=25%"; Hit description =Hypothetical protein precursor
  Pfam annotation: Domain name=Methyltransf_11; Domain location=162 -254; Score=4.1; E_value=0.022; Accession=PF08241.2; Description =Methyltransferase domain
  Pfam annotation: Domain name=Methyltransf_12; Domain location=162 -252; Score=18.8; E_value=0.01; Accession=PF08242.2; Description =Methyltransferase domain
  Pfam module annotation: Pfam domain module=Methyltransf _11::Methyltransf_12; Domain location=162-254::162-252
MHSVKLSAEALPSQAWIQRFLPKRLWAQALLIQCVSMLLITGLAPGVINSVFAFELRSLGIRLDTIWFWLLPHVCLTSVMAKIAKMPAWWRWIHVIFPVAVVFMQQVALPPGVYFAGFIMTLALYWSVHNTRVPFYPSFPSTWRAMHHILEQHAGDRSLQVLDIGSGIGDIAMFLAKQRIHDEVSGIEIAPLPWAISAVRAIFSGTSVRFILGDYRQLDFAALDVVFAYLSPAVMTDVWQKVQHEMRPGSLFVSSEFPVAELTADRIIYPSAQAPALYIYHIR

SEQ ID NO: 216416 - protein, 89 aa, Glycine max
  Coding DNA Sequence Number=SeqID_99638
MKRAQINRTHPSISSTKAENVNETRSRNVNEAKGRNENEAKGRNENEAKGRKRNRNEIAIRSRKMEKCIHVNSNTKLPKRKTLNSSIIA

SEQ ID NO: 216417 - protein, 82 aa, Glycine max
  Coding DNA Sequence Number=SeqID_99639
MDKFDIFVPHPLVITSLLPLEYGCKPLLCLLKRPALLSLDFQDRSIRNYLMQSYPARALDRKLQVDWARDAREGPRVLMSLR

SEQ ID NO: 216418 - protein, 223 aa, Glycine max
  Coding DNA Sequence Number=SeqID_99640
  Homolog annotation: Hit_ID=Q1SIY6; Match level="QueryCoverage=17%, HitCoverage=3%, E-value=3e-09, Identity=66%"; Hit description =Integrase, catalytic region; Zinc finger, CCHC-type
  Pfam annotation: Domain name=WD40; Domain location=33-69; Score=5.2; E_value=9.1; Accession=PF00400.22; Description=WD domain, G-beta repeat
  Pfam annotation: Domain name=WD40; Domain location=97-133; Score =11.7; E_value=1.6; Accession=PF00400.22; Description=WD domain, G -beta repeat
  Pfam module annotation: Pfam domain module=WD40::WD40; Domain location=33-69::97-133
MHPTNPKTPCRITFSLPKDHNSLHQRLEELCGKNLLHLPWYKSPVVYSLAFEFPWLVSASSDGKLALIDVRKLLKISKRALGKRVSKVKHLGGDIVEPPQRMLHGFKSNLFSVDIGAERIVCGGEEGVVRIWNFTEALEIERRARALRGIRLDNRMRRRKLQTELSNKSGRSDQCSVAAKKNAVTCIWPKRGVGSMILASEFYETNRHTGSYGSNTGSWGSDR

SEQ ID NO: 216419 - protein, 54 aa, Glycine max
  Coding DNA Sequence Number=SeqID_99641
ESIDEEDPRPTSSNGACIIVCQGVGPGLNFHIISTRYAYNDDLGTTCKISHGYS

SEQ ID NO: 216420 - protein, 145 aa, Glycine max
  Coding DNA Sequence Number=SeqID_99642
MATVQHLVIVNKKRMPIICRIKPDLNRTSKTTEVAQVQIDLMVGDHKIIMHIVGPFNNSYAGSSNRGPQKPRTLMLPLKIWKFRLDNWQNNCLSMEMDFFSTNTQMAPKKLATKRDRKAAIREGSRTAPPVDFEFDGDRFCSEEH

SEQ ID NO: 216421 - protein, 95 aa, Glycine max
  Coding DNA Sequence Number=SeqID_99643
  Subcellular localization annotation: CTP_CleavageSite=77; ConfidenceScore=5.81e-01
MSSTSSALPPSPWTYLLLKNRPVSRLCNSRTKLLGSRPRPNDACKCASGASSSTGVLRWTPRMATAVVVVEHLLLVEAAKIASVVVLALACNICQ

SEQ ID NO: 216422 - protein, 147 aa, Glycine max
  Coding DNA Sequence Number=SeqID_99644
  Gene Ontology: Mol. function=RNA-directed DNA polymerase activity; Biological process=RNA-dependent DNA replication
SSQEEATSSPSSSGSEGEAKGDEHIEEVYPYEEGDLLMVRSIRLVSKLSLTIISHPKPYKLQWLNEQGEMIVNQQKAIHNGLTNEKTLTHGSKKFKLVPLTPSQVVGDQVQIKLKWDEEKNRKRKEEQPLIVKEECKEVSVSSKRLA

SEQ ID NO: 216423 - protein, 169 aa, Glycine max
  Coding DNA Sequence Number=SeqID_99645
MIYAIKNVRVPGYLDLEWFFQQGFNFPNLLEVQALSKLVQMKETFYPELVYTCARVDHEGNFFSTINGVDMDIDVVVWKEVAGLDIGGVRKFDETPDGCDLQIVYDLKLGIRINWVLLNIVDFTKASSEITKRHLKNLGMMFANHEWIIAGEPVARNVGEIEEDVEVEA

SEQ ID NO: 216424 - protein, 94 aa, Glycine max
  Coding DNA Sequence Number=SeqID_99646
MEMGVHDIMKPMVLNEIKKAREEEYCHSQSKETTNFVPRLQSCQPLVTWTMIGIELFRPPPMKFSMVQMARHPPNFSVIRRVCGQMSSMGGLCH

SEQ ID NO: 216425 - protein, 141 aa, Glycine max
  Coding DNA Sequence Number=SeqID_99647
MGSERGVTGVLEKVLVCFVDSVEAKLHDESRLIQRCFDDNKGDDKKLKGQSKNEFKMFKIESRTLQDSRGNLISRIKNQASKNQDQDSRLKIQESRKYLIKISMKRFFQKLSSTWIFLKTCLPKSFYSLVIDYQIVVIDYQ

SEQ ID NO: 216426 - protein, 73 aa, Glycine max
  Coding DNA Sequence Number=SeqID_99648
MTSRWLTNHSSPKTHKITLQSRTWYRTRAASINSSIFGQDVLDIVSDIVDPATSILHLTFYLALCIVQPDLIP

SEQ ID NO: 216427 - protein, 103 aa, Glycine max
  Coding DNA Sequence Number=SeqID_99649
MNSFPKVFFEFYTDLDINRWDCHTCDDEMMSHFMTKNQNEREVMEKTKVTSKPHTKTKGKLQRTLAFHDFIATTESYEWEQEPECETERCWVTMPPQKVQEWE

SEQ ID NO: 216428 - protein, 143 aa, Glycine max
  Coding DNA Sequence Number=SeqID_99650
MKVDMEAMKEQITTMMEAMMSMKKIMEANAIAIAATNVVAKVSPMPPSGLNQMNHPTSVCPNYTPPNVAYTPSENVNNSTPILIESRQPQTDHAHVSQIVGETHEIPHHNLADFKPCLGYAIKGQAVGGIPLQNTLEGRQYHP

SEQ ID NO: 216429 - protein, 86 aa, Glycine max
  Coding DNA Sequence Number=SeqID_99651
MENSSLRNIAFVLFLFLILHHQVLFVQGRNLKCPLCKECSKSQKNTMSVASYEVHQEGLRRVEYEVDDFRPTTPGHSPGVGHSINN

SEQ ID NO: 216430 - protein, 57 aa, Glycine max
  Coding DNA Sequence Number=SeqID_99652
MEKNEECWKRELKVGIYMRGLRNRKWNLNKVLRFGRPQLVMYFTPHRWENILCGDIL

SEQ ID NO: 216431 - protein, 256 aa, Glycine max
  Coding DNA Sequence Number=SeqID_99653
ASEPVDTQRLTSSSAPFKRCQHLPTETAKKSRLLSVRLKDGKSDDMRRYPMVIHTFCQLEARDPVDTQRLTSSSAPSSSRDGKSDDMRRYLMVIRTFCQLEASEPIDTQRLTPPSAPLSSRGEKSNDMWRYLMVICTFCQLEASEPIDTQRLTSSSAPLSSTDDKQASPLTRRDQCGHLHPSRKCQRLPAETAKKFHFCHQTQGFASMRRYLKGLPAETAKKSHFCYQTQGSGSMRKYLMVIHTFHKLEASDPVDT

SEQ ID NO: 216432 - protein, 130 aa, Glycine max
  Coding DNA Sequence Number=SeqID_99654
SLRAIRLFVLQTAKKNVYTDNHSGISARQRDSNVSIRDLVSAEDDKEKKNVYSDNQSGISARQRDSNVNMTDLLSAEDDAFRLTDSKKRMVYTDNHFGYFPPGSGNSNIRIGDLVSTEDERKSSRVIGLV

SEQ ID NO: 216433 - protein, 64 aa, Glycine max
  Coding DNA Sequence Number=SeqID_99655
MTLVSACYQALSLTDSKRMFIRITTGVRITIRYLGMSSDLPSLDDKGADDDVSLCESTGSLTSG

SEQ ID NO: 216434 - protein, 83 aa, Glycine max
  Coding DNA Sequence Number=SeqID_99656
  Subcellular localization annotation: CTP_CleavageSite=57; ConfidenceScore=5.30e-01
MEQSEGFSKAGSDRLIFKLKRSLYGLKQSPRFTLQSMQSQLTSSSIAWTCRMLLSVRCDRTLNPRNQGGDCCAWLIFYGLDKC

SEQ ID NO: 216435 - protein, 82 aa, Glycine max
  Coding DNA Sequence Number=SeqID_99657
MSNEELKLQDPRCRIQCPGHPARKYWTHKSVISLTDCAGSTMSDTIFFRRMIDLIQRKLLQPRYAHCYINMKAARVLYQVRD

SEQ ID NO: 216436 - protein, 79 aa, Glycine max
  Coding DNA Sequence Number=SeqID_99658
MAEKKRWVELSGVRFCNWGRGSEGFGGKGFGERNEKRNGGDDVVVVAWALSGSVHSSRFITLVCKVGNLEPFVANVRLH

SEQ ID NO: 216437 - protein, 190 aa, Glycine max
  Coding DNA Sequence Number=SeqID_99659
MTEGCGEGFCLANLPGDAFSLWGNFFEAKKQMMADASLGKPLVEILPPGQLRGFCPLLAWLGSAVLGYGPVLSFGLVGPLLPPVISFVARILPTLACAPLAKSVPRQNEREPTNGSLFWPNIVEEERDTGLIGEGRIKATRAESQWIVAARPLCHLQYPVAYLSRLQRILPAARWELRFKASRRANPPHE

SEQ ID NO: 216438 - protein, 55 aa, Glycine max
  Coding DNA Sequence Number=SeqID_99660
MAQFGTLSEQSEEKLEESQETVRNAAIVVTMHTFARLEVTDEFTIGVRMNMCRDP

SEQ ID NO: 216439 - protein, 147 aa, Glycine max
  Coding DNA Sequence Number=SeqID_99661
MASRKRRIILPERKVEIYHTELDDFKTELERRNLNKRLTNLADGTIDLALVKEFYANLYSFEDPSPKQARVRGHLVKIDADNLNTFLETLVVLEEGETLPIYSRYCRLPTDHREIETALCIPGKWFILNAEGHPGRILRKDLTTLAQ

SEQ ID NO: 216440 - protein, 85 aa, Glycine max
  Coding DNA Sequence Number=SeqID_99662
  Gene Ontology: Mol. function=helicase activity
  Homolog annotation: Hit_ID=Q1SRJ5; Match level="QueryCoverage=97%, HitCoverage=10%, E-value=5e-10, Identity=49%"; Hit description =Probable helicase [imported]-Arabidopsis thaliana-related
MTENLLLKDYISIFQANSVVDEDHDDIDDVLSKPSISDSKFISWMNTNQNSVEGRSLTYAEFVFKFVYSKKKRCWQLRKKGYTIG

SEQ ID NO: 216441 - protein, 131 aa, Glycine max
  Coding DNA Sequence Number=SeqID_99663
MHALLGTFDSGNWSDSKVLDSAGLSCRAFTRNRAIILVEISLTRGICRRCLIRIRLSYHEESGFSISGDTIRTHEHYSLYTCSYSHLLLHNRRLFAEIAYQITQVPRVFDTRFLPFYTTCAIRCPCRKPNT

SEQ ID NO: 216442 - protein, 65 aa, Glycine max
  Coding DNA Sequence Number=SeqID_99664
  Subcellular localization annotation: CTP_CleavageSite=54; ConfidenceScore=5.34e-01
MDMSVKQEKPSFEAHNFVLFLSFSLPSSSPTSSSYPWLSMVVSLCLTHLLHEVVMTHLVARISPL

SEQ ID NO: 216443 - protein, 70 aa, Glycine max
  Coding DNA Sequence Number=SeqID_99665
MTSLISKELKVCLMVRRLKDLSFNKNMSCKKDKDNLTKHSVHNKLHRSDFLIAIKEYVGARETPSSTAKR

SEQ ID NO: 216444 - protein, 67 aa, Glycine max
  Coding DNA Sequence Number=SeqID_99666
MWGVELLRKRRFYGVFIQWIYRNGAVILIIKGLAGEIFEFSLDPILMTRLRFSDVLQLVAYPKLYYT

SEQ ID NO: 216445 - protein, 241 aa, Glycine max
  Coding DNA Sequence Number=SeqID_99667
  Gene Ontology: Mol. function=UDP-glucose 4-epimerase activity; Biological process=galactose metabolic process
  Homolog annotation: Hit_ID=O65780; Match level="QueryCoverage=33%, HitCoverage=22%, E-value=2e-39, Identity=90%"; Hit description=UDP -glucose 4-epimerase GEPI42
MAQGSTPPDHCNLISQFLVHGFLFSSTQFQESILGLNKFLAFGGNVVAMDKDSCGVGFMAELSGMEQEETKKAFFILTVEKRNKMQGITRMDVALDAMRPLGFRTQLILRTVNELLDVVWELLQVYGGNQGWCFIEETYYKLLMEALLSKQQGSAEYKFGNLGTGRGTSVLEMVAAFEKASGKKFPLKMCPRRPGDATAVYASTDKAEKELGWKAKYGIEEMCRDLWNWTSKNPWGYQGKH

SEQ ID NO: 216446 - protein, 117 aa, Glycine max
  Coding DNA Sequence Number=SeqID_99668
  Gene Ontology: Mol. function=DNA binding; Biological process=DNA integration
  Subcellular localization annotation: CTP_CleavageSite=49; ConfidenceScore=5.17e-01
MYRVPYVSIVGSLMYAMVCTRPNLAQVVSMFSCKATLQPTFALSTTEAECMALAEATKEAKDQVHHERTKHIDTKYHFIRTEKRIVVQKVDMKENPVDMFTKPIPQSKFLHYLDYLM

SEQ ID NO: 216447 - protein, 82 aa, Glycine max
  Coding DNA Sequence Number=SeqID_99669
MMWMDKFAFTLNGSQDLPRLLAKAKAMADVYSAPEEVHGLLDYCQHMIDLMAPLAKPTYRLSEPFAERNTPWLSARKNLEEG

SEQ ID NO: 216448 - protein, 92 aa, Glycine max
  Coding DNA Sequence Number=SeqID_99670
  Subcellular localization annotation: CTP_CleavageSite=49; ConfidenceScore=5.38e-01
MATPPNSHPPPPPTDSHSPSTMKRLRKETRLRSLATRPVGAKRPLVHVDPATEKADDPHRKKLRTYLGIFARDKDEFDIPEASDLRTKKTIL

SEQ ID NO: 216449 - protein, 138 aa, Glycine max
  Coding DNA Sequence Number=SeqID_99671
MQQGQGFLKGRVKHPITIPKTQETLRETQANKEKGLEVKITSEKLRKEGLREFSPPNPSSWCGSSTTSNGSSWWPLVVVGGREEGVRVWREKRAKREIRSCYFQNPNGQTVENCLRNLQPKFEEDPTVNESRITILLK

SEQ ID NO: 216450 - protein, 82 aa, Glycine max
  Coding DNA Sequence Number=SeqID_99672
MEKPPGHSVEHCRALKRKVQVQAIGLFAQATYAPEFGLPRPFNQRLLVLHVGGGAVKQRRSELSRIGCWTNGLSYLEKGGLN

SEQ ID NO: 216451 - protein, 92 aa, Glycine max
  Coding DNA Sequence Number=SeqID_99673
MATILAVKSTVPATTARWDMMTLGGGLRVEGLGYRVYGIGFRVYGIGFRVRFRVRVMIGVWDMGHGGRGLGSGFGSWGLGFGLRVWGLGFGF

SEQ ID NO: 216452 - protein, 149 aa, Glycine max
  Coding DNA Sequence Number=SeqID_99674
MQGYLMVICTFCQPEASKPVDTQRLTSSSAPLSSKDSESDDMQGYLMVICTFCQPEASEPVDTQRLMLSSAPLSSRDGESDDMRGYLMVICTFCQPEASDPVDMQRLTSSSAPLSSRDGESDDMRGYLMVIHTFCQPEASEPVDMQRRT

SEQ ID NO: 216453 - protein, 64 aa, Glycine max
  Coding DNA Sequence Number=SeqID_99675
KIPRLIVQLAEAGRELELERKKKELADETVRRDEMIKSASRLATRIKNAVEWKKERTRAILEDC

SEQ ID NO: 216454 - protein, 111 aa, Glycine max
  Coding DNA Sequence Number=SeqID_99676
MDFLGLRSEIETKHINITSIIIKTLKLNGNLAKLPIISPKTPYPRKSREKEVHPNLKFRSPTRRDALHDSENALLSRFGAEMMAKGWSFVGASMVEEEEGEKQREGEKRAF

SEQ ID NO: 216455 - protein, 203 aa, Glycine max
  Coding DNA Sequence Number=SeqID_99677
  Gene Ontology: Mol. function=endonuclease activity
  Homolog annotation: Hit_ID=Q2HUP4; Match level="QueryCoverage=51%, HitCoverage=35%, E-value=4e-31, Identity=62%"; Hit description =Endonuclease/exonuclease/phosphatase
MGWIRGRHLLSIEGVPNRPSQQICYDNSGFKLWYTGKIRSRNGVGIIVDKEWKKDVVDVRRVGDRIIVLKLVVGQDTFNVISGYAPQVGLAEHFKVKFWEDLEGVLQDIPQGEKVFLGGDLNGHVGSVARGFEGVHGGFGLGEMNGEGKSILEFSEALDLSIANTWFKKREEHLITYKSGGTCSQIDFFLIRKSDRFLPYQEV

SEQ ID NO: 216456 - protein, 237 aa, Glycine max
  Coding DNA Sequence Number=SeqID_99678
  Homolog annotation: Hit_ID=O80960; Match level="QueryCoverage=93%, HitCoverage=36%, E-value=7e-79, Identity=63%"; Hit description =Nodulin-like protein
IDMLILFIATTFGAGGTLTAIDNLGQIGHSLGYPNKSTTTFVSLVSIWNYLGRVASGYASEIFLTKYKVPRPYMLTLVLLLSCVGHVLIALGVPNSLYLASVVIGFCFGAQWPLMFAIISEVFGLKYYSTLYNFGAAASPLGSYILNVKVAGVLYDKEALKLLKAKGLTRQEGKDLTCVGVQCYKMAFIIITASTLVGCFASIILALRTRKFYKGDIYRKFRTEDETIENEIEITKA

SEQ ID NO: 216457 - protein, 78 aa, Glycine max
  Coding DNA Sequence Number=SeqID_99679
MWFASRRPTTVDSQQRQGSAPFVCPTPEKFRDEVAWPGDWPDAQTEMEPAESPGDEDESHMDEDMTNLLSFLGGSGAT

SEQ ID NO: 216458 - protein, 211 aa, Glycine max
  Coding DNA Sequence Number=SeqID_99680
  Homolog annotation: Hit_ID=P07930; Match level="QueryCoverage=22%, HitCoverage=53%, E-value=1e-19, Identity=100%"; Hit description =Lysis protein
  Pfam annotation: Domain name=Microvir_J; Domain location=106-139; Score=18.2; E_value=0.027; Accession=PF04726.4; Description =Microvirus J protein
  Pfam annotation: Domain name=gpD; Domain location=1-123; Score=56.1; E_value=1.2e-13; Accession=PF02925.6; Description=Bacteriophage scaffolding protein D
  Pfam module annotation: Pfam domain module=Microvir_J::gpD; Domain location=106-139::1-123
VPPVQLLTGWCVTAKAPPDISAGKCSGHAARRVPFAIQAAQLLGRAIGAGLFAITPAGERGMCCKAIKLGIRSCLIMEGAEFTENIINGVERPVKAAELFAFTLRVRAGNTDVLTDAEENPLRGTKGKRKGARLWYLLFPLVRVNFELGVIMVIAVSFGKPVVPAALMNRPTRGERRFAYWALAECILAYYVGTDEGVSEVLHVAGEKRLH

SEQ ID NO: 216459 - protein, 168 aa, Glycine max
  Coding DNA Sequence Number=SeqID_99681
  Gene Ontology: Mol. function=electron carrier activity; Cellular component=integral to thylakoid membrane; Biological process =electron transport
  Homolog annotation: Hit_ID=P49161; Match level="QueryCoverage=99%, HitCoverage=70%, E-value=2e-72, Identity=68%"; Hit description =Apocytochrome f precursor
  Pfam annotation: Domain name=Apocytochr_F_C; Domain location=109-168; Score=53.7; E_value=2.5e-14; Accession=PF01333.10; Description =Apocytochrome F, C-terminal
NKPVDIEVPQAVLPDTVFEAVVRIPYDMQVKQVLANGKKGALNVGAVLILPEGFELAPPDRISPEIKEKIGNLSFQNYRPTKKNILVVGPVPGGNRGRGQIYLDGSKSNNNVYNATAAVIDIIPPGPELLVSEGESIKLDQPLTSNPNVGGFGQGDAEIVLQDPLRVQ

SEQ ID NO: 216460 - protein, 159 aa, Glycine max
  Coding DNA Sequence Number=SeqID_99682
  Subcellular localization annotation: CTP_CleavageSite=34; ConfidenceScore=5.06e-01
MLSFNQKQSQFQSQMQSQGLTLPPEPEVGPSAARASTKESCVDPSGNDPNTGDSDKCRLYVEENPPGLVSLGRLYEGSTTIHYIPLPHDQVKVMRDATMFGVFNENFPLYIKHEDLSKIVHGGQCLRIFVIQLWISHMTETSMRAGNVDMYGFLEPQSI

SEQ ID NO: 216461 - protein, 100 aa, Glycine max
  Coding DNA Sequence Number=SeqID_99683
MGDKLHRREGNSPDHQLRPLNDRSVIKEMNGAKRSAEAVGCKKESVGERSALEGRTRASSAGRSGSENVGLSNANVGSERTKLSFRFVCAPLPVQFAMAE

SEQ ID NO: 216462 - protein, 294 aa, Glycine max
  Coding DNA Sequence Number=SeqID_99684
  Gene Ontology: Mol. function=ribonuclease H activity; Biological process=DNA integration
MRVELTASLATERYRSKGTPSLGRLKTGGVAMVFLKARKACSQVLSHRKGILLDFLNVGRAAYLEYSGAFVSLASIPQCVIMKTRELASVYPENAFFRKLSTWNSNTPLTSLSMLCRGCYLPFAIDLFDHDDIVKLGEKPDLSDEVCLKEFVDFFLYDFMSFFTHLPFLLRYWFGLRAYGINAPVLMTSKVLKELHTLPRFRFELQLDKLFDRFQASVRGVISRIYIEFIALACLVDDAMGVRHGRLLDGRIWCYLMQSYPARALDIRLQVDWARDAREGPRILMRLRVDFGSM

SEQ ID NO: 216463 - protein, 193 aa, Glycine max
  Coding DNA Sequence Number=SeqID_99685
  Subcellular localization annotation: CTP_CleavageSite=47; ConfidenceScore=5.47e-01
MQEPITYIAHKTRQTQAPHSVSLTGSQNPRLVLGKPQHSSTGSTKHRANTSPVQGLIDPRFTLGESFLLLSSISKETQGLPKKPKVHLWCTFFQNLRSVLGIHSFKTQGLPLVHTSTKPKAFPWSAHMQQLRQPPSKVQVQLNKLPPHYLARPLIRYNPYLLFTTIRSTLAGQDDPIKDSGSNMSNMVNNIKA

SEQ ID NO: 216464 - protein, 158 aa, Glycine max
  Coding DNA Sequence Number=SeqID_99686
VSKWKDVARTFWRVERPKVGNATIVVAEAVRSNRQLTSKVGREEELGRQGGELGGWKDELAKAVKQASFIAKDLDLGLFDPFKDMKDGVLLDEEDIVAEDEAIDEGLQVDWARDPREGPKVLMSLREVSLAIRELLKEVFSKKLIKEVFSRKLLKEAT

SEQ ID NO: 216465 - protein, 76 aa, Glycine max
  Coding DNA Sequence Number=SeqID_99687
GELSTPNAPLGGPWNVPEDIPDMDDLLGVDLRHDFSVEADQVDERANRRRRNPDRAARNWDRPCGTSSRHHRHSDD

SEQ ID NO: 216466 - protein, 336 aa, Glycine max
  Coding DNA Sequence Number=SeqID_99688
  Gene Ontology: Mol. function=lyase activity; Biological process =electron transport
  Homolog annotation: Hit_ID=Q6D684; Match level="QueryCoverage=93%, HitCoverage=93%, E-value=1e-118, Identity=66%"; Hit description =Probable aminodeoxychorismate lyase
  Pfam annotation: Domain name=ADC_lyase; Domain location=37-329; Score= 459.3; E_value=4.8e-135; Accession=PF02618.6; Description =Aminodeoxychorismate lyase
MKKIVAGAVVIAGLAAALSYWQIKRFAATPLTIHQETLYTLPAGSGRVVLEAQLESQHIIPQSIWFGPLLKLEPDLANFKAGTYRLETGMTVRQLLQLLASGKEAQFPLRFVEGSRLKEWLAELRKAPYLKHTLPDDEFASVAAALKLDVSQLEGGFYPDTYLYTANTSDVALLERAHARMNKLVDEVWQGRMASLPYKTPQQMVTMASIIEKETGVSEERARVASVFINRLRTGMKLQTDPTVIYGMGDSYTGTLTRKDLETPTAYNTYTISGLPPGPIAMPGRASLEAAAHPEKTNYLYFVADGKGGHTFTTNLASHNKAVQVYRLAMKEKNEK

SEQ ID NO: 216467 - protein, 255 aa, Glycine max
  Coding DNA Sequence Number=SeqID_99689
  Gene Ontology: Mol. function=nucleic acid binding; Cellular component= chromatin; Biological process=DNA integration
  Homolog annotation: Hit_ID=Q1T010; Match level="QueryCoverage=99%, HitCoverage=19%, E-value=1e-67, Identity=49%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
EIMILLGYHATGGYKLFNLVTKEVLVSKDAVVDESKDWNWDKEMVEEPTKVVIEASIDEPSDSSAAVIDDSDQGGVRKSQRARQPSSRLQDYELIHDSAIGEEGELVHLALFAESESVSLEEAMNDTKWTDAMKEELKAIEKNNTWQLVPLPAKKKPIVVKWVYKVKKNLKGEISKYKARLVAKGFLQKAGIDFKKVFAPVARMETVRIITAIASQKRWHMHHMYVKSAFLNGPLKEEVYVSQPPGFEIKGSEEK

SEQ ID NO: 216468 - protein, 106 aa, Glycine max
  Coding DNA Sequence Number=SeqID_99690
MVEEEFLRWFGWSIEREKRDIVFLMLKNLVSLSRSPLLVLSATFRVSAIPLRLGFALSTTIRAQHNSLSGWNCAILRIPMIKLWGNMFGTYSQNLKTIQQLMNPRL

SEQ ID NO: 216469 - protein, 99 aa, Glycine max
  Coding DNA Sequence Number=SeqID_99691
MRQMLVNELASISKIVYNSEHLDLILDGLPNEYELSISMITSRNFGWNNCGGHGSDHGGGGGRGRLEEDYVPTFPPPASFSFTSSSSISTTQAQSGQTS

SEQ ID NO: 216470 - protein, 152 aa, Glycine max
  Coding DNA Sequence Number=SeqID_99692
  Gene Ontology: Mol. function=protein binding
  Homolog annotation: Hit_ID=Q8H609; Match level="QueryCoverage=60%, HitCoverage=15%, E-value=7e-12, Identity=38%"; Hit description =Putative disease resistance protein Cf-2.1
  Pfam annotation: Domain name=LRRNT_2; Domain location=67-101; Score =23.1; E_value=0.001; Accession=PF08263.3; Description=Leucine rich repeat N-terminal domain
LIYEAYNLGLRSKRNYEASHDRNANAARNFLDEEIKNMIVMRIMKSTVGVCFLFFLLSEAIRCEGCWKEERDALLGLHSRFDLPYSWDGPDCCQWKGVMCNSSTGRVAQLGLWSVRRNKYSTLNYSDFVVFKDLKNLNLSENGISGCAGTEG

SEQ ID NO: 216471 - protein, 101 aa, Glycine max
  Coding DNA Sequence Number=SeqID_99693
MTKARQKGVRKEKEGDTCHPARPGELGCFLQKQLPSGGTSWKAQVGLHVTELHGLCYNAFLLTSGMSRNFTNCLTMGAKYLEVVKRGSHPNNGWSPDEIRI

SEQ ID NO: 216472 - protein, 96 aa, Glycine max
  Coding DNA Sequence Number=SeqID_99694
MYNYHEKGRAPDLESVLADFMTYQASSKDYQWESEWQPYYHNEAEGVSNLDDLLMQFKGTVDSMQQAFKRAETQIGQLVDNMIKVVVRIEEEYAKD

SEQ ID NO: 216473 - protein, 52 aa, Glycine max
  Coding DNA Sequence Number=SeqID_99695
  Subcellular localization annotation: CTP_CleavageSite=29; ConfidenceScore=5.15e-01
MTFSRGEVALNASSTLGPLIKPTNQGSVRLARASSGLVREDMALCVRVVLSG

SEQ ID NO: 216474 - protein, 59 aa, Glycine max
  Coding DNA Sequence Number=SeqID_99696
ARNTCSQQCCCCLHPVNRTTKVSEHDGIFLVEHMTKLCQDNAKVSGGEDCEEEDRNGRH

SEQ ID NO: 216475 - protein, 282 aa, Glycine max
  Coding DNA Sequence Number=SeqID_99697
MAKFDPEIVLEFYANAWPTEEGVKDMRSWVRGRGVRIMRTSMTTLTQIWMTLLLSNILPSDHNSDLPLPKCQLVYTILTQMTVHVAQIIAKAIYLFAGTATTRHPFDPEKSNRALGFSALITGLCQFYGVPIIPSKVIGPSITRAFIEKYCTPRQAQGDTQQAADAPPPQQPDLVRPLSVEQYLRHMVCQQVANHRGQVQLHECFYRFNLSQQGQGSTPFVCPTLEQFRTEVAWPRDWPIEEEIRPVGSSGEAEEAHVNEDMTDLLGYLGEGGATRPRLPHL

SEQ ID NO: 216476 - protein, 62 aa, Glycine max
  Coding DNA Sequence Number=SeqID_99698
  Homolog annotation: Hit_ID=Q9SYI3; Match level="QueryCoverage=69%, HitCoverage=3%, E-value=2e-08, Identity=52%"; Hit description =Putative multidrug resistance protein 5
MPPSGTIFHPIRSYFFAVAGSKLIKRIGLMCYKKIIHMEVGWFDKAGIRSEIYKLRVIYVQN

SEQ ID NO: 216477 - protein, 115 aa, Glycine max
  Coding DNA Sequence Number=SeqID_99699
  Gene Ontology: Mol. function=methylcrotonoyl-CoA carboxylase activity; Cellular component=mitochondrion; Biological process =metabolic process
  Homolog annotation: Hit_ID=Q42777; Match level="QueryCoverage=86%, HitCoverage=14%, E-value=8e-26, Identity=68%"; Hit description =Methylcrotonoyl-CoA carboxylase subunit alpha, mitochondrial precursor
MFCGQSQPPFTATLTGTRSMWRPPIRPSESDRHRHGLAIHRGYGYLSESVDFTKLCEDNGLTFIGPPTSLLFKIWVTRDYQSFFGMDCGSASKRIMGVVGVPLVPGYHGRIDVVL

SEQ ID NO: 216478 - protein, 151 aa, Glycine max
  Coding DNA Sequence Number=SeqID_99700
  Gene Ontology: Mol. function=kinase activity; Cellular component =integral to membrane
  Homolog annotation: Hit_ID=Q3TPR7; Match level="QueryCoverage=78%, HitCoverage=26%, E-value=2e-16, Identity=33%"; Hit description=Adult male hippocampus cDNA, RIKEN full-length enriched library, clone:C630039B09 product:...
  Homolog annotation: Hit description=hypothetical protein, full insert sequence
  Pfam annotation: Domain name=DUF300; Domain location=1-151; Score =48.9; E_value=6e-16; Accession=PF03619.7; Description=Domain of unknown function
PHTTRLDHKTLKLLKNWTWQFVVIRPVCSILMITLQYLDVYPTWVSWINTVILNISVSLALYSLVVFYHVFSKELEPHKPLAKFLCIKGIVFFCFWQGIVLDLLAALGIIRSRYSWLAVERIEEGYQNLLQYAYSAAPYKVNSAPSDKKSK

SEQ ID NO: 216479 - protein, 171 aa, Glycine max
  Coding DNA Sequence Number=SeqID_99701
  Homolog annotation: Hit_ID=Q1SKD7; Match level="QueryCoverage=61%, HitCoverage=27%, E-value=2e-08, Identity=33%"; Hit description =Ankyrin
MLLSRNIIQIYVMVAMLQLTDSLLIEAGGLTPPLGDLTVLAFLQNQWMPQKLIDGISIKGNPLAPHPEVHVSDSFFRRLSISTKLHDYLRIKLSHGRYKLSPSPPGYLLLELNILLIPQLDSPPFEERPAFDGLKPLLVFRTPGLVSIEVHICLRGRTGTLSSGILPRPLG

SEQ ID NO: 216480 - protein, 89 aa, Glycine max
  Coding DNA Sequence Number=SeqID_99702
MVPEGLINIPLPTPLKAKKHPDLKVANDLPFETKMEEVKEDMNNLKQQYEASIKRVEESQPPNKSDGGFKEINLVQGNGRRKIGGIVMF

SEQ ID NO: 216481 - protein, 48 aa, Glycine max
  Coding DNA Sequence Number=SeqID_99703
MAAAVTDMARRHTISQILVDLVKFAVGSAIDGSRRIIPEIEMNLHVKN

SEQ ID NO: 216482 - protein, 195 aa, Glycine max
  Coding DNA Sequence Number=SeqID_99704
  Gene Ontology: Mol. function=RNA-directed DNA polymerase activity; Biological process=RNA-dependent DNA replication
  Pfam annotation: Domain name=AT_hook; Domain location=136-148; Score =14.9; E_value=0.061; Accession=PF02178.9; Description=AT hook motif
DDGEIEGDVNHRIQAGWMKWRKASGVLCDAKVPIKLKGKFYWTAIRLAILYGTECWAVKSQHENKVGVAEMRMLRWMCGKTRQDKIRNEAIRERVGVAPIVEKMVENRLRWFGHVERRPVDSVVRRVDQMERRQTIRGRGRPKKTIREVIKKDLELNDLDRSMVISRAITECVKNNIDVPRPDYERKFLDGMIHE

SEQ ID NO: 216483 - protein, 138 aa, Glycine max
  Coding DNA Sequence Number=SeqID_99705
  Homolog annotation: Hit_ID=Q75ID7; Match level="QueryCoverage=41%, HitCoverage=63%, E-value=4e-08, Identity=58%"; Hit description =Expressed protein
METGDISQPEPPKQVWCEEKQASVHEEIKRMNQLPANSSYVTHRLKVLNKILQLMSVQNCIPRAGVGVAFCRAFFVKVVLLAMPLTLVDLHLEGQKIKNKACLQFSQGFTHNLAELKQQCLYPSLATFDIIVIHHVAS

SEQ ID NO: 216484 - protein, 360 aa, Glycine max
  Coding DNA Sequence Number=SeqID_99706
  Gene Ontology: Mol. function=protein-disulfide reductase activity; Cellular component=membrane; Biological process=cytochrome complex assembly
  Homolog annotation: Hit_ID=Q7XY14; Match level="QueryCoverage=99%, HitCoverage=100%, E-value=0.0, Identity=92%"; Hit description=C-type cytochrome biogenesis protein
  Pfam annotation: Domain name=DsbD; Domain location=127-350; Score =147.5; E_value=3.6e-41; Accession=PF02683.6; Description=Cytochrome C biogenesis protein transmembrane region
MSLSMSLCGSYSLQIRNRRIVSCNLHQDGRHIVPINTHQKTSKPENCLRSKWKINGNNIRTCIGVMTVAHLVAPVTAKAEVAASIYALADGSLNDWFGGFLYSAGQQANEAVQGQLTSLSFTSLAVIYGAGLVTSLSPCTLSVLPLTLGYIGAFGSGKSRAEVSTHNNGALHFIKSGIVVGDSIAFSLGLATTLALLGVGASFAGKAYGQIGQGLPLAASGLAIIMGLNLLEIIELRLPSFFDSFDPRAAAANFPSSVQAYLAGLTFALAASPCSTPVLATLLGYVAASKDPVIGGSLLLTYTTGYVSPLLLAASFAGALQSLLSFRKFSAWINPISGAMLLGGGVYTFLDRLFPVTMVM

SEQ ID NO: 216485 - protein, 482 aa, Glycine max
  Coding DNA Sequence Number=SeqID_99707
  Gene Ontology: Biological process=regulation of GTPase activity
  Homolog annotation: Hit_ID=Q1T0M4; Match level="QueryCoverage=99%, HitCoverage=96%, E-value=1e-163, Identity=62%"; Hit description=Arf GTPase activating protein
  Pfam annotation: Domain name=ArfGap; Domain location=1-115; Score =190.2; E_value=5e-54; Accession=PF01412.9; Description=Putative GTPase activating protein for Arf
MQILEGLLKLPENKECADCKAKGPRWASVNLGIFICMQCSGIHRSLGVHISKVRSATLDTWLPEQVAFIQSMGNEKANSYWEAELPPHYDRVGIENFIRAKYEEKRWVARNEKPKSPSSFREEKSPSHWQKPVERGGHDYAAVSENTFEERKKIQPSHAIPATRISVPAPPKGPELVTTVAKPQHVEKVEPVAPSPQAETSKQTTDTTQNSPSKVDYATDLFDMLSMDDPNEKGSGAADATADDNNWAAAAEASTAEKTDATKAVESTPQSTSGIEDLFKDSPSVTPSLTTEKPQKDVKNDIMSLFEKSNVVSPFAMHQQQLAMLAQQQSLLMAAAKSAGGDPKYLASLQQQQSLLMAAAAAKSDGGDSKYPTAIQQPGSNIPVQSWPAASFPMPGAMPMGGLEELQKLMQTMNMNAAHSAGSSFQYPPSSYYAMGQVAPTNGTAPTGASKPQSASPVSSTTSKTGNDYDFSSLTQGMFAKH

SEQ ID NO: 216486 - protein, 69 aa, Glycine max
  Coding DNA Sequence Number=SeqID_99708
  Subcellular localization annotation: CTP_CleavageSite=26; ConfidenceScore=5.22e-01
MFSPSGIENSLEISGKNCFHKENRSRSASVTLSRRFHGQFRGDSSPFFGLQPFSKELRRSDFLIAIEDT

SEQ ID NO: 216487 - protein, 146 aa, Glycine max
  Coding DNA Sequence Number=SeqID_99709
SLGQNSSKPKQSKRARREEHGRNKFRGALWGSNNELMLRREERDQSQVHSMALKEELAASSRSKKSLTQHLEATKQNMLAIIGQYKEELNHSLTHEQKLVEDFAQAYAEKEAKGRVIDALHQEATMWMEREVLKLITLSKKALRWI

SEQ ID NO: 216488 - protein, 73 aa, Glycine max
  Coding DNA Sequence Number=SeqID_99710
MEKSGGKQNNFGSMKEREWKIFRSDKFSARLPFSTGDIPPHMNKEKKTETPGFLSKNTSLEKILLVRDRTFDL

SEQ ID NO: 216489 - protein, 492 aa, Glycine max
  Coding DNA Sequence Number=SeqID_99711
  Gene Ontology: Mol. function=kinase activity; Cellular component =proton-transporting two-sector ATPase complex; Biological process =ATP synthesis coupled proton transport
  Homolog annotation: Hit_ID=Q1SMI5; Match level="QueryCoverage=83%, HitCoverage=27%, E-value=1e-131, Identity=57%"; Hit description =Prefoldin; tRNA-binding arm; t-snare; Protein kinase PKN/PRK1, effector
MVEEFYRAYRALAERYDHATGVIRHAHKTMAEAFPNQGAFLDPDEPQKDVYAHFHAIKRNGGYTGEPDSPLNKTGLKQLNDLYIPGEQENLPKFARRGLNFFETREESNEQNSGSNNTLSESKRVTKDETVILALKKAIAKLEDEKEAGLLQYQQSLEKMSNLELEVSTAQENSRKLDERASKAEAEVQALKEAQIKLQAESEASLLQYQQCLEKISNLEKNISSLQKEAGELNERATKAETESESLKQELARVEAEKEATLVQYNQCLETISKLEERIKEVEENARRIKEHANIAEKEIEALELQVTKLNEEKEDAALHYQQCMEIISSLEYKLSCAEEEVHRLNSKIVDGERLQFIEAEAAFQTLQQLHSQSQEELRSLASELNSKVEILGNVESCKQALEDEVHRAYDDDDYEGSFCDNPLLEKTSNESNLASIDSHRKCFPFRFGRVGNRQKIVILVTLLVFIIVVAFVVVIWIGIGKNPIDSEVAAQ

SEQ ID NO: 216490 - protein, 95 aa, Glycine max
  Coding DNA Sequence Number=SeqID_99712
  Subcellular localization annotation: CTP_CleavageSite=52; ConfidenceScore=5.06e-01
MAGHSSYTSGRCHTGHRHGLSHVLTARAPLHTMGIAERVRFRGTFRGLRWVSRERERAKGTIERGVRVRAQQREGRERGSAMLWKERVRFSRERG

SEQ ID NO: 216491 - protein, 152 aa, Glycine max
  Coding DNA Sequence Number=SeqID_99713
ENEGGACHPARPGELGCFLQKAPPSGEHPGRPKFFFRNVMKLYEFCNDTCFLFVMLRNLMDHAIIPFLGFWDVMELYGLRTNTSFRLPACHGTSRVVQKCFLLTSGMSRNFTNCLTMGAKYLKVVKRGSHPNNGWSPDEFRVTHVNRCDFSF

SEQ ID NO: 216492 - protein, 69 aa, Glycine max; identical to SEQ ID NO: 184761
  Coding DNA Sequence Number=SeqID_99714

SEQ ID NO: 216493 - protein, 115 aa, Glycine max
  Coding DNA Sequence Number=SeqID_99715
  Gene Ontology: Mol. function=protein binding; Cellular component =integral to membrane; Biological process=protein amino acid phosphorylation
  Homolog annotation: Hit_ID=Q1S979; Match level="QueryCoverage=70%, HitCoverage=11%, E-value=3e-16, Identity=57%"; Hit description =Leucine-rich repeat
  Pfam annotation: Domain name=LRR_1; Domain location=87-109; Score =17.4; E_value=0.05; Accession=PF00560.23; Description=Leucine Rich Repeat
  Subcellular localization annotation: CTP_CleavageSite=6; ConfidenceScore=5.38e-01
FLGSVVASVVGLSHLFHTVADSNSARLKELFPRKVFELTRNYFNGSIPKSLGRLSSVVTLTIATCFRNLLGNRLTGSIPSEIGDMASLQELILEDNQLEGPLPPSLGKMSNLLRL

SEQ ID NO: 216494 - protein, 141 aa, Glycine max
  Coding DNA Sequence Number=SeqID_99716
  Gene Ontology: Mol. function=protein binding; Cellular component =integral to membrane; Biological process=protein amino acid phosphorylation
  Homolog annotation: Hit_ID=Q1S979; Match level="QueryCoverage=71%, HitCoverage=16%, E-value=8e-24, Identity=56%"; Hit description =Leucine-rich repeat
  Pfam annotation: Domain name=LRR_1; Domain location=11-33; Score=1.0; E_value=1.8e+02; Accession=PF00560.23; Description=Leucine Rich Repeat
  Pfam annotation: Domain name=LRR_1; Domain location=35-57; Score =20.4; E_value=0.0064; Accession=PF00560.23; Description=Leucine Rich Repeat
  Pfam annotation: Domain name=LRR_1; Domain location=59-81; Score =12.4; E_value=1.4; Accession=PF00560.23; Description=Leucine Rich Repeat
  Pfam module annotation: Pfam domain module=LRR_1::LRR_1::LRR_1; Domain location=11-33::35-57::59-81
MTFPNLKNLKLLLRLELRNCLITVPIPNYIGEIESLKSIDLSSNMLTGSIPDSFQDLGNLNYLFLTNNSLSGPIPDWILSIKKHIDLSLNNFTKTSANNCQMPDVFFRRMIDLIQRKLLQPRYAHCYINMKAARVFYQVRD

SEQ ID NO: 216495 - protein, 82 aa, Glycine max
  Coding DNA Sequence Number=SeqID_99717
MDELERRNFHKRLTNLAGTSIDLALVKEFYANLYSPEGLSPKQVRIQGHLIRIEADRLNVFLETLVVLAEGDLYPLTQDTAG

SEQ ID NO: 216496 - protein, 203 aa, Glycine max
  Coding DNA Sequence Number=SeqID_99718
  Gene Ontology: Mol. function=transition metal ion binding; Biological process=proteolysis
MYTRHQHFLKPHHPCRRLKKAFNGSQEHETAPIPLTGDQVFQRMLDIVLMLCMWRKMAGTLLNIQGKTKDDWDETFCLTNKVLDLVKLDELENEAAIILYQLEMYFPSAFFDIMVHLVVHLRMYSVEWYMKILKGYTKNLHHPEASIIERYIAEEAIEFCSKYIEKAKPVGLPESQHDERVGGKGSRGLHVITPIVEDLQRAH

SEQ ID NO: 216497 - protein, 65 aa, Glycine max
  Coding DNA Sequence Number=SeqID_99719
MRHLKSIFRLTILATPPLPLKCLGTLSEQSEKKLEESQETARYAAISVTMSYSHLGNSENMCRDP

SEQ ID NO: 216498 - protein, 517 aa, Glycine max
  Coding DNA Sequence Number=SeqID_99720
  Gene Ontology: Mol. function=transmembrane receptor activity; Cellular component=integral to membrane; Biological process=defense response to bacterium
  Homolog annotation: Hit_ID=Q9FYQ8; Match level="QueryCoverage=99%, HitCoverage=78%, E-value=0.0, Identity=80%"; Hit description =Endosomal protein-like
  Pfam annotation: Domain name=EMP70; Domain location=57-516; Score =470.6; E_value=2e-138; Accession=PF02990.7; Description=Endomembrane protein 70
MESCAQFGLWVVLILCLAFQIQPNYGFYLPGSYPHNYDVTDELWVKVNSLTSIDTEMPFSYYSLPFCKPEGGIKDSAENLGELLMGDRIENSPYRFRMYTNESEIYLCQIQALSGDQFKILKERIDEMYQVNLILDNLPAIRFTQKDGYFMRWTGYPVGIKIEDAYYVFNHLKFNVLVHKYEETNVARVMGTGEGAEVIPVGKEGSSEKPGYMVVGFEVIPCSIMHNADSAKNLKMYDKYPSSIRCDPATVAMPIKEGQPVVFTYEITFEESDIKWPSRWDAYLKMEGAKVHWFSILNSLMVITFLAGIVLVIFLRTVRRDLTRYEELDKEAQAQMNEELSGWKLVVGDVFRTPTNPALLCVMVGDGVQILGMSVVTILFAALGFMSPASRGTLITGMLFFYMILGIAAGYVSVRMWRTISFGEQKGWVSIAWKAACFFPGISFLILTTLNFLLWGSHSTGAIPFSLFVILILLWFCISVPLTIVGGYFGAKAPHIEYPVRTNQIPREIPQQKYPSW

SEQ ID NO: 216499 - protein, 169 aa, Glycine max
  Coding DNA Sequence Number=SeqID_99721
  Gene Ontology: Mol. function=protein serine/threonine kinase activity; Biological process=protein amino acid phosphorylation
  Homolog annotation: Hit_ID=Q1SV88; Match level="QueryCoverage=71%, HitCoverage=25%, E-value=2e-30, Identity=68%"; Hit description =Protein kinase
MRSILHRFAEEDTSYMSQRTEDVRAHPTHFLHMFGFGTRNGLCQCPVTKNSKESTFRLRKGTTIERAIMSSILAKISLLDIKSSARWVKHIASAVGTFGRVLECWDRQTREYVAIKVVRSIRKYRDAAMLEIDVLQQLAKNNRGSSRYGAYGVKWILNFFLYLIVPRDD

SEQ ID NO: 216500 - protein, 155 aa, Glycine max
  Coding DNA Sequence Number=SeqID_99722
  Gene Ontology: Mol. function=transferase activity; Biological process= protein kinase C activation
  Homolog annotation: Hit_ID=Q1SV87; Match level="QueryCoverage=89%, HitCoverage=25%, E-value=4e-45, Identity=66%"; Hit description =Pentatricopeptide repeat
MEKGYVAIRVFEDMQKARVAPNWVTFVGVLSACAHEGIHRNLEIAVVAMEQLLELEPEEFGNYVLLANIYAELGKWEGVSDVRKLTRSKRIKKTPGCSLIEVNNLVQEFVSGDDSKPFSQKVFWILKGLSLHQTRTNDLIEFVEEDAGQLYSKVI

SEQ ID NO: 216501 - protein, 57 aa, Glycine max
  Coding DNA Sequence Number=SeqID_99723
MALDEAGAIPILIDLMNDVDEVEEPRDNVVEALVIYYVDPLYHDRVSDTINVPSFRN

SEQ ID NO: 216502 - protein, 470 aa, Glycine max
  Coding DNA Sequence Number=SeqID_99724
  Gene Ontology: Mol. function=DNA binding; Biological process =regulation of transcription
  Homolog annotation: Hit_ID=Q1SV84; Match level="QueryCoverage=73%, HitCoverage=98%, E-value=1e-102, Identity=56%"; Hit description=No apical meristem (NAM) protein
  Pfam annotation: Domain name=NAM; Domain location=141-269; Score =316.4; E_value=4.9e-92; Accession=PF02365.6; Description=No apical meristem (NAM) protein
MKAKERRIQGRQGFLEIGQGEQKRGEVKIVILIQVDIAILLGIYSYWSICNLKVKTHIWWKLQKHTPCFSSLPLYLNFPTLHARIPQVIVSFPSEPHNLYKPSKLDSRRVCLSMQKEKEAIIKEGTTEIEMEGTRAKEGTLPPGFRFHPTDEELVTCYLVNKISDSNFTGRAITDVDLNKCEPWELPGKAKMGEKEWYFFSLRDRKYPTGVRTNRATNTGYWKTTGKDKEIFNSETSELIGMKKTLVFYKGRAPRGEKSNWVMHEYRIHSKSSYRTNRQDEWVVCRVFKKSGGAKKYHSSNHARTVNPYSLEIGPSIMPPPMMQLGDPSAHFLYGRNYMNSAELAELARVLRGGGSTSSVNLPIQSQLSYPTSSSAGGGGFIISGLNLNLGGGATATTQPILRPMQPSPPVHTMAQVLDVNSSMMTTSSLGAENNVGYGTEVSNNMNSHGNRYMGMDHHCMDLDNYWPSY

SEQ ID NO: 216503 - protein, 98 aa, Glycine max
  Coding DNA Sequence Number=SeqID_99725
MNASVEARTNLACDRHLFQNNAEEKTAARERDKSEKLCKNEGVREEARTDLACDQHKLSDAVTGNHRRQLSAEVFGPEAKRENSERMKDVSRSCGILA

SEQ ID NO: 216504 - protein, 176 aa, Glycine max
  Coding DNA Sequence Number=SeqID_99726
  Homolog annotation: Hit_ID=Q1S7C5; Match level="QueryCoverage=30%, HitCoverage=4%, E-value=3e-12, Identity=61%"; Hit description =Integrase, catalytic region
MDSKEDALGVVDSEGENQEEQKVQKENERETVERIEGPQQGKTGTVKGFKEMKIRILVEKGNKRNGKIEGSNGKSINQIDSSNKGIIPKLTQRWMVNITRFRMETKVLMNLLPNLIGVIRAKPNKERLVLNFPSFILRIHTICNAIILREIARQNDGIDDETLQLYNLITSSTCCR

SEQ ID NO: 216505 - protein, 178 aa, Glycine max
  Coding DNA Sequence Number=SeqID_99727
  Gene Ontology: Mol. function=calcium ion binding; Cellular component =flagellin-based flagellum; Biological process=ciliary or flagellar motility
  Homolog annotation: Hit_ID=Q1SV82; Match level="QueryCoverage=99%, HitCoverage=100%, E-value=1e-55, Identity=64%"; Hit description =Calcium-binding EF-hand
  Pfam annotation: Domain name=efhand; Domain location=114-142; Score =32.8; E_value=1.2e-06; Accession=PF00036.22; Description=EF hand
  Pfam annotation: Domain name=efhand; Domain location=152-178; Score =13.1; E_value=0.47; Accession=PF00036.22; Description=EF hand
  Pfam module annotation: Pfam domain module=efhand::efhand; Domain location=114-142::152-178
MGIAEACSRFLGDFLQALKCSPQSSVSHLDHKPQNVLKLNDKMVGALVSVFGMETNGRIKKENARQVVEKLGLMYDKSSSSSGFELTKGGLLDDEVPVEEVLGELEDMSKRSELLHEAFKIFDEDGDGYIDAMELKRVLDCLGLDKGWDMSAIEKMVKVADLNFDGKVDFGEFELMMG

SEQ ID NO: 216506 - protein, 437 aa, Glycine max
  Coding DNA Sequence Number=SeqID_99728
  Gene Ontology: Mol. function=aminoacyl-tRNA ligase activity; Cellular component=cytoplasm; Biological process=translation
  Homolog annotation: Hit_ID=Q1SV83; Match level="QueryCoverage=99%, HitCoverage=100%, E-value=0.0, Identity=78%"; Hit description=IMP dehydrogenase/GMP reductase
MAPPKLFVFALSVTLIFAIVGAEADVSVEGATPEPDTSAIKIQLDQLNSKIQILESQISEKLEEVKKKDKIIAEKENSIEDKSITIQSLQNEIASLQKKGSLDAEEQVGKAHARAGELQKQVDKLKRELETQNKEKVNWETRVPELENKIHDLNSKLEDLQKINEEQKTKIQKSERALKVAEEEMLKAKFEATAIEKELREAHGAWLPPWLAVHYIHSKSFVDSHWNKHGKPALEMVTQKALEKKAQAGKWAEPHVETIKTWSVVKTNAEPHVQLLTTKTVEVYEASKNAISPHLSKAKEVVDPYYQEARKFSKPYIDQIAIAAKPHVDKVQEVLKPYTKEVVRVYGKFLESATTYHRQVQASVQETLKKHELTRPLATKELEWFAASALLALPIVLMARVFSAVFCSKKVSKPARNGNTHHARRKPKRGHLDKHTT

SEQ ID NO: 216507 - protein, 87 aa, Glycine max
  Coding DNA Sequence Number=SeqID_99729
  Homolog annotation: Hit_ID=Q0GPJ5; Match level="QueryCoverage=45%, HitCoverage=18%, E-value=1e-15, Identity=100%"; Hit description=BZIP transcription factor bZIP61
  Subcellular localization annotation: CTP_CleavageSite=26; ConfidenceScore=5.12e-01
ATLIPFSLPILSPTVNVFCFLSVDVLAASQESLTPLSVFSGHGYFQRMATTTTEFDLDYEFPDLDYDLRYLSLAGIDALTAFQNLLP

SEQ ID NO: 216508 - protein, 365 aa, Glycine max
  Coding DNA Sequence Number=SeqID_99730
  Gene Ontology: Mol. function=signal transducer activity; Cellular component=membrane; Biological process=signal transduction
  Homolog annotation: Hit_ID=Q2L1A6; Match level="QueryCoverage=76%, HitCoverage=46%, E-value=1e-112, Identity=80%"; Hit description =Methyl-accepting chemotaxis protein precursor
  Pfam annotation: Domain name=MCPsignal; Domain location=38-260; Score= 367.6; E_value=2e-107; Accession=PF00015.11; Description=Methyl -accepting chemotaxis protein (MCP) signaling domain
MQESLTRTVSSVRRGVDEINTGSHEIAAGNTDLSSRTEQQAASLEETAASMEELASTVKQNADNARQANQLAASASDVAERGGSAVAEVVNTMQGISASSRKISEIVSVIDGIAFQTNILALNAAVEAARAGEQGKGFAVVAGEVRSLAQRSAQAAKEIKGLIEDSVSKVGAGSQQVERAGATMQEIVASVKRVTDIMGEISAASEEQSSGIDQVNRAVSQMDEVTQQNAALVEEAAAAAGSLQEQAQRLAEAVAVFKINAGDVIEVPARQLAQHRSAPRVAAPQAETVAPTPAPATTAAAPAARLTHSAPRAKTATAEAASAARPPRRPAPRAAANDAKPTPAATRRQAPADDDWESFDAGRDR

SEQ ID NO: 216509 - protein, 267 aa, Glycine max
  Coding DNA Sequence Number=SeqID_99731
  Gene Ontology: Mol. function=transcription factor activity; Cellular component=membrane; Biological process=regulation of transcription, DNA-dependent
  Homolog annotation: Hit_ID=Q4BG00; Match level="QueryCoverage=95%, HitCoverage=91%, E-value=3e-82, Identity=64%"; Hit description =Regulatory protein, LysR:LysR, substrate-binding
  Pfam annotation: Domain name=HTH_1; Domain location=15-74; Score =103.0; E_value=9.1e-28; Accession=PF00126.17; Description=Bacterial regulatory helix-turn-helix protein, lysR family
  Pfam annotation: Domain name=LysR_substrate; Domain location=98-266; Score=43.1; E_value=9.8e-10; Accession=PF03466.10; Description=LysR substrate binding domain
  Pfam module annotation: Pfam domain module=HTH_1::LysR_substrate; Domain location=15-74::98-266
MPAIGFTNSWGVMLLRHIRYFLAVAEQGNFTRAAESLHVSQPTLSQQIKQLEDTLGAPLFDRSGRAVRLTDAGEAWMRYARLALQDLDAGARAIHDVATLARGHLRLAMTPTFTAYLVGPAVDAFYRRYPGITLSIEEMAQERMEALLAQDRLDLGIAFKMAQSAEVEAAPLFNESLELMVGTDHPLASHRRPLTLAEWQHLPLALLSGDFATRGGGGQCARRHRRDRAARAARHAAAGRHCAREPAVEKSGFGQRHAGAAGGMAAA

SEQ ID NO: 216510 - protein, 221 aa, Glycine max
  Coding DNA Sequence Number=SeqID_99732
  Gene Ontology: Mol. function=carbonate dehydratase activity; Cellular component=integral to membrane; Biological process=carbon utilization
  Homolog annotation: Hit_ID=Q0B2Y3; Match level="QueryCoverage=97%, HitCoverage=97%, E-value=2e-95, Identity=77%"; Hit description =Carbonate dehydratase
  Pfam annotation: Domain name=Pro_CA; Domain location=31-197; Score =284.6; E_value=1.9e-82; Accession=PF00484.9; Description=Carbonic anhydrase
MEKRMKEVIEGFLKFQREAFVERTALFQQLATRQNPRTLFISCSDSRLVPELVTQREPGDLFVIRNAGNIVPSFGPEPGGVTASVEYAVAALGVEDIVICGHSDCGAMTAIATCQCLDHLPTVAGWLRYADSAKAVNQAYPHASDEARVASMVRENVIAQLNNIKTHPSVALALDQGRLTLHGWVYDIASGAIEALDGETRRFVPLATHPEVTATPALARF

SEQ ID NO: 216511 - protein, 217 aa, Glycine max
  Coding DNA Sequence Number=SeqID_99733
MITSDDEGEVGDVLDDTNTNFSFSPELPNQKLSPSRTQRAEGGTDVRCCDLRPLGNIQADVTPKEKSKGTVEGMLGSSFGKLNLGDSFAGTEEEAANTKEVTCYNTLQDDRRHRNHIEGKYLNGGAKVAADQTFIGEEEGHVTQSLSPSLSGQIQQGIGPGCIKGPISTQGGCNKEDIHPVELLGVQAVQNQKEGGLSNDLGPILKTDGCHKEDPYL

SEQ ID NO: 216512 - protein, 91 aa, Glycine max
  Coding DNA Sequence Number=SeqID_99734
MTTTMMLLPQCGWISSDTIRIWRIRNDYQWKLVDFIRILFLVFLGRETKDESEIIIVEGVVGDREGEVVCMQQWWKLPSRRVRREASAYLE

SEQ ID NO: 216513 - protein, 54 aa, Glycine max
  Coding DNA Sequence Number=SeqID_99735
MTNGDDEGEFEPNIGDDNGGAGGEAPHPYPRREGAWLAQGRGRRGVRDEGIFYH

SEQ ID NO: 216514 - protein, 389 aa, Glycine max
  Coding DNA Sequence Number=SeqID_99736
  Gene Ontology: Mol. function=threonine endopeptidase activity; Cellular component=proteasome core complex (sensu Eukaryota); Biological process=ubiquitin-dependent protein catabolic process
  Homolog annotation: Hit_ID=Q8LD27; Match level="QueryCoverage=58%, HitCoverage=100%, E-value=4e-98, Identity=77%"; Hit description =Proteasome subunit beta type 6 precursor
  Pfam annotation: Domain name=AIG2; Domain location=254-368; Score =128.3; E_value=2.2e-35; Accession=PF06094.2; Description=AIG2-like family
  Pfam annotation: Domain name=Proteasome; Domain location=11-193; Score=222.0; E_value=1.3e-63; Accession=PF00227.16; Description =Proteasome A-type and B-type
  Pfam module annotation: Pfam domain module=AIG2::Proteasome; Domain location=254-368::11-193
MDQKVDFSAPHSMGTTIIGVTYNGGVVLGADSRTSTGVYVANRASDKITQLTDNVYVCRSGSAADSQIVSDYVRYFLHQHTIQLGQPATVKVAANLVRLLSYNNKNFLETGLIVGGWDKYEGGQIYGVPLGGTIVQQPFAIGGSGSSYLYGFFDQAWKEGMTKDEAEDLVKKAVSLAIARDGASGGVVRTVIGVTRNFYPGDQLPLWHEEMEPHNSLLDILGAPEPMSMELSDSRGEEGKKDEREVELRGWWRDSQRLRLRFKIKGRVYPAILPVQNNKVNGRVLLGISGVELDILDEFEDVEYTRTDVEVSLKDKSEKLQVCAYVWSNPNDPNLNAEWDFEEWKQVHLNDFVKMTGGFMQELELPESKPRVQTYETFYKQENDKPLEP

SEQ ID NO: 216515 - protein, 170 aa, Glycine max
  Coding DNA Sequence Number=SeqID_99737
  Pfam annotation: Domain name=DnaJ_CXXCXGXG; Domain location=100-154; Score=-33.3; E_value=0.019; Accession=PF00684.9; Description=DnaJ central domain (4 repeats)
MAGVLFWRKNKVRNGNVDKRDNKTKRKRVHSRNRTGEWQPCPLHLHLHFLQSPLSANAMAVLFTSSPSTALPFNNATYSTLSSHLIFTSQNPLSHRFIVGAEAGIVCEPCNGTGWLVCDFCNGQKTNVKAENNKRIYRRCPSCKAVGYVLCSKCKVFKCVTFPNFNDSEN

SEQ ID NO: 216516 - protein, 111 aa, Glycine max
  Coding DNA Sequence Number=SeqID_99738
MEGSTQVVRTDNDTNPILSRFNYEKEARDRHVVLLEEAESACHPAHTINTYLSCAAFLKPEKEKEPTTKSREKERTIPTLISLLNPSCLAFPLFSLVNLLPFPPVAFQIQM

SEQ ID NO: 216517 - protein, 198 aa, Glycine max
  Coding DNA Sequence Number=SeqID_99739
  Gene Ontology: Mol. function=protein serine/threonine kinase activity; Biological process=protein amino acid phosphorylation
  Homolog annotation: Hit_ID=Q49N12; Match level="QueryCoverage=52%, HitCoverage=10%, E-value=8e-34, Identity=67%"; Hit description =Putative receptor-like protein kinase 2
MYDDDSSETGPTRFHKVGTNRALINSGHFFDSDRANYYTWTNTTKLAMDNSKLYMNARVSPNSLTYYGFCLGNGNYIVNLHFAEIMFTDDKTYSSLRRSVFDIYIQTRMAEYSRSKFKMEQIEDAIAKLTSNQLNYATVQNHVTAELDELLQWIFAIENNQHSPNSSSSTNPHSPVSQFQSTRRILSILFSYISRNTR

SEQ ID NO: 216518 - protein, 110 aa, Glycine max
  Coding DNA Sequence Number=SeqID_99740
  Gene Ontology: Mol. function=protein serine/threonine kinase activity; Biological process=protein amino acid phosphorylation
  Homolog annotation: Hit_ID=Q49N12; Match level="QueryCoverage=54%, HitCoverage=7%, E-value=8e-14, Identity=71%"; Hit description =Putative receptor-like protein kinase 2
MQQQITLTKPSRLEKEGLVLFIKGFVLVLLKIVHTNIKATNVLPDKDLNPEISDFGLAKLDDGDKTHLSTRIASTLLLSMQCMSPFLLEYQWQQNGEGGKVIGDATSRRR

SEQ ID NO: 216519 - protein, 656 aa, Glycine max
  Coding DNA Sequence Number=SeqID_99741
  Gene Ontology: Mol. function=protein kinase activity; Cellular component=integral to membrane; Biological process=protein amino acid phosphorylation
  Homolog annotation: Hit_ID=Q1RVJ1; Match level="QueryCoverage=94%, HitCoverage=99%, E-value=0.0, Identity=67%"; Hit description=Protein kinase domain, putative
  Pfam annotation: Domain name=LRRNT_2; Domain location=50-89; Score =33.1; E_value=9.6e-07; Accession=PF08263.3; Description=Leucine rich repeat N-terminal domain
  Pfam annotation: Domain name=LRR_1; Domain location=117-138; Score =7.2; E_value=13; Accession=PF00560.23; Description=Leucine Rich Repeat
  Pfam annotation: Domain name=LRR_1; Domain location=140-163; Score =18.4; E_value=0.025; Accession=PF00560.23; Description=Leucine Rich Repeat
  Pfam annotation: Domain name=LRR_1; Domain location=165-187; Score =10.9; E_value=2.6; Accession=PF00560.23; Description=Leucine Rich Repeat
  Pfam annotation: Domain name=LRR_1; Domain location=189-210; Score =4.5; E_value=41; Accession=PF00560.23; Description=Leucine Rich Repeat
  Pfam annotation: Domain name=LRR_1; Domain location=211-233; Score =10.7; E_value=2.9; Accession=PF00560.23; Description=Leucine Rich Repeat
  Pfam annotation: Domain name=LRR_1; Domain location=92-115; Score =3.2; E_value=71; Accession=PF00560.23; Description=Leucine Rich Repeat
  Pfam annotation: Domain name=Pkinase; Domain location=362-630; Score =42.9; E_value=4e-11; Accession=PF00069.15; Description=Protein kinase domain
  Pfam annotation: Domain name=Pkinase_Tyr; Domain location=361-630; Score=-15.6; E_value=1.6e-11; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::Pkinase::Pkinase_Tyr; Domain location=50 -89::117-138::140-163::165-187::189-210::211-233::92-115::362 -630::361-630
  Subcellular localization annotation: CTP_CleavageSite=17; ConfidenceScore=5.33e-01
MPIISQFSSLSILPNPPTKTRFSFHLQSIMPHKREYFCLFMLFTCFLPSLADNAQVLMNFKSNLSNADALKNWGDPSTGLCSWTGILCFDQKFHGLRLENMGLSGTIDVDTLLELSNLNSFSVINNNFEGPMPAFKKLVSLRALFLSNNKFSGEIPDDAFEGMKRLRKVFLAENGFTGHIPASLVKLPKLYDVDIHGNSFNGNIPEFQQRDFRVFNLSHNHLEGPIPESLSNRDPSSFAGNQGLCGKPLTPCVGSPPSPSDQNPISTLSHQEKKQKKNRILLIVIVVVAVIVLALILALVFIRYRRKKAVLVTDAQPQNVMSPVSSESKSIVMAAESKKSEDGSLSFVRNEREEFDLQDLLRASAEVLGSGSFGSTYKAMLLNGPAVVVKRFKHMNNVGKKEFFEHMRRLGRLSHPNLVPLVAFYYGREEKLLVYDFAENGSLASHLHGRGGCVLDWGSRLRIIKGVARGLGYLYREFPEQDLAHGHLKSSNVVLDHSFEARLAEYGLAAVVDKRHAQQFMVAYKSPEVRQLERPSEKSDVWCLGILILELLTGKFPANYLRHGKGASEDLASWVESIVREGWSGEVLDKEIPGRGSGEGEMLKLLRIGMGCCEWTLETRWDWREAVAKIEDLKETDNGTQGDHSYSSDHLSISLN

SEQ ID NO: 216520 - protein, 92 aa, Glycine max
  Coding DNA Sequence Number=SeqID_99742
MPFHHNIPNTKMITIAPATTISTTTPMDILLPPLSDGSINSARLLCVATYRSAGGQREAHGCVFQRRKMHGVATNIYLRKKLEKTKKWVYES

SEQ ID NO: 216521 - protein, 278 aa, Glycine max
  Coding DNA Sequence Number=SeqID_99743
MAASSRTYVDARRSTVPIPTPGASVSIMKGEPKMRKGLCLARLCHFVTLILLGSQFLAFGNGGTGWQICGSGRICQSIVVAVLLKRAQVAGVAVSFQFDDPLSMHEIHVVIVGNEEEELGRILMLTTKLLIAIKTQSPLLATSNLLKRQSFKRCGGGFGGEGKGTTKSATEDTTVIIEFLFLQLHKGHCLDQSERLKGMNLGVDLQSETGDKIAKQKWCQKFWWDPHTGTEQTRVMTIFVHYTSSIETKLMSSNLRDLCHQNMGPRASLDEDLEKVMP

SEQ ID NO: 216522 - protein, 151 aa, Glycine max
  Coding DNA Sequence Number=SeqID_99744
VCQLKQTLPKLDKNYAVQSEKDTLIDAVSILGEYLKEEPWLQLLCNHLKYQPFRMSYFKDFTSTFLVIITHKRNPSRVGMGFLLNILEVTGKAQANAEGNNNSRLCNELQEQSNDKKGTTAKKGRQAKKVKLETESHNIKDMFSRASRKKS

SEQ ID NO: 216523 - protein, 412 aa, Glycine max
  Coding DNA Sequence Number=SeqID_99745
  Gene Ontology: Mol. function=electron carrier activity; Cellular component=nucleus; Biological process=cell redox homeostasis
  Homolog annotation: Hit_ID=Q8LB68; Match level="QueryCoverage=84%, HitCoverage=91%, E-value=1e-73, Identity=40%"; Hit description=PDI -like protein
  Pfam annotation: Domain name=AhpC-TSA; Domain location=202-322; Score= 11.1; E_value=6.9e-05; Accession=PF00578.11; Description=AhpCTSA family
  Pfam annotation: Domain name=C1_3; Domain location=378-406; Score =29.4; E_value=1.3e-05; Accession=PF07649.3; Description=C1-like domain
  Pfam module annotation: Pfam domain module=AhpC-TSA::C1_3; Domain location=202-322::378-406
MAGLNFEATHTDNRDILKIFAAEGVEFLLSCEGKIQLKINPLRACLGISCKIMFEAKVPVSECNGKIICLFFTANWCRPCRAFVPRLVELYETLRKRRINLEIIFISFDRDEDGFKEHFKNMPWLAVPFDLNLHRRLIDRYQVDRIPSFVPSCSDGITIEEDLIGCIEDYGADAFPFTRKRHEELKGIDIRKREEADLEELLGHEGGKFLISGDDRKVPLSELAGKTIGLYFGAYWSPPCCAFTVQLTDAYNNLKAAKGDCFEIVLISTDRDLEEFNVNKSTMPWLAVPYEDRTRHDLRRIFDVKGIPALVLIGPDGKVISVNGKLMVSSYGAEAFPFTESRIRDLEAALRKEGEALPPQVEDVKHEHVLKLDMAKAYVCDSCKKQGKFWTFSCDVCDYDLHPSCLEKVNKD

SEQ ID NO: 216524 - protein, 64 aa, Glycine max
  Coding DNA Sequence Number=SeqID_99746
  Subcellular localization annotation: CTP_CleavageSite=47; ConfidenceScore=5.24e-01
MKNGRRTTKNVHRIDHRNLNPFPSAPTPIYSKMRGGDCNTARPGELVASSRSSMLTQTSWLLLL

SEQ ID NO: 216525 - protein, 134 aa, Glycine max
  Coding DNA Sequence Number=SeqID_99747
ACRRVGLFGNAAPNRAGSGWGPAMCPGRMWNGESRSADRLGTLTDADCDGGPKPRAVDMLVETSSSRLWMAARALGVPRHLRAPGVGLWAPHSARLETRTKESDMCASQRASKPVRRKEADWWDPPVGCTADRP

SEQ ID NO: 216526 - protein, 44 aa, Glycine max
  Coding DNA Sequence Number=SeqID_99748
KILQTVREWWRQFKSNLISKWALAADKDNVDDTVCKKYDINKEK

SEQ ID NO: 216527 - protein, 92 aa, Glycine max
  Coding DNA Sequence Number=SeqID_99749
MDEKKKKQLEEASQSRSTDTMIDPPSPIKRHVKWKMARTKKTRQMTSKATKEIVGKIIRFVGGAGLTRFLCRPWALGCTDCCHWATRTPWSC

SEQ ID NO: 216528 - protein, 520 aa, Glycine max
  Coding DNA Sequence Number=SeqID_99750
  Gene Ontology: Mol. function=protein serine/threonine kinase activity; Cellular component=ubiquitin ligase complex; Biological process=protein amino acid phosphorylation
  Homolog annotation: Hit_ID=Q1PF03; Match level="QueryCoverage=98%, HitCoverage=66%, E-value=1e-133, Identity=51%"; Hit description =Protein kinase family protein
  Pfam annotation: Domain name=Usp; Domain location=14-169; Score=44.6; E_value=3.3e-10; Accession=PF00582.16; Description=Universal stress protein family
MWLSKHHSEKKDGVNGLVAVAIDKEKGGQNALKWAVDNLLTRSSTVILIHVKLLAPTLSPSPSLFTPRISALLGDDTSLVSKEPEGNNKNVFLPYRVFCTRKDIQCKDVLLEDSDISKALIEYASQAGIEHLVLGSSTKTSLLKRFKVSDIPGAVSKGAPDFCTVYVIAKGKIQTVRSASRPAPAIVPNLLSQASVRTDHSDPNVPLTQSIKEQERHSFDAAAPRRSLDESEPFRSPFTWKGYNGRQYGDTPKPDKDISFVSTGRKSIENLFPSLNSDSGFSNHRLSLGSDIDGSFSLESMHDGRKSTETGTPPEFPSLSFESDQHSSSTSQAVDDMEAEMRRLKLELKQTMELYNTACKEAVTAQQKAVELQKWKLEEERRLEEARLAEETALAIAEKERAKSKAAIEAAEAQKRIAELEAQKRLNAEMKALRESEEKKKLLDALVNVDVRYRRYTIEEIEAATDFFAESLKIGEGGYGPVFKCLLDHTPVAVKVLRPDAQQGRSQFQREVSRETKHYI

SEQ ID NO: 216529 - protein, 173 aa, Glycine max
  Coding DNA Sequence Number=SeqID_99751
  Gene Ontology: Mol. function=nucleic acid binding
  Homolog annotation: Hit_ID=Q6YZW2; Match level="QueryCoverage=93%, HitCoverage=34%, E-value=3e-50, Identity=61%"; Hit description =Putative oligouridylate binding protein
  Pfam annotation: Domain name=RRM_1; Domain location=3-70; Score=22.8; E_value=0.0011; Accession=PF00076.12; Description=RNA recognition motif. (a.k.a. RRM, R
MNCLLHKLLDKVTQAELHCQFHALGAGVIEEVRVQRDKGFGFVRYNTHDEAALAIQMANGRLVRGKNMKCSWGSKPTPPGTASNPLPPPAQPYQILPTAGMNQGYSPAELLAYQRQLALSQAAVSGLSGQTLLQMTGQHGLAPASMGVNSGASQAMYDGYTGNSSRQQLMYYR

SEQ ID NO: 216530 - protein, 71 aa, Glycine max
  Coding DNA Sequence Number=SeqID_99752
  Gene Ontology: Mol. function=nucleic acid binding
  Homolog annotation: Hit_ID=Q2XPV3; Match level="QueryCoverage=76%, HitCoverage=12%, E-value=2e-14, Identity=67%"; Hit description =Oligouridylate binding protein-like protein
MICLNAIDMQDAQSAINDMTGKWLGNRQIRCNWATKGAGGSSNEEKINDSQNAVVLTNGSSEGMGTTEELR

SEQ ID NO: 216531 - protein, 196 aa, Glycine max
  Coding DNA Sequence Number=SeqID_99753
  Gene Ontology: Mol. function=nucleic acid binding; Cellular component= cytoplasm; Biological process=negative regulation of cytokine biosynthetic process
  Homolog annotation: Hit_ID=Q9M427; Match level="QueryCoverage=87%, HitCoverage=34%, E-value=6e-54, Identity=63%"; Hit description =Oligouridylate binding protein
  Pfam annotation: Domain name=RRM_1; Domain location=57-153; Score =31.7; E_value=2.6e-06; Accession=PF00076.12; Description=RNA recognition motif. (a.k.a. RRM, R
MQQRLKLQQQQALMQQALLQQQQMYHPGMLAAAMSQMEPVPSGNVPPGFDTSACRSVYVGNIHVNVTDKLLAEVFQSAGPLAGCKLIRKEKGTLLGIFNQSTKVIGFQGVLNRYASYSEKSSYGFVDYHDRASAALAIMTLHGRQLYGQALKVNWAYANSSREDTSGHFNIFVGDLSPEVTDATLFACFSVYPSCS

SEQ ID NO: 216532 - protein, 168 aa, Glycine max
  Coding DNA Sequence Number=SeqID_99754
MWLKGEKTPVVLSGNHDERAKHACALSLFIATVKILDFHMNALSVPCRAKRVHPSLSLTLMAKRHFAYMTSKIRKTPSTPTQARFDRSRKISPEKSVILHHTKFDEFTEELERRNWHKELTNFVDGSIDVAIVKEFYVNLYDPKDKPPKQVKVRGRLVKFDADTLTHS

SEQ ID NO: 216533 - protein, 179 aa, Glycine max
  Coding DNA Sequence Number=SeqID_99755
MWDFVISVSKFCSDAEHEPVQSQAMIAIFFGFRLSSVHSFNGFIYGRVTRPEIYKNEHKDQVKGQRYTRIVCWTWNSIQHNINSKASLCHSYCLSLAAHAFQVSASGTNRWQCQTQDRMDRTHKKLWGPLKKTLSQKLAYAALSDKYTDWSQPTIVDGFEGILYSYGSSNMRRRLYVWA

SEQ ID NO: 216534 - protein, 693 aa, Glycine max
  Coding DNA Sequence Number=SeqID_99756
  Gene Ontology: Mol. function=transferase activity; Cellular component= membrane; Biological process=protein metabolic process
  Homolog annotation: Hit_ID=Q9SJA2; Match level="QueryCoverage=99%, HitCoverage=100%, E-value=0.0, Identity=73%"; Hit description =Putative glucosyltransferase
  Pfam annotation: Domain name=Glycos_transf_2; Domain location=232 -407; Score=19.3; E_value=3.1e-05; Accession=PF00535.16; Description =Glycosyl transferase
MAPRLYFSNWWTKDTLKGTPVVVKMENPTFSVVEINGADAAFRPVEKSRGKNAKQVTWVLLLRAHRAVGCVTWLATVLWALLGAIKKRLIHGQGVSVESESDKLEKGKLLFRVIRVFLVTSLAVLAFEVVAYLQGWHFGNPTLHIPRTSDLEGLLHLAYVAWLTFRAEYIAPPIQALSKFCVVLFLIQSVDRMLLCLGCFWIKYRKVKPRIEGDPFKSDDVEGSASNYPMVLVQIPMCNEREVYDQSISAVCGIDWPRDRLLIQVLDDSDDESIQWLIKAEVSKWSQKGINIIYRHRLVRTGYKAGNLNSAMSCDYVKDYEFVAIFDADFQPNPDFLKQTVPHFKDNPELGLVQARWSFVNKDENLLTRLQNINLCFHFEVEQQVNGVFLNFFGFNGTAGVWRIKALEESGGWLERTTVEDMDIAVRAHLNGWKFIFLNDVKVPCEVPESYEAYRKQQHRWHSGPMQLFRLSLPAIVRSKVSPWKKANLILLFFLLRKLILPFYSFTLFCIILPLTMFVPEAELPLWVICYVPVFMSLLNILPSPKSFPFIVPYLLFENTMSVTKFNAMVSGLFQLGSSYEWVVTKKAGRSSESDLLAAAEREAKSIEQKIHRGASDSELIESNQLKEHKEAAPAKVKKSNKIYTKELTLAFLLLTASVRSLLSAQGVHFYFLLFQGVTFLLVGLDLIGEQMS

SEQ ID NO: 216535 - protein, 187 aa, Glycine max
  Coding DNA Sequence Number=SeqID_99757
  Gene Ontology: Mol. function=voltage-gated potassium channel activity; Cellular component=integral to membrane; Biological process=potassium ion transport
  Homolog annotation: Hit_ID=Q9SJA4; Match level="QueryCoverage=95%, HitCoverage=24%, E-value=2e-90, Identity=91%"; Hit description =Putative cyclic nucleotide-gated ion channel 14
MQTYLQSITVRLEEWRLKRRDTEEWMSHRQLPQNLRERVRRFVQYKWLATRGVDEETILRGLPTDLRRDIQCHLCLDLVRRVPFFSQMDDQLLDAICERLVSSLSTQGTYIVREGDPVTEMHFIIRGKLESSTTNGGRTGFFNSITLRPGDFCGEELLAWALLPISTLNLPSSTRTVKPLWKWKPLH

SEQ ID NO: 216536 - protein, 316 aa, Glycine max
  Coding DNA Sequence Number=SeqID_99758
  Gene Ontology: Mol. function=voltage-gated potassium channel activity; Cellular component=integral to membrane; Biological process=potassium ion transport
  Homolog annotation: Hit_ID=Q9SJA4; Match level="QueryCoverage=79%, HitCoverage=35%, E-value=5e-94, Identity=68%"; Hit description =Putative cyclic nucleotide-gated ion channel 14
  Pfam annotation: Domain name=Ion_trans; Domain location=4-250; Score=- 13.8; E_value=0.057; Accession=PF00520.21; Description=Ion transport protein
MAIKFRTAYVSPNSRVFARGELAMDPRLIARRYLRSEFFLDLVATLPLPQIVIWFIMPAIRSSHADHTNNALVLIVLLQYVPRLYMIFPLRSQIIKATGVVTKTAWTGAAYNSTIHVLGASWYLLSIERHATCRKSECRNESLPVKCALKYLDCSTLNHDDRTKWVNTTSVFGNCNPENSINFNYGIFGNAVENNVVSSVFKEKYLYCLWWGLQNLSSYGQSLTTSTFVWETAFAILSYSGSCSVCPLNWGDHPGHRLLHKWSLTVDITFKIYGEWVFFTEQLVYSYSMVGCFAHTCHSNNSIKALKLWLDGVHSI

SEQ ID NO: 216537 - protein, 141 aa, Glycine max
  Coding DNA Sequence Number=SeqID_99759
  Gene Ontology: Mol. function=aminoacyl-tRNA ligase activity; Cellular component=mitochondrion; Biological process=tRNA aminoacylation for protein translation
  Homolog annotation: Hit_ID=P93736; Match level="QueryCoverage=90%, HitCoverage=11%, E-value=1e-36, Identity=53%"; Hit description=Valyl- tRNA synthetase
  Pfam annotation: Domain name=Anticodon_1; Domain location=5-141; Score=53.6; E_value=6.4e-13; Accession=PF08264.3; Description =Anticodon-binding domain
MGYHKNEAVKSLESFEFSQAITIVYSWWQYQLRDVFIEVIKACFTGNDPRFAFEICFAQDTLWFCLDNGLRLLHPFMPFVTEELWQCLPSTREYERAESITICDYPSTVEGWNNERVGNDINIIEFIIKSLRSLAKESRDR

SEQ ID NO: 216538 - protein, 57 aa, Glycine max
  Coding DNA Sequence Number=SeqID_99760
MSLEYEGPVTYNMKRELLKVLIDKDCYAKFPERTLPMCRVTFVVKPGSLGKDVVENM

SEQ ID NO: 216539 - protein, 315 aa, Glycine max
  Coding DNA Sequence Number=SeqID_99761
  Gene Ontology: Mol. function=transferase activity; Biological process= metabolic process
  Homolog annotation: Hit_ID=Q9FHP1; Match level="QueryCoverage=74%, HitCoverage=51%, E-value=2e-39, Identity=40%"; Hit description =Uridylyl transferases-like
  Pfam annotation: Domain name=ACT; Domain location=211-284; Score=9.7; E_value=0.23; Accession=PF01842.15; Description=ACT domain
  Pfam annotation: Domain name=ACT; Domain location=72-135; Score=22.3; E_value=0.0018; Accession=PF01842.15; Description=ACT domain
  Pfam module annotation: Pfam domain module=ACT::ACT; Domain location =211-284::72-135
MGKYIRSKPSITTRYYKKNLFHVTDQDGNKLTDVGLVHYIQQALCESRSSNKEISSDIELTSCNEPPRVVNLAIELTTTDKHGMFSEISAVLLGLGFNVTSATAWTHNDRVACIIHLEDANKLGPINAERLAQVQAQLQNVVKARDGKNGEDDRVRLRLRSFGGGRNHTERRLHQMMYADGDYERLRACHGEKGCEGTNVSVGRYEVKGYWVVNVRSRDRPKLFFDTVCVLTDMQYEVFHAAVSSNGSMADQLELENHPTQICTLGAVAMEIKKSRLLLEKKRGKTYEQESKEIKQDDQNKLLSYSLSKMNLYTD

SEQ ID NO: 216540 - protein, 131 aa, Glycine max
  Coding DNA Sequence Number=SeqID_99762
MAGMCVSLSLIVTIEDQSQMKLKTEQSSLKSSDTMSQIKLELENHHAQICTLGAVAIEIKKSRGYCSRRKEEKLMNKKTKKLSKRSKQDFVLFIEQNELIYRLRMRIDPETNTKAVTKFVTVRVQNEFGGK

SEQ ID NO: 216541 - protein, 107 aa, Glycine max
  Coding DNA Sequence Number=SeqID_99763
MIDSCIDEDFKGLDVNQESQYAQLHRQATEDAAFLRNLCMKQDNAVNVPSPSSLMHHQEYAFYRQKYLIMYNPFRGKKEDKKFTREKIKKLFIVNLKKKNAKTTQPN

SEQ ID NO: 216542 - protein, 91 aa, Glycine max
  Coding DNA Sequence Number=SeqID_99764
MQEKALGQEAATPERSPYISPNPPSSMVVQYSPQQLVNPPTLVHEIPADPSTPLLEIPEDPATPVLGLTTTPPDTPLIYFSDEEGTQDQDT

SEQ ID NO: 216543 - protein, 192 aa, Glycine max
  Coding DNA Sequence Number=SeqID_99765
MGDIEEVQEKIKVDMVALKDQMTSMMEAMLIMKRLIESSAATAIATSVAVEVDTTHPSATNQAHQPTPDMAGRGGEVLGSTDNPHMGYNRNAYPYGLPCNYTPPTMHENVDHAVPITFNGQQPQPIGVTHEESRERPQDLCLVPDVVIPPKLKVPDFDRYKGFTCPKNHLKMYCRKMGAYCSTAGKCTRSHK

SEQ ID NO: 216544 - protein, 255 aa, Glycine max
  Coding DNA Sequence Number=SeqID_99766
  Gene Ontology: Mol. function=chitin binding; Cellular component =extracellular region; Biological process=chitin metabolic process
  Homolog annotation: Hit_ID=UPI00006A17C9; Match level="QueryCoverage =100%, HitCoverage=100%, E-value=2e-24, Identity=31%"; Hit description=UPI00006A17C9 related cluster
LDPWVLVPITFRGLHVLALRGLHVLAIRGLHVLAIRGLHALTSRGLPVLALRGLHALTLGLHVLTFRGLHVLALRGLHALTLGLRVLTIRGLHALTSRGLYVLALRGLHALTLGLHVLTIRGLHALTSRGLHVLALRGLHALTLGLHVLTIRGLHALTSRGLHVLALRGLHVLTLGTSYLHLQRTTRPRRQRDYASSPSEDYMFPIFKGGHALTFRGLHVLAIIGLQSLAFERRHVLNFRGLHALAFRGLRVLTF

SEQ ID NO: 216545 - protein, 328 aa, Glycine max
  Coding DNA Sequence Number=SeqID_99767
  Gene Ontology: Mol. function=protein binding; Cellular component =integral to membrane; Biological process=protein amino acid phosphorylation
  Homolog annotation: Hit_ID=Q9C6A7; Match level="QueryCoverage=91%, HitCoverage=61%, E-value=8e-43, Identity=31%"; Hit description =Disease resistance protein, putative; 6346-10057
  Pfam annotation: Domain name=LRR_1; Domain location=117-138; Score =0.3; E_value=2.5e+02; Accession=PF00560.23; Description=Leucine Rich Repeat
  Pfam annotation: Domain name=LRR_1; Domain location=143-166; Score =3.0; E_value=79; Accession=PF00560.23; Description=Leucine Rich Repeat
  Pfam annotation: Domain name=LRR_1; Domain location=17-39; Score =19.0; E_value=0.017; Accession=PF00560.23; Description=Leucine Rich Repeat
  Pfam annotation: Domain name=LRR_1; Domain location=192-215; Score =9.5; E_value=4.8; Accession=PF00560.23; Description=Leucine Rich Repeat
  Pfam annotation: Domain name=LRR_1; Domain location=218-240; Score =19.5; E_value=0.012; Accession=PF00560.23; Description=Leucine Rich Repeat
  Pfam annotation: Domain name=LRR_1; Domain location=242-265; Score =10.7; E_value=2.9; Accession=PF00560.23; Description=Leucine Rich Repeat
  Pfam annotation: Domain name=LRR_1; Domain location=288-311; Score =9.7; E_value=4.4; Accession=PF00560.23; Description=Leucine Rich Repeat
  Pfam annotation: Domain name=LRR_1; Domain location=41-63; Score =11.6; E_value=1.9; Accession=PF00560.23; Description=Leucine Rich Repeat
  Pfam annotation: Domain name=LRR_1; Domain location=65-88; Score=1.1; E_value=1.7e+02; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1; Domain location=117-138::143 -166::17-39::192-215::218-240::242-265::288-311::41-63::65-88
MAPFLPRVIAYWFKLKKLEELDLSENEFEGPLPSSFVNMTSLRKLEISYNHFIGNFDSNLASLTSLEYFGFIGNQFEIPVSFTPFANLSKIKFIYGHGNKFLLDSHHSLQTWIPKFQLQELFVSSTTETKSLPLPNFLLYQNSLTNIDLSDWKLEGEFPLWLLENNTKMTEALFRNCSFTGTFQLPMSPLPNIQAIDVSDNTINGQIPSNNISSVYPNLQYLHLSRNNIQGSIPSELGQMSLLYSLDLSGNQLSGKIPESIFGDGHPLQFLILSNNMFEGPILTIPNGLKTLLLNDNGFIGRLPNSIFHASIISLDVSNNHLVGRFQV

SEQ ID NO: 216546 - protein, 295 aa, Glycine max
  Coding DNA Sequence Number=SeqID_99768
  Gene Ontology: Mol. function=protein binding; Cellular component =integral to membrane; Biological process=protein amino acid phosphorylation
  Homolog annotation: Hit_ID=Q9SKK2; Match level="QueryCoverage=68%, HitCoverage=83%, E-value=6e-39, Identity=39%"; Hit description =Putative disease resistance protein
  Pfam annotation: Domain name=LRR_1; Domain location=108-130; Score =13.3; E_value=0.88; Accession=PF00560.23; Description=Leucine Rich Repeat
  Pfam annotation: Domain name=LRR_1; Domain location=132-153; Score =5.1; E_value=32; Accession=PF00560.23; Description=Leucine Rich Repeat
  Pfam annotation: Domain name=LRR_1; Domain location=60-82; Score=9.4; E_value=5; Accession=PF00560.23; Description=Leucine Rich Repeat
  Pfam annotation: Domain name=LRR_1; Domain location=84-106; Score =17.5; E_value=0.05; Accession=PF00560.23; Description=Leucine Rich Repeat
  Pfam module annotation: Pfam domain module=LRR_1::LRR_1::LRR_1::LRR _1; Domain location=108-130::132-153::60-82::84-106
MPFEVEDSPRLWRYLHGWPMGRYLVRNKYSRFQLLPYVQEKANFTSKKRTYTYMGSILAYMSGIDLSHNKLKGNIPSELGNLTKIHTLNLSHNDLTGKIPATFSHLVQTESLDLSFNMLNGQIPPQLTTLTSLAVFSVAHNNLSGPTPEFKGQFSTFDESSYEGNPFLCGLPLPKSCNPPPTVIPNDSDTDGHYDTLVDMYFFFVSFVVSYTSALLVTAAALYINPYWRRAWFYYMELASMNCYYFIMDNCSKLAPLLKVLAFRDIDPQAPTHILIIPKVRDAWLTGLSKAYYAV

SEQ ID NO: 216547 - protein, 597 aa, Glycine max
  Coding DNA Sequence Number=SeqID_99769
  Homolog annotation: Hit_ID=Q6AC53; Match level="QueryCoverage=49%, HitCoverage=71%, E-value=3e-29, Identity=28%"; Hit description=Phage- related portal protein
  Pfam annotation: Domain name=Phage_portal; Domain location=280-595; Score=9.5; E_value=1.5e-07; Accession=PF04860.3; Description=Phage portal protein
LEDPRIQARLRQHRGPRIRRKVIFDEEAWEAAETHDFIIGLRALTVDVTNDRSWTSLAWAGINRAGDMQAELIKHERGTHWIAAEAGAIFDRNPKMARRVYCVPGGQAVTLESALERAGIDLVVLGRADYAGAAGQYYAGSGDPEELASDDPAPRIYHTAQKGQSPLHVAIAGAVWTKDKAPVWDTLRSSSSASPSATSCRPSPRRFREAQGHRDDSARAHRPGAHRRRHRHRIRHRPRADHRRHPARRPVVRADHSRRPPVSIMFREQREAKFSDLPSRVGWRRNVTSKRGALGHSAAWACIRLRGDLISTLPIDTYRKVPWGQVEVPKPPVLVEPGGTKVDITEWMYSTQTDLDTLGNTFGSITEVDGAGLPRRIDLVARDEVSVTSLKGKVTYRFNGKVQDEDTVWHERQYTSSGMILGLSPLAHAALDMQSHAAAQEFAAAWFGGGLVPLAHLKYDAAAVPAREAEAIKLRHKLAIENGDALVTGKDWEYKPIDVASAQANFIAAMQFSDTQLCRFFGVPGDLIDANTAGSSVTYANITQRNLQLLVMNLGPAIKRREVALSRALAQPRFVKLNTDALLRMDPETVSRMLGQQ

SEQ ID NO: 216548 - protein, 457 aa, Glycine max
  Coding DNA Sequence Number=SeqID_99770
  Gene Ontology: Mol. function=pyridoxal phosphate binding; Biological process=metabolic process
  Homolog annotation: Hit_ID=Q7VXD6; Match level="QueryCoverage=79%, HitCoverage=90%, E-value=1e-131, Identity=67%"; Hit description =Probable class-V aminotransferase
  Pfam annotation: Domain name=Aminotran_1_2; Domain location=80-449; Score=-73.3; E_value=0.0011; Accession=PF00155.11; Description =Aminotransferase class I and II
  Pfam annotation: Domain name=Aminotran_5; Domain location=80-445; Score=105.1; E_value=2e-28; Accession=PF00266.9; Description =Aminotransferase class-V
  Pfam annotation: Domain name=Beta_elim_lyase; Domain location=110 -369; Score=-111.3; E_value=0.0032; Accession=PF01212.11; Description= Beta-eliminating lyase
  Pfam annotation: Domain name=SHMT; Domain location=87-437; Score= -241.9; E_value=0.012; Accession=PF00464.10; Description=Serine hydroxymethyltransferase
  Pfam annotation: Domain name=SLA_LP_auto_ag; Domain location=108-453; Score=-203.3; E_value=0.072; Accession=PF05889.4; Description=Soluble liver antigenliver pancreas antigen (SLALP autoantigen)
  Pfam module annotation: Pfam domain module=Aminotran_1_2::Aminotran _5::Beta_elim_lyase::SHMT::SLA_LP_auto_ag; Domain location=80-449::80- 445::110-369::87-437::108-453
  Subcellular localization annotation: CTP_CleavageSite=70; ConfidenceScore=5.29e-01
MVESVRRCRPPRAQRGGRGLAAAGRGGRGGSRRRTDARLMPRRRTQARRVFPGTLMPAAVLTATTLEALRAATPGTRTTVHFNHAGASLPSAATLDAIQAHLRREAEHGPMEAVVAARAHTEQARQLAAQLLNAQPGEIALTGGNSPGWGAAFAALGPWRPGDRILVGRHEWGGNLAAMRLAAQRAGASIETIPSDDSGCVDADALRAMLDERVRLVALTWLPANGGLINPAAAIGRVTRAAGVPYFIDAAQAVGQVPIDVAEVGCDVLSGAGRKALRGPRGTGLLYVRREFLPRLAPAFVDTHSAPLGADGEPQLRDDATRFESAEASMALRAGLANALQEALDIGLEAIRARIDLVAQALRAELRAIAGIEVLDQGRELSGLVSFNLAGHDPAAVQRTLAAQGITIGSNGVPYTPLDMNARGLAHIARASVSYLTRDEEIDRLLDALRALSRQGA

SEQ ID NO: 216549 - protein, 198 aa, Glycine max
  Coding DNA Sequence Number=SeqID_99771
  Subcellular localization annotation: CTP_CleavageSite=33; ConfidenceScore=5.33e-01
MKVGALISGQITSMAQSNSSRLGFPALIISLCRSRGVTSDSLVFESLSLVINLAYMRKNCWNPDDPTIIIRGARRPRARPAETSSTSATPHLAFTSAALPPARIVAAPSTPSPADFQCFEAYIRGRLFCCKVSSWDDEDPTAQVPHQPVDESSKSSTLEPLIRKRRVVVTQEAATTPEKSPEATPKPLAPMADTTSPQ

SEQ ID NO: 216550 - protein, 163 aa, Glycine max
  Coding DNA Sequence Number=SeqID_99772
MRAKAKVMSEIEEVQEQMKANMEAMKEQMATMMEAMMSMKKIMEVNMATVITASTATEVDPTHPSGLNQINHTTIDMVGQGGKALRSEDGPHFVQVQNKHSFPPYGLPPNYTPPNVAYIPDENVDNSASIPIETQQPQFDHAHVSQPMGEIHEVPHLRYATEG

SEQ ID NO: 216551 - protein, 74 aa, Glycine max
  Coding DNA Sequence Number=SeqID_99773
  Subcellular localization annotation: CTP_CleavageSite=34; ConfidenceScore=5.41e-01
MDGSIWLSSIHPSRFSHFRFRASAKCGNLLVGLRSSSSMDSIASWKMNGSGMEKEEREEMPLQGEDESRRSSPP

SEQ ID NO: 216552 - protein, 65 aa, Glycine max
  Coding DNA Sequence Number=SeqID_99774
  Gene Ontology: Mol. function=nucleic acid binding
  Homolog annotation: Hit_ID=Q1T4Y5; Match level="QueryCoverage=98%, HitCoverage=22%, E-value=2e-20, Identity=69%"; Hit description=Zinc finger, CCHC-type
FQIFVKGKELWGHVDGTDYAPDKTMHKEAHAKWEVKDAQVMTWIISSVEPNIVLNLRPFTTAAKM

SEQ ID NO: 216553 - protein, 120 aa, Glycine max
  Coding DNA Sequence Number=SeqID_99775
  Gene Ontology: Mol. function=protein binding; Cellular component =membrane; Biological process=defense response
  Homolog annotation: Hit_ID=Q1T3J8; Match level="QueryCoverage=63%, HitCoverage=19%, E-value=1e-10, Identity=39%"; Hit description =Leucine-rich repeat, typical subtype
  Pfam annotation: Domain name=LRR_1; Domain location=34-56; Score=3.2; E_value=72; Accession=PF00560.23; Description=Leucine Rich Repeat
  Pfam annotation: Domain name=LRR_1; Domain location=58-79; Score=6.4; E_value=18; Accession=PF00560.23; Description=Leucine Rich Repeat
  Pfam annotation: Domain name=LRR_1; Domain location=81-103; Score =12.5; E_value=1.3; Accession=PF00560.23; Description=Leucine Rich Repeat
  Pfam module annotation: Pfam domain module=LRR_1::LRR_1::LRR_1; Domain location=34-56::58-79::81-103
MESIDEEDLRPTSSNGAYIKIFLPQAKRKEALINLERVDLQGYIQLKKIHPSIGLLRKVIDLNLGDCKSLTKLPHFAEALNLKWLNLEGCILLSQIDPSIGLLRKLTVTNVESFRMFSTV

SEQ ID NO: 216554 - protein, 111 aa, Glycine max
  Coding DNA Sequence Number=SeqID_99776
MKTVIYKPVFELRKHYFNDIALVNTVVLSTFLSHRHSFVTPTYGGHHDSGHSFCGGAPLAYCDSGNTNVESAGYYVVPDVTTDVENTFSKSDVIPVFERHPSTSVVWLAPM

SEQ ID NO: 216555 - protein, 114 aa, Glycine max
  Coding DNA Sequence Number=SeqID_99777
MNEVNFVGGGNNSYNQYPSNFNQEQGFRHNRGIQLGNLPSQPKPNPKREDVNVVITRSKRIQEDSKEKEGYFPKVADDVLTEKDKAPKKLEVLIDGNLVPKKKGDEKKEILTSP

SEQ ID NO: 216556 - protein, 118 aa, Glycine max
  Coding DNA Sequence Number=SeqID_99778
  Gene Ontology: Mol. function=protein serine/threonine kinase activity; Cellular component=cytoplasm; Biological process=protein amino acid phosphorylation
  Homolog annotation: Hit_ID=Q7XI53; Match level="QueryCoverage=98%, HitCoverage=22%, E-value=2e-32, Identity=58%"; Hit description =Putative ankyrin-kinase
MAPEVLKHRRYDKKVDVFSFAMILYEMLEGEPPFSNYEPYDGAKYVAEGHRPSFRGKGYIPELRDRMDFDLALHVLRLTEQCWDADMKQRPSFIEIIKHLEKIKENLPSDHHWHLFTS

SEQ ID NO: 216557 - protein, 132 aa, Glycine max
  Coding DNA Sequence Number=SeqID_99779
  Gene Ontology: Mol. function=RNA-directed DNA polymerase activity; Biological process=RNA-dependent DNA replication
MCGKTRQDKIRNKAIRERVGVAPIVEKMVENRLRWFGHVERRPVDSVVRRVDQMERRQTIRGRGRPKKTIRGVIKKDLEINGLDRSMSKSFCPKEVGGSTRTKYHHQKQFSFEMVTHSQGIAVVIGATMRQF

SEQ ID NO: 216558 - protein, 302 aa, Glycine max
  Coding DNA Sequence Number=SeqID_99780
  Homolog annotation: Hit_ID=Q1RVN3; Match level="QueryCoverage=43%, HitCoverage=21%, E-value=1e-07, Identity=27%"; Hit description =Nucleotide-binding, alpha-beta plait
  Pfam annotation: Domain name=RRM_1; Domain location=80-150; Score =16.5; E_value=0.0043; Accession=PF00076.12; Description=RNA recognition motif. (a.k.a. RRM, R
MSLIKLNHFPHRSLNITIERARAIEKGGREWTTVTRGRGRHREEVRTRVDPRQSYVDTRFGQHQRYHHANSRERDDITTFYFTRFPEHTTEKDLWAQFKKWGDVREVFISKHRNKGGRRYGFVRFKGVSDEHILERLLDNIIVGELKMYVNVPKYGRGKARSEEHKVKPRTQADGDNKEVEAPRQMATHCKATSMSYVKVVATAKTNVGQQSHPQPRTFKPDGSYSSIQLEIPAGERKWYTDIWVGRLKKSGIFERVEDELPWEIGTNVVPKYIGDDMILLLGLSDTKAEELIIKEIRHGTS

SEQ ID NO: 216559 - protein, 103 aa, Glycine max
  Coding DNA Sequence Number=SeqID_99781
  Gene Ontology: Mol. function=RNA-directed DNA polymerase activity; Biological process=RNA-dependent DNA replication
  Homolog annotation: Hit_ID=Q1T251; Match level="QueryCoverage=75%, HitCoverage=27%, E-value=3e-11, Identity=40%"; Hit description =Multicopper oxidase, copper-binding site
MADGFLGEIARTTIHPHRADNWVWKSYPSGHYSTKSTYDLLCGESLGENQDVVFKELWKLIIPAKSSVFAWRLIRDRLPTKLNLKRKQVVQNPTFMVGVIVLD

SEQ ID NO: 216560 - protein, 143 aa, Glycine max
  Coding DNA Sequence Number=SeqID_99782
  Gene Ontology: Mol. function=receptor activity; Cellular component =integral to membrane; Biological process=intracellular protein transport
  Homolog annotation: Hit_ID=Q307Y3; Match level="QueryCoverage=79%, HitCoverage=51%, E-value=2e-41, Identity=74%"; Hit description =Vesicle transport v-SNARE 11-like
  Pfam annotation: Domain name=V-SNARE; Domain location=42-130; Score= -19.1; E_value=0.043; Accession=PF05008.5; Description=Vesicle transport v-SNARE protein
MSEVFEGYERQYCELSANLSRKCSSASLVSDQEQKPQKLSEIKAGLDDADVLIRKMDLEARSLQPSVKAMLLAKLREYKSDLTNLKKEFKRLTSPNADEAAREELLETGMTDTHLFGTLLVRVLESSKYEICFLLFGSPMNIS

SEQ ID NO: 216561 - protein, 134 aa, Glycine max
  Coding DNA Sequence Number=SeqID_99783
AINSWGSGLDGGGCMNNARQSIHGAPDLMMEDARTTLGNQFRLTVNSWGSGLDGGGCMNNARQSIHGAPDSMAINLWGSGLDGGGCMNSTRQSIHGAPDSMAMSSWGSGLDGGGCTNNARQSIRGAPDSMVEDA

SEQ ID NO: 216562 - protein, 187 aa, Glycine max
  Coding DNA Sequence Number=SeqID_99784
VELEKRNFHKRLTNLADSSIDLALVKEFYPNLYSPEGPSPKQVRIWGHLIRIDADSLNAFLETPVVLAEGESLPAYSRYCRMPTDIREIEAALCILGRGFILNAEGHHGKILRKYLTTLAQVWSVLSYSNLASTFHTSVLAVDRARLIFGLMTQLDMNVEALISGQITSMAQSNSSGLGFPALITAL

SEQ ID NO: 216563 - protein, 76 aa, Glycine max
  Coding DNA Sequence Number=SeqID_99785
MGLISQNQLGPLGINGNSNRDAEILTSMCYFRKIFMFYVQGEVIIIHLSYPNFVRGPLLDDVRPFFGPREVLGTHH
